United States Patent 12,102,091 (CONTROL OF PLANT PESTS USING RNA MOLECULES) - sequence listing, part 2

SEQ ID NO: 1649 - DNA, 831 bp, Piezodorus guildinii
atggatttccaaaatcgacctggaggtaaaacaggaagtggtggcgtagcatcatggtcagagacaaatcgggaccgaagagagaggctgaggcaactagctcttgagactatcgatataaacaaggatccgtattttatgaaaaatcatttaggttcttatgaatgtaagctatgtctcaccctgcataataatgagggaagttatttagcccacactcaaggaaagaaacatcaagcaaacttagcgagaagagcagcgaaagaagctaaagattctccacaacaaccagcaccagataaaccaagaatagaaccaaaaaagtttgtaaaaattggtagacctggttatcgagttactaaacaaagagatcctgaaacaggccagcaaagtcttctttatcaagtagattatccagaaattgcagaaggaatcttacctaggcatcgttttatgtcagcttatgaacaaagagtggaacctccagacaggaaatggcaatatcttctgtttgctgctgaaccttatgaaacgatagcctttaaggtgcctagccgtgaagtagacaagtctgaaaacaagttttggactcattggaacaaggacacaaaacaatttttcctccagtttgcatttaagaatgaaccacttgctcctcctatgggtgcaccccacttaggtcaaatgagacctccgcacatgttaccaccacctatgagtgtgcctccaccaccaatgttcaatcctgttccacctccccctcctaatctaatgcttgcacctccacctccacctgcaccgctcccacctcctcctcaacctatgaaataa

SEQ ID NO: 1650 - DNA, 495 bp, Piezodorus guildinii
gaggataatatgaactgctggggcattagtcgttcatgcggcgttagtcctgtttgtaacctcttgttgttttcgagttgtgttttcatcatgtccatcggtgttcctatcaaagttttgcacgaggccgaagggcacatcgtcacctgcgagaccaagactggagaagtctacaggggaaagctcatagaagcggaggataatatgaactgccagatgaccggtttgactgttacctaccgcgatggacgagtagctcaattggaaaacgtcttcatcagagggtccaaaatacgctttctgatattaccggacatgttgaaaaacgcgcctatgttcaaaaaacaagggaataaaggcaatacgggcgctggtagaggtaaatcggcgatactgagagctcaagcagccaggggcagaggttcacagacgagaggaggtgctacctcatcaagaccttcgtggcaaggagggtctaatcagtcgaggaaatag

SEQ ID NO: 1651 - DNA, 1464 bp, Piezodorus guildinii
tggccaccaggtcaccgctcagggcccccccccgggcccccccccacggcgggccctttttttttttttttttttttttctctctttctgatatcccaattctcactgatattctgcagcctgaagtttaagttttatcaaatggcttcaagtgtttcaaaagtcccccttctgcagacattagcgaagagaacattcgcagctgctgcggctcctaaagctgctggatgtaaagctactgttgaagtttctactcttccgaataaggctattgtcacttctttggggtgtggacctaaaccctttgtacaagtagctgtagcattcagagctggaagtcgtaatgaatgttctgaaaactatggagcaagtcaccttctgaggagctctgctggtcttagcacttgtggtgcatcttcattctacatttgtcgcagtttgcaacaaattggtgctagcctaactgccacttctgaccgtgaaacgattgtttatgtcctggaatcttctgctagcaagataaatgaaggccttgatattttgaagaaggctattactggtcaagagttcaggccctgggaactttccgacaatgtttctcgaatcaaagtagaattggcatcactacctccacaagctaaagtgatcgatttgattcatacagctgcatttaggagtggactcggaaattctatttttgttaaagaattcaacataaaaaaacttagcagtgaaacgcttaaacattatgctgctacctatttaactggagacaaagcagttattggtggttgtggattacctcattccagattgagtcattttgctgattccttgggactttgtgctggaagtgtcggtgcaatcccagcatctaagtatagaggtggcgaaatcagggttgaggaaaacattccgctccatcataccatcattgctgctgaagcaccaagcttagataaaagcgaggccttggcctacgctgttctgagatacgcccttggaactggcccttcagtctaccgcggaacaggatccgggccacttgccaaagtctctggccaccaggtcaccgctcaggccctctccatggctcactcagatgctggtctctttggcatttatgtttcttctccaggttattgcgccaaggaggttgttgaaggagcagtgaaagtgctgaagggtggagtcactgatcaagatgttgcacggggtaaagcacagttaaaagcagctttattatattccagcgaatcttgccgtggattagtggatgatcttgttgggcaggctttgcttatccaaggggctcctcccaagactaccgctgacctggccgaagaggtttcttctgttactactcagcaggtccagcaggcattacaaaaggtccaatctggaaagaaatcaattgcttctgtcggtagtgttggcaaagtaccatatttagatgaattgtaa

SEQ ID NO: 1652 - DNA, 339 bp, Piezodorus guildinii
atgaggcgggctcatggcaactattaccaacctgttcctacgttcgacgggcctagcggttccctcgaagaggaaaatgatcagatgaccaacaaactgaaagataaaataactgctttgaagcacctgtcgatcgacatcggtgcggaagtgaagtatcaggataagatgcttcatggcatgtcggaagactttgatcgtaccggaggctttttaggaaataccatgaatagagttttacgtctgaccaaaggaagtcacaattattatattttgtacctttttatattttctatcgttgttttttttgtactgtacatagtattaaaatttagataa

SEQ ID NO: 1653 - DNA, 1491 bp, Piezodorus guildinii
atggctatatcttcgagtcaagctgttaaggaacatgttttggctgtttcaagagattttgtctctcagccaagattgacatacaaaactgtgtctggagtaaatggacccttagtaattttagatgaagttaaatttccaaaatataatgaaattgttcagctgagacttgctgatggaacattacggtctggccaggttttggaagtcagtggttccaaagctgttgttcaggtttttgaaggtacttctggtattgatgcaaaaaacacaatatgtgagttcactggagatattcttcggactccagtgtccgaagatatgcttggacgagtcttcaatgggagtggaaaacccattgacaagggacctccaattctagctgaagattatttggatattcaaggccaacctattaatccttggtctcgtatctaccctgaggaaatgatacagactggtatctctgcaatagatgttatgaactcaattgctagaggacaaaaaattcccatcttttcagctgctggtttgcctcacaatgaaattgcagctcagatttgtcgacaagctggtttagtaaaattgcctggtaaatctgttcttgatgatcaagaagataattttgccatagtgtttgcagctatgggagttaacatggaaactgcccgatttttcaagcaagattttgaggaaaatggctccatggagaatgtttgtttgtttttgaacttggctaatgaccctactattgaacgtattatcacacctcgtctcgctctgactgctgctgaatttcttgcttatcaatgtgagaaacacgttttggttatattaacggatatgtcttcttatgcagaggcccttcgagaggtatcggctgccagggaagaggtacctggtagaagaggtttcccaggttacatgtacactgatctggccaccatttatgagagggctgggcgtgttgaaggcagaaatggaagtattactcaaattccaattcttactatgcccaacgatgatatcactcaccctattcctgatttgacgggttatattactgagggccaaatctacgttgaccgtcaattgcacaacagacagatttacccgccaattaatgtactaccatcactgtcccgtttgatgaaatcggccattggcgagggaatgacccgaaaggaccattcagatgtctcaaatcaattgtatgcctgctatgctattggtaaagatgtgcaagccatgaaagctgttgtgggagaagaagctctaactcctgatgatcttctctatttagagttcttgacaaaattcgaaaagaacttcatttcacaaggtacttatgaaaacagaacagtttttgaatcattagatattggctggcaactgctgcgtatattccccaaggaaatgttaaagaggattccagcatctacattggcagagttctatcccagggactcaaggcatacaaccaccaaatag

SEQ ID NO: 1654 - DNA, 2229 bp, Piezodorus guildinii
atgatgcaacaagctcaaagtaggccaatgtcccatggaaactatcagggtgggccagatttgcccatgggctctgtcaaagaccagaccctcatgtggcaacagagctcatatttgggtgattcagggattcattcaggtgcaaccaccacagctccttcactgtcaggcaaagaagaagagatgtatggcgatcaagacatgtttgacctggatcaaggatttactcagggttttacccaagagcaagtcgatgaaatgaatcaacaactctctcagacaaggtcccagagagttcgagctgcaatgtttcctgagacattagaagaaggtatagaaattccatctacacagtttgaccaggctcaagccacggcagttcaaagactagctgaaccaagccaaatgctaaaacatgctgttgttaatctcatcaattatcaggacgatgctgacctagccacccgtgctattcctgaattgattaagctgctcaatgatgaggatcaagtagtggtttcacaggctgctatgatggtacaccagctgtcgaaaaaggaagcctctcgccatgccatcatgaatagtcctcaaatggttgaagctttggtgagagcattatcaaacagtaacgacttggaaactaccaaaggagctgtaggaacattacacaatttgtctcatcacaggcaaggtctcttggctattttcaaaagtggtggaattccagctctggtgaagcttttgagttccccagtagaatcggttcttttctatgcaattaccactttgcacaacctccttcttcatcaagaaggaagtaagacggctgtgcgagttgctggaggattgcaaaagatggttgttttgctccaacgaaataatgtgaagttcttagccattgtgaccgactgtctccaaattctagcttatggcaatcaggaaagtaagctaattattttggcatctcagggtcctattgagctagtgcggatcatgaggagttatgattatgaaaagctcctttggacaacatcaagagtacttaaagttttgtctgtctgctcgagcaataaaccagcaatagttgaagccggaggtttacctgctctggcaatgcacctggggcatccatcacagcgacttgttcagaactgcctttggaccctcagaaatctttcagatgctgggaccaaagttggtggcttagaagggcttctccaatcgcttgtgcaacttttggattcttctgatattaatatcgttacttgtgcagctggtatcctatcaaatttgacttgcaataaccaaaggaacaaggtgactgtgtgccaggttggtggtgtcgatgctctagtccgcactattatatcagctggagatagagaagaaattactgaacctgctgtttgcgctttgaggcatctgacttctcgccatatggagagtgagctagcccagaatgctgtccgcctcaactatggcttgcaagtgattgtcaagttgttacaccccccatcaagatggcctctagtcaaagctgttattggtttgattagaaaccttgctttgtgtcaggctaaccacacaccacttagggaccatggtgcgatacaccacttgatcaggctcctaatgcaagcattccaggatacacagaggagatccagtgttacgagtggaggaacacaatcaggtggaatttatgctgacggtgtgcgcatggaggagatagtggaaggcactgtgggtgctcttcatatcttggcaagggagagccacaacagagctatcatcaggggtcagatggttataccgattttcgtacagcttctttttgatgagatagagaatattcaacgggttgctgctggtgtgctttgtgagcttgcgcaagacaaggaaggtgccgagcttatagaacaagaaggtgctacagctcctcttacagaattactccactctcgaaatgaaggtgttgctacttatgctgctgcagtcctcttcaggatgtccgaagataaacctcaggattacaaaaagagactttcgatggagcttactaactccctctttagggaggatcagaatttgtggaatggtgatttaggaatggctcctgacttacaggatatgctgggagagcaaaattatgacaccatgtactctcatgggccgcctagtgtacatagtagtcacggtggtaggggatatcagccagggctctga

SEQ ID NO: 1655 - DNA, 735 bp, Piezodorus guildinii
atggcccgaaatgctgagaaggctatgactactttagctcgatggcgagctgctcagttaggagaaggcgatcaagccaaacaaagaagaccctacttagcatctgaatgtactgatcttcaacaagctgagaaatggagaatgcaaatcattagagaaatagctcgtaaagtttctcaaattcagaatgctggtcttggtgaatttagaattcgtgatttgaatgatgaaatcaataaactactgcgagaaaaaggacattgggaagctcaaattcgagaacttggtggcccagaccactccaggtctgggccaaaaatgctggatgctgaagggaaagaagtgccaggcaataggggttacaaatactttggtgcagcaagacaacttcctggagtcagagagttgttcgagcaggctccacctccacctccacataaaacgcgtggcgagctaatgagagatattgatgcttcttattatggttatatggatgatgaagacggaatcattataccacttgaagaaattgaggaaaccaaagctattaaaaaagctgtagcagaatggactgttaagaaagaaaagtcaatggaaatggatgaagatgagaaagaagaagtcgaagaggataacatctacaaagctgcaggaaacaaagagggtgatgaagatgatgatgatgatgatgaagaggcaggagaagaagatgggtttgaactgagtgctaagtta

SEQ ID NO: 1656 - DNA, 645 bp, Piezodorus guildinii
atggaagaggctgatgttccatcatttaaatgtgtacttgttggtgatggtggtactggcaagacaacatttgtcaaacgccatttaactggtgaatttgaaaagaagtatgttgctacattaggggttgaagtgcatcctttagttttccacacaaaccgaggccctatccgttttaatgtttgggacacagcagggcaggaaaagtttggtggacttagggatggatactacattcagggtcaatgtgctattattatgtttgatgttacttcaagggtaacttacaagagtgtccctaactggcatcgagatttagtgcgtgtgtgtgaaaacattcccattgtactttgtggaaataaagtagacattaaggatagaaaagtgaaagccaaaagcattgttttccacaggaagaagaaccttcaatactatgacatcagtgctaagagtaactacaacttcgaaaagcctttcctgtggctggctaggaaactcatcggtgatccaaatcttgaatttgttgctatgcctgcattgttgccccctgaagtcaacatggatcctgaatggcgtgaccagattgaaaaggatcttcaggaggcacaagacacagcacttcctgaagatgatgaggacctgtaa

SEQ ID NO: 1657 - DNA, 531 bp, Piezodorus guildinii
tttttttttttttttttttttttttttggtgaggtgaaaaaaactattaacatggatatccaaaccattgcaacgatatttattaaagttttaaaacttgtaatcaattttatcattttgatgctctaccgctatggtggaaaacaaggatttctcggagttggtggaacatggaacttgtatgaagttaaaagtgctgatgctgaaattattgcatctggagtttttgtgggattttttatatatacatctgtaatccttatttcatactgctttggaacaaccaaacacaaatatagtgcagtagatattataatgaacgtgagcggaaccatattgttcacagcagttggagggatagctttacactattgggttggcttccaggatgaaaatcattacgtgggaatctctcaagaaaagcaaataggacttgcgttgggcagtcttagcgtagtttgcgcagctatttaccttcttgatacagttttatcttgtatacatatcgcgcataagcacgcgatcgcttaa

SEQ ID NO: 1658 - DNA, 2337 bp, Piezodorus guildinii
atgccgcgaattatgataaaaggtggtgtctggagaaacactgaggatgaaattcttaaagctgctgttatgaaatatggaaaaaaccaatggtctcgaatagcttctttattacacagaaagtctgcgaaacaatgcaaagctaggtggtttgaatggcttgatccaagcattaagaaaacagagtggagtagagaagaagatgagaaattgttgcatcttgcaaagttaatgcctactcaatggcgaaccattgcaccaattataggacgaactgcagcacaatgcttagaaagatacgaatatttactagatcaagcccaaaaaaaagaagaaggagaagatggagctgacgatcctagaaagttaaaacccggagagatagatcccaatccagaaaccaaacctgctcgtccagatcctaaggatatggatgaagatgaattggaaatgttgtctgaggcaagagctagattagccaacacccaaggtaaaaaagcaaagaggaaagcgagagagaaacaattggaagaagcaagacgattagctgctttgcagaaaaggcgagaattgagagctgctggaattgaatatgcagcacgtcataaacgtaaaagaggcattgattataatgctgaagttccatttgagaagaaacctgctgccggtttttacgatactagtaatgaagctatcgatcctcatgcacctaattttaataggcttcgtcagcaaaatttagatggtgagcttcgcagtgaaaaagaagaacgagaacggagaaaagacaaacaaaaaataaagcagaggaaagaaaatgacatgcctctagcgatgctgcaaaatcaagagccagccaagaaaagaagtaaacttgtcttgcctcagcctcagatatctgatcaggaactgcaacaagtagtgaaattgggaagagctagttacgctgctcgggaagcagtgacagaaggctctgaaagtgcttcagacactctcctcaatgattatgctttagctacacccaatgctggctccactcctcgtacgcctgcacctactactgacaggatacttcaagaagcccaaaatatgatggcattgagccacgtagatactccgctaaaaggaggtttgaatacacctctttacaactcagagtttagtgttcatccaccagcagagcagatcacaacaccaaacactgttctaactactccgttttccaatcgaactcatgaaggaaggactccaggctttcaaaccccgcaggacgtgaggaacagcctgaccactcctgtcagagataagttaaacatcaacccagaggaaggtggtgatacaccctatgcacctgtaaataatcaaaaacaggcgaaggaggaacttgctgctcgcctcaggtcactaccccagccgaagaacgattatgaaattgtggttcccgaagatgaagtttcatcggaaacgactgcagagggtgctggtttgccaagtgttgaagatcaagctgatattgatgctagaaatttgagtattctcgctcaacaacgtgaaaaagaattgaagagtagatcgcaggtaattcagcgagctttgccccgacctggagatatcaacatagtattacgtccagctaatacagatccacctttaacagaacttcagaaggctgaagagatgataaaagaagaaatgataacgatgctacattacgatgcggtgcatagcggtgaacctccttcctcgaggaaaataggaaccgtgagtcaggcgcagcacctagcctatctcgagcaacacccttaccacacctattcagaagatcagatcgaaaaggcaaaagaaatgctgaaagcagaaatggaggttgtcaaacaaggaatgaatcatggtgatctgtcgctggaaacctttacacaagtttgggaagaatgtttagctcaggtattatatttgccaaatcaaaatagatacaccagagcaaatttagctagtaaaaaagaccgtctggaatcagtggaaaaaaggctagaacaaaataggacacacatgactcgggaggccaaaagagcagccaaaatggaacgaaaaattaaaattatcaccggtggatatcagactagagctcaagcgctgattaagcaacttcaggatttagctgacgaaaccgacaaggctcacatggagctgtcgacgttcaagctgcttcagcagcaagaagaaagtgctatccctaaaagaatagagtcaatatcagaagacgtcaacaggcagcttgaaagagaaaagagcttacagaaaaggtttagccaacttcagctggtatcgcaatcgtag

SEQ ID NO: 1659 - DNA, 474 bp, Piezodorus guildinii
atgatgcaatttatgcttttatttagtcgtcaaggaaaattgcgattacaaaagtggtatgttgcacatcctgataaactgaagaaaaaaattacaagagagttaattacaaccattttggctaggaaacctaaaatgtgtagctttttggaatggaaagatttaaaaatagtgtataaaaggtatgctagtttatatttttgttgtgctatagagcaaaacgataatgaactgcttacattagaagtgattcatcgttatgttgaacttcttgacaaatacttcggaagtgtttgtgagttggatattatattcaactttgagaaagcatacttcattctagatgaactgttactcggaggagagattcaggaaacaagcaaaaagaacgtcctgaaagctatagctgctcaggatctccttcaggaggaagaaactccacaaggattttttgaagatcatggtcttggataa

SEQ ID NO: 1660 - DNA, 1311 bp, Piezodorus guildinii
atgtcctacagcatagttctcagtcggttgagtagatttccattaatctcttactcaagaggatataatatcgcaggtcacaatgtgaaaaatcattcagtgagtttcagatattactcatctagtgggagaaggcctaattttttctctcaatttatagaaaatgttaggcaagacttggccaaaagtaaagagatgaaagaaagtttgaaaaagtttagagaagaggcacaaaaattggagcagtcagaagcattacagaaagcaagagccaagtttcaaactgttgaatcagaagcatcaaaaggtggtgaagtttttagggaaaaactagaccacatcaaagataaagtcagtgatgttctggaggaagcagcaaaatcggaaattggaaaaaaagcagggcagcttggagccgaaattggaaagactgctagaggagctgcagaaacattgtcagaaacaggacaacagataggaaaaagtggagcatttcaaaccattagtcaaactgcagcagctgtgaaacaggaattagatcaaactggaatccacgctcatgtttaccagcctccacgaaaactaaggagaagggtggaaataatgccagataacaaagcattgaaacctgacacagaaacattgggtattgatcttcataaagactcaaaatttttccaaagttggcaacaatttaaagacaataatgcttatatcaacaaagttcttgattggaaaatgaaatatgatgagagtgataatcctgtcattcgggcatctcgagtattcactgataaagtttcaagtgttatgggtggcctttttcagaaaacagaactttccgaaactctgactgagatatgtagaatagatccgaatttcgacagagctcagtttttgaaagattgtgagaaagatatcatcccaaatattcttgaagcaatggttcgtggagatttagacatattacaagattggtgtcatgaaggtccatataatgttcttgctgctccaattaaacaagcaaaagaagcccactttcaattttgttctaaaattttagatattgataatgttgatctggtaatgggtaaagttatggaccaaggaccagtgttagttattagtttccaatctcagcaattactgtgtatcaaagataaaaatggtaatatagttgaaggtgatccaaacaaagttttaagagttaattatgtttgggttctttgtagagatccatctgaactggacccgaaagcagcatggcgtcttttggatatgtcagcacaaagcactgaacagttgttatga

SEQ ID NO: 1661 - DNA, 903 bp, Piezodorus guildinii
atgacaaggccgactctaagagagcttcaattagaggagcttgaaaattatgaagcggagacggattcagatactgaggcattgcaagaagcttttgcccgaggggatctcaagcccggtcttaatataccagtcaaagatagacccaggacaaacaatgttcctcttctgatggaagcattaagtgaaattaagcaggaactaccttggatcgaaagattagatgttacgaatgatcaggcacccttggccccagaacttgccctccagatcagggatgaagaaaaaggtcataatccgttggtgtacgatgagttgaagagagaaagtgtattctacaggcaggctcagaatgctgctttaaaagtcctaccgcagctgaaacagttaggccttagaactgaaagaccaggagactatttcgccgaaatggctaagtcagatcaacatatgcaaaaggttaaaggtgaagctatcaagaagaaacttatgatggaaaggattgaaaaattgagagaaatacgagcgcagaagaaagtccaaaaagctctccatgctcaagctaaagtcgccaaagtacagagtaagaagcaaatgctagatgaggtgaagaagtacaggaaaggggagaccaaaagcttagctttcctcgaacctggctacaagccaaaacccaaagccaataaatcccaaataaaacgacaacacaagaatgccaaattcggccatggtggaaagaaaagaggagctaagcgaaacaccagagacagcacgagcggaattgaaaggcgcccgagcaaaccatccttcgccaattcagcaggaaaggggaaaaaggttatgaagcaaaaaaggccgggtaaaaatgctcgactaaaacagaaatctaagagaaagaattaa

SEQ ID NO: 1662 - DNA, 3792 bp, Piezodorus guildinii; identical to SEQ ID NO: 1637

SEQ ID NO: 1663 - DNA, 1998 bp, Piezodorus guildinii
atgaatacaggaccaggaggaccaaattaccccatggcatctttatatgtgggtgatctgcattcagacgttactgaagcaatgctttttgaaaaattttcatcggcaggacccgtactttctattagagtttgcagagatatgatcacccgaagatcattaggttatgcatatgtcaatttccaacaacctgcagatgctgaacgagctttagatacaatgaatttcgacaaccttaaaggtcgccctattcgtataatgtggtcacagcgtgatccatctctcagaaagtcaggagtaggcaatgtctttattaagaacttagacaaaagtattgataataaagctatgtatgacactttctcagcttttggcaatattctcagttgcaaagtggcacaagatgaaaatggtgtctctaaaggatatggttttgtccattttgaaaccgaggaagctgccacaaagtccatagataaagtgaatggcatgttgcttaatggtaaaaaggtttttgttgggaaattcattccacggaaagaacgtgaaaaggaattgggtgaaaaagctaaactgttcacaaacgtatacgttaaaaatttcggagaagatttcactgatgatatgcttaaagaaatgtttgagaaatatggaccaatcaccagccacactgttgttgtaaacaaagatggcaagtctcgcggtttcggttttgttgcttttgaagacccggaagctgctgaaagagcagttgaagatctaaacggaaaagaacttattgaaggaaaaccgttgtatgtcggaagagcacagaaaaaagctgagcgtcaacaagaacttaaacgaaagtttgaacaactaaaaatggagcgtatgaaccgttaccagggtgtcaacttgtatgtcaaaaatctggatgatactatagacgatgaaagattaaggaaagaattctctcctttcggaaccatcactagtgctaaagtcatgttagaagaaggacgtagtaaaggatttggttttgtttgtttctcatctcctgaagaagctactaaagcagtaaccgaaatgaacggtcgtatcgttggaactaaacccctatatgttgctcttgctcaacgtaaagaagatcgtaaagctcatttggcatctcagtacatgcaaagaatggccaatatgcgtatgcaacaaatgggacagatctttcctactggtggaactggaggctactttgttcctacattaccccagccgcaaagatttttcggtccagcccaaatggcccagatgcgccctcaacctcgttggccagcacagccacaagtcagacccagcacacaagccactgcatcaggcttccccaatatgcaaggtcctttcagaagcgggccacgaggccctggcgccgccggtggtggtggtggtccaggaagtgctgcagctgccgcggcagcaatgcgctcctctatcagtgctgccgcagctgcggtggctgccgccgggcgacccacagccaacgcagctgctgctgccgctgcagctgctgccaacccagctgttgcccgccaattggcccaaggagcttctcagggtgctccagtatctgtgtctgctcaaggccgtcctgcaaattacaaatataccgcaaacatgcgcaacccgcccccgattggaggtggcgctggagcaggtgcaggaggtcctccacaacaagcattgcacatccaaggacaggaaccgctcaccgcaagtatgttgtcatcagcaaacgctcaagaacagaagcaaatgctcggagagaggctattcccacttatcaggagcatgtatcccgatcttgctgggaagatcacaggaatgttattagaaatcgacaactctgaattgctgcacatgctcgaacatcatgagtccctcaaggccaaggttgaagaggctgtggctgtactacaggcccaccaggctaaacaagctgctgcatctgtcaaaaaagaataa

SEQ ID NO: 1664 - DNA, 2742 bp, Piezodorus guildinii
atgacggactcaaagtatttcacgaccaccaaaaaaggtgaaatttttgaattaagatctgaattgaacagtgataagaaggagaaaaaacgagaagcagtaaaaaaggtcattgcttctatgactgttggaaaagatgtgtcagctctttttcctgatgttgttaattgtatgcagactgataatttagaacttaaaaaattggtctacctgtatttaatgaactatgcaaagagtcaaccagacatggcgataatggctgttaacacttttgtcaaagattgtgaagatgccaatccacttattagagctcttgctgtgagaacaatgggttgcattagagtagataaaataactgaatatctctgcgaacctctaagaaaatgtctcaaagatgaggatccttatgttagaaaaacagctgcagtctgtgttgcaaaattatatgatatcaatccacagcttgttgaagatcaaggtttcctagatcagcttaaagaacttttatctgattccaacccgatggttgtagcgaatgctgttgcagcgctgtcggaaatgaatgaagcatcagttaatgggacacctctcattgaaatgtctgctgcaactatcaacaaacttcttactgccctcaatgagtgtacagaatggggacaagtcttcatattagattcactggccaattatagtcccaaagatgagagagaagcacaaagtatttgtgaacgtatcacaccacggctggcccatgctaatgcagctgttgttctatctgcagtcaaagttctgatgaagtttttagaaatgttgccatctgaatctgacttcgtttccactttgacgaaaaagcttgctcccccattggttacccttttatcatctgagcctgaggttcaatacgttgccttgagaaatattaatttaatcgtacagaaacggccagatatcctgaaacatgaaatgaaagtcttctttgtgaaatataatgaccctatttatgttaaactggaaaaattggacatcatgattcgattagcttctcaggctaatatagctcaagtgctttcggaattaaaagagtatgctacagaagttgatgtagatttcgtcaggaaagctgttcgagccattggccgatgtgccataaaagttgagcaatcagctgaacgctgcgtttctactcttctagacttaatccatacaaaggtgaattatgttgttcaagaagctattgttgtaatcaaggatatttttagaaaatatcctaataagtacgaaagtattatttcaacattatgtgaaaatctagatactttagatgagcctgaagcaagggcttctatgatttggatagttggggaatacgctgaaagaattgataatgctgatgaattactggagtcatttttggaaggatttcatgatgaaaatactcaggttcaacttcaacttctaacggctatcgttaaactatttttgaagaggcctacccatactcaagaacttgtacaacaggtgttgagtctagctactcaggattctgacaatcctgatctccgagacaggggatttatctactggaggttgttatcgactgaccctggtgctgccaaagaagttgttttagccgagaaaccactaatttcagaggaaactgaccttcttgaaccaactctcttagacgagctcatatgtcatatatcttcactagcttcagtttatcacaagccacctactgcttttgtcgaaggaagagctggtttgagaaagtctttaccagccagatctggatctgcagaagtagttcaagaaactcctggtgctcaagtcattccatctcaagattcgctgattggcgacctcctttctatggatattggtggcgtttcagctcctcctccacctccaacgacatctgctcctgttgatcttttgggtctggattcacttcttggaggggtacctgaacccgttgtctctcagagtacaaccggtttgcttggagatatctttggtttgggaacagccgccgggcctacagcatattctccacccaaaaccatttggctctccagcgataggggtaaaggttgcgaaatatctggaacgttttctcggagaaatgggcaaatccaaatggatatgacttttgtaaacaaagctatgcagccgatgactggcttcgccattcagttgaataagaacagtttcggtgtgactccagccggaactctccaagttttgaacccactaccgcctggtacttcgcatgactgctcattgcccttagttacgactggagcagtacaaagaatggaacctttaacaaatctccaggttgctgtgaaaaacaacattgatgttttctactttgcttgcattatcccgatgcatgtatttttcactgaagatggacaaatggataagcgtgtattcctcgccacttggaaggacattccagctcaaaacgaagtacaatacacactgacaaatgttcagtctaatgctgatactgtcgttcaaaaaatgcaagaaaataatgtttttaccattgctaagcgaaatgttgagggacaggatatgttgtaccaatctgttaaactgactaatggtatttgggtattgattgaactaaaaatacaaccaggaaatccaaatattactctttctttgaaatcaagagctctcgacatagccgctggtatattccaggtatatgatgccattcttcattcttaa

SEQ ID NO: 1665 - DNA, 498 bp, Piezodorus guildinii
atgcctccaaagttcgatcccaacgaagttaaaacagttttcttgaggtgtgttggtggtgaagtaggagctacatcctcccttgctcccaagatcggtcctcttggtttgtcccccaaaaaagtgggtgatgatattgccaaagctactgcagattggaaaggtctgaaaattacagtttgcctcacaattcaaaacaggcaagctgctatctcagttgtgccatctgcagcttccctcatcattaaagcccttaaagaaccaccaagagacaggaagaaggtgaaaggagttaaacacaatggtaacctcaccttcgatgaaatcctcactattgccaggtcaatgaggccaaggtccatgtctaggaaactagagggtactgttaaggaaattcttggcacatgccagtccgttggttgtacagttgatggaaaaaccccatctgaggttatctgccagataaacgatggagaaattgatgtagcagatgaatga

SEQ ID NO: 1666 - DNA, 1110 bp, Piezodorus guildinii
atgtgtggagaagaaccaaaactaggagaaatgaaggcgctcattttagtcggggggtatggaactcgtcttaggcccttgactttaagcaggcctaaacctttggttgaattcgcaaacaaacctatgcttattcatcagatagaagcattagttgaagctggtgtaactgaagttgttttagccgtgtcttacagagcggaacagatggagaaagaattgagtgacgaagctaaaaagttgggtgttaaattaattttttctcatgaaacagaaccacttggaactgcaggtcctctggctctagcaaaagatattctttcatcgggtaatgagccattttttgttcttaattccgatattatttgcgaatttcctttcaaagaacttgtttctttccataaaaatcacgggaaagaaggtacgattgtagtgacaaaggtagaagagccttcgaagtatggtgttgttgtttataatgaaaagggttgcattgctagtttcattgaaaaacctcaagaatttgtttcaaataaaattaatgccggtatgtacattctcaatccttctgtattaagaagaatcaaactggaaccgacaagtattgagaaagaagtttttccgttcatggctgaggaaggagaattgtatgcaatggagttgaatggattttggatggatgttgggcaaccccaagattttcttacaggaatgtgcttgtatctcacatctctgcgccagaagtctcccgagaagttgtactctggccctggatgcatcggaaacgtcctggtccaccctacagcaaggataggcacgggctgttccatcggaccgaacgttacgctcggtcctggagtcattgtggaagacggtgtatgcataaaaaggtgtacagtcttggaaaatgccacaatcaaatctcattcttggctttccgggtgcatcgtcgggtggaaatctgttgtcggacaatgggttcgaatggagaacaccaccgttctcggtgagaatgtaaatatcaaagacgaactctacatcaacggaggacaagtactccctcataagagtatcgcaaagtctgtgcaagatccgcagattatcatgtaa

SEQ ID NO: 1667 - DNA, 864 bp, Piezodorus guildinii
atgactttggacggtgaagaaactatatcggatcaagaaaaggtgcgaatcgtttctaattttatattacattcgccaccgggagagtttaacgaagtttttaacgatgcaaggatattattaaacaacgatacccttttgaaagaaggagctctcggagtcttcgggcagtactgtaaagaccagctaacgcctgtgaagattaagaacagtgagtatccagttttaattacagaacataatgatcttggatccaacaggttttatgatgcaaggtcgaaacagtcatttaaatatgatccattaaggagggagacatctaattatgacacatgggatgctgaacctggtactgaaaagtggagatcagctttagaggttgaattagatgcatatatagctaaacacttcgaaagtggatctggtagtgtattttctaaaaaagaagatggtaaagtaagcttggttgcgtgcatagaagcccatttatttcagccaaaaaattgctggaatggttgttggcgatctcagtggtttgtgacaatagattctgataatgcagacgtgaaaggtgttttgaaaattcaagttcattattatgaagatggtaatgtacagctagtaagtttgaaagatattaatcaatcactcccagttgtcgacgaagagcagttaagtaaggctttaattaaaatattcgaagactctgaaacagagtaccaacaagcgatatctgaaaactaccatacgatgtcagacaccacttttaaagctttaagaaggcagttacctgttactcgttcaaaaatagattggaataagatggtgtcttacagcattgccaaagaactcaaacctcagtga

SEQ ID NO: 1668 - DNA, 3660 bp, Piezodorus guildinii
cgtgatgaaatgtttttatctgggcgaagttttgttatcatatttacacaggctaggtgtggcatgaaagtgataacggatcgaggtgatcgcttcaagtcagtcgagaggatggaggtggcgttgcttctgctttttgtcacttttgtggcaagtaaagatgtcaatagagtcagtgagaatttggtcaggccctataacaagaattattatacttcaagattgcgcggcggtcctggtggtctacagccaaacgctgatgatgatcgagaggctccttccattgaccaaccgagtatcccttatgtgataacagaagatcgactaaggaagataagatcgaacatgatgtattggttttttgaccgagattctaaaggcggttatggagatttgcaaaaggatataacaccatcaattacccaagttgataagaatttaaattttcaattgccatttttcggatttcgcttcaattatacaagggtttcactaaacggttatttagaattcagtgaccctccagaacaatatagctaccctctcactttcccaactgtagattggcctcgtaaaaacgacccttcattcatcggaatattttacagtaagtgtaggattggacagttgggtctcaatgatgttgaccaaagagaaccaggagtttatttcaggatggaaagagatttgatatcaagaaaagacaaattcggcgtcgaaatgagggagcggctgaaatgggacatccgagagagtgttgttggctcagattcttttgaaccaaagcattcggttattgtgacttggaaaaatgtatcgtttgctggtggaattgaaaactcagtacaaacaacaaacacatttcaactggttcttgcaacagacgaagtgttcacttatgccatgtttaattatgttcaaattaagtggactacacacacggaagcaagaggagacacagtaaaaggggaaggcggtgtaccagcttacattggatttaatgccggcaatggtacgagaagttatgaatatcgaccatattctcagacatcaacaatcagagatttggttatgcgtggctgggctaatggtttccctggtagacatatttttagaattgatgaaaatatcctacctggaacttgcaacaaggatattgctggagcaagtttgcccctcgcatttgctcctgaaagtggcaatatgctaggtggtaccattgtcaatatcacaggaccttgttttgaacctaatatgaagatagtatgcagatttgacatgaaagctgtttatggaacagttgtggacaggaacagagccatatgcgttcagccttttatcatggcagaaggttacatattgtttgatattgccattgacgatgggaaatacgtttggaaaggacaatatttcattgaaacacctgcaactgcagctgaaaaaatatcttttgctgacgacagtgttcatcaaaagtatcctccggaagtcagaataacatggaatcagtataatttaacttcaaatttaggtgctccagttcaaatttcaatatggggatacagagaaatatctattcgcccagagctggtttatatagattctttggacgtgggtgtcccaaataatggcttgtattcaatcattccagccacctataaaaatcgtgataaccgtttattcactgatatgagtttcggattcatacaaatcaatctgacagaatcgacgaattacaatggactcaaagtaacaccagttatatggagcaaaccaatacctttaggttggtacttcgcaccgcaatgggagagacagctaggttccaaatggccggaagggaaatgtaacacttggataatgaatgatcgatatttgaagaacttccctgctgagcttagcatatgtccctgtaaactagaacatgcgcttgctgataaaggaagatttatgccagattttgactgtgacatggatgcaaaccctcactgcttttatcatgaaggagcaaggcattgcgtaaaaactggagctcccaaacaggaaggttccgaacagcaatgttgttatgacaaaaaccattatttgatgctttcctatgatcaacagtggggttcgtcaccaaagaggtccagtaatttaggaatcttgccatggaatgaaccaaataaggtgccaacactatcacaatggtatcatgatatcgcacccttttaccattgttgcttatggcagttcgaacaatcagtaggctgcgaaacatttaggtttgaaagaagaccttcacaggactgcgtgggctaccaatcaccttacatcgcaactgtttttggagacccacattttattacctttgatggcttggagtacaccttcaacggtaaaggagagtttgtgttattgcatacagattctgaaaagtttaagttagatgtccaagcaaggtttgagcaagtgggtaagaacatttatggtgaagtggcggcaactcagttgacatctatagcagcaagagacaatacttcaagcatcattgaaataaggcttagaccaaaggaggcacaatggaggtacagactggatgtttttgcaaacaagaaaaggatatattttgaccgtccagctcttcgtgtgcaacacttcacaggtgtcacagtttatcagccatcacatatacttaatcaatccgaaatcattatcatgtttcaatcgggtgttggtgtagaagttgttgaaaatgtaggatatatggctgcgagggtttatctgccctgggaatacataaacagaacgaggggtctgtttggaaattggagtttcgacccgtctaatgacttcacgctaccagacggaagtgttgtcagtgctgataatctgaacaacttggaaagaatacacaaggaattcgcaattcattggagattagaggataatgttgaacccaataaaggtgaagctctctttgtgagagaatatggaagaacttcaagctattatttgaatcgaacttttgttcctgaatggaaatcaactcctcaagaaatcatacctcctaacaggactaaagatatacaacaagctttagcactttgtggtgaatcttatcaatgtagatatgattatgctgtaactttaaacagggaaatggccttttatactctaaattattacagtgaatttacccaactaaggcaaacaaataaagacagagttctgtcttgtggtgtgctagaaacaccaagatttgggcgaaaatccaactttttctttgttcctgattcaaaggttatatttgaatgtgatcaaggatttattctggtgggtgatcaaagaagaacatgctcttctactggaagatggtcttttgactatggatatactgagtgtctgcgtgaagaagaatattctttacgtgcatttggttggacttggggtataatagctctagtcctaatacccattgttattgtacttgtatgtgccggttttcgaattgtgagacgaataatagaacagaaaaagaatgaattacgtactgaccaaagaactcagtatcatccagattatagtgctggtcctataaggtacaatgcaagagaagttagtctagccattaatccagaaagcgaaccattgaaaaaagaaactgaagtaaattaa

SEQ ID NO: 1669 - DNA, 342 bp, Piezodorus guildinii
atgcgttacgtggcagcttatcttctgtcttcccttggtggaaaagaagccccttctgcagctgatattgataaaatattaagctcagttggaatcgagtctgattcagaacgagtaaacaaagtaatttctgaacttaaaggcaaaaatatcgaagaggtgatcgctgcaggaaaagagaagttggcttcagttccttctggaggtggcggagctcccgccgctgctgctgccgcacctgcagcagcctcccctgccaaagcagcagaggagaagaaggaagcaaagaaagaagaatccgaccagtcggatgatgacatgggctttggtctctttgactaa

SEQ ID NO: 1670 - DNA, 2742 bp, Piezodorus guildinii
atgatgactgatcatattggtggaataacccttaaatgggatccaaaaaaccttgaaatacgaacattatcagtggagaaaacattagaaccactggtattacaggtgacaacacttgtaaatacaaaagggcctagtaagaagaaaaaaggaaggtctaaacgcgctcatgttttggttgctgctgttgaaaaagctactgaaaatttcatcgaaaaaggtgaaatgatagcttatgaaaatcctgatataaaacaagaaatgctttcagctgtagaagaagtgaggaaaacaggagaagcaatgagtgcagccgcgagggaattcgctgatgacccatgctcatccataaagagaggtaacatggtacgtgcagcacgcaacttactctctgccgtgactaggctcctcatcctagctgatatggtggatgttcatctcttgttgaagtctcttcgagttgttgaagacgatcttgttaaagttaaaaatgcatcaagccaaccagaactgctcgagaacatcaaagcattcggacgtaatgcttctgagctgatgtcccaggctgcaaaacgacagcttgaactgaaggattctcagttgagagatgacttagccgcagcacgtgccgtattgaagaaacattccaccatgttgctgacagcatcaaaggtttacgtgagacatcccgagctagctgctgcgaaggcgaatcgtgattacgtcttcaagcaggtgtgcgaagcggtgaacaccatcagcgacgtggcccagggcaaggggccatccatcactaccaacccttacgaagggcctggcgagctggcagctgctctcgacgactttgatgagcgtatggtgatggaacctctggcttattctgaagtagctacgaggccatccctggaagagaggttggagagtatcattagcggagccgccctcatggccgactcttcttgcaccagggacgagaggagggagcgcattgttgccgagtgcaatgccgtacgtcaagcacttcaggaccttctatcggaatacatggccaatatgagcgtcaaagatcaaagcgaaggcttggagagggcgattgaccatatgtgtcgcaagacgagggatttaaggaggcaattacggaaggctgttgttgaccatgtttctgacagctttcttgagacgagcgttcctctcctggttttaattgaagctgcgagagctggtaatgagaaggatgtcgaagagtacgcacttgtatttcaggagcatgctaataaactcgttgaggttgccaacttggcttgctccatgtccgggaatgaggacggagtgaagatggtgcgctacgcggcagctcagatcgacgccctctgcccgcaggtcatcaacgcagcccgcatcctcggggccaggcccaagtccaaagtggctcaggagaacatggacgtcttcagggactcctgggagtcgcaggtccgagtgctcacggaggctgtcgacgacattaccactattgatgatttcttagctgtctctgagaaccatatcttggaagacgttaacaagtgtgtgatggcgttgcaagagggagacggagactcattggacaggacggctggcgccatcaggggccgctctgcccgcgtggctaacgtggtcactgcggagatggacaactatgagcctggcatctacacagagagggttctcgaggccatcaaggtcctcagggagcaagtgatgccaaattttgctcaaagagtagaagttgcagtagatgctctttcttcaaaccctcctaaagatgtcgatgagaatgaattcattgatgcctcccgtttggtctacgatggcgtcagagaaattagaagggcagttctcatgaacaggacggatgaggaactcgatcctgaagaagttgagttagacgaacactacacgttcgaaactcgcagcaaatctagcgctcatactgccgatcatggtgtcgatgaatatcctgaaatcagtggtattacaacagcaagggaagccatgcgaaagatgactgaggaggataagcagaagatcgcccagcaggtggaatatttcagaactgaaaagttgaagttcgaccgagaggtagccaagtgggacgataccggcaatgacatcatcgttctagccaagcatatgtgcatgataatgatggaaatgacagactttactagaggccgagggccgctgaagacaacaatggacgtgatcaatgccgctaaaaagatctctgaggcagggaccaagctggacaagctgacgaggcagattgcagaccagtgtccagagtcctccaccaagaaggacctcctcgcctacctccagcggatcgccctctactgccaccagcttaacatcacctccaaggtcaaagctgacgtacagaacatcagtggagagctcatagtttcagggcttgacagcgcgacttctcttattcaagccgccaagaacttgatgaacgcagtcgtattgaccgtcaagtcttcttacgtcgctagtaccaagtacccccgacagggtacagtgtcggtaagtccttctccgatagtcgtctggaagatgaaagcacccgaaaagaaacccctcgtgagaccagaaaagcccgaagaggttaaagcgaaagtgagaaaaggatcacagaagaaaatacagaacccgattaaggcattatcagaattccagagccctgcagagtcagtttaa

SEQ ID NO: 1671 - DNA, 1239 bp, Piezodorus guildinii
atgaacgaaagtaatcttcaatcaactccgaaaaccaatgccagtactgggttttttcaagccaccacgccgaagcaaggatccagtgttagttttggttctatgtcaactaatcaaacccagcaaacgggatttttgaattttacgcctcaagttggaacctctaagcagtctacaatgttcatgccacctacagcattgtctggtacaagtactccaaaaactacagcaacaggtactgcaacattgtttaatattacaactacaacagcttctgctcccatttccagtagttcagcaacaacatcagggttttcacttggttcttcatcagcagctagctctcagcagttcaaaccaccttctacatctcagccgatgcagttaaaaacaactgtatcaggtgcttctatgccattaactactggtttatcatccactggaggaaatacccaggcaactgccggcttgaattttggaagtaccgctaaatctacccctggatccactgtcttcagtcctgctaaaagttcactcccagctgcgagttctactacaacctcatccttaacattgccaccttcttctacaacttctctcactaattcattatcgaacaaacctgttactagtactggtgcttcgacttctcaacaaccaaataaccttacttttcaacaattagaagaattgattcttaataaatggacagccgaattgtacgaacaggaaaaagtgtttttaaatcaagctacacagatcaatatatgggacaaagttattaatgaaaatgctgaaaaattaactcaattacattctaccatggagaaagttaggaagcaacaagccaaaataaatgatgatcttgagatcatatttactcaccagaaagacttggaagcatgtctcgttcccatggagaaggaagacttactttcagttcttaaagctgatccaaatagaaaaaatctgtatataaatgctaagaaaatagattctcagattaaaactatgtcagaagatttgaaggaaacgattgagcatatcaatgaaacatcacgatcacatgatactgaagatcctgttatccaagttggacgaattttgaatgctcatatggaatctctgaggtggattgatgaacacactgcaaggatgcaagattatttcgattcattattaaaaatgcatgatgatcttaggagagagtgtgagataagcaagcatgatgtttattaa

SEQ ID NO: 1672 - DNA, 582 bp, Piezodorus guildinii
atgttcatttgggattggtttactggagttttaggctatttaggtttatggaaaaagtcaggcaaactattatttttaggattagataatgctggtaaaacaactcttctccataggttaaaagatgacagattggcacagcacgtaccaacactccatccaacttctgaagaactatccataggaaatatcagatttactacttttgaccttggtggacacactcaagctcgccgagtatggaaagattactttccggcagttgacgctattgtttttcttgttgatgcttgtgacacgagtcgattaccagaaagtaaagcagaattagatgctcttttaaccgatgagagtctcatcaactgtccagttctcattctcggcaacaaaattgatcttccaggtgcagcttctgaagatgatctcaggaattttttcaatctgtatggacaaacaactggcaagagcaaagttccacgaagtgaattatctggtcgtccattagaactattcatgtgttcagttctgaaaaggcagggctatggtgaaggttttcgttggttagcccaatatatagactga

SEQ ID NO: 1673 - DNA, 1791 bp, Piezodorus guildinii
atgtctggaaataatgtttatggtgaaatgctacttactgttacatccgagaagttttacatcgagcctgttcaagatattgataatagccttatcttggatagagtcactggaaatataactatatcaaatgttcctggaagcagtggggatgcaccaatgatcggggaaaaaaaaactatttatggtattcttgggactattaggctactagctggacagtatttagttgtagtgactggcagaaccaaaattggcaatatatggagaagagaagttttccagatggactctgccgagattttatgtttttctaggagtactactcatctaaatgataaacagaaaaggattgaaaaggagtatatatcaatgctggaatctattcttgctacgccccacttttacttttcatattcttatgacctttctcacactgttcagagattgcataatatatcgccagacttcttaaaaatgccaatgtatcaaagggcagagcagaagtttgtttggaatgaatatcttttatctgaatttgcgcaaaactctggtgtctctaaattctgtcttcctatcatccatgggtatctctcaattacatcttgcattttaaatggaaaaacctttagtcttatcttggtctccagaagatccaaggaaagagctgggaccagattatttactagaggaatagattcaaatggaaacgttgccaacttcgtcgaaactgaacagatagttgaggctaaatttgaacgtgctagctttgtccagacacgaggttctatgccattcttctggcagcagtatcctaatctgaagctgaaaccacgacctgccataattcaagatgaaaatcattctgctgccttcagtaagcattttgaaacacagctgatggattacggaagacaagtcattgtgaatttggtcgaccattctggctctgaggggaagttggaagagttttatagaaagctagtgaacgaagcaaataatgctgatctgaaatatgaagcatttgacttccacagggaatgctcaaagctacggtacgatagattgaagattcttatagatcgtctggcctatgatttagagcagatgtcagtaacgatgattgttggagatggaacagttatatcacagcaggaaggtgtattcaggacaaattgtattgactgtctggacaggactaatgtggtacaatcattgttggctcgagccaatcttacatatattttacagagactagcaatattaaagaaaggacaaacagttgaggatcaagttggtcttgaaaacacatttaaagtaatatggagtgaccatgcagatctaatatcaatccagtattcaggtaccggagcattgaaaacagattatactagaacaggaaaaagaaccaaaaagggaatgattcgagatggagttaactctcttgttcggtattacaaaaataattttcagcatggttttcgtaaggatgctttggatctttggcttggtcattatcgcgtctcttcagaagaaggaataatcattagaagccctcttgatgttaaaagggaattcaaatatacagcttttccgctcatcctccttgttgctattgccatgttctttgcaaatctggttacaccaaatgaatacactactggcacactcctgtcacttatattctggtgctctatggtatcagcaactcttatcgctatattttacaatggttcagaatatgtagattgtccaagactatgccccctccttcggtcaccatctgtctag

SEQ ID NO: 1674 - DNA, 1299 bp, Piezodorus guildinii
atgtctcctactgttccaactaccacaaatgttgttgacaagagaccaacccttgtcaaaccacactctgctgaaagaagatcagaattagtttgccgtgtaaagtactgcaacactttgcctgatattccatttgatccaaagtttattcaatatccatttgaatctactcgattcattcaatataatcccacttcactggaacgaaattataaatatgaagttcttactgaacatgatcttggggttactattgatctcattaacaaagacatgtatgctgctgatcacaatgcagttcttgatcctgctgatgagaaactacttgaagaagatatccttacacctcacgattctaaaaggtctagacatcattctcgatcagtttcatggcttcgtagaactgaatatatttccactgaacaaacacgtttccagccacaagttatggataaagttgaggctaaagttggatttagtattaagaaaagtctcaaggaagaaaccctttacatggatagagaaagccaaattaaagcaattgaaaagacatatgatgatgctaaactacctatagagaaacatcatagtaaacctaatgttgttccaattgaaattcttcctgtctttccagatttccagttatggaagtacccttgtgctcaggttatgtttgattcagaccctgcacctataggaaagacagtacccgctcagttagaacaaatgtctcaagctatgatcagaggtgtcatggatgaaagtggtgaacaattcgtagcttatttcttgcctactgattcaactttagaaaaacgcaggagagattttactaatggtatagattatgaagacgaggaagagtatgactacaaaatagccagagagtataactggaatgtgaaaactaaagcttctaaaggatatgaagaaaattatttttttgttataaggaatgatggagtgtattacaatgaattagaaactagagtccggttgagtaaaagaagacaaaaagctggcactgctcccaacaatactagattagtagttagacataggccaatggatgctaatgaatttaatattcaccgtcaaagggaaaagcaacttcaacatcctattgaagaagaggatgaagaagaaagtgctggtgaagaagaaaagaaggaagaagaaaagaaatcaaacagcaaagattctgatgaaagtgacaaagatgaaggtagtgagaaggagggtggaagtgataaagatgaaggaagtggtaaggaggatggtagtggtaaagaaaatgat

SEQ ID NO: 1675 - DNA, 1203 bp, Piezodorus guildinii
atggataacgaaggagttacaccagcatatatgaagctggcccaaattaagtttgctttaagtctgcctgagtataaaggtgacctggccttaaaagaagaacttcttaatggcattaaagctggaaatatggcaccttattatcgggaggtttgcaatgaccttggatgggtaatggatgaaactttgtgtgcccagatggcaaaaaataatgaaaccaggctggcagaattagagaaagagcacgagaattcagttattgaagatgaagagcaagtgagtgggctatggcaggcaaagttagactacttgtgtagcattggggacaaggaaaatgccagtacattagccaatagcaagcttcaagacaaaacagtgcctaagactcatcgtatcgatgcagtttttgcattatttaggttatcatatttccacggttgcgatatcaaaggcatgtcttcagctattgagaaagctaccgaactgattgaagggcaaggcgattggagttcaaggaataaattgaaagcatatgagggagtgtggagttttgctgtaagagattatctacgggctgcaaagcttttcgttgatgtcgtacccactttcgaatcttacgagcttgctgacttcggaactatcattaaatacaccgtactctcgtgtatgatagcattgccgaggtgtgaattgaagaaaaaactcatgcaccacggtgttatggcccaagcacttcactctcaatatcgaaacttgaaggagtacttccagtccctttacgatggtcactacgcagacttccttgtcgctttggcacaggtggaatctgatatgaaacgcgaccctctccttcatccgcattatcgccactatgtacaggaaatgaggcttagggcctacaagcagatcttgcaagcctatcgctcactctctttggactatatggcagaagcatttggtgtttcttgtgaattcatcgaacgtgaagtcgctaaatttgctgcttctgggcgtctccagtgtaaaattgattctgtggctcgctccgtaattacaagcgtccacctgagtgatgaagctctccgcgtcaaggattcatctgatttagatctcgatcgctccctcctctacaagaccactgtcaagaggggtgatattttgcttaacaggctgaaaaagttagctagggttatggatttttag

SEQ ID NO: 1676 - DNA, 12339 bp, Piezodorus guildinii
atggaggagggttctggggaccgtgaaggtaaaagcggcgggggggaagaagatatggatgttggtgattgctctgaagaagaggaagatgaggaagaagatttggaaatgggttcctcacccatgcagcaagaacagtcttctataatggatataacctctcctgcttctcaaccatatgaaggcttagcatcgacacttcgtatggttcctcccaccgttctgtccgcaggaaaacctttgcaaggaacgagtggattaaaaaggggaccggggaggccaagaagtagaggagctggtggaaattcagctgccactccgaggcctatcaagaagcctgcggttggtcttaaactaaagaggtggaaagggcttcttgtctctggagtgtacggtgcagctggtggaaaaggcggtggagagggagaccctgaaggagaaagtacatccccttctcagccatcaactcctgtcgatcaactcaaaggccccatctttgtggacgaacccttatttgatgagcagtggcccggtaaactatgtgttctttgtaacttaagtgagcacagtcaacttggccaggggaagatgatgcgagcggaatgtagcttggaagaccttccaagagatcttccgcgagaatctcttatgtcaccacccgaaactcccccacctatagattctttctcacctagacctcctcttcaaaatcgtagacaaaagggatttgccaaattcagtggacaagagccagttgaagaattgagcttagttggacatatcgacattccagaaccatcaaatttaatagattccggctacatttatgtccatgaatggtgtgctgtctggtgccctggcgtccgacgagatgaaagtggtcagttgttgggattggtagtggccgttgctgccgctgctacccgtcgatgttaccattgctctcgctatggtgctggtccgccatgcattgttccatcatgtaacaaacacttccatatcccctgtgctgcggccgcatcagcattccaacatgttcgcacattaactctcatttgcagtcaacatttagaccatgttgccaatagttcttctatgagtaatgtgacctgtccctcctgtaacagcctaggtaatgttgcaaatcttgtcatgtgctctgtatgtggtaaccatcaccatggggcatgcatagggaatgctctacatcctggcctgagggctggttggcagtgtatcgactgtcgggtgtgccagctttgtagggaaaatgaagagaccggtagaatgctagtctgtgactattgtgataaggcatatcatccgcactgcgtcaggcctgcgatgtcttctgtacctaaagtcggttggaagtgcaagcggtgtcgattatgtagtgactgcggggctagaactcccggaggtggcctttcatccagatggcactccaattatacagtctgtgactcgtgctatcagcagaggaataaaggattttcctgccctgtgtgtcacaaagcatacagggcggctgctctcagggaaatggtcaagtgttcgcagtgtcgaaggtttgtacacgggacctgtgacaaagaggcagactttgttagttaccacagaaaaaaagaagcccatcccgattaccaatatatatgtttatcgtgtaaaaataattcaaccattctctacctgaagaggaaagatagcactgaagatgtaaatatggattctgctttaaatatatctcaagaatctcttgccacccctgacgaactcgatatggattcagaaaggtctgatgaccctccatttcgaccatctggtgttggcttaggcaaaggaaaaccattctatgcctctaaaatagccaagaaaaagctcgggttgggcccaggtcggccaaaaggaagtgggaagatgtcttctatagccctacctcactttcagaagagacctcgatacgcagacttcggtaggaagcgaggcgccaaaacgaaaatgagaggaatcttcggtgttcccgggcttggtttacagagacctttaatggattctaacaccaaacctgaagatgaaccagggctcgaaaataagctggtccttgtatcatctcgtgacaaatacgtgttaagtcaagatgtttgtgttatgtgtggtgctttggggcaagaccaggaagcatgtcttatagcttgtgcacagtgtgggcagtcctatcatccctactgtgtatcagttaaggttaccaaagtgatgcttcagcgtggctggagatgccttgattgcactgtgtgtgaaggctgtggccaaagaaatgatgaagggcgattaatactgtgtgatgattgtgacatttcttaccacatctattgcatggaccctccactcggttccgtacctaccggtgtctggaaatgcaagtggtgtgcccattgccagacctgtggctccaacaacccaggcccaaattcgacgtggcagtctaactttacccagtgcgggccttgtaattcaagaactgtttgtcctgcttgcctagagctttatacagacggtgatctcataataaaatgtattcactgtgataggtggttacattgcctctgtgatacaatatctaatgaaaatgaagcagaagcgtgctgtgctcaaggttatacttgcatcctttgcaggccaaataatgctgcattggtgttacctgcaacaacaccatcaagagttccatctcctgaactcaatacagagagcagagctacagactactatgtagatggtgtttgcttatctgaaactgggctacagttaatcaaaactctttcaatggataatggaaaccaaccagtacggcgaaaaagaccaggattcaggagacaagatccttccgttgacttggtagatgatatggataatgaaggaaaagatacagtgtataaagatggtatgttttgggcctctaaagaaaacggcccgattcccagtccacctgaaggctttacattatacactagggaaagtggaatagttgtcctgaaaagaataaaaaagagaaatcttcaaaggcttggcattggtggtttcactactgtcaaaatgagaagctccagattaaaagaagatgatgaacatctataccctgaagaaaaacccaggaggaaacctcgagttccaaagaagaaaagcaaaattgctgaaagttatcctaggcatcttcaggaagctttttttggcaaagaattactagatacaactaaagaaacttcgcaagagttagagagcactggtgatgaatcagatgatggcaaaatgagggaggaagaaggtagcgatggtgaaacgttgaaggatattctacatctccctgaaaatcttctccacaatgatctagtcaacacaatcatgaatgaaagtgcagatagtatcaaatcagaaaatcttatgtcagagagtgggcacgaaggtagcagcagccaaaaagacgaactatgtgatattcttggacctcatttcaatatagaatctatggtgagggaaacaggtcttccaaatatggattccaaagatgttgaagaaattttcaaaggagttcttactgatgaggctcgtaatcaggcccatcataatcaagcgtcccctcaacaacagcatccagttgcaaaaagcgcacctgcaggcttggcttcttctccattgcagtatccatcggcatctccttacaattcagaatatagcaatagccctcagttcagtccggaaagttcgtgggatgattgtggctcttataatagaactacatcgttgaaaatggaagcagatgaatcactcggaagagatgcgacgatatcccctgttctgtatgccaacatcaatcatccagaatggaaaaaagagtatccgagttggaatgaacgtttcaaacaaattttaaagcagtggcgtgctttatcatctgaagaaaaggctccatatcttcaacgtgcgagagacaatagaacgaacttgcgcagtaggaagcaggaacatgacaaaacattgaataccaaatcttgccgggaagctgagcaagaacgacagtggaaggagttacaggctctgaggcagcagcagcaacatatgctttctcaaaccagggtccagcaagtgaaccgtgtccgccaagtgggcaatgcagggcttgtacaattttcaacaaacgaccaatctccatctcctcatttgactcagcaattacaagtttcaacttccactcaggaggctaacctaggaggcttggcatctccaagagctcaatttgcttctggtactggcggtacggttaaggttgcgacacctggtggtacgatttaccgtcaggtgaggccacctcagtcaccgtttccaagcccgaggcaaccatccacacctcaacagcaggaagaagttagacaactcagggatctcttacagcggcatcaagtcaagcaagaaggatcagaaaccgtcctgtcgggtggtgttcttcaagcagtacaaatgcgacctcagcctcctaggagcagcctgcacccacaagtcgttcatggtatggaaccgagagtcaggttagtggtacaacaacaggcctctaggttcccaggaaccacgcaagtgagattggctgctcctaggacacaacttcaagaacaattcctcatccaacggcagtttgctgtagcccctgctgcccaacatgctcataatgcaagtgcaataattaggaatagtagtactttagtcgagcaaacaaggttgcaaactctgccagtcgaccaaagaatccaaagcggaggccgagaaggagaggaaataccagaaagtgttaccgcagaactggaaaagctagaggaagaaggaggtaccatcggtggtgaagctgatgaggtttctgcaatattctctgacctagtggaagatgacgatgagctgctcgcggaaatgggctcagatttcaacattctcgaatatgctgatccagaacttgataatgtatccggaggagagaagacaaatatccttgacgatctggaagatgaagttgagaaaaaaaaacaagttggggcttccagaaaagataattccgtacaaaggaattcttcagaaagtattaataaagagcttagtgaacctagaccagaaagtaagccaagcgaagaagtctctagggtgtcggtaacatccacaccacctcatctacctcaacagatatctctaagcggaaacaatggcatcgtacaaccaaaaattgttgggtcaggttaccaaacacaattcgccactccaagtacacctctccctagaatgcaagttttgcaaggtgctaaccaagttaatcgtggaggagcaagcttcgttggaaaccctccaccacctccacctccgtaccctggtccacctcctccatatccagggcagcaagctgcgatacgaggaaggggtgttgttagatctcacatcatctccagccaggcgtctcaggcccagcaaagaagaaccttgctccttcaagagcagcctctactgttggaagaattacttgaagaggagaaacgagagcaagagaaagcctcagtgacaccttctccagcaagttctctcatgagtgatgcagactttgaaatgctgagagccgatgtcctcggttcgcggactgccagccctcctcaatctcaaactctcggcactctgaatcttgttggacctcctcctccccctcctccagaaaacatagtgacggaggccgataggcaggctcaaatccaatacgaaacatggcttaggacgactggaagtgccgtcagccaacagatccgatattttgaaaccgaagttcaaaaattaagaaaaatacgcaagtcgttaaatagtaaacagcgacaattgagaaaaaatggcaatgaattaaatgagaaagacgcaaatgaactacaacgtgtaaccggtgaacaaacaactttacagaaacacctggaagcagccagaaaacaaagcaggcagcataccatggtgatgcaggaatatcaaacaaaacaagagagcaaaggaggtggaggtagtgctggttctgcgtctccgcagtctcccctcctatcaccggctggcggaggcgtcggcggacatcagtcccatcaaccttctcctcaaacatcgtcagtctctccggtgaggcatagccctgccggaactcctcattctcagagtggtgatgacaaaagtgaaagcagtggtcttccgtcaccaagacctcctcccatgacgccaactccacccagccctcatcagttccatcagataaggcatccttcaatggtaccaaggtttgccagatcccctgaaggaggtttacggccacgtttagctcctctccaaacgtccggctttaattctcctagaggaatgtcacctcaaccaccatctccgcagacaatgagattgacccaacaacagcagcttctcctgcaaagacatcagctacagcagcaaaaacaacagattctagaacaacatcctgaagcaggagctattctgagtagacaactaatgaggcaagaacctcagaggcagttcaggaactttccaggtcctcagagtcctggttctcaaggagggtctcctctgtacagccctcgtgctcctcctagtcctatggtctatcaaggacttcagacaccaacttctcccatgcctcagtttacccagcccacgtctccaatgcagtctcctcgtttgcagtatgcaccaagtagtcctcatcaacagcaatatcgacccaactcccccatggtaccatcccccatgagaaggccttcatctgctagtcctcaaggagaaaatccaggtggcggaggaaacccattcaatcctaataaccctattcctatacctcctgaaatacgtaggttgaaattgggcttaaaaggaggttcacctatgtggaatgaacagagaaaaagggtgcaacctagtaccagctcagaaaaagttgctactagcttagtttgtgcagactacaacgattttgaagaggaatctccacctattactccaccatctaaacctgccttaattaaaaaaaccgaaacagtgaaagctcgacaatctgaagacactgattcagaattaactgtttatgatgacattgtgttagttgaaggctgcaaagaaacaaacttagaagttgcagagttgcggtctgctttagaaggaaatgttatgtctactgttgtatcaatgccaatggttatcgattcaggccagattcagatgatggatgttgaaggggagctcctggatgaccttgtggtcttaggtgtaggaaatggaaccaccgatagcgactgtattttggaagtgaacaaagatctcattttggacgatgatgtcaaagaagatgagcttgaagatggttctccacctagagctagaatgcaaggtaaagttcttcctggtgggggctctcacaattcaccttctcctgaatctagaaataactgtgatatattcaaaaaagtcgaagaaaaagctaaaaaacttgaaaaagaaaggaaaagtactgacgaaaggacagttcctgttcaacctaacattgtagtctcacgaactccaacaacttttacacccgttgttactcaaaaatcaataccaatagcagacaatcgtcaattagctatgcagcaggcagctgttgctagccttgtccaagatgctgtgaatgctgcaaagctggcagctgaagctcaaaattatttgaaagctagtcaaggcaatgatcagcatagaaatgcgatttcccgtgggtcttttgttccattgtcagttatcacaagtaaagctgtcgataatgaacctctcgtcaacaataccatcaaaactgatgtaaggaaatctgaaatgaacaggttttctgaggccgacaatggtcaaaaagagccagaaaacaaaccagagcaacaaaagttccgattagaaaatgctaatgatatacggataattaatactgatagttcaatcatcaagtacaaaacatcagattctgttgaacgccatcttgtccataatgaaatcaatgtaattaaagaaaatgaagaaactaacgataagcgagatcacaaacttcccgaaagaatgaaccacgtctctacaaaagtagagaacgtcaccctcccctgtgtcagttctagtattcttgaggctcagctaacatctatgttgaggactaatagtgaaccctcttccaatcaaaattttatttatgccgttgttaatcataccgtcaaggatcagaggagagaagaaaataatcaggatgacatgagggtcgaaggtcttgctgctcacttccaaaggacagttaaaaatgaagagctgatgttgactgacagtgatatgtataaaaattctaggaatcctcttcttaataaaaaacatggcaacatctatgtgagctctcaattaaagactgatacagtaatggtaggaggaaaatcttataaaatttatcaagctgggccacaatcgagtacgagtgacattctgacgttgagggacgacaaggaagaggctaatggcagggttgcccataaagtgaatacattagagcggaggctgtctgtcaataacgagaaatcagcaaacgaaatgcttcaacagagggtcgtttcaagttctgaaacagctgagaaagaaacgcatcacttgagtttcggcgggccgaaaactcaggtagttgctcaaaaggaagaaccaaaaaagtttgttgcgcttgctacgatgttgttaccacggaataatgaagagaaaagagtaaggcctggtgaagactctcaaaatgtgcttcttaaacagctgcttcagaacaccgcatgcgctaccaccaccgcttcgctgcccattgtcccatctttggaggctcagctcgctcgaccagtaccacctacaccatcttctctccttccctcagttttgaacgaacctcctaaagagataccacagccaaaacctcaacagcagataatagaatcaccgaaacaagagtcacgcccccacatcggtccttcatctctggatgagttgctttcgcctccaccgcctcctcaacagctccaacatccaccctcagcgatacagacgagtccgataatcaagcgtgaacccgttttttccttgagtcagcctggcccggtcatgacacccatggtggatgtgaaaagagaagtcgaggttaaaaaagaagtgatgtcttctgatgaaatgttgtcccctgggctgcgtttggatcaggctgactcccagccacaagatatcaaaaagttgaaaaagcgtccataccaccatcaaaagcgaaggcaaagtttgggaaaagaaatgattgggggaaccccgaagaaaaggcctcgaaagagctcgaaagtagaagaagattatgactcttttattgattccgttatgcatcaactcagacagactcctggaatgtcaatttgtgaacctaatctcacttataactttactggatgtcctccgtttggtgctggcgatatgagcaaagtcaattcatgcacacgtcttggtgaattgcgtggtatgtatggtactgcttatttacctcatgaaaacgaccattataatacgttaccttttggagaccttccacctaaagctccatcgacgcctgcaactcagcgtggattctataatgaggaatttgcacctttaaagttacacactgcaaaggatgattttgatgatcggaaatatgactacaaccgagatcgtgacaatgatactcctgatacaatcgtaagttcttccagtccggagtgtattatgccagagttccatccaagatttccagggttgcagttaatagactcagataacgaagaagaaagattcaggttatccaggttttctcctgatattcctatcattgctccattagctataaggccgaagcctatacgattctatagtgacatggataaagaaaatgaaactcctgatggtgagagagggcgcattcgtgaaagcgtgacggttactttaacgctgactagtcaagcagccgacgatgtgctctctgtattacgtaatttagccaatgttctgaggatacctgtacctgccactcacagcataacggagaggagttctgcatcccaccgccttggaatatatcgattgaagggcaaagatgggaaggaaggagctcaagttgatatccagtctattctgaacggaactgcgaagttttgtaggcattgcgatgtcgttataatgaacaatctcatgcggaaaaaagcttcggaaatgcctctagttgccaggcaaggagaggaagatctttatttctgcagcacgtcgtgttatatgcagttggctctctcccattcacagggtcctaacaaggataaggctttaacaattatagatcatgtagaaacaccttccaaaaagactaaggtcgaatcaacaactgactgcagcgctgtaaaaattgaaccaaagaaagaatacaatctatcttccgatcctacttatatgaccacaaggggctcaggaaaacgcgagaaacaaagtagtgcctatgacaaaatggctgtgacaaactcctataatacacttggaaagaaatctccttcaagatatcgaacatggacgacagcaactattccacctccttctgccaggcataagaaacctaccgataaggaaattactgagatgctgttcaagagcggtatcacggttatgcctttgaaattgcctgaggacagtcgccattgccttctttgccatcaagttggcgatggtgtcactgatggtccagcgaggttattaaattacgatgtaaataaatggattcatttgaactgtgccctttggtctgatgaagtatatgaaactgtaaatggaggtttgatgaacgtcgaaatcgcccttcaaaatgggctttctgttcattgtgcctattgcaacacaactggagctactttaaaatgttacaaaatgcgctgttctttagtttaccatcttccatgcgcagtcaaagaccaatgtgtattttttaaaaataagacactgtactgtagcagccatgtaccaaagaacgaaaaggaaaacgaactgaccactttgtctgtcatgaggcgtgtgtacatatctcgagatgaaaatcgccaagtggcagctataatgcaccattctgaacagacatcgcttctcagggtcggttccctcatttttttatctgtcggtcagttacttcctcatcagctgcaagcgtttcatacaccaaattacatctatcccgttggatataaaataataagaatgtactggagcatgcgcacagtcaacaagcgctgtagatacatttgttccatcgcagacgtggagggtaaaccagagttccgtataacggtagaggagcgaggtgaggcagatatggaacttcgcgacaccactccaagaggggtttggttgaaagttttagaacctctggctgagcttcgaaaggtttcctcagttgttcaattgttttctcgatacgttactggtgaagatctgttcggccttactgaaccagcaatagtcagggttctcgaatctttgccaggtgttgaaacgcttagtgactataaattcaaatatggaagaaatcctttactggaattacctttggctgtgaatccaactggctgtgctcgttctgaaggaaaaccaaaaggttggaagagagctcacacgcagagagccacttctcttaggggaggaggaagtggtcctgcgttccccacgtcggctccgctgcctggagaacttgcctgcccctactccaagcagttcgtccattccaagtccagtcaatataagaaaatgaaacaagaatggaggaataatgtttacttggccaggtccaagattcaaggattgggattatacgcagcaagagatttggaaaagcataccatggttatcgagtacataggtgaaataataaggtcagagcttgctgaaacccgagaaaaacaatatgaagctaagaaccgaggtatttatatgtttcgcttggatgaagaccgtgttgttgatgctaccttgtgtggaggtttggctcggtatatcaatcactcctgcagtccaaactgtgttgccgaaacggttgaagttgacagggatctcagaataattatttttactaaaagaagaatttcgcggggtgaagagcttgcttatgattacaaatttgatatcgaagacgaccaacataagataccctgcatgtgcggtgccaccaactgtcgaaaatggatgaattaa

SEQ ID NO: 1677 - DNA, 3276 bp, Piezodorus guildinii
atgtccgaagacagtgaaaatcacagagcccggccgaaaaggaatttgtcagcgaaacaaaaaaaactcgaactacttgaaaaacttaaaagtgggaagaaaaataaatatgacattggagaacttgaaaacgtttatgaagaagtcgatgagaaagagtacactcgtaaagtacttgaaaggcaagatgacgattggattgtcgatgatggtggttgcgggtatgtggaagatggaagagaaatatttgatgatgatttggatgaagaatcaatcaaaaaatcacaaagtattgttactggcagaaaaagaggaagagatattgcccctgaaaagaaaggaaacattcgtaatatgcttgcaaaaatgccctctaagaagaaaaagaaagagacatcagttaaactggaagaagatgatattttaggagacattattggtgaaatagattcaacatcagtggcaccattacaaaacggcaacaagaagcctgtaatatctgaaaaagattatttgaaatctttaaccaattttaaacaaacaagccataaagcatctcctgtgaaacgtgcaaaaataagttctgaagtcaatccacttcctttagttaaagaaaccccaccaaaaaagttggttgatgtaccagttgagacttctcctattaagattaaagaggaaccaatagatgtcgatgagattcaagattacagttgtgatatgttcagtgacgactttgatcaagaagttattgaaatttctgatactaaagataatgaagtatgctcaagagatattaaagtagaacctgcttctcctgtaaaagatgcatctccagttaaaatggaaattgttaaagatgaagtaagtgaagagtgggacaagcaaattgaatttgattctcctgtaacttatgtcaatgtcgataaatctaaattacccctggtgaaaaatgaaagtggtcaagaggttttaagattctactattgggatgctgcagaggaaatgtactcacaaccagggactgtatttttctttggaaaaattctaattgaatcagctaatacttatgtaagctgttgtgtctcagtaaaaaatattgaaagacgtatatttcttctgccaagagaaaggaaaatgaatcttaagactaatgaagcatatggtgatcctgtgacaatgacagatgtttatcaagaattcagctcaactgtagcagagaagtataaaataaagcagttcaaatcccgaaaaatttccaagaaatatgcttttggtgatagtaacgttccttcagagtctgagtatctggaaataaggtatccgtgcacttctacagctttgccaagtgatctcaaaggagaaaccttttctcatgtatttggaacaaagacatcatttttagaaattcttctcttggagcgaggaattaaaggtcctagctggattgagattaccaatgctgagcctgttctagctccatttacttggtgcaaagtggaggcatcctgtatgaaggccagtgatgttaatgtattgaaacctggtttgccgcacattccacctttgattttggttactcttcatccacaagctgtccataatcctaaaacaaaacagacagaaattgtagctgtaggttgcttagtcaataactcataccatgttgacaaaccttcttctgatagactttttaatcaacatttctgtgtgttttcaaagccatctgatctcacttggccatatgatttaaaagaacatctatcaaatttcaagaaaacgtcactggaacgaatggaatcagaacgtgcacttctaaaccttcttttaacaaaattgtatcgaatagatcctgacattattgtcggtcatgatctctctggatatgggatagaattgctagtgaaaagattggcatttcacaaagttcccaattggtcacgtctgggtcgtttgaaaagatcagttatacctaccactaaggctagaaatcaaattgaaaaaattgctcttactggtcgcttaatgtgtgacatcaaagtaactggtaaagaacttattagagctcgtagttttgacttggattccctctgccagctggttttaaatttccaagaaaataaaagacaagattttacagatgaggaatttaaaagttgtttttattctggagagaatttagtcaaagctttgtggtcaataatgacagatgcttcttacatattgagaatatttaatgaacttaatgcacttcctttggctctacaaattactaatattgcaggtaatgtcatgtctagaacattgatggggggtcgctcagagagaaatgagttcttgttacttcatgcttttcacagcaaaggatacattgttccagataaagagtacaaaaagactactaaggatgatgatatagatggcactgcagaagttactactagctcaaggaaaaagccatcttatgctggaggacttgtgcttgatcccaaggttgggttctacgatgatttgattctcctcatggattttaattcattgtatcctagtataattcaagaatacaatatttgtttcaccaccattcctccatcttctattgatatggatgaagattttaatgaaaattatcaaaaatattttcctgaggaaactgtggaaccaggaattttaccaactgaaatccgtaaattagttgaaagccggagggatgtaaagaagctactgaagtcagctgtttctcctgagcagaaaatgcagtatgatattcgacaaatggctttaaagttgactgcaaacagtatgtatggttgcttaggattttcaaattccagattttgtgctaaaggccttgctgctcttgttacagctaaaggtagagagatacttttaactactaaaagaatggtggaatcttttggctatgaagttatttatggagatactgattccattatgattaatactagaactaaagactatgagcaagttcatcaagttggtaagaagttgaaattcgaggtgaataaatgttataaacaagttgaattagatatcgacggagttttcaaatatatgcttctgttgaaaaaaaagaaatatgctgctgttactattagtaagcttccaaatggtgagtttgttgaaaaacaagaaatgaaaggtttggatattgtgagaagagattggtctcagctagctgcagcagccggaaggcatattttaaatgaaatattatcaaacaaatcaagtgatgatagaattgatggaattcacaac

SEQ ID NO: 1678 - DNA, 1401 bp, Piezodorus guildinii
atggcggctgggacccaggttaaaaatgtggaagtccgtgacattgcaagaattgagcgaattggagctcattcccatattcgaggattgggtttggatgacagcttggaagcgagagctgtgtcccaaggaatggtaggacagcaaatggcaagaagagcagctggagtggttttaggaatgattaaagaaggaaaaattgctggaagggcagttttacttgctggacctcctggcacaggaaagactgctattgctatgggaatatcaaaatcacttggtaaggatactccgttcactgcaatggctggctctgaaatttacagtctcgaaatgagtaaaactgaagcccttacacaagccatacgtaagtctattggtatccggataaaagaagaaacagaaatcattgaaggtgaggttgttgagatacaggtagagcgacctgctacaggggtcggtgccaaggttggaaaacttacattaaagacaacagaaatggaaactgtttacgaccttggaaataagatgatagatgctcttactaaagagaaggttcagtcgggtgacgtaattacaattgataaagctaccggtaaaattagtagaattggaagatcatttactagagctagagattatgatgccactggcccccagacgaggtttgtccaatgcccagaaggagagttacaaaaaagaaaagaagtggtacatactgtatctattcatgaaattgatgtaatcaattctcggacccatggattcttagctcttttctcaggtgatactggtgaaatcaaaccagaagttagggaacaaatcaacacaaaaattgctgaatggagagaagaaggaaaagctgaaatttcacctggtgtattgttcattgatgaagttcacatgttggatatagaatgtttttcatttttaaatcgagcccttgaagatgagatggctcccgttgttattatggctacaaacagagggatcaccaatatcagaggaactaattacacatcaccgcatggaatacctattgatctcttggacaggatgattatcatatctacctcgcagtacagggagagtgagcttagggaaattttaaaaattagatgtgaagaagaagattgtgaattatctgatgatgccttgacagttctcactaggatagcaatggagactagccttaggtacgcaattcagctgataacactagctggcctggtttccagaaggagaaagagtaatgaggtagaaatagaagatgtaaagaaagtatattccttgtttttggatgaaggaagatcaacccagatcttaagtgaataccaagatcagtacctgtatgaccagaagcctgatgttggtggaggtggggaaccaatggatatgtga

SEQ ID NO: 1679 - DNA, 1110 bp, Piezodorus guildinii
atgtctatcaggacttatggcgataagccaattagtttccaagttgaagaaaatggagagtattattgcattggttccgaagttggtaattatttacgtatgtttcgaggatccttgtataagaggtatcctggaatgtacagaagaactcttggaaatgaagaaaggaaaagacttatagaacttggattaagttctcattgtttggcctctagcatttctttactcagagcttcagaagttgaagatatcattgagggtaatgatgaaaaatacaaagctgtttcagtccattcttctgagacgcctattacaagttcttctaaacccaagaaagctatgccatgggtaccttcgcttccaaacagttctcatttagatgctgttccacaggcaactcctatcaataggaatagagttgttagcaagaaagttagaagtttccctctctgtttcgatgacactgatccatcatctatcatggaaaatgcttcccaaatggaagttctcgtacctattcgtctcgacatggaaatagaagggcagaaacttcgtgatacttttacctggaacaaaaatgagagtttgataactccagaacagtttgctgaaattctttgtgatgatttagatttaaaccctctcagttttgtccctgccatagcacaagcgattcgccagcaaatcgaaggttttcccactgataatattttagaagattcgagtgaccaaagagttatcatcaaactgaatatacacgtcggaaacacgtctctggtcgatcaaatcgaatgggacatgagtgaaaaagagaacagtcctgagcagtttgcgatgaagttgtgcgctgaacttggattaggaggagagtttgttacggccattgcttattcgattcgaggacagctcagttggcatcagaaaacgtacgctttcagcgaatctccccttcaaactgtagaagtgcctttccgaccgcagtcagaagctgatcagtggtgcccgttcctggagacgttgaccgatgcggagatggagaagaagataagggaccaggacagaaacacaagaagaatgagacgattagccaacactactcctgggtggtaa

SEQ ID NO: 1680 - DNA, 654 bp, Piezodorus guildinii
acagctgctccttgggcaaggaatgtccacttagtagtgttgggagttgctttaagtggttattgttttgtgatggctgctatacgtaaaaaactagttatagttggggatggtgcttgcggaaagacttgtttgttgatagtatttagtaaagatcaattcccagaagtatatgtgcctactgtgttcgagaattatgttgctgatatcgaagttgatggaaagcaagtggagctagcattgtgggatactgctggacaagaagattacgatcggctaagaccactttcttatcctgatacagatgttattttaatgagtttttctattgattcaccagattcattagaaaacatacctgaaaaatggactcctgaagtaaaacatttttgcccaaatgtacctatcattcttgtaggaaataaaaaagatttgcgaaatgatccaaataccatcaaagagttggcaaaaatgaaacaagaaccagttaaacctgaagaaggtagagctatggctgataaaattaatgcctttgactatcttgaatgttctgccaaaacaaaagatggggttagacaagtatttgaaacagcaactagagctgctcttcaagtcaaaaagaagaagaggaaccgcaaatgtaagcttctttga

SEQ ID NO: 1681 - DNA, 3984 bp, Piezodorus guildinii
atgaatcttagtttgagtaattatgaaagagttccacctctggactgttatcagccctcaggaaatctattagatttagctgatcgtatgctagaaaaatttactcaagaagacaataatttgcctcaactgctggacaggctccaaatcacttgtgaaagtggaactacatctagtggaaccaaggacactgattatattaacaatgtagactcaagttatttatcacagatatctcagttcaggttaattaacaagataccacttcctcaggaaatatctgaccagttcagcacccttgcagcaggatcatcaggagatacaactatcatggggatgtttcctgaaataaatagagcttggatggcagttgaaagtgatatatacttatggaatttcgaaacaggaggcgatgtggcatattttgatggtttaagtgaccctatagtgagcgttggcctaatagctccaagacctggagtttttcagagttttattagccatcttcttattcttaccacacctgtagaaataactgttctcggggttattttggcatgttcaagtgatcgaaaagttggtgatgaattgcaactcacaccagataccatttacactttgtctactgatggtgttcctataagagtgattaaaggcacaaaaagtggacgaatatttcttggaggaaaagatggaaacctttatgaattagtttacaggaaagaaatgagctggggtggtaaaagagcttggaaggtgaaccataccaaagctattctgtcctatctagttccaacatttgtgtctggagctttttcagaagaagatcaaataaccgaaataactgtggatgaatctcgaaatgttctgtatacactttcaataaaaggatctattgaagtatttgatctgggtagaaatggagatacaacatgtagagttgcatcacttcatcattcttttattaatcgttgcactgtggatctaattaggaaatcattttatttcaggaatataactcctccagaggttagtcgagtagtgagcctttgccctatttctgaaaatgattctccacattttggagttgttggggtcacagaaaatggaattagattatattttactacaggaagcccacctagaccatctaccttgtcacttcttcatgctaggctaccacctggacatgcccctaacactgccaatgtgagaattggtagagtagctatgtctattcataaatcaggtacatttattatggtatcatccatgggtgactattcacctgaccgcctgtggtgctttaccatggatggtttatctgctttgaagttacccttaacagaatttgtctttacaaatcctcaaaatgctgcaattgctatcgctgaatcaagggaaaatatgagcttgacggatcgtggattacatggacactttctagtttaccagcagaattatccccaggataggtttattattttaagtcagcagggcacagatatttatgaaaagctgaggcctgtggatatatttggtgagctgatgcgagaaaaaggtggtccggactgtgaagaagtaaagcagttctttgcccagcatggttcagatcaagcatgtgcaatggctcttatactagcctgtgaccagaccaatcaacatatggcagaatgggcaacacgtgcattttttctttatggaggtgatcctaaatatgttctgcaaaccattcagcaacctctacaaccatcagcagttaataatcctcttcagcagaccatactgcatcatacattacctttaggtttcaaaccaggtactgttagtaccccactaggagagaagcaaacgcagccctcaagaagtatcgaaacttatggagtgtcgatgtcatctaagcataatggtctttatattttccttagccgaatgcttagaccagtttggttaagaagagttttagatgtcaattacaataaaaaacctatttatctaccaaccattacttgtgaagaactcagtttaaagacagttcaactttttgagcttcgttcatttcttgcaagatacaccttaagctcatcagacgttggctccagtttgcagccagccaacaatacaactgtggtttctccaagtggtcagcgcactcgccttcaagaagcactcattcaagaaaaagcatcgcttgatgccttaaggaatttcgttgagcgaatcacccaagttttctctctttggaaattattatgtgatcatgaattgcctctgattgtagaatctctttctccggaaagtcaagaccaattaatacatattacatttagagaactaattcttaaaggagaagatttatgtcatgagctcatttcaaaattagtcagtttatatttgaatgacaatgcttccgtcgatccaatcagttcaaagctgagagaagtttgtcctcttctttataaaaatgaagatgcaacttgtacaaaagtcaatgaaattcttcaaatggcattggaggaaattgatgaagaagccaagttgaacctgttacgatccgcaattgatctttgtaaaaacgtttctccgaatgttgatattgattcagtatgtaagagcttagtcaaatgtgggtattatgatggagttttagaaatgtgccaggatgtcgctagcaagtctgattcaaattcactggcttcaaagtttatagctagaggtagacctgttgaagatgttgaaggaagcaaggcttttgaagccagacataaggcttaccaacaaatagttcatttattagacttcctataccaacagtgccaactagggggtaataatattcctcctctctttggaagtgctgatttatcttctcattcacagaagcttttggaagctactcttgaaaaatgcttgtcagttgaagatgaaacttgccacattgttgtttatgattggctagtgagccgagaacttcaagcgtcactagtttctttaggcagaccttcagttgagagatttctctcacgatatcctgttgatagcagtctcagagatcttttatggcaatatcatgaaaaatctggaaatcacgctgctgctgctcaaatattatataagattgctactgcccctggtgaatttataactcttcatcaacgattaacataccttggaaaggctgtaatgtgtatgcgaagtgatggagtgggatgtgcatcacatttaggagtatttctccatgaattagaagatttagtacatgttgcacgagtacagaaacagattctagaaaggattacctcaatgccagatgctaatgatattaatgttcaggatgcttgccggaaacttaatgccaatttgctttcaattaccgaattatatgaatcttttgctgaaccttttggactttgggaacaaaaactagccattttagactgtgctggccatgatgataaagaacttattaattctatttgggataacataatactaaaagagcttgatcagtgtaattcaagagacccatctggtcaaatggttgtattagtatcaaaagttagatcattaggtcttcagtttggtatacagtccccatgcttccccattgaatatctagtttggcagttggaattgattagctgcaagcttggagtagataagtttcatgtacacaatatcatgacctcattaggagttccttactccacacttttggatatctattcaaagatgtattcagctaatgataactgttggcttgaatcagataatgaatttcatttaattcaagttatcgcaagcttctgtgaatccttttgcgataataaacagttaacaacatcagcacaagaaagaaaatcaactgcggtacaaatgcacgacttaattaatgaatgtataatcgtccttcatagcaaaactggcttgggggaacttgttggatatcttaaaagcatacaaactaaactagaaaggatttag

SEQ ID NO: 1682 - DNA, 3624 bp, Piezodorus guildinii
atgtctggaagtgatttctatggggctgatactttgcataaagaagtctatattaggaaaggccatgaagactggaatgaaataagtttgaatccaggagggattgcaagcactctccaggacattaaaacccagcaaagagcaggagcttatgcatacaaaaagattcccaatagatttatatattggagaactgaaggaaatgtacttgaaattgttgaagaatgtcttgatataacattgcatggcaaccagattagatacaagtttactgatagccaagtgttggatggtttggctattgttgaaactatgaaaagactaattattcttgttcctacagtatctagtcttcatgttttcacttatccacatcctgagaaactcctgaaaaaggggtttggtgaagtatctagcttgtcagtttttcatggaattagtgaaaatgatgcaactgatccacagacctactaccaactgaattgttcttccagtgccattgtcagctgcacatcttgtatcacaaataatggagaagctatctttgctcttgggttggcaaatacatcagttcttcttgtcaacatagattctgttagtggttcatctagttctcgtattctttctcatgacaacattgttcctcgatttcttaccggaattttaggaaaggacggtggagaatgggttccaatttgtttgattttgcattacataaaaaaagagctttttctcttttcactttgtagaggaggaagccttcgtgtgtggtcagttgatagaggatcatttatcacttctctatgcgtgaagtcaacgagtcaaaccacgttgaaagctcagaaacataagatgtgcaaaggatatataaatggaacttttgtattgcattgttgtgtacaaggagctgctattgtaacattggctcctgattatgataatggtacattcaacttcacaaccatttcagaaatacctattcaacctggttttgaagttacaaatatgtgtccaggagaggagggatacttttggtgtagttggttgacacttgatgaatcacctgctgtaaccaaaaataatgtaattcatcctggattttctaaggttgctttaaccagaccttcccttcaagtgccagtgtcagactacattcctagagatccagcttctcattacttagatgctatattttcctctggtttcttcacttctttagacatagctaaagcaatttcactgtataaaataactgctgttataaaaccaaatatagatgttgctgaacagatttgtgccatagtggaaactgaaatttattcagaaataggtgaacaagaattggatgatgatgaatttttagatatagcttttaggtgttggaatcgattatattcatgttgcagtcagtatattatttcaagtatgcttccactaggaatggtttggcttggagattacttagttttaattcaagaatgcggtttctcaatagttgttgatattgagccattagaactttttatgacaactggtgtaaagtcctcacaatttccacaagttggatatggctggttggtggaaagactgagggatattaatttagatccaggtattgagaagttagaattgagtcttcataccggagaatcaattgatgaactttctgttcttcaagaagctgctgatctcatttcaccttctaaacagcttgatgatgctctaagcatgttttatgaggaaggcttaagcagaagtttaaacagtcttattgaagaattagctgtgcctgaagattttaataaagatggatcttgggaatcattttgtagttatagtggtgttggtgctgtaacatctgcatttcgagactatgttgctgtgagattaaagatttgtgaaaaaatattattaattactgaactcgctatgagggatgatgatggtgctgcagataggactcaacataggagcttagctgccctttgtaaagcctattatattttaaaatggatctgcacatcaaagtccactggaaatgcacctttgattcatgtgttttcattggtcaatccaacatcaattatgcaatcttctcttgaacaatgtgttcttggcctcgcaaattgcttatggcccctagcgacaaattgtacacttgctcaacatttactgtctacaaaacaatattcccttctacaaactttagcaagattggttggaataaataactggagtttactactggcagaatcgtacattttgactggacagcctggtaaggcatttgatgtttgtttaaagaatgctggttcagatgtggtgcacttccttaatgctataagactttttgaaaaacattcaagatcagatttagttatagcaatggctactaaagccttggaacttcttattgtttcacattctgatagggaaacacttgaatcagctttattcattcatgaattaggaatggaaaattatgatgctgcttggagttggattgaatcatgtagttcttggtcccgcagatctgactttttgcagcgtcttgttgccaacatgatatcggaaggaaaactcactgatcttatctcattttcttatactgggctcctagatgagttagaaaagcttctggcttcccgtgctagatctttgacttttggactagctactaactactataatatcttatatgctttccatgtcaaacatgaaaattttaagaaagctgcaagtataatgttggaaaaagctcttcgtgcagaaacagctgaagtacagtggaaatgttatggcgcctgcctcagctctttgatgttgataaatgattccaagcaagcgtggctggtacgtcctaatccattctctcaagaggatgctgtagaaatactagaaattgaggatattcaaagagaatttgaattatctggagctcgtttcaatttagatgggtgttcaccggatgcttctcaggaagaggtaattgcattatgtgttagtcaaaaacaatataaaacagcacttcgtctagcaaccatgtgcaaactttcttgtgctccttgtattcaagcttttacagctagctgtgttgctctttctgaacaatcaatatcctggcattggctgaaagcaaatgaaatagatgatattattataactgaatctaatgcaactgaaatgttatggagaattttagaaagatgtataatgaaatatgaaaaaaaaaatgaaacagtgcttcatcgggcttgcgctaaccaattcttaactgttggtttgtttattcctacttggcttcttcaatcttataagaaaagaaacagctcagaattgcttcgtatgtttgttcaacatggatatctggaagaagccgaagaattagcctgtgaatacttaaatgctgctcttgggattggtagagaaaatttttcaattgattttccattacatctttcatctcctcctctctgtctacctttacaaaccattgatgttttacttctagagctaaaacattataatattggtgaacgactacaaaaaaaattggatacttatgtaagcacaatatcaaggataactttggaacgaccaatgatgttgcctacaaaatattaa

SEQ ID NO: 1683 - DNA, 2901 bp, Piezodorus guildinii
atggagatatcagaggaaaatttacacaccctctctaactatttaatgcagacactaagtccggacccaaatgtcagaaggcctgctgaaagattcctcgagtctattgagataaataagaactatcctattttactcttacaccttatcaataaagaagaaatccattacacaattcgtgttgctggtgcaatcactttcaaaaattatactcgcagaaattggccagtaaacgatgataacttggaaaacaagattgatccagaagacagacaaagggtcaaagagttgatagtagatgttatgttggtagcaccttctagtattcagaagcagctttccgaagcaattggcactattggaaaatgtgactttccaaaagattggccagggctactgacaaatatggtcgaaaaatttgctggaggtgacttccatgttataaacggaatcctccaaactgcccactccatattcaaaagatataggtatgaattcaaatctcaaaagttatgggaggaaattaagtttgtgcttgacacattcgcaaagccgttgactgatcttgctgtggcaacacaaaatctaacccaagttcatgctgcgaatccagatgcactgagggtgatttattcatcattgcttctcatttcgaagatattttactcattgaattttcaggacctgcccgagttctttgaagacaatatgaatgtttggatgccactctttcatacactccttactgctgatgttaagtgtcttcaaacagatgatgatgatgaggctggaatacttgagcaactaaggtctcaaatctgttcaaatgtttcactttatgcacagaaatacgatgaagaatttcaaccttaccttcaaggtttcgtcactgatatctggagccttcttgtaacagtttcacttcagcctaaaaacgatctgcttgtgagcaacgcactgcaatttttgtctacaatcgccgaaagacaacagtatcgacacctcttcgaagataaaaatgttctcactggaatatgtgaaaaggtcatcatacctaacatacattttagagacgcagatcttgaactctttgaagataacccggaggagtacattagaagagatattgaaggttccgatgttgagtcaaggagacggtcatcgtcagagcttgtcaaagtgctcgcaggtcacttcccagaaactgtcaggactatttttggtgctaggttacaggaaatgctcgctgaatacaatagtgatccagctaaatggaggttgaaaaacacagctgtatacattgtgacctctctggctgaaaggggttcaacggcaaagcacggggtaacaaaatcctctgaccttgtggaccttcatgattttgcagggcaatatattattcctgagctcaaaaaagatttgaatacgttgcctgttatcaaagcagattctatcaagtatcttatcacctttagaagcctccttgctccacaggtgctgataactgctttacctgatatagtgaagcaccttgcatctcccagccttgttgttcactcatatgctgcatcggctatcgacaagttgttgacactgaaacagaacaatcaaccattaataacacagaccctactgcagccgattgctggagatatcctcactggtctttttaatattctaaacttcaagggctcagaagagaatgaatacgttatgaaagctataatgagatctttcaacaccctggacgagtccgttattccattcttagccgaacttcttcccaagctgacgcaaaagctcaccgttgttgctaagaacccaagtcgcccacacttcaaccactaccttttcgaaaccatatctctctctattaggatagtgtgtaaaaataatcctggtgctgttggcgcatttgaagaagctctctttcctaccttccagataatatttcaagaagatgttcaagagtttgtgccgtattgtatgcaagtgctgtcattaaccctcgcccggaggtcacctcccctccctgctccctacgttgccctctatccttgtctcctgtcgccacagctctgggaaaggcctggctgtgttcgaggtctcgtctgcctcctgcgttcctacgtcagggtctcatccaatgatgattttaaccagacagttaaagttaatgggcttcttggagtattccaaaaattgatatcatctcggctgaacgaccatgaaggtttctacctgatgcaatcactcatagaacactgtccaagggaactccttgacccgttcatgaagcaggtagttctcctcctcttccagaggctgactgcggctaagacgaccaagtatgtcaaaggcctgatcacgttcttctgtttgctggtcgtgaagtacggggcaccaacgttcatagaacttgttgactctgtacagcctcagatgttctcaatggtagtagagaggctcattacccctgactgtcgtaaagtatcaggaactgttgagaggaagattactgctattggtttgtcacgcctcgttgctgaatcaaaacaagttttctccggaccatactcagcctgctggccagctctagccaagagtgttgttgaaattttggaagccccagaagatgattccgttgctcctgaagatcacttcgtagaggtcgacaatttaccaggctatgaaccagcatacgtccacctcactgcagtcggcaatgataagcatgatcctgttcctgatgttactgatttgagaagagaatttgcaaatgggatccgtaacctcctgcaggtttcaggacaagtcgtgacccaagccatcgctagcctcggagaaccttacgctagtcacatcaagagctatctcattttggtaggagttaacatatag

SEQ ID NO: 1684 - DNA, 576 bp, Piezodorus guildinii
atggcgaaagtccagataggtaatgttttggtgcttgataatccctcctcttttttgaatccgtttcaattcgaacttacattcgaatgtatcgaagaattgaaagaagatttagaatggaaaatgatctacgttggctctgccgaaagtgaagaatatgatcaagttttagacacaatttatgtgggtcctattccagaaggaagacataaatttgtctttcaggcagatcctcctgatgttactaaaatacctattgaagatgccctaggtgttactgtggttttactaacttgttgttatcgtggacaggaatttgtgcgagtaggatattttattaataatgaatattctgatccagagttgagagagaatcctcctccagtgccgcagtttgacaaggttgtcagaaacattttaggctctgaaccgagggttacaaggtttaaaatcaattgggatgattcagaatcacaagatcaacctagtcaagaatcagaagaacaacaacagacaacagaaaatgtagcttttgctgaaaatagtggaagtcataattttatggaagtatcttga

SEQ ID NO: 1685 - DNA, 1011 bp, Piezodorus guildinii
actataacctactgcattatctgctgtcaacaaaacaatactataattgtgtttataatttctcatggtgtattatttacgtttttgatctttaattttcatccctatatcaaaatggatcatatgctcgcgagtccgtttaatttacctagcataggtactcctgtccatcaacctgaagaagatcaacaaatattgcctatagcacaacagcagcaacaacaacaaatacaaccacctttgcaaatgccccctttactaccaatacaatcttcaattaatcaaccaaaacctatgaacacttatgccccttcaatgggttttacaacaccacagagtatgatgcatccacaaacaccacaaaatctcatgtcaccaatggtgaatagaatggaacagacgccgaacaatattataaatcccaccactcctggaccaatgacacccatgacaccatcatcggcagaccctggctttatgccgcagttacagaatatagtatctactgttaatttaggttgtaaattagatcttaaaaagattgccctacatgcaagaaatgctgaatataatcctaaacgatttgctgctgttatcatgaggataagagaacccagaacaacggcactgatttttagttcaggaaaaatggtttgcaccggtgctaagagtgaggatgattctaggctagcagcaagaaaatatgcccgaataatacaaaagttgggattccaggcaaaattccttgacttcaaagtacaaaatatggttggtagttgtgatgtaaaatttcctataaggttagaaggattggttttaactcatggacagtttagcagttacgaacctgaactgtttcctggacttatttatcgaatggtgaaacctcgtattgttttattgatatttgtatcaggaaaagtcgtactcacaggtgccaaagtacgtcaggaaatttatgaggcttttgataatatctatcctattttgaaaagtttcaagaaacaataa

SEQ ID NO: 1686 - DNA, 483 bp, Piezodorus guildinii
atggcttctgtcggcacaaccagatctgttttgaggcttctttcttcccagcctattttaaaacaagctgttcgaggctatgccgatgagatggcattcacatttgctgcagcaaataaggttttctatgccaattccaatgtgaagcaagttgacgtgccctctttcagtggagcatttggtatccttccgaagcacgttccaactcttgctgttttgaaacctggcgtcgttacagtttttgaacaagacggttcatccaagaaagtttttgtttccagtggaacagtcacaattaatgaagactcctcagtccaagtgctggctgaggaagcccacccagtggaggacctggacgcctccgcggcgagggagcagctctccaaggcccaggcagatctgtcgagggcgacctctgagatcgagaaggcagaggctcttatcgccatcgaagtagctgaagccctcgtagcagctgcataa

SEQ ID NO: 1687 - DNA, 936 bp, Piezodorus guildinii
atgccttcggacgagcaagataaatttgatggtatgttgttagctatggctcaacagcatgaagggatcaaagatcttcttgatactttcttcagtttcttagcaagaaagacagatttttatattggtgctcaagcagatgctgctagatctttggttatagattcatttgagaaatatcagtcaaaagcgaatttggccgcagaaaggaaaagaacagaaaatgccgaagctgaaaagaaaaggaaagaaaggctcgctgctaaagccactcctaaagtgatggaaataagcgatgaagaagcacaaaaaattgaagatgaagaaaaaaagaggaaagaagaagaggaaaaagctttgtcgaaaccaattacagaaacagaaggtgaagatgatgaacaggacaaaggaaaactaatgccaaatgctggaaacggtgcagatcttgagaattacaggtggacccaaacacttcaagagttggaaatacgggttcctcttaagaccacattcactgtaaggtcaagagacttaatagtagatctgggcaagacacatctgaagataggattgaaagggcacgaaccacttgtggatggcgaattagagcatgaaatcaaaattgaagaatctacttgggtcattgaagacggcaagacgctgtttctgacagttgaaaaagttaacaaaatggagtggtggtccaagctgtttgctacagatcctgaaattgccacccgaaaaattaatcctgaaccgtcaaagttatctgatttagatggtgaaacacggggtttggtcgaaaaaatgatgtatgatcaaaggcaacgtgagcttggacttccgacctccgatgaacagaagaaaaaagacatgctcaaaaagttcatggaacaacatccagaaatggatttttccaagtgtaaattctcataa

SEQ ID NO: 1688 - DNA, 429 bp, Piezodorus guildinii
atgacaacaccttggagtccagacaaaaagcacagtgatagagaaagatggatttgcatttacccagcttatttgaacagtaaaaagactcgtgctgaaggtagaattgtcgcaaaagaaaaagctgtagaaaatccaacctaccaagaaataagggatgtgttatcagcagctggtttgaaagttggtgttgaaaacaaactttattgtcgagagaagagtaaagagcttctctatagaggtagaatacgggttcagttaaaaaatgataatggtactcctctcaacccagatttcgctaccagagaatctgtaatacttcatgcatgtgcaatgattccaaagctgaaaactcgccaaggtggaaaacatacaactgagcaaggtcagggtggaactagcaagaagaagggaaaagggagaagataa

SEQ ID NO: 1689 - DNA, 2031 bp, Piezodorus guildinii
atggagaagcctcagaaaatgcctaaagtagccaaggttaaaaacaaagcacctgctgagatccaaatcacagcagagcagcttttgcgagaagctaaggaaagagatttggaaatagttcctcctcctcctaagcagaaaatctcagatcctgaagaattagccgattaccaacatagaaaaagaaaagcttttgaagataatattaggaaaaatagaatggtaattagtaactggatcaagtatgcacagtgggaagaaagtcaaagacaggttgatagatctcgatcaatctatgaaagagcccttgatgttgatcatcgaaacatcaccctttggttaaaatacactgaaatggaaatgaggaatcgtcaaatcaatcatgcaagaaacctttgggatagagctgttacaatacttcctagagcgaaccaattttggtataaatatacttatatggaggaaatgcttggaaatgttgctggttgcagacaagttttcgaaagatggatggaatgggagccagaagaacaggcttggctaacttacattaaatttgaattacgttataaagaaatagaaagagctagggaaatttacactaggtttgttatggttcatcccgatgttcaaaattggaaacgatttgcaagttttgaagaaaggcatggattcatttctggtgccagaaaagtttatgaaagagctgttgaattttttggagaggatattatggatgaacgtctatacattgcttttgccaaattcgaagaaggacaaagagagcatgatagggcaagggtcatttataaatatgctcttgatcatcttcccaaagaacgaactgctgaaatatacaaggcctacactattcatgagaaaaagtatggggacagaactggcattgaagatgtaattgtgagcaaaaggaaataccaatacttggaggaagtaagaacaaacccgaacaattatgatgcctggtttgacttattgaggcttgttgaagaagagggtaatgtagatactattagagaaatgtatgagagagctattgcgaatataccaccttcaagggaaaaagatatgtggaggcgttatatctatttgtggattaattatgccctttatgaagaacttgaagcagaagatgaagatcggactagacaaatttacaggacatgtcttgacattattccccacaaaacgttcacgttcagtaaaatatggcttttatatgctcagtttgaaatcagacataaaaatctttcaacagctcgcaaaacactggggatggctttaggagtgtgtcctagagataaactctaccgaggttatatagatcttgagatacaactaagggaattcgatagatgtagaacattatatcaaaaatttttggagcatggtcctgaaaactgtattacatggatgaggtttgctgagcttgaaacactgttaggtgacacagacagggcaagggctatttatgaactggctgttaatcagcccaggcttgatatgccagaaattctgtggaaagcttacatcgattttgaaataaacattggtgaagctaggaatgcaaggcaactatacgaaaggcttttagagagaactcaccatgtcaaggtctggatgagttatgttaaatttgagatgtctcatagccaagaagagggaatcgaacctatttcattagcaagaagaatttatgagaggggtaacactgctttgagagaatcgggagaaaaagaagaaaggttattgttgttagaagcatggagagagatggaaaaagttcacggtgatgaggaaagctataagaaagttgaagccaaacttcccaggagggtccgaagaagacaagctgttattgctgcagatgggagtgaagaaggttgggaagaagtttacgattatattttccccgaggacgaagcagttaagcctaatctcaaacttctggagaaagcaaaagcttggaaaaagaagcaagaagctgataaccaaacaaatgatgaagactga

SEQ ID NO: 1690 - DNA, 1431 bp, Piezodorus guildinii
atggctatcaagtttttggaagtaataaaacctttctgcagtatattgcctgaaatagcgaaaccagaacgaaagatccagtttagagagaaagtactatggactgccatcacacttttcatctttttggtctgttgtcagattcctctattcggaatcatgagttcagactcagcagatcccttctattggattcgtgtgatccttgcctcgaacagaggtaccctcatggaacttggaatatccccaatcgttacttctggactcattatgcaattgctagctggagcaaagataattgaagttggtgacacgcctaaagacagggctcttttcaatggagctcagaaactatttggaatggttattactgtcggacaagccattgtatatgtaatgactggaatgtacggagaccctgctgaaattggagcaggtatttgcttgcttatcattgtacagctgttcgttgccggccttatcgttcttttacttgacgaacttctgcagaagggttatggtcttggctctggaatctctctcttcattgccacaaacatctgtgaaactattgtgtggaaggcattttctcctgctactgtcaacactggtagaggcacagagttcgaaggtgctgtcattgcacttttccatcttttggctacaagacaagacaaagtccgtgctctgcgtgaagctttctatagacaaaatcttccaaatttaatgaacttgctggctaccattcttgtgttcgccatagttatatatttccagggattcagggtagatcttccaatcaaatcagctcgttaccgtggccaatacagcagctatcctatcaagctcttctatacttcgaacattcctatcatccttcaatcagctcttgtatcaaatctttacgttatatctcagatgctggctgtgaaatttcatggaaatgtatttgttaacatgctcggagtgtgggccgatgttggaggtggtggccctgcccgagcttatcctgtcgggggtctttgttattatctctcgcctcctgaaaatcttggtcacatcctggaagatcccattcacgctatgctctacattatttttatgcttggttcttgtgctttcttctccaagacttggattgaggtttctggctcatcagccaaagatgttgctaagcagcttaaggaacaacaaatggttatgcgaggccatcgtgacaattccatgattcacgaactgaacaggtacatcccaactgctgcggccttcggaggtctttgcatcggcgcactttcagtcctagctgactttatgggagccatcggctcgggaactggtatcctcctcgccgttaccattatttaccagtactttgaaatatttgtcaaggagcagagtgagactggtggcatgagcactcttctcttctaa

SEQ ID NO: 1691 - DNA, 522 bp, Piezodorus guildinii
atgtgcgaactgaacgttctcgcttctgtgagcccgtccatcgtgactccttcggtggagctgagcacctaccgggaccggaggttcagtggcaccaagagcgaacaggaagagaccctgctgcactcctccacgctctatgtcggcaacctctccttctacacgacggaggagcaaatcttcgagctcttctccaagtgcggggacgtgaagaagatcgtgatgggactgcacaagttcaagaagataccctgcggcttctgcttcgtggagtactacgagaggcagagcgccgagggggcgatgaggtacgtcaacggcacgcgtttagacgaccggatcgtgcggacggattgggacgcagggttcgtggaggggaggcagttcggacgaggccgcagcggaggccaggtgagggacgagttcaggagggactacgacgcggggcgaggaggatacgggaagatggtgcaagaggtgagcagcaaggcggaagttgcaaccatcttcgctggccagtga

SEQ ID NO: 1692 - DNA, 963 bp, Piezodorus guildinii
tttttttttctctccacaccatctaaaatggctgctgctataggtcgggtatatggctctagacttttaaaaattaatccagtttctaaacattttcagattggcagcttttctactactaaatcatggtcaagagggaagaaagctttgtatacctcactcggtattttaactggaggtacaggcatgttgatatatgcccttgaaaaaagtcttcaagcaggagatcttgaactccatcctcccaaacttccttggaaccatagtgggtattttcaagcactggatcatgcaagtataaggcgaggttatgaggtgtacaagaatgtgtgtgcagcctgtcacagcttaagatatgtttgctatcgagatcttgtaggtgtttcacacactgaagcggaggctaaagcagaagctgaagaacaacttgtattagatggtccaaatgaacttggtgaaatgttcaaaaggccaggaaaactttctgatcatatgcctagtccatatccaaacgaagaggctgctagagcagctaataatggagcatatccccctgatctttcatatatagttcctggacgtcatggagaagaagattacatattccacttattaactggctactgtgatgctccagcaggtctggttttaagggatggccagtatttcaatccttattttcctggaggtgccattagtatggcacaagctttatataatgagattattgaatactctgatggaacgccagccactcaaagtcaattagctaaggatgtcgcaactttccttaaatggacctcagagcctgagcatgatgtgcgaaaacaaatggccttaaaggtaatgtttatcttttcaatcttcatagctgctactctttactggaaaagacacaagtggagcactctcaagagccgaaagattgtgtttagaccaccttcatctccaccaaaagtgtaa

SEQ ID NO: 1693 - DNA, 1728 bp, Piezodorus guildinii
atgttagctttacaacagtacggagaaagcgacagtgataaagatgaagaagaaaagaaagaagaagttgataaagatgctttgctgcatttaacgcctctttctactggacaatcatctataatacagactgctatttgtcccgcaccggctgctttaccacctgttgagtacaatccgctgaaattcattaaacctggttgcactgagatgactgtaaatcttaaatatgaagaactgtttgctgctgatgttgggcctgagaatccatatcttacagatcaacaaaaggctcccaaaaatattctctcaggttatgttgaagcagctcatatgagcgaatttcagtttgaaaatcagaggaaaacttttcaaagtttcggatatgctcttgatccttcgattgataatatgggtcgcagcgaagacggtatacccgttgtaggagcagtagaagttgcgaaggaaaccaatctcaagacagtttttgaatctacttccaagcgacctcttgatagaaggaaaagaaacaaaaacgacgatccgtctgatatcaatggcttcctcggcccgtgggggtcttacgttgatgagaagaaagttgttaaaccagatcctgaagttgctgctgaacttgaagaatacctcgctaagaggcaaaagctcggtaaaaaagttgaagataaacctctggaagagaagactgtccttcatatcaaagacccagtggattaccagggccgcaacttcttgcaccctcctcaggatgtcggcgtcaacctcaagtcagactctcctccggacaaatgtttcatccccaagtcagaaatacacgtttggaaaggacataccaaaggaatctctgctatccgctggtttccaaaatatgcacatcttctcctatcgtgcagtatggattgtcgtgtcaagttgtgggaggtatataatgaaagaagatgtattagaacctattatggccacagacaagctgttagagatgtttgctttaataaccgagggactaaattcctttcagctgcttatgatcgctacataaaattatgggatacggaaactggagaatgtatatcacgatttaccagcagaaaaattccctattgtgtgaagttcaatcccgatgaagacaaacaaaatctatttgttgctggaacctctgacaaaaagatcatctgctgggacttgcgatctggtgaaatagtacaagaatatgacaggcatttgggagctgtcaattctatcacttttgtggacgagaatagaagattcgtcactacttctgacgataaaagtttacgtgtttgggaatgggacatcccagtcgacatgaagtatattgctgacccatcgatgcattccatgcctgccgtaaccccctcacctaaccagaagtggctcgcgtgccagagcatggacaacaagatagtaattttctccgctcttaacaggttcaaattgaataggaaaaagacgtttactggacacatggtcgcaggttacgcctgtacgcttgacttctccccagatatgagctacattgtatcaggtgatgctgatggaaaagcctatgtatgggattggaaaacgacaaaactcttcaagaaatggaaggctcacgatcacgtgtgcattggtgtcctttggcacccgcacgagccgagcaaagtggtcactgcgggctgggacggtctcatcaaatattgggattaa

SEQ ID NO: 1694 - DNA, 807 bp, Piezodorus guildinii
atggtccaaaagaagcccaagaagaagacagggaagaaggttgcagcagcacctcttgctgttaaaaagcaggaggttcagaaagttgtgaatcctctgtttgagaagagacccaggaattttggcattggtcaggatattcaaccttctagagatctaagtcgatttgttagatggcccaaatatattcgtattcagcgacagaaatctgtattacagaagaggctgaaaattcctccttcaattcatcaattttctcaatcattagataaacaaacagctacccagttgttcaagattcttgaaaaacatcgacctgaaactgcactggccaagaaacagaggttgaaggccagagcagaaggaaaaattaaacaaaaggaagaggttccaaccaaaaagactaatgttattaggtcaggtgttaatactgttaccagattggttgaacagaagaaagctctgcttgttgtgatagctcatgatgttgatcctatcgagctggtgcttttccttcctgcactatgcagaaagatgaatgtgccatactgcattattaaaggtaaggcacgccttggcaggttggttaggaggaaaacctgttcttcaattgcagtaacccagatggagggtaatgatcgtactgctttaaataaggtcattgaagctgttaggactaactacaatgaccgatatgaagaaattaagcgacactggggaggtggtttgcttggctctaagtcagcggccaggatagccaaacttgaaaaggctaaagctagagagttggctcagaaacaaggataa

SEQ ID NO: 1695 - DNA, 1005 bp, Piezodorus guildinii
atggctaatatgataaaagatgttacaattgatgataagatgcccaatgagcttttattggacaagcatataaaattcgttttagcttatggagctaataaggatgaatatgaatattgtacaacagagcacttgagaatgtctggtatgtactggattttaacaactttagcagttaccaagaagttagatgaagttgacaagaagcagtttattgactttatacttgaatgcactgatgagaaaacgggtggtattggtgcttgtgttggacatgatcctcatatcttgtatactctgagtgctgttcaaattgcttgtattttaaggtcattagaccaacttcccctagaaaagattgttagttttgtgtcaagtttacagaaagaagatggcagttttatgggtgataagtggggagaagttgataccagattttctttctgtgctgttgcttgtttatctttgatcggtcgcttagatgctatcaatcttgaaaaagcagtcaattttgtgttaagctgtcaaaactttgatggcggttttggttctcaacaaaattctgaaagccatgctggattaatctactgctgtgttggtgttctgtcaattacccagaacttgtatagaatagatgctgatcaactgggttggtggttatgtgagcgtcaactgccttcaggtgggctgaatggaagaccagaaaagctaccggatgtttgctattcctggtgggtcttgtcttcattaacaatgttaggaagactacattggattgataaacagcttttgaaaaaatatattcttgctagccaagattctgaaggaggttttagtgatcggcctggagatatgccagatcccttccatactctttttggaattgctgctttgtcactgttaggagaatcagatttaatgaaaattaatccaacttattgtatgccacaatatatcattgatgaactgaacttggatcctgaaattatgcagtcacaatcataa

SEQ ID NO: 1696 - DNA, 2748 bp, Piezodorus guildinii
atgatgttgaaaatgaatagcgaagccacagcacagcttatacaaattttagagaagactgtttctccagacaaaaatgaacttgaggctgctcaaaattacctggaacatgctgcacaaaccaatttggctgagtttctgcaaacattgtcacacattctccagcatggcggtaactcaccagttgcacgtatggcagctagtttacagctcaaaaataaccttacctccaaagatcccagtatcaaagcgcagtatcaagctagatggctcgcatttccggaggaaactagaatgtatatcaagaaaaatatcctaggtgctttgggaactgaaaacacaaggcctagctcagctgctcaatgtgttgcttacgttgcagtagccgagatacctgttggtcagtggcctgatttaatcccaacattgtctgctaatgtaaccggaccctcttcgactgaaatcatgaaagaggctactcttgaagcgattggttatatttgccaggaaatagaacacgattgtttagctagtcaatctaatcaaattttaacagctatagtacatggaatgaggtctgctgagagaagtaattatgtcagactggcagcgacaacagcactccttaattcccttgaatttaccagggcaaatttccaacaagatatggagcgtaattacttaatggaagtagtttgcgaagctacacagtcaaccgatacacaagtccgtgttgcagctcttcagtgtcttgttaaaattatgactctctactaccaatatatggagacgtacatgggtcaagcattgtttcctattactttggaagcaatgaaatctgatataaaggaagtggcacttcaaggaatcgagttttggtctaatgtctctgatgaagaagttgacctagctatagaagaatcagaagcagtagaaatgggaaaacctccagctagaacatctcgttattatgcaaaaggagcactccagtatcttgttcctgtagttctcaccaagttgactaaacaggaggaatttgatgatgaagatgattggaatccaagcaaagctgcaggtgtttgcttaatgttactggcaacatgctgcgaagaagacattgtgcctcatgtgttgccatttgttcaacaaaatattaagtctccagattggaggtatagggatgctgctgtgatggcttttggctcaattctgagtggacttcactctaacacgttgaaacccatggtagaacaagcaatgcctactcttattcaattgatgtatgactcttcagtcgctgtgagagacacagctgcgtgggcatttggtcgaatttgtgaaatagtacccgaagcagctacaaatgaaaattatattaaaccccttcttgaatctctgctcaatggcctcaaggcagaaccaagggtagcagcaaatgtctgttgggcttttactgggttggctgaggctagttatgatcaggctgaaaatcaggttgaagatggttctcagcctgagacttacatcctctccagatatttcgagtacatcgtgcacagccttctagctactactgatagggtagatggggcacaggctaatctacgtcctgctgcgtacgaagcacttatggagatggtgaagaactctcctaaagactgttataccgttgtccaaagagccacactcattatattggatcgtttaaatcaggttctggccatggagcaacagattcaaagccactcagatagagcgcagtttaatgatctccagtcactcctctgtgccactctccagagtgttctaaggaaaatgaccccagaagatgcaccccaaatatctgatacaattatgaatgctcttcttcaaatgttcaattccaattcatgcaaatcaggttcagtgcaagaagatgcgataatggcagtctcaacactagttgaagttcttggtgatggctttataaagtatatgccagcattccaaccgtttctgtgcatgggcctcaaaaatcatgctgaatatcaggtttgttgtgctgccgtgggtctcactggagatatatgtcgggcattgaaaaacaaagttcttccatattgcgatgatattatgcggcttctccttgaaaatctcagtgataacagtgttcaccgttctgtaaaaccacaaatcctatcaacttttggagatgttgcattaagcattggtgctgattttaaaaagtacttggatgtagtacttcacacacttatgcaggcttctcaggcacaagttgatacgagtgacttcgacatggttgattggttaaatgaattaagggaaggaattgttgaagcctactccggtattattcagggattgaaaggggaagataacaacacagctgcaagcgctgccaatcttgcactgcttgagcctcatataccagtgatggctcaattcttaacctgtgtttcaagagacacttctaagcaagataaagtgttggctggctctgctggtctagttggagatctttgttctgcttttggtgcaaaggttatacccctgttggacattgatccaatcaatgagctccttacccagggaaggagatcaaggatcaacaaaacaaaagctgtttccaattgggcctcaaaagaaatgaggagatacaaagcaactattgctaatgctgcctcatgcgggagtgaagtggtgaccaatggtgctcaggcgatgatgtcaccaccaggtgccatgtaa

SEQ ID NO: 1697 - DNA, 1506 bp, Piezodorus guildinii
atggagactatattggagcaacagagacgatatcatgaagaaagagaaaggctgatggatgcaatggtcaaagagatgttgcataaaaaatcaagttatcgtgagcaaattaactcagatcacagactcaagatgcttcttgatcagtatatggagagcactcacaaactcaaggaactgtatgaagacaaggatggtataaggaaagatgaagttgctgcactttcaggtccaaatgaattttctgaattttattcaaggttgaagaccattaaagaattctatcgtagaattcctaatgaaatttcggttcctatgtctgttgaattcgaggagttagcgaaacttcgagaaaatcctactgaagaaacatcaaatttagtagaatttactgacgaagaaggatatggaaaatatctcgatcttcatgaatgttatgagaaatatatcaatttgaaaggagttgagaaagtggattatatcacatatcttactacatttgatcgactttatgaaatcccaaaagatagaaagagttctgagtacaaacgatatgttataatgctcctgaattatctttgtgattacatcgctaggatcaagccactacttgacctcgaccaggaattaactaatgttcaaaaggacttcacatcacagtgggaagctggaactttccctggttggcctaaagaaacaggcagtgtgttaagcaatgttggtgcccatcttgacttgagtgcattttcatctcctgaagaattggcttctcttggtctggacaggcttaagtcagctttgatggctttaggattaaaatgtggaggaactttagaggaaagggctcagcgtttattcagtactaaaggaaaaaagtccttggatccgaatttacttgccaagtcaaaaccaggtaaatcgaatcgagaacgtgaccttgaaagacagcgggatattgcattcttagaagctcaagtttacaagttggctgaattactaagcgaacagcgagctgctactaaagaaaatgttcaaagaaaacaagccagaacaggagaagaaagaggagattcagaaggtgaagcgtcatcttcaggaagtgaaagtgagggagaagatgatggtgttccgtacaacccaaaaaatttacctcttggctgggatggaaagcctattccatattggctttacaagttacatggactcaacattagttataattgtgaaatatgcggtaactttatctataaaggaccaaaggcgtttcagagacattttgccgagtggaggcatgctcatggcatgcgatgtcttggaattccaaatacagcacattttgccaacgttactcaaatagaagatgctttggctttatgggagaagctaaagacaatgaaacacgatgaacgttggcaacctgaacacgaagaagaatatgaagattctctcggaaatgtagtcaataggaaaacttaccaagatttgaagagacaagggcttttataa

SEQ ID NO: 1698 - DNA, 636 bp, Piezodorus guildinii
atgacggtcggtaagaataataaaatgcttcaacatattaactacagggtgagaataattttgcaagattcaaggacattcataggcacctttaaagcatttgataaacacatgaatcttattcttggagattgtgaagagtttagaaaaattaaaccaaaaaataccaaacagccagagcgagaagaaaagagggtattaggatttgtattactaagaggtgaaaatattgtttcacttacggttgaagggcccccacctccagaagaaggattgcctagagtacctcttcctggagcaggtggaggaatcggtacggcaagacctgctggacgtggagttccagcccctggtactccagctgcacctggtcttcaaggaccagttcgtggtgttggaggcccatctgcacaagttatgactccagctgggcgaggcggacaagtttcagcacctcctcaaatgcgtgctccacctccaggaatgcccccaatgatgggagctcccccaatgatgaatatggcacctggaatggcaatgggtagaggtgggcctcctcctcagatgggtgctcctcctgctccaccaatgcggggtcctccaccaggaatgatgagaggtcctccacctttttaa

SEQ ID NO: 1699 - DNA, 1251 bp, Piezodorus guildinii
atgcaagcttccttatcgtcaaatcaattagtagggattgcagtggcattgtcaacgattccgaatgagaaacgtaggagaaaaagaaaaatttgggccaaagatttgttcctccaacgtcccagggttagagaaaccggaatttccgaagtattagaaagtgatgattttaaacttatgaggattacgcctgatgcattttataagttacttaagatggtgcggcctttaattaagaaaaataatactgttatgagagaagcagtcactgaggaggaacggttaattattactcttaggcatttagctaccggtaagagctatgctgatttgcaaaacagtactgcagtttctccatcgcttatgacttcagttattagagaaacttgtgacgctatttatctcagtctcaaaagtggaataaagatgcctactacagaacagcaatggcttgaggtcgctgatggttttgaaaagaagtggaacttcccgcattgcctgggctcttttgatgggatacacgtggcgataaataaaccagcgcatagcggtgcaatctttctcaactacaaaggatatccaagtgtcgttttgttggcacttgttgatgccaattatcagtttatgtatttaaacactggtgcaaatgggagtgcatcaggttcaactgtgttcgaaaacactattttttaccaaaaatatctgtcaggaaagctaaacttacctaaggacagtccactacctggtatggaagaaaaagtcccctatgtttttctgggagattgtgcattttcccttgatgaaaattgtatgaacacatttccggttaaaaatattgaccacccgaaaaggattttcaattaccgtctttcccgagtgaggaatcttgctgaaaatacattaggtattctcacgtcaagatttagagttctacgccaaatttcttctgtaaaattagataccattgattcaatcgttcttgcatgctgttctttgcacaattatctctcgaaaaataatccttcctacttagatgatggtgtaaccgtagattacgaagatttacaaaacattgaattccgtcccggagaatggaggctagataataagcttgtaccattgtgtcataaaagtataagaaatagatttcaagaaggtgatgatgtacgtcaaatatttgttgactacttcaactctgtcggtagtgttccttttcaagaagacatgcttaaagtcatcccagaaggatag

SEQ ID NO: 1700 - DNA, 1710 bp, Leptinotarsa decemlineata
atgaaaaaggaagcaaaggaacggtcaaggaaagaacggatgggatgggataatgaatacctacactacaccaatagcgataatccatttggcgacggaaatcttttgtcaacattcgtgtggaataaaaaattatcaaaggaaggactaataggtgtcagccacgaagaaatagaagcaagaaacagattcaagcaagaagaaaataaaagagaacttgagaaggtcaagaagagaagacaagaaagagaattagaaagacaaaagagggaagaagaaacacaacttttacagaggagtaaagaagcggcacaatttgaggagtgggagcgtcacgaagatcagtttcatctagaacaagctcgattgcgttctcacattcgaattcaggatggaagagcgaaacctatcgacctcctcgccaaatatataagtgctgaagaagaagtggatgcggtagaaatgcatgagccctatacatatcttaatgggctacatattaaagatctcgaggatctcgtagaagatataaaagtttataaagagctggagagaggaaaaaatttggattactggaatgacattactgtcattgtggaagatgaattacaaaaattgcgaaaactagaaaaacaagacgattttgatatgggtttgaacagacgtgaaggaattcatcaagcagttgcatcggatgttacttccatattcaaagggaaaacagcagttcagttggcagctttggagaaacaaatcgaggccaaaatcagtagtagagcagatggaattgatattggatattgggagtccttgttatctcagttgaaagctcatatggcacgagcacggctaagagatagacatcaagacagtttgagacgtaaattgcaagtattgaaagctgaacaagcaattattatccctgcacaggccgaagccagttccaatgaagtagacgagccaagtaccagtaaaaattttgagccgaaaccaggtgtatcacaagaagatgatcgagtcagcgaaaatgaaggaaatgaagatgaagcaaaagacatgctcaatgaatacttcattgcctatcaaacaggaggctacagtccgaaatttttatcaccagaagatattgaacctggaaccattgttgtaactgaagaagatgacttaaaaaggttggaattcgctaggctacaagttgttggcagtggtaaaaaagttgagaatgttatcacaaaggaagagttgctgcttcaaaaggaagcgaggaagggaatggatgcggacgaagcacaattttctgtggaacaagctctagatagccaagtttatttgtggtctgataagtatagacctcggaaaccgaggtatttcaacagagttcatacaggtttcgaatggaataaatataatcagacacattatgatatggacaatcctccaccaaagattgtgcaagggtacaagttcaacattttctatcctgatctaatagataaaagcagtgcgcccgaatactttttgattccgtgcttggaaaataaagaattcaccatcctacgattccatgcaggccctccatacgaagacattgctttcaagattgtgaatagggaatgggagtattcttacaaaagaggatttagatgtcagtttcacaacaacatatttcaattatggttccatttcaagagatatcgatatcgacgatga

SEQ ID NO: 1701 - DNA, 1107 bp, Leptinotarsa decemlineata
atggataatttagaagcaaatataatggacaagtccatgagatctgtttttgttggaaacataccctatgaagctactgaagaaaagttgaaagatatatttggtgaggttggtcaagtattatcattcaaacttgtctttgatcgtgaaaccggtaaaccaaaaggttatggattctgtgaatatagggatcaagaaaccgccttgagtgcaatgagaaatttgaatgggtatgaaataggaggtcgtaacttgagagttgataatgcttgtacagaaaaatctagaatggaaatgcaaaatctgctcaatcagccacctgtagaaaatccttatggggagcctattcaagcagaaaaagcacctgaagcaataagtaaagctgtagcttctctacctccagaacagatgttcgagttaatgaagcagatgaagacaacaattcagaataatccaacagaagcaaggcagatgcttttgcagaatcctcaactggcttacgctcttcttcaggctcaagttgtaatgaaagttatcgatccgcaaacagcagctagcctattgcatcccatcaatcaagttccagcgactctgatgcctggtgataagaatgttccagttcaggttccaattagcaatcaatatagagaacctcctgcaccagtacagccgcccaggcaagaatttcagccagtaccagcgccagttttacatccaagtgcccagccttcagtgtttgcaggtcaagacatagatctaagatctattggaggctcaacagatctaagaatgacaagattaggggatcaggatatgagacagattcctggaccattacagaatcctttgccaccaccggtggctgaaagtttccaaagggatctgagagatccccgtcctatacctcaagcattctcagttgaacccagacaagctcgtatcgatcccaggcagaaaccatcagctatgcctcctgttcagttgcaaccacaacctgtgagacctccattacaacctcaaacaactggacctgtacctcttcgtcccccagtaccccagcctatggctaaccctgtcccagctactgtcagtcctggaatcggccca

SEQ ID NO: 1702 - DNA, 651 bp, Leptinotarsa decemlineata
ggacccccaggaactggaaaaactcttcttgctagggctgtagcctctcaattagatgcaaatttcttgaaagttgtttccagtgcaattgttgataaatacattggagaatctgctagattgataagagaaatgtttaattacgctaaagatcaccaaccttgtatcatttttatggatgaaattgatgccataggtggccgcaggttttctgagggaacttcagctgacagagaaattcaaagaaccctgatggaacttctaaatcagatggacggatttgattcattgggacaggtaaaaatgataatggccactaataggcctgatacattggatcctgctttgctccgcccaggtcgtttggatagaaaaattgagatacctctaccaaacgagcaagcaagacttgaaattcttaaaattcatgctttgcccatcgccaaacatggtgaaattgactacgaggcaattgtcaagctatctgactccttcaatggagcagatttgagaaatgtgtgtacagaagcagggttgtttgcaatccgggcagaaagagaatatgtaattcaggaagatttcatgaaggcagtgagaaaagttgcagataacaagaaattagaaagtaaattagattacaaacctgtataa

SEQ ID NO: 1703 - DNA, 762 bp, Leptinotarsa decemlineata
gatacgagaacgacaatcttttcaccagaaggaagactttatcaggtggaatatgcaatggaagctatatcccatgctggtacctgtctcggtattttagctaatgatgggattttattagcagcagaaagacgcaatacaaataaattattggatgaggtgtttgcttctgaaaaaatatataaactgaatgaagatatggtgtgtagtgttgctggcataacatctgatgccaatgttttaactaatgaattgcgtttgattggacagcgatatttattccagtatggagaatctatcccttgtgaacagttagtatcatggttatgtgatgtcaaacaggcctacactcaatatggaggaaaacgtccatttggtgtttcaatattatatatggggtgggataaacattatggatatcagctctatcaatctgatcccagtggcaattatagtggttggaaagcaacttgtattggaaacaatagttcggctgccatttccaacttgaaacaggagtataaagaaggagaaatgacactaaaggatgcaaaatctctggctataaaagttcttgtcaaaactttggatatggctaaacttacttcagaaaaagtggaaatggctactttatcacgtgtgaataataaaacagtaatcaacattttgagcagtacagaagtggaaaacttgataagtgagtttgaaaaaaatgaagctactcttgaggctaccagaaaagaacagaaacaagcagtctga

SEQ ID NO: 1704 - DNA, 2646 bp, Leptinotarsa decemlineata
atggaaacttccaaaatcgaagtaaaaactaatgatgataagaacaaaaatgagctgtctgatgaagataagctgctgcaagaagaactcaacttatgtgtggaaaaactacaggaaagtgatgaaaaactttatttacctgctctacatgccttgggtaataatattcgagcatctaccacatctatgacgtccgttcctaaacctctcaaattcatgaaaccacattatgaaactatgaagcaagcttatgagaaagtcactaacccagaaataaaaaatgtttttgctgatattatttctgtattggccatgacgatgggagaaggaagggaatgtctcaaatatagacttctctctaatttgggtaatatcggagagtggggccacgaatatgttcgtcacttggcaggagagattgctggagaatgggcagaaactgatttcatggtgaacacagaaataagagataaattaattttactggctaagcagatccttccttataacatggctcacaatgctgaagcagaagcatgtgatttactgatggaaattgaaagacttgatctactagaacaatacgtggatgaaaataattatcaaagatgctgtttgtatctcacaagttgcataccatatgtggccgatccagaaaataatacgcttcttcagactgctctattgctgttccgcaaattcaaacagtattcgcaagcattacgtttagctatgcagttgaatgatcattctctgatagaagaaatattcacaacttgtccagatacggctatccagaagcagttggccttcatgttgggtagacaacagatttacatagaaattcccgagagtactccagaatatgaagatattatagaaattatggctaactgccacttgaacaatcacttcctgaatcttgccagggagcttgacatcatggatccgaaaactcccgaagatgtttataaatcccatttggaaaatagtcgtcctccctttggaggcagtcaagttgattctgccaggcaaaatttagcagctagttttgtgaatggattcgtaaatgcggctttcggccaagacaaacttctaatggaggatggaaataaatggctttataaaaacaaagagcatggaatgctgagtgccaccgcctcccttgggttagtcctcctctgggatgttgatggtggtctgactccaattgataaatacctgtattcttccgaagattacataaaatctggagctctgctagcttgtggtattgtcaactgtggagtccgaaatgagtgtgatcctgccttagccctcttgagtgactatgttcttcataatactaatattatgaggataggagccattgttggtttaggtttggcttacgttggttctaacagagaagctgtcctgagtctgctcactccagtattctcagatcctaaatccaacatggaagtaataggcatgtcggcattagcctgtggtatgatcgctgttggatctggcaacccccaagtcaccacaacaattatgcaaactctaatggagaaatcagatacagaactgaaagatacatacgctcggtttttgcctttgggtctgggtctttgccatttgggaaaacaggaaggtatagatactattattgccactttggaagtcatacctgaacctttccggtcgatggctacaacaatggtggacatttgtgcctacgctggaacgggaaacgttctcaaagttcagaatttgctgcacatttgttcagagcattatgaaggctctgatagcaccgacaaaagctccaaagataaggacaaaaaggaaactgttaaagaaaaagatctatctaccaggcaggctgtagccgtacttggtattgcattgattagcatgggggaagatattggcagtgaaatggctttcaggacatttgggcatttacttcgttattgtgaaccagcgattcggcgagctgtacctctggctttgggactcatctccgtgtccaatccaaagttgggcattctcgacaccctcagcaagttttcacatgacagtgatgcagaggtcgcccacaatgctattttcgccatgggattggtcggagctggtactaataatgccagactggcagccatgttgaggcagttggcacaatttcatgccaaggacccaaacaatttgttcatggttcgcatcgctcaagggctcactcatctgggcaaaggaacacttaccttaagtccttatcacagcgataggcaactgatgagtcctgtagctgtagcaggattgatggcaacacttattggattcttggatgtcaaaaatataatattaggaagatctcattatctgctttataccttagcagcggctatgcaacctagaatgcttgtgacatttgatgaggaactgaatccactgcccatacctgtgcgagtgggattggctgttgatgtggttggtcaggcaggcaaaccaaagacaattactggtttccaaactcacactactcctgttctgttggcttatggtgaaagagctgaattagccaccgaagaatatgtagccttaacaccaattatggaaggttttgtgattttaaggaaaaatcctgatttcaatccataa

SEQ ID NO: 1705 - DNA, 1242 bp, Leptinotarsa decemlineata
atggatccggccgaagaacaagaagtcaaagacgtcaaaccaaaagctgactcagatgaagacaaaaaccagcagcaaccacaacaaccgcagcaacaacctcaacaacgacctccaccatcatccaccgtcatcaaacgaaatttcatcacaactgctggaacaatagttgaaaattacgacgaacagcctccagaggcagcaggcgaagaaatagttaacacctctacgtcaactccacaagaacaaagtcctgtgacgcacaaaattgagtctccagaatcgggatcataccaagagattatcacccaacgagacataaagacttattcggtcgaggtaccggatacttatacagcttccggcacctactcctcagagttatactcaatagataacagcatgacatcagttactatctctagtgacttggaacatcaaggagactacactaacttgcagactgctcagtacaataacggatacaccgatgcttcgcagtatatggaacagcatcagtaccagaccctgtacactgagagaggagccgtggatagttctccaccggttttgtataggaacgatcccaatttggggtcttctaggtatcaaggcgactacgaaccgtccacgcaaacccaagtcagcctcctcaacccgtccagcgaaaccgtctactccacatttccctccacgagcagcgccacctaccaccagttctaccagaataaccccaacgtcctgcacccagcggacagcacccaggcgtatgggggggcgtacgtgaatacggcctggtccagtggcggcggcttggacgacgggcaccgggccagtcaagagatcggaaacagacgaaacggagttcagtgtgccaactgcaagacaaatacaacaactctttggcgacgaaataatcaaggggaaccagtatgtaatgcatgtggactatacttcaaattacacaatgttaacaggccgatcagtatgaaaaaagaaggcatccagacacgtaaacgaagaccaaagaattcttccagcgtttctagcgcaggagcatcgaatcaagttagattggcaccttatatgggttacctacaagtttcggatgaattgcctcaagaccagtaccaacctcccatgaacatttatccaacttccaatcaaccagtctacaaccaatacaccccagctgcaatcgaacaacttagaaatttgagtgccattcaaccaatcatggtg

SEQ ID NO: 1706 - DNA, 3111 bp, Leptinotarsa decemlineata
ggtacagagtatttcaaccaaaaacctaaaaaaggtatagaatttcttcaagaacatgggtttcttaaacctgtattagacatagaagaaattgtgatgtttttgcgagaaaatcctggtctaagtaaagctatgattggtgaatacataagcaataggagcaatctgaagattttagaagcttttgtgaagacattcaacttcacagatgttagaatagatgaagctttgagagcgtttttggaatctttcagattacctggtgaagcacctacaatttcacttattttagaacattttgcagatcattggcacaaaagtaatggggaaccttttgctgatgttgattcagcctttactttggcctatgcaataattatgttgaatgtggatcaacataatgaaaatgcaaaaaaacaaactgtaccaatgagtgcttctgcatttaaaaagaatttgaaaggcgttaatggtggagatgactttgatgaagaactactcgatgaaatttataatacaataaaaaatgatgaaattgtcatgcctgcagaacaagcaggtatcatcagagataattacctctggaagttactgttacggaaaggtcaatcaaaagaggcttcgtatgttcatgaaaatagtggcacatatgattttgaattattccagattctatatggtccagctgtgtctgctctatcatctggttttgaaaagagtgacaatccaagtatatacaaaaaaataatgaagggatttgaacagtgtgcctttatagcttctaatctgaatattcctaagagtttagacatgcttcttttgacaatctctaaattttctctattccataatgggggaagacaaaacaatgttgttattcagtttggcgcaaataataaagcacaattggcattgaaaactttttttgccttgttccatcttcatggcaatagcattacagaaggttggaaaactttgtttgatttaatgttgtccttatacaccaatgacttgctctccaaaactttcactgaaattgaagatttcattgaaccaagtggaaaatttgtgttacactttgaagaggctcccaatttggaaaaacaagatacaggtctcttaagctcattatattcctacatggtttcagctgaaaatctctcgaaagtaccaacacctgaggaacaatattttattgaaataaccaaagaatgtataaaagattgtaatttggatcagttgataaccgactctaaatttctccatgaaaatgctcttctggaaatggttaaaactttgatagagttatccagaggacctgacattcaagaaagcctggggtacaactataatcagaatgtaacagtgtttttcttggaactccttataaaaattgttatgcaaaatagagatcgagtaatgtcaatatggcagaatgtacgagaccacatatatactattgtaatgaatgcatctctgtttgattaccagttccttctggagaggtcagtaataggattattacgaatagctatacgtttgatgagaaacgaagaaatgagtcatatagttctgcagtcacttcgaatgcttcttctgttgaaaagtagtacattaagcagaatatcccgacagatctcgtttggattatttgaattattgaaaacttctgcccagaatatacatactaatactgactggacgattattttcacacttcttgaatgtgtcggagcaggagcccaaccacctaagcctatttcagaagattcatctttgctgagccatgagattaaatctggcgaggaatatcctgataatactagagaagacgatgccattgttgatagaggatacaaatccgattcagagctaacaaagagtaccaaacatgaccaagagcatcaaaaaagttttgttcctgtttcaccacttggaacgcccagtactggaggttggatactggttggtaacgaaggtgaaattcaacccgtcatgggcagaactgtgccaccaacccaatatgaactttgtttggaaaagaacttgggaattcatgatcctcgtagtatgatgaagtgctgtgaaagccttgcatttttagttagagatgtagctcatataacaccgtataattttgatatttgtgttcattgtatcaggacatttgttgaggcaaacgtacagagttgtaacggaactaagagattcgctaatcacgaatctaggccacgaatcaaatctaaccgaacaagattgagggtttccagaaatagaaaaagtccgacaagcagcccagatgaggatgaagaaagtgaagaagagggggtacctagtggctatcatcaaatttcaatacagttactggatctcatgcatacactacatactagaactgctcaaattttcaagtggtgggctgaagaaggtggagaagtttcacaagaaacatccttgtggtcccaaggttggtgtcctcttttacaaggaattgctaggctttgttgtgactctagatatcaagtcagaacaagtgccataacatacttacaaagagccttattggttcatgatctgcaaactttgagtggtccagaatgggaacagtgcttccagagagtcctttttcctttgctgaattaccttttacagccaacaatgccgaaagatgctggttcaatggaagaaaccaggatgagagcagctactcttttatcgaaagttttccttcaccatctaactcctttatcatctctctctacattcagtaatttatggttgattatactcgattttatggataagtacatgcatgcagataaaagtgatttgttgtacgaagctattccagagtctttgaaaaatatgctgttggtcatggattccgctaaagtatttgatgggcctgaaggtagaagtattttgtggaatgctacgtgggaaagaataactaagtttttaccagaattaaagaatgaccttttcagggaaattgagagtgaatcccaggctagtgtggaagacaaactactagaaaatatgcgaaacactcaacagtcgtttgaaactaaagaatcaactccatattctgaaaagctaataacctgttag

SEQ ID NO: 1707 - DNA, 405 bp, Leptinotarsa decemlineata
ttcagcccctatgctgataatggagggagcgtagtggccatagctggagatgatttcgtggtagtgggagcagatacacgtctaagcgccggcttctccatctacactagagaccaaaataagttgtttcctctttcaaaaacaacggttctcggatgctcaggttgctggtgtgacacgctaacgttaactcgtattttgaagtctcgcatgcagatgtacgagcaagagcataataaagtgatgtcgaccactgcttgcgcgcagatgctctccaccatgctctactacaaacgcttttttccttattacatctctaacgttctcgtgggtctcgacaacgaaggaaaaggttgtgtttacagctacgaccctattggacattgtgaaaagactacgtacaga

SEQ ID NO: 1708 - DNA, 2808 bp, Leptinotarsa decemlineata
atggatcagaaaccaggattggatttggtaatttcggcagtttcggcgctatacaataatcccgaaagaagtgaaaaggaaagagcatcccaatggcttttggaactccagaaatccgtccacgcgtggacagtagcagacgaactcctccacctcaaaagggacctcgagtcatgctatttcgcagcccagacgatgcgaacgaagattcatcagtccttccacgaactgcctgcggaagttcacaattccctgagagactctctactagaacacattagtcagataaatgaaggcaccaatgctgtgatcgtgactcagctgtgcgttgccctcgcggacctagctctacagatgccatcgtggcaaaaacctacgttggatctaatcaacaaattctcgcagactaatatatggccgcttttagaaattttaactgtgtttcccgaagaattagagagtaggtctgtaagattaggagaaaatagacgaattgaagtactggaagatatgaggtattgtgcccctaccgtgaacgagttcctgaagcactgttcgaacctctatggaacagagtggcaagaccaagtgcagatcaacgtgaagatcttgcgctgcttcaattcctgggtgtctgtgggggcgataggactgggagatctagccgataatgtggtcatcaacagggcgtttgaaatactcaactttaaacctcaaaacgacaaatacacgcctgcaggatccttccacgaagccgcgacggactgcatttgcacgctcttgctctgccttgaagacaataacaaccagatggtgctggagaattaccttttcaacaatatcataaacttggaagtggcgtaccatctgtcggtagccaatgaggaccaaggcaagtctatggactactgcaggctcttcacggaactggcggaatccttccttgagaagatcatatcaaacagcagtcagaagcagacacattacgctatcaagattttggatttggtgctgatgtgtgtcgggcatcatgactatgaggtagccgaaatcaccttcaacctgtggtacgtcttgagcgaggagctctaccagaagaacaacaaggaactgacggaactattcaggccgtatgttgaacgactgataacagcgctctgcaggcactgtcagatggagccagactgcgagggcctgcttgaggagggagacgagttcaaagatttccgattgaaggtatctgatctgattagagacgtcgtcttcattgtcggcagcagcagttgcttcaggcagatgttcatcaatctgcaggcacccggcgtgacgtgggattccagtgaagccgcccttttcgtgatgcaggccgtggcgaaaaacgttttaccgactgataacgaagtaattccgaatgtggtggaagccatcctgaacgtccccgagaacactcacatcgctgtcaaatatacgtcagtgttgctgctcggcgagctatgcgagtggatcgaaaagcacccgaacacgctggaccccatcctgaacttcctcgtgtgctgtttaccccaagcaggtattggcgctgcagctgctgtagccctgcagaacatctgcgctagctgcaatgatcatatgccgaggcacgttcccattttactacagctactgtaccaagtcgacacgttcgccataacgaacaacgccgtcattggtctcctgaaaggcgtcgcctctatagtaggtaggatgccggccgtagaaatggcacctgcgatgcgcgagctgtgctttatgcagctcaaacagatcgaccagctcatcgagcaggacgtcgtccctgtacgaggtacgaagacggaccctgggctgtggcttgacagactgagcgccattcttagatatgttaatgtcaacgtgtcagaaggcgaaatccacccgtgcaaaccagtcatcctggaggtgtggccccagctgtcgcgcgccttcaacaaataccaatcagacatccggataatcgaaaaatgctgccgctcggtgcgcttcctgctgcgctgctgcagccagcaggcgaaagaactcctcgaagacctcgtcagccagatggtgcggatttattcgatacacaaacactcgtgcttcctctacgttggtagcattctcgcggacgaatacgccagtgattcggagtgcgtgcgcggtctgctcgacatgctgcaggcgttcctcgaaccgacgtttcagctgctgcaggaggagaacggcctcaggcaccatccggacactgtcgacgacttcttcaggctgtgcgggcggtttatgcagcgcgcccccgtcgattttttgcagtgcaccgcgctcgtccacattcttcagtgcgcgttgatggcttcgacgctcgaccacagggaggccaacatgtctgtcatgaagttcttctacgatctgatcagccaggggcagaacggacgtactcagcccgacttcgagaagaggaaaatgctggttacgagcatactagaggagtacggccagcaactcacgacgaacctcatccattcgtgcgtcttctacctgcactcgtacatgctcaccgaggtggcggacgtcttcgtccagttgctggacttcaacagagaagcgaccagtaagtggttggtcaacggtttggaccagctcccgaaacacagcaacggtggaatcatggctgcaaccccccagcaattgaacgacatccacatgtctattacaacgtcgaacacgtctagatcagtgactcacgctttaaaagatttgactcgattatatcgttaa

SEQ ID NO: 1709 - DNA, 1512 bp, Leptinotarsa decemlineata
atggcccaaaggtttccagggccaggtccaacacaaggacctggaggaattccacctcaaagatatcaacctcctcaaaattcgggaatgcgtcagtataaccaacagaattttccgcaaagacctggttacaatccaccacctccaaccatgtcgtcgagcggcggtaccatgattcaaagacccactggttctccttattcgccaatgagagcagggcctatgcctcagccatcaagcagcaaaaggcctgctactgaaaataggggccctgttccacaaaagacggattatccacatactactcccagcagtagtaaaaaaaagaaaaaactggctgacaaaattttgccacagaaagtaagggatttagttcccgaaagtcaagcatacatggatttactagcttttgagagaaaactggactctacaataatgagaaagcgattagatatacaggaggctctaaaaagacccatgaaacagaaaagaaagttacgaatttttatttcaaatactttctatccagccaaggagccacagcctgatggtcctgaaggtccttgtcaagaaggttctgtggcctcatgggagcttcgtgttgaaggaaggcttttggacgattccaaaaatgaccctaataaagttaaacgtaaattctcatcatttttcaaatcattggtcatcgagctcgataaggacttatatggccctgataatcacctagtagagtggcacaggactcttacaacacaagaaactgatgggttccaagtaaagcgtccaggtgataaaaatgtcaggtgcacaattctcctattattggactatcagcctttacaattcaaactagatcctagactagctcgccttctaggagttcatactcaaactagaccagttattatatctgccttgtggcagtatataaaaacccatagacttcaagatgctcatgaacgtgaatacattgtatgtgaaaaatatcttgaacaaatttttaattgttctcgtatgaagtttgctgaaatccctcagcgtctgaatcctttgttacatccaccagacccgattgttatcaatcacgtaatatctgttgaaggtggcgcagaaagcaaacaaactgcttgttatgatattgatgtagaggtggatgatactctgaagaatcaaatgaataattttcttttgagtacagcgagtcaacaagaaatacaaggattagattcaaaaattcatgaaactgtggacactatcaaccaactaaaaacaaatagagaatttttcctgagttttgctaaggatccacaacaatttattcataaatggattgtatctcaaactagagacctcaagacaatgaccgatgttgttggtaatccagaagaagaaaggagatcagatttctttcatcaaccatgggcccaagaggcagtctgcagatatttttatactaaggtacaacaaaaaagagctgaactggaacaggcacttggtattcgtaataattaa

SEQ ID NO: 1710 - DNA, 435 bp, Leptinotarsa decemlineata
atgccaaaagtacgccggagtaaaaaggccccaccggaaggttgggaattgattgaaccaaccctggacgaattggagcagaaaatgcgagaagccgagactgaatcccacgaagggaaaagaaagaacgaatctttgtggccaattttcaagatccaccatcagaagtcccggtatattttcgacctgttttatagacggaaagccatcagcagagaactgtacgagtattgcttgatggaaaacatcgctgacaaaaacctcatcgccaagtggaagaaacaagggtatgaaagtctttgctgtttacgatgcatccagacgagagacacaaattttggaacaaactgtatatgcagagtcccgaaggccaaactggaggagggaaggatagtggagtgtgtgcattgcggttgcagagggtgctctggatag

SEQ ID NO: 1711 - DNA, 885 bp, Leptinotarsa decemlineata
atgcctgcagctactcttagtagcctccaacacccaaacaatgaagattgcgggataagagatgtttgggcacacaatttggaagatgaatttcgaacaatcagacaaattgttcaaaaataccaatacgtagcaatggatacagagtttcctggagttgttgcgagaccgattggggagttccgtagttcagcagattatcagtaccagatgttgaggtgtaatgtggatttactcagaataatacaacttggactaacattcttggatgataatggaaagacaccaggaggatcatataccacctggcagttcaatttcaagtttaatttacaggaagacatgtatgcccaggacagtatagatctgcttcagaattctggcattcaattcaaaaaacacgaagatgaaggaattgagcctctcgagtttgccgagttgctaatgtcttctggtattgtcttgatggagaacataaaatggttatcctttcattctggctatgatttcggatatctcataaaactattaacggataacaacttgccacaagatgaaaatgaatttttcgatttattgaagttatatttcccaactatatacgatgtcaagtacctcatgaaatcttgcaagaatctgaagggaggactacaggaggttgcggaacagctagaacttgagagaattggaccacaacatcaggccggttcggattcattactaacaggaatggcatttttcaaaatgaaggagatgtttttcgaagacaccatcgatgactccaagttttctggccatctttacggactgggaacttcatttgctgtcaacggtacttcaaacaattatgcaaacgataatggtgacaccacgaattcttcatga

SEQ ID NO: 1712 - DNA, 1212 bp, Leptinotarsa decemlineata
atggctggtgctactaaaagggcagcttcagtttttgaagacctctctaatgtggaattcgagacaagtgaagatgtggaagttatcgacaagttcaagaatatgaatcttaaagaagaactcctcaggggaatttttgcatatggatttgataagccatctgctattcagcagagagctataaagccaattatgaaaggaagagacgtgattgcacaggctcagtctggtactggtaaaactgcaacgttttcaatctccattctacaatctctagatcttacaatgagagaaactcaagttttatgcttgtccccaactagggaattggcagttcaaattcaaaaagtaattctagctttaggagattttatgaatgttcaatgtcatgcttgtattggtggcacaaatttaggagaagacataagaaaactagattatggacaacatgtcgtcagtggaacaccaggaagagtgtatgatatgattcgtagacgagcactacgaactagatctgtgaaaatgttggtattagatgaagccgatgaaatgttgaacaaaggattcaaagaacaaatttatgatgtttatcgatttctcccaccctctacacaggttgttttgatttctgcaactttacctcatgaaattttggagataacttctaaatttatgacagatccaattcgtatactggtaaaacgtgatgaattgactctggaaggtatcaaacagttcttcgtagctgtggaacgtgaagagtggaaatttgacactctctgtgacctttatgatactcttactataactcaagctgttatattctgtaatacaaaaaggaaggtggactggctgacagaaaaaatgagagaaaacaacttcactgtgagcgccatgcatggagatatgccccaaaaggagagggacaacatcatgaaggagttcaggtcaggacagagcagagttcttattaccaccgatgtttgggcccgaggaatagacgttcagcaagttagtttggtaataaactatgatttaccaaataatcgtgaattgtacattcatcgtattggtagatctgggcgttttggacgtaagggtgttgcaatcaattttgtcaagtccgatgacattagaattttgagagatattgaacagtattattcaacacaaattgatgaaatgcccatgaatgttgctgatttgatataa

SEQ ID NO: 1713 - DNA, 1605 bp, Leptinotarsa decemlineata
atgactgctcctactgctggtggtgattcaaacagggggagaacactagcgtataaagataaaagtaaacctgctgatgtaagaaccagcaacataaatgccgcaaaagctgtttgtgatgcaattcgaacaagtttgggtcccagaggaatggataaaatgatccagtctggaaatggagaagtaactattaccaatgatggggccacaatattgaagcaaattaatgttatacatcctgctgccaagatgttggttgagttgtcaagggcccaagacatagaagctggagatggtactacatccgttgtcgttattgctggagcattattagatgccgcagagaagttgctacatcgtggaatccatcccactgcaatttctgagtcattccaaagagcagcagtgctagctcttgagatattgaatgaaatttcaactcctgttgagattacaaacagagaagaactgataaagagtgcctcaacttctctcaactccaaagttgtgtcacaacagtccagccatttagggcctttggcagtagatgcagtactcagaatagtggaacctggacgcgagcaggcttgtaatcttaacgatatcaaagttatcaagcaattagggggaactgtagaagacacagagttagtcgaaggaatcgtgttccctcagagatcttcaaatgtttctgggccaaaacgtattgaaaaagctaagattggattcatccagttctgcatttcacctcccaaaacagacatggaccacaacgttattgtgtcagactacgctgcaatggatagagttctgaaagaagaaagagcttacattctgaatatcgttaaacaaattaagaaagctggatgcaacgttcttctgatccaaaaatctatactgagagatgccgtatccgatttagcactacactttttggacaagataaaatgcatggtaatcaaagacatcgagagagaagatgtggaatttgtttgtaaatctctagggtgtcgccctattgcgtcgttggatcattttgtagctgaaaatctggtgtcagctgatctagtagaagagcttggagctgctggcaatagaatggttaaaattacaggtgctcagaacgctggacacactgttacacttcttgtacgaggatcgaataaactggttctcgaagaagcggatcgctctattcatgacgccctgtgtgtcattcgttgtcttgttcgtaagcaggcagtgattgcaggaggaggagcacctgaaattgagatagctctcaagttagccgctatagcgaacagattggaaggcatagacgcaatttgtacaagagcttatgccaatgccttggaaatcatcccattcaccttggcagaaaacgccgggttgaatcctattcagaccgttacagagttgaggaatcgccatgccaaaggagaaatatcagctggaattaatgttcgaaaggggaccatttccgatattctggaagaaaatgtcgttcagccccttttagtaagcacatctgccttgagtttggccacagaaactgtcaggtcaattctgaaaattgatgatattgtgaacactataacataa

SEQ ID NO: 1714 - DNA, 1230 bp, Leptinotarsa decemlineata
atggaggctatggaagttgttgttcctgaaaaggaagaaggtagcccttcagacgcaaaacagaccttacaggacgtggatattgaagatttgtataccaaatataaaaagttacaacaaatgctcgagtttttagaggttcaagaagaatatatcaaagatgaacaaagaaatctgaagaaggaatatttacatgcccaagaagaagtgaagcgtattcaatctgttcctctagtaattggtcaatttttggaagctgttgatcaaaatactggtattgttgggtccactacaggttccaattactttgttcgtattctctccacaatcgatcgggaacttttgaaaccttcagcaagtgttgctcttcacaagcacagtaatgcacttgtcgatgtgcttcctccagaagcagattcctccataagtatgctgcaagctgatgaaaaaccagatgtacagtatagtgatattggaggaatggatatgcagaaacaagaaattagagaggcagttgaattaccacttactcattttgagctatacaaacaaattggtattgatccacctagaggggtgttgatgtatggacctcctggatgtggaaaaaccatgttggcaaaggctgttgcccatcatacaacagctgcttttatccgagtagtgggatctgaatttgttcaaaagtaccttggagaaggaccccgtatggtacgagatgtgtttcgtttggccaaagaaaattctcctgccattatattcattgatgaaattgatgctatagcaactaagagatttgatgctcaaactggggcagatcgtgaagttcaaagaattttactagagttgctcaatcaaatggatggttttgaccaaactacaaatgttaaagttataatggcaacaaatagagcagacaccttagatcctgctctgctcagacctggtcgtttggataggaaaattgaatttcctctgccggaccgtagacaaaaacgtttgatattcagcactatcacatcaaaaatgaatttatctgaagaggtggatttggaagattacgttgccagacctgacagaatttctggggcagatatcaatgctatttgtcaagaagctggtatgcatgctgtaagagaaaatcgttacattgttttgcctaaagattttgaaaagggatataaaaataatatcaagaaggacgagagtgaacatgaattctacaaatag

SEQ ID NO: 1715 - DNA, 489 bp, Leptinotarsa decemlineata
atgccgcatattaaacttcagtcgtcagatggagaaacattcgaagttgatgtggagatagcaaaatgctcagtaaccatcaaaacaatgttggaagatctcggcatggacgacgaggacgaagaagttgtgcctttacccaatgtcaactctgccattttgagaaaagtgattcagtgggctacctaccacaaagatgatcctccaccaccagaagatgatgaaaacaaagagaagcgaacagatgacatatcttcttgggacgcagacttcctgaaagtggaccaagggactttgttcgagctcattttagctgcgaactatctggatatcaagggacttctggacgttacatgcaaaactgttgccaatatgatcaaaggcaaagctccggaggaaattcgcaaaactttcaacattaagaatgattttactgcctctgaagaagagcaagtacgtaaagaaaatgagtggtgcgaggaaaaatga

SEQ ID NO: 1716 - DNA, 1038 bp, Leptinotarsa decemlineata
atgaaggctactaatatagcaaaaccctcaaaaatgcttacacaaaaaattataaattccaatgaatccttggacaaaacagagaaaattaagctgaaaccatcagttatggatgataaggcgtcctgtaaagaactggatcagtggatagaacagttaaatgactgcaagcagctaacagaaaatcaagtcaaaacactatgtgataaggcaaaagaaatattatcaaaggagtctaatgtacaagaagtaaaatgcccggtgacggtgtgtggagacgtccatgggcagttccatgatttaatggaactatttaggataggtgggcgaagtccggataccaactacttgtttatgggggattatgttgatcgtggatattactctgtcgaaacagtgactttgttagtagccctcaaagtgagatataaagagagaatcacaattttgagaggcaaccacgaatctcgacaaattactcaagtgtatggcttttatgatgaatgcttaagaaaatatggaaatgctaatgtttggaagttcttcactgatttgtttgattatttacccctgactgcacttgttgacagccagattttctgtctacatggtggtttgagtcctagcatcgatactttggatcacattagagccctagaccgtttacaagaggttccccatgaaggccctatgtgtgatctgctatggtctgatcctgatgatcgtggaggttggggcatttccccaagaggcgctggttacacttttggacaggacatttctgaaaccttcaatcatagcaatggtctcacccttgtttctcgagcacatcagttggtcatggagggttacaattggtgtcacgataggaacgtcgtaactatattcagtgccccgaactattgttacagatgcggcaaccaggccgctattatggagttagatgatgccctcaagtattctttcttgcagtttgatccagcaccacgacgtggcgaacctcatgtaactcgccgaacaccagattatttcctataa

SEQ ID NO: 1717 - DNA, 354 bp, Leptinotarsa decemlineata
ccagaccaacaaagattgatcttcgctggaaaacaacttgaagatggccgaaccttgtcagattataacattcaaaaagaatctacacttcacttggttcttcgactccgtggtggtatgcagatctttgtcaaaactctaactggaaagacaattactttggaagttgaaccatctgacaccatcgagaatgttaaagccaagatccaagataaggaaggaattcccccagaccaacaaaggcttatcttcgctggaaaacaactggaagatggccgaaccttatcagattataacattcagaaagaatctacacttcacttggttcttcgtctccgtggtggtatgcagatc

SEQ ID NO: 1718 - DNA, 1629 bp, Leptinotarsa decemlineata
atgatgcaaccacaaattttgattttgaaagagggcactgattcatctcaaggaaaacctcaattgatatccaacgtcaacgcctgccaaaatgtagtagatgcagttcgaaccacattgggacccaggggcatggataaacttatagtacagagaaatggaaaatctacgatatcaaacgacggagcaacaatactcaaactactagatattgtccacccagctgctaaaactctagtagatatcgccaaatctcaagacgctgaggtaggtgatggaactacaagtgtagtactattagcaggggaatttttgaagcaaataaagcagtacgtagaagaaggtgtgcatcctagaatcataatcaaagctgtgcgccagtcgctgcaaatctgtctcgataaaatatctgaattatctgtaaaagtaaacaagtccagtgctgaggagttcagatcattactggaaaaatgtgcagcaacggcaatgagttccaagttgatcaatcagcagcgtgccttcttctctaaaatggtcgtagatgcagttttactgttggatgacttactgccactaaacatgattggtatcaaaaaagttcagggtggggcattagaagattcaatgttagttgcaggcgttgctttcaaaaaaaccttttcatatgctggatttgagatgcaacccaaagtttacaaaaattgtaaaattgctcttctcaatattgaacttgaactcaaagctgaaagggataatgcagaagtaagagtggataatgttaaggaataccagaagattgtggatgctgaatggaatatattgtacaataaactacaaaaaattcatgaatctggagccaatgttgtactatctaaactacctattggagatgtggccacacagttctttgcagacagggatatgttctgcgctggccgagtacaagaagatgatctgaagcgaaccctcaaggcttgtggtggagctgttatgacaactgttaatgacctcaataactcagttcttggcaaatgtgatttgtttgaagagaaacagataggcggtgagagatacaatttcttcaaaggctgtccgaatgccaagacttgcactttaatcctccgaggcggtgcggaacaatttctagaggagactgagagatctcttcacgacgccatcatgattgtaaggagaacaatcaaaaatgatgcagtggtagctggaggaggagccattgagatggaattgtccaaaatcctgagggatcattcccgtacaatagccggtaaagagcagctgttgattggggccatcgctaaagcgctggaggtgattcctagacaactgtgcgacaatgccgggtttgatgccactaatatcttgaacaagctgaggcagaagcatgcacagggtggttgctggtttggggtagatgttaataacgaggatattgctgataactttaaaaactgcatttgggagccggcagttatcaaaatcaatgctcttacagccgcttcggaagccacctgtttgatactgtctgtggacgagacaattaaaaatcaaaagtcaggagacgggcagatgccacagatgggaggacgtggtatgggaaggccaatgtaa

SEQ ID NO: 1719 - DNA, 8802 bp, Leptinotarsa decemlineata
atttttgcgcacttacgcaaagttagatcaactaagtatcccattcaaagatgcctaagacttgtagaggcaatttcaagagatttgggaactcagttgttgaaagttctcggaactaggaggttaatgcatattccttttgatgatttcgaaaaggttatgacccaatgctttgaagttttctcaatttgggaggacgagtatgagaaattgcaagctttattgagggatataatgaaaaagaaacgtgatgagcacatgaaaatggtttggcgaatatctccgcaacataagaagctgcaaaatcgtatggaccagatgcgtaagtttcgtcgtcagcatgagcaattgcggaccgttatagtacgagttttacgaccaaccattagagaaatagtagcaccaatagagggagaggacttagaacctccaaaagcaacattttcattagatgcggccgatgcgaatgctattgaggaggtcaatttagcatatgagaatgtgaaagaggtagattgcttggatatatccaaggagggacaagatgcttgggatgctgctgtacaaagatatgaagaacggatagatagggtagaaacaagaatcacagcccatctccgtgatcagcttggaactgctaaaaatgcaaacgagatgtttagaatcttctcgagatttaatgctctctttgttagaccacatataagaggggccatcagggaatatcagacacatctgatacaaagggtcaaggatgatattgaggccctacatgaaaaattcaaggtacaatatcctcagagtaacagtgctaagatcagtaaagttcgtgatctaccacccgttgctggttctatagtttgggccaaacagattgatcatcaactcaccacatatctgcgacgagtggaagatgttcttggaaaaggctgggaaaatcacatcgaagggcaaaaactcaaagcagatggagacagttttcgtttgaaattgaacacccaagaaatattcgatgaatgggctcgtactgtgcaacagcgcaatctcggggtttctggtagaattttcaccatcgaggcagtacgttccaaaagcggtagagggaatgttttgaaactaaaagtgaattttctaccggaaatcatcactttagccaaggaagttcgtaatttgaagtgtcttggattcagagtgccacttgcaatcgtaaataaggcacatcaggcaaatcaactttatccgtttgccatatcacttatcgaaagtgttagaacttatgagatgacactagaaaagattgaagacaaggcaagcatcattccacttgtcgcaggcatgcgtaaagaagttcaaactcttattgccgagggaattcaacttgtctgggagagttacaagcttgatccttatgtccaacgtctctccgataatattgtgagttttcaagagagagtcgaggaacttgtcattgtaggagaacaactggaagttgatgttaggtcattggaaacgtgtccctattcagcgaacacttttgtcgatatcctgtcaaaaattcaacatgctgttgatgacttgtccttgaaacaatattcaaatcttcatatttgggtcagcaggctggatgaggaggttgagaaaaatttagctcgccgccttcaagctggtattgaagcatggactgatgctttgagtggtcagaagaaagatatagatcacagcatggacaccgatgccccagtgcaacctacacacaaacccgggggcgatccacaaatacaaattgtgattcatgaagttcgaataaccaatcagaccatgtacctatatccgagcatagaagaagctcgattccagattatgcaacagctgtttgcttggcaagctattgtaacttcacagcaacgacttcaaagcagtcgatatcaagtgggagttgataaaccagtgactgaaacctaccggaatatcttgacaaaacttcccggaggaccacaacctctgaataatgcttatagtgccatcgcttccaaaataaaagaggtgcaaaaatatgttaatgaatggttaacctaccaatctttgtgggatcttcaagctgaaaacctttatggcaaactaggtgaagacatcagtaaatggatggagtgtctgaatgatatcaagaaaacccgaactacctttgacacatcagatactcgacgtgaatttggacccattgtgatagacttcgccaaagtacaaagcaaagtctctctgaaatacgattcatggcataaagaaactctcagtaaattcggaggactccttagtaacgaaatgactaccttccacgctaacgtttcaaagtcgagatctgacctagaactacaaagtattgaagcagccagcacttcagatgctgttagtttcataacctatgtgcagcagctaaaacgtagtatgaaagcctgggagaagcaggttgagatatatagggaaggtcaaagaattctggagcgtcaacgtttccaatttcctactaattggttacacgttgaaaatctagaaggtgaatggggtgcttttaatgagattatcaaaagaaaggattctagcattcagactcaagtggccagtcttcaacaaaagattgtggcagaagataaggcggtagaaactcgcactaatgacttccttgttgattgggaacgtagcaaacctgttgaaggacatttgagaccagatgaagcactctcccaacttcaattattcgaaagcaaatttgctcgtctcaaggaggagagagacaatgtagcaaaagctaaggaagctttagaattgcaagatcctggtggtattaacagcagtgaagatcgaatgcaggtggtttatgaagaattgcaagacttaagaggagtttggtcagaactatcaaagatctggcagcaaatagatgaaaccagagaaaaaccttggttgtctgtacaacctagaaagcttcgccaacaactggacggaatgagtgcacaactcaaagggctacctgctagattgagacagtattcttcttatgaatatgtcaagaaaacattacaaacttacaccaaagttaatatgatgattgtggagttgaaatcagacgctctcaaggaacgacactggaaacaactcatgaaacaactgagagtcaattgggttctttccgacctaacactagggcaagtttgggacgtgaatttacagaagaacgaatccattgtcaaagacattatactcattgctcaaggagaaatggctctggaagaatttttgaaacaagttcgcgagtcttggcagacatatgagttggatcttatcaactatcagagcaaatgcaagcttattcggggctgggatgatctctttaataaggttaaagaacatatcaattcggtggcagcaatgaagctgtccccttattataaagttttcgaagaggaagctctaacttgggaggaaaagttgaaccgcattaatgccttgtttgatgtttggattgatgttcaaagacgttgggtatatttggaaggcattttttctggaagtgccgacatcaaaacactactacctgttgaaacatcaagatttcaaagtattagttccgaatttttgggattgatgaaaaaagttagtaagagcccaatggttatggatgtcttgaacataccgggagttcagagagctttagagaggctagcagatttacttggaaagatacaaaaagctctgggtgaatatttggagagagaacgtacctcatttccacgtttctactttgttggtgatgaagatttattggaaatcatcggcaacagcaaaaatattgccagactacaaaagcatttcaaaaaaatgtttgctggagtagcatccattcttcttaatgaagacaacacggttattactggtatagcatcaagagagggcgaagaagtggttttcggaaaacctgtgtctaccgtagaacatccaaagattaatgagtggctaaccttagtcgagaaggaaatgagagttactttggcttcgaatctcactgaagctgtacaagatatcaaacaattcaaagatggcatcgatccgaaattgtacatgcagtgggttgacaaatatcaggcacagatcgtcgtacttgccgcccaaatattttggagcgaagacgttgaagctgctttagtcaaaatgaacagcgagccgcaaaagggccctcttgaaaaagtcttgcaacaagtcgagaatactctcaatgtcctcgccgattcagttttacaagaacaaccgcaactgaggagaaagaaattggagcacttgatcaatgaatttgttcataaaagaactgttactcgccgacttatatcgaatggggtatgcagtaacaaggcctttgaatggttgtgcgaaatgagattctattttgatcctcgtcaaactgaagtattgaagcagcttacaattcacatggcaaacgcacgattctattatggttttgagtatctcggtgttcaagatagattagtacagactccacttactgatagatgctatttgacaatgacccaggctttggaagcaagattgggagggtctccatttgggcctgccggtactggtaagacagagtctgtcaaagctcttggtaaccaattgggccgattcgtcttggtcttcaactgcgatgagacatttgattttcaggctatgggaagaatatttgttggactttgccaagttggagcttggggttgctttgacgaattcaacagattggaagaaagaatgctgtctgctgtttctcaacaagtacagaccatccaggaggctctgaaatcacagaaagaagctgcagctgatggagcagcttcagtgggcagtatcagtgtggagttagtaggaaaacaagtgaaagtatccccagatatagcaattttcattacaatgaatcctggatatgcaggaagatcaaatctcccagacaatctgaaaaaactatttagatctcttgccatgactacacctgatagacagctcattgctgaggttatgttgttctctcaaggatttcgacaagctgaaaaattggcttctaaaattgttccattcttcagattatgtgatgaacaactgtcaaatcaatctcactatgattttggtttgagagctttaaaatcagtgttaatatctgccggtaatgtaaagagagacagaatccaacgtattaaagagactaagacgcaacgaggagaaacaaatattgatgaagctagtattgcagaaaacttaccagagcaagaaattttgatacagtcagtgtgtgaaacaatggtacccaaacttgttgccgaagatattcctcttctgtttagtttactgaatgacgtgttccccaatgtacaatataccagagctgaaatgaaaggtctcaaagatgagatcaggaaagtctgtgctgaagaatttttggtatgtggcgaaggagatgagcagggttctgcctggatggaaaaggtattgcaactgtatcaaatatccaatcttaatcatggtttgatgatggttggtcccagtggttcaggaaaaagtactgcttggcgtgttcttttgaaagctttggaaaggtatgaaggtgtagaaggtgtcgcacatgtcatcgatccgaaagcgataagcaaggaggcactctacggtgtcttagatcccaacaccagagagtggaccgatggtctcttcacccatattttgaggaaaataattgataatgtacgaggagaaataaacaaaagacagtggatcatttttgatggtgacgtagatccagaatgggtagagaatttgaactctgtccttgatgataacaaattgttaacgctgcctaatggagagcgtctctcgctacctccaaatgttagagtcatgtttgaggttcaagatttgaaatacgccaccctagcaacagtatctcgttgcggcatggtttggttctctgaagacgttctatccaccgaaatgatttttgagaactacattctcagtttgaagaacattcctcttgaagaaggtgaagatgatagttttggaaagacttcagagtcgaaagatgacgtactctcacccacacttcaagtgcaagttgatgttgccaatcttcttcaaccttatctggctccagatggtttagtggtgcgttgcttggagtatgccatggaacaagaacatatcatggacttcacaagattgcgtgctctaagttcgttattttcaatgttgaaccaggctataagaaatgttttgcagtacaaccattctcattcagactttcctctgtcaaacgattctttggaaaagtatattccaagatgtttggtttattccgttttatggagtttcgccggtgacgctaagcttaaagtaagatcagagcttggagatttcatcagatcagtgacaactgtgcctttgccgccggacaacaatatgccgataatagattatgaagttaccattgaaggtgattggtcaccatggtcccataaggttccccaaatagaagtggaaacccacaaagtagcttctcctgacattgttgtgcctacgcttgatacagttcgtcacgagtctttactttacacctggttagcggaacataaacctctagttttatgtggtccacctggttctggtaagactatgacattgttttctgctttgagagcacttccagacatggaagtagtgggattgaatttttcatctgcgactacaccagaattattattgaaaacctttgatcattactgtgaatacagaaagacgcccaacggagttgttttggctcctatccagttgggtaaatggttggtgttgttctgtgatgagattaacttaccagatatggacaactacggaactcaaagagtcattatgttcctgcgtcaaatagtcgaacagaaaggtttttatagggcttcagaccaatcttgggtagccttggaacgcatacagtttgtgggagcttgtaatcctccaacggatcctggcagaaaacccttatctcacagatttttgagacacgtccctgttatttatgtggattatccaggagaaacttctttaaagcagatttatggtacttttaccagggccatgttgcgtttggctcctggactaaaaggttatgctgaaccattgacgaacgccatggtagaattttatcttgcatctcaggatagattcactcaagatatgcagcctcactatgtatattcacctcgagaaatgaccagatgggttaggggaatatgtgaggctattaggcccttggataatcttgcagttgaaggtttggttcggctgtgggcacacgaagccttacggctgttccaggacagacttgtcgaagatgtcgagcggcgttggaccaatgaaaacattgatgctgttgcattgaaacattttccttcggcaaattgtgagaaagcattggaaaggcccattctttatagcaactggctttcaaaagattatatgccagtggaaagagagcaacttagggaatatgtcaaggccagattgaaggtgttttacgaagaagagttggatgtgcctctggttttgtttgatgaagtactcgatcacgtccttagaattgatagaatttttaggcaaccccaaggtcatctgcttctgattggtgtctctggtgcaggaaaaacaactctgtccagatttgtagcatggatgaatggtctttccattttccaaatcaaagttcataacaaatatactgcagaagattttgacgaggatttacgatcagttttgagaagaagtggttgtaaagatgaaaagattgccttcattttggatgaatcaaatatgttggactctagctttttagaaaggatgaacacattgctggctaatggtgaagttcctggattgtttgagggagatgaatataccactttgatgactcagtgcaaagaaggtgctcaaagagaaggtttaatgttagattcaaatgatgaactttacaaatggttcactcaacaagtaatgcgtaatttgcatgttgtcttcactatgaatccatcaacggatggactgaaagatagagctgctacatcaccagctctcttcaataggtgtgttttaaattggtttggagattggtctgatggggctttattccaggtggggaaagagtttaccaaccgtctggatttggataaaccacactggaaatgtccagatttctttccggcagcttgtacacttatacctacaactcctaatcacagggaagctgtcataaatgcatgtgtttatgtccatcaaacacttcacaaggcaaacagtcgattagtgaagaggggaagccgtactatggcaatcacacctcgccactatctcgatttcatacatcatttcgtaaaactccataatgagaaacgctcagacctggaagaacaacaacttcatctgaatgttggtttgagtaaaattgcagaaactgttgaacaagtggaggagatgcaaaaaagtttggcagttaaatcccaagagctacaagccaaaaatgaagcagcaaatgcaaaactcaaacagatggtgaaagaccaacaagaagctgaaaagaaaaaagttcagagtcaggaaattcaacaacagctggctgagcaaactgttcatatagaacaaaaacgttctgaagtaatggctgatctggaacaagtagaacctgctgtgattgacgctcaaactgctgttaagtcaatcaaaaaa

SEQ ID NO: 1720 - DNA, 2640 bp, Leptinotarsa decemlineata
atgagtaagcaaaaactaatgaaagaccataaattagatgagacgaatatggccgataacgtagaagaagcccgaagaaaagatcttgaagaaagagatgaatttgcccatcgtttgaaaaaacgagatgaaaatcgtaccagaaatattgcacatccttcaggttctaaggcgtacgaagaagctgcgaagagactcaaattagaaaatgctgaccgcggtgaaattattcccaagcttagggtgcaatctagaaggaaatacttggagaaacgtaaagaagataagcttcaagaacttgaagctgatattgctgatgatgaatatctgttcgaggaagagatactgaccgaaagagaacgaaaagaaaggtaccacaagaaagaattattaaaacttgcaaaggaacatgaaaaagcaagagaacttgagcgagtgcatcgatatcacatgcctcgagatttaggaaaagattctgtgtctgattatattgaagttgatgaattagaaaaagttcctcaatcggagcagaaaaaatgggaaaaagaccagatggcttctgctgttttcaaatttggtgcgaaagattctgtcagaacagatgaatacgagctattacttgaagatcaaatccatttcatccaagcattacaaatacctggtgtaacagagaaaaaagagactaaattaacagaggtacaaaaaaaaaagcttagtatcgaagagacaaaaaagagtttgccaatatatcctttcaaggatgacttgattcaagctatacgagaacaccaaatattaattatagaaggagagactggatcaggaaaaacaacacaaatcccacaatacttgcacgaagcaggatttacaaaaaataataaaaaaattggttgtactcagcctcgaagagttgctgcaatgtcagtagcagcaagagttgctcaagaaatgggcgttaagcttggaaatgaagtggggtatgctatcagatttgaagactgcacttcctccagaactgttattaaatatatgactgatggtacgttacacagagaatttttatcagagcccgatttacagtcatatagtgttatgatcattgatgaggcccacgagagaacactacatacagatattttatttggccttgttaaggatattgccagatttcgaccagatttgaagttgttgatttcaagtgctacactagatgttgctaaattctcagaattttttgatgatgcacctatgtttcaaattccaggaagaagatttcctgtagatatatattacactaaagcaccagaggcagattatgtagatgcatgtgttatatcagtgttgcaaatacatgttacacaacctctgggggatgttttagtatttttgactggtcaagatgaaatagaatcatgtcaagaactacttcaggatcgagttcgaagattaggttcgaaagttaaggagatgattattttacctgtatatgctaatttaccgagtgacatgcaggcaaaaatttttgaacctactcctccaggatccagaaaagttatactggctacaaatatagcagaaacttctttaacaatcgataacataatttatgttatagatccaggatttgctaagcaaaaccattttaactcacgaacaggaatggaaagtttaatggtagtgccaatatccaaagcttcagctaatcaaagggcaggacgagcaggtcgagtggctgcaggaaaatgctttagattatacacagcatggtcctacaaacatgaattggaagataatacagttccggaaattcaaagaatgaatttgggaaatgcagtattgatgttgaaagcacttggaataaatgacttagttcattttgatttcctagatccaccaccacatgaaacgttggtattggcattagaacagctgtatgcattaggagctctaaatcatcatggcgaactcacgaaactaggaagaagaatggctgagtttccagtggaccctatgatggcaaaaatgttgttagcttcagaaaagtacaagtgttccgaggaaatagtttcgatagcagccatgctgtcagtaaatggagcaatattttacagaccaaaggacaaaatcatacatgcggatactgcccgaaaaaacttcaatcatattggaggagatcatctgagtttacttaacgtttataatcagtggagagattctgattattccacacaatggtgttatgaaaatttcatacaatatagatccatgaaacgtgcacgagatgttagagagcagttggtaggtttgatgcagagagtagaaatagaaatggttagcaacataactgaaacagttaatatacgtaaagccataactgccgggtatttttaccacatcgcaaaattgtccaaagcaggaaattacaaaaccgtgaagcacaatcaaagtgttaccattcatccaaacagttcactgtttgaggagctccctagatggattttatatcatgaattggtgttcaccactaaagaatttatgcgacaagttatagaaatagagagtaagtggttgctagaagttgcaccacattattacaagcagaaagaattggaagaaacaaatttgagaaggaaagtttga

SEQ ID NO: 1721 - DNA, 804 bp, Leptinotarsa decemlineata
atgaaggtggaagaagttaaaagtacagttaaaacccagagaattagtgctcacagtcatataaagggtttaggattggatgaatcaggatttgccatacaatcagcagcaggtttggtcggccaagaacaagcaagagaggcagcaggagtagtagtggacatgataaaaagtaaaaaaatggctggtagagcagtgctcctagccggaccaccaggaacaggcaaaactgctatagctttggccattgcacaggaacttggaaataaagttcctttctgtccaatggtaggttctgaagtttacagttcagaaattaagaaaaccgaagtccttatggaaaacttcaggagagcgattgggttacggattagagaaactaaagaggtttatgaaggagaagttagcgagctaacaccagttgaaacagaaaatccttcaggaggttatggcaaaaccgtcagtcatgtcattattgggttgagaacagccaaaggtagtaaacaattgaaacttgatcctagcatttatgaggcacttcaaaaagagaaagtagaagttggagatgttatctatattgaagccacaagtggagctgttaaaagacaaggaagatctgatgcatttgctactgaatttgatctggaagctgaagagtatgtcccccttccgaagggagatgtacataaaaaaaaggaagtcgttcaggatgtcaccttgcatgatttggatgcagccaatgccaagccacaaggaggtcaagatgtattatcaatgatggggcaactcctcaaacccaagaaa

SEQ ID NO: 1722 - DNA, 2208 bp, Leptinotarsa decemlineata
atgacttcaattattaaggttcatgctctctctggggctatggacgaatcgcccccttgttatattcttcaagtagatgaagtcagaatattgctagattgtggttgggatgagaaattcaacatggaatttatcaaggaaataaaaaggcatgtacataccatagatgcagtattactttcttaccctgatgtgacacacttgggagctttaccttatgttgttggaaagcttggtctcaattgtcctatctactcaacaataccagtttataaaatgggacagatgttcatgtatgatttgtatcagtcccaacacaatatgaaggagttttgtatattttctctagatgacgtagatgctacctttgaaaaaatcatacagctgaaatataaccagactgttcctctgaaaggaaaaggatatggtcttacagttacccccttacctgcaggtcacatgattggaggtacaatctggaaaattatgaaggtaggagaagaggatataatatatgctaatgatttcaaccacaaaaaggaaaggcacctgaatggttgcgaacttgaaaaacttcaacgaccctctttggtaattattgatgccttcaatgccacttatcagcaagcaagacgaagagcaagagatgagaaactgatgacaaacattcttcagacactgagaaacaatggtaatgttctcattgctgttgatacagctggacgagtattggagctagcccatatgcttgatcaactgtggcgcaacaaagaatctggtcttcttgcatattctttagcattactaactaacgttagctataacgttgttgagtttgccaagtcgcagattgagtggatgagtgataagttgatgagaagttttgaaggggctcgaaacaatccattccagtttaaacatttacagttgtgtcacactcagggagagttgagcaaagtttccagtccaaaggttgtgcttgctagttcagcagatatggaaagtggctactccagggaactgttcctacagtggtgttcaaatcctgccaacagtgttattttgaccacaaggacatctcctggtactctagctagagacttagtggataatggaggagagaggaccgtagatttaacagtagaaaagagagtcaggttggaaggagcagaacttgaagaatacgagaaacgacagagagaaagatgtgaagacgatgaaaccaaagaagaaggtgattcagattctgatgatgacattgagatgtcagtcatttcgaaaggcaggcacgacattgtcataaaacaggaaggcaaaatttctacagggtttttcaaagtaacaaaaaaaatgtatccgatgtacccattccacgaggaaaaagtcaagtctgatgaatatggagagatcatcaggccagaagattataaattagcagatgtgcctttagaaggagaagataataaagaaaacttggtagttaaaaaagaagaagaggaaataactgagatcccggagatgccaaccaagtgcattgttcttcaaaggactgtccaggtcaattgtcaagtgcattatatcgactttgaaggtcggtccgatggcgaatccctcatgaaaatattatcacatcttaaaccaagacgagtgattgttgttcgaggtactgcagagaatacagcagttattgcaaaatactgtgaggagaatgttcaagttgcgagggtacttactcctgctaaaggagaaattgtggatgcgactagcgagactcatatctaccaggtgcgtcttacagatgccttggtatctcatttagcattccaaaaagccaaagacgcggaagtagcatggcttaatgcccaaatagtcgtaagggagacccaggctgatgctaagagaatgaacattgataatgaaccaatggaaattgacgacgatgacatgaggatactcactttagagccagcctccgaagaagataatcatgaacccgtattcataaatgaactgaaattggcagaatttaaacagattttagcaaggagtaatatcagttcagaattttctggaggagttttgtggtgttcgaatggaactattgcgatacgaagggtggatcctggcaaaataatgctggaaggttgtatatcagaagattattatagggttaaggaacttttatatgaacagtacgcaattttataa

SEQ ID NO: 1723 - DNA, 2280 bp, Leptinotarsa decemlineata
atgccacccttagaggtgacaccaaatagtaataatgaagaaccaggcccaataaatcctgtagtgggtataatttatccaccaccagaagtgagaaatattgttgacaaaactgcaagttttgtggcaagaaatggaccagaatttgaggcacgtattcgacagaacgaacttggaaatcccaaattcaatttcttgaacactggagacccttaccatgcttactatcaacataaagttaaggactttcgagagggaaaaggacaagagcctgctgctggactgaatcaggctattttgaagctatctgtaacttcagcagctcaacaaaaacaacaagaaattttgaagcaagtcgagcagccttttgtaccaaaggatcctccacctgaatttgaattcattgctgatccaccatccatatctgctcttgatcttgacattgtgaaactcactgcacaattcgtagcaagaaacggaagagcatttctcacacagttgatgaatagagaacaacgaaacttccagtttgattttctaaggccacaacattccttatttcagtatttcacaaaacttttggaacaatataccaaggtactcatccctccaaaaagtatgcagcaacgtctccgtgatgaagctaaaagtgccaaatcagttctagaacaagtaaaatatcgtgcagaatggttaaaatatcaagaagcacaaaaggcaaaggaggaggaaatcttggaaagagaaagagttgcttacgcacaaattgactggcatgactttgttgtggtagaaacagttgattaccaaccattcgaaataggtaattttcctcctcccactacaccagaagaagtaggagcacggattctcatccaagaaaggattgaagatggtgaagacatcgaaatgcagcttgaaagtgatgaggaagaaccaccaccagcggacgaaggactaagtacaatgcaagacaaaacacatagtcgtaaaggacgtgatgataatcgtattcaggatatggaggaggaaagttctgaagaagaagatgaatcctcacttaaaccacccccacctccttctattcaaccccctctgccacctgcacctgataaggttttagttaagaagtatgatcctaaacaagctgttaaggtaaccagaccaactgtaggcgatgactacttggtatcgccaataactggtgagaagattccagccagcaaagtccaggagcatatgcgtataggtctccttgaccctaggtgggttgaacaacgtgataagcaagttatggataaaatgaatcaagaaacagtttacgcagctggttcagcaatcgatgcttcattgaaacttctggcagaaagacgtacagatatttttggtgttggtgatgaggaaactgcaattggtaagaaaataggagaagaagatgttaggaaggacgagaaagtaatttgggatggacacacgagtagtgtggaaactgctactagagctgctagagctaacataacactggaagaacagatacaccaaatccataaggtcaaaggattactccctgatgaagaaaaagaaaaaattggccccaaaaatatagggtcaaaatctggcaagatcaacattcagagtgtaataactacaaaaccaccaaatcaaccaccgccacctaagcctcaggtttctctcattcagacgcaaccggctcctccaatggctatacctgtacctccccaacctactatgatggctacgcaaccaccaataatgatgatgactgctcctcctatgcctccaatgagacctcctcctataatgatggcagcaccacctcctatggccagctttgttactccaatgcctcctcctatgggacagccaatgggaatgccaatgaaacatccaaacgatggtatgttagatgatgaaccaagtaataaaaagttgaggaatgaagattctcttgtacccgaagaagtattcatgacaagaaatccaggtccagtgtctatcaaggtaacaataccacttttgcctgagaagtctgaatggaaattaaccggacaggtgatgagcctcacattacccttgggagaaagtgtggctaatttgaaggcaaaggtgcaggaagaaacaaatatgccaccagctaagcagaagttgtttttcgatggaatgtttttcaaggattctaatactttggcatactataatgttacacagggtgcaacgattcaacttcaagttaaggaaagaggaggccgaaaaaagtga

SEQ ID NO: 1724 - DNA, 963 bp, Leptinotarsa decemlineata
atgcctagtcaagaagtgtcgacaacaaaagtaatagtgcaccccttggtgttgctgagcgttgtagaccattttaatcgcatgggaaaaattggtaaccagaaacgtgttgtaggagttctcttgggttgttggcgagctaaaggagtcctcgacgtctccaatagctttgcagttccttttgatgaagatgacaaagataaatccgtgtggtttctggaccacgactacctggaaaatatgtatggaatgttcaaaaaagtaaatgctagggagcgagtggtaggttggtaccacacaggtccaaaattagaccagaatgacatagcaataaacgaactaattaggagatactgtcccaattctgtgttggtaataattgatgccaaaccgaaggatctaggcctcccaaccgaggcatatcaagctgtggaggaagtccacgatgatggatcgcccacttccaaaacatttgagcatgtacctagcgaaataggggcggaagaagcagaggaggtgggagtggagcaccttctgagggatatcaaagataccacagttggcacgttgtctcaacgaataaccaatcaactcttaggtttgaaaggtctgcacctgcaactgcgggaaatccgagactacttgatacaagtctccgagaacaaactaccaattaaccatcaaatcatttaccagctgcaggatatcttcaatttgcttcccgatattaaccaagccactttcaactcatccttctatataaaaaacaatgaccaaatgttggttgtctatcttgctgctttggttaggtctatcgtggctttgcacaatttgatcaacaacaaacttaccaataaagatgcagaggagggaaagaaagaagaggcgaaaaaagataaagaaaataaggagaaagagaaggaaaaagataaagatgggaagaaggatgacaagaagaaataa

SEQ ID NO: 1725 - DNA, 1596 bp, Leptinotarsa decemlineata
atgtttggtggaggacgtgcccctattttagttttaagccaaaatactaagcgtgaatcaggcagaaaagtccaggtggaaaacatcaatgccggaaagcaaatagcagatgtgattcgaacatgcctggggccacaagctatgttgaaaatgttgatggatcccatggggggcatcgtaatgacgaacgacgggaatgcgatccttcgtgaaatcacagtgcaacaccctgccgcgaagagtatgattgaaatcgccaggacacaagacgaagaggtaggagatggaactacttcagttattgtattagccggagaaatgttggcagctgctgagcagtttttggaacagcagatgcatcccacaatcattattcgacagtacaggcaagctctcgaagatattgtgcagttatgtgaaggacctctaagtattgccatagaaagagatgacaaagcagctcttgctaatgtggttaaaggttgtgttggcactaaattcctcagcaaatggtcagatttggcagtaaacattgccctggatgctgttaacacagtttttctagaagaaaatggtcgcattgaagtggatatcaaaagatacgccaaagtagaaaaaattcctggaggatctatagaagagtctcgaattttgaaaggtgtgatggtcaacaaggacgtgacacatccaaaaatgaggagatatatcaaagatccacggatcattcttttggactgtgcactggaatacaaaaaaggagaatctcaaaccaatgttgaaattacttccaacatggatttctcaagactactggagctcgaagaggaacacgtcaaacgtcagtgcgatgacattatcgccctcaaacctgatgtagtcttcacagagaaaggtgtttccgaccttgcccaacatttccttctcaaagctggcatcactgccatacgacgagttcgcaaatcagacaataatagaatcgcaagagcttgcggagctaccatcgtcaacagaacggaagaattacaggaatccgatttaggattgggagctgggctctttgaaatcaagaagattggagatgaatacttctgtttcattgtcgaatgtaaggatcccaaggcttgcaccatattgctacgtggcgctagcaaagatatcctgaacgaaactgaaaggaatctccaagacgccttgcaagtagcgagaaatatagttctgtccccaaggctggttcctggaggaggtgccatcgaaatggcggtagcccagcgattattgcaaaaggctagtcatggtccttacagggctttagcgcatgctttagagataatccctcgtacgttggcccaaaactgtggtgctaacacaatacgtacgttaacgactctaagagcaaaacacgccaaccatacagacttgaataaaccatgcacttggggtattgatggagagagcggtgaattggtggaaatggacaagaaggagctttgggaaccactggctgtgaaactccagacctacaaaactgccgtagagacagccattcttcttttacgtatcgacgcggtcgtttctggttctaagaagaagggagat

SEQ ID NO: 1726 - DNA, 405 bp, Leptinotarsa decemlineata; identical to SEQ ID NO: 1707

SEQ ID NO: 1727 - DNA, 951 bp, Leptinotarsa decemlineata
atgtcgagacgtgcatatagagctagacgtgatagagatagaccagcatacaatgagtttcaatttggattcaacatgtttccggaaattccgaggcctttcaacattacatatcagtgcttctctgtagctatgctacctggaaatgaaagacaggacgttgaaagaggaggaaaaattatcatgccaccttccgcgcttgagaagctgaccaggctgaacataaattaccccatgttatttaaacttgttaacaaaaaaactaatagagtcactcactgtggtgttttggagtttgtggctgatgaaggcaaagtttatctaccactctggatgatgcacaatttggtacttgaagaaggagatttggtacaaatggaaagtgtttctctgcccgttggaaccttctcaaagttccaacccttgaatccagattttcttgacatcacaaatccaaaggcagtgttggaaaattgtttgaggtcttttgcttgcctcactacaggggatgtcatcgcagttaaatacaatcagaaagcctatgagctgtgtgtactggaaactaaacctggagacgctattagcattatagaatgtgacatgaacgttgaattcgctgctcccgtgggttataaagagcctgaacaaaggaagaaagaagaagaagaagccgcagtggatcctgccgagctgatgccggagccttctgggtttgttgcttttcgtggaactggaaatcgtttggacgggaagaaacgaaaagattccacatctagtgatttcgcatcagccaaacccgtctatgtcagaggtataccagattatgactaccaaatcgggactttgaaatttatcaggcgaccaatcaagcagaagagtgatgatatcgaagagagtgaggaatttaaagcttttagcggaacaggatttagtttaagaggtagaaattaa

SEQ ID NO: 1728 - DNA, 1617 bp, Leptinotarsa decemlineata
atgtctagttttccaggaagtattgcttttgacgaatatggtcgacctttcatcattattcgtgatcaagaccaacaaaaacgattaacaggaattgatgcacttaagtcacatattttggctgcaagacaaattgctaacactattagtacttctttggggcccaagggattggacaaattgatggtgtctcctgatggtgaagtgactgtcaccaacgatggagctacgatattgaagatgatggatgtggagcatgaagtcgccaagttgttagtggaattgtctcaatcacaagatgatgaaattggtgatggtaccacaggtgtggtagttcttgctggagccttgctcgaacaagctggatctcttcttgatcgtggaatccatcccatcagaatagctgatggcttcgaattggcttgccaaactgcagttcagcatttagaaaaaattgctgaagtttttccagtttccgccgaaaatacagatcctcttatcaaggtagccatgaccactttgggatcaaaaatcatcaacaaatgtcaccgtcagatggcagaaatagcagttaatgcagttttagctgttgccgacttaaagactaaagatgttaattttgaactcattaaaatggaaggaaaggttggtggaaagttggaagacagtacactcgttaaaggagtggtcattgacaagacaatgtctcatccacaaatgccgaaagaattgaagaatgtaaagttagctatcctcacctgcccatttgaaccaccaaaaccaaagaccaaacataagttggatgttaccaatgttgatgaatataaggaactacgacagtatgaacaagacaaattcaaagaaatagttggattggtaaaaaatgttggagccactttggctatctgtcagtggggtttcgatgatgaagcaaatcatttattacttcaacaggagcttccagcagtcagatgggtgggaggaccagaaatagaactcatagctatcgcaactggaggacgcattgtacctagatttgaagagttgagcccagagaaacttggcactgctggtctagttagggaaatatcttttggtaccacaaaagacaggatgctggtcattgaagagtgctcaaattctcgagctgtcactattctcgtacgtggcggcaatcagatgctggtagctgaggcaaagaggagtttacacgatgccttgtgtgttgttcgaagtttggttcaggaacccagagttgtttatggaggtggtgcagctgaaatttcgtgcagtctggctgtctctgcccaagcagatcagcttgctactctagagcaatacgctttccgtgcattcgctgaagccttagaaagcattccgttggctttggcagaaaacagtggattgtcatccgttcatgttcttggagaattgaaggccaagcagtccgctgccgaagatcccgctttgggtgtcgattgtatggatacaggtaacataaacatgagagaacagcacgtcattgaatctcttaggtctaaacgtcaacagctcctcctggcgactcaactggtcaagatgatattgaaaattgacgacgttcgccagcccaattaa

SEQ ID NO: 1729 - DNA, 342 bp, Leptinotarsa decemlineata
atggcttcagcaatggatgtagatgctgaagaagttgaaatgcccacttcaagtagttccaaaggagaaaaaaagcgttttgaagttaaaaagtggaatgctgtggcattgtgggcatgggatattgtcgtggataattgtgctatttgtcgtaatcatattatggacttgtgtattgaatgtcaagcaaatcaagcttcagctaccagtgaagagtgtaccgtagcttggggtgtatgtaatcacgcctttcatttccactgcatttcaagatggttgaaaactagacaggtttgtcctttagataacagggagtgggaattccaaaaatatggccattga

SEQ ID NO: 1730 - DNA, 1605 bp, Leptinotarsa decemlineata
atggtctccctgaacccagttagaattttaaaaaatgaagctgaagaagataaggcagaaattgctagactgagcagttttataggtgctataactatgggggatctagtaaaaagtactttggggcccaaaggaatggataagattctagtatccagcggaagaaatgcaggatctgtagaagtaactaacgatggtgccaccattctcaaatctgtcggtgtggataatcctgctgcaaaaattctcgttgacatgtcgaaagtgcaagatgatgaagtaggtgatggaaccacatctgtcacagttttagctgctgaacttcttagagaagcagaaagactgatcgaacagaaaattcatccccaaacgattattgctggttggaggaaagctgttgatgtagccagaaaagccctgcgggatgcttcaatggataacagcgataatctcgaaaaattccgtgaagatctgttgaacattgccaggacaactctgagctcgaaaattctctcacaacacaaggaacattttgcaaaactatccgttgatgcggtactcaggttaaagggatcaggagatttacaagctatccagcttatcaagaaaactggtggtactctggaagactcatttctagacgaaggtttcttattggacaaaaaaccaggagtccatcaacccaaaacagtggagaacgccaaaatactcatcgcaaacactcccatggactctgacaaaattaaagtattcggctcccacatcaaagttgactcaatggccaaaatagctgagctggagtccgccgaaaaggaaaagatgaaggacaaagtcaacaagatcctgaaacacaatgccaacgttttcatcaataggcaactcatctacaactaccccgagcagctgtttgccgatgcgggcgttatggcgatcgaacatgctgattttgatgggattgagcgtctggcgctcgtcactggaggagaaattgtctctacgttcgaccacccagagctggtcaagttgggaacatgcgatctcattgaacagataatgatcggagaggacattctcctgcgcttcagcggcgtcgctctcggagaagcgtgcaccattgtcatccgcggcgcgactcagcaaataatcgacgaggcggaccgatccctccatgacgccctctgcgtcttggcagcgaccgtcaaagagagtcgcatcgtcttcggcggcggctgcagcgagacgctcatgtcgacagcagtgagcagggcggccgccaacacgcccggcaaggaggccgtcgccatggaggcgttcgccagggcgctgctccagttgccaaccatcatcgctgataacgcagggtacgattctgcgcagctagttagcgagttgagggccgcacacaatgccggaaagagcactctggggctggacatggaacgcggggaagtgggcgacatgagcgtgctcggcatcacggagtcttttgtcgtcaagaggcaggtgctggtgtctgcctctgaagctgctgagatgatcctgcgtgtggataacatcatcaaggcggcgcccaggaagcggacggaggacagggggatgtgctag

SEQ ID NO: 1731 - DNA, 846 bp, Leptinotarsa decemlineata
atgtttagaaatcaatatgatagtgatgtgaccgtctggagcccccaggggcgtcttcatcaggtagaatatgcaatggaagccgttaatctaggttcagcgactgtaggtttgaaaagtaaaactcatgcagtgctcattgctcttaaaagagcctcttcggagctctctgcctatcagaaaaagatcatcaacatcgacgagcatattggaataactatttcaggactcactgcagatgctaggatccttagtcgatatatgaggaatgagtgtttgaattacaaatattctttagatgcccatatgcctctgaatagactcataagcacgttaggtaataaaatgcagcactgtactcagcgctatgaccgtagaccatttggagttggtcttctagttgctggctatgatgagtcaggttctcatatctatcaaacatgtccgtcagccaacttttatgactgcaaagctatgtcaataggtgctaggtcccaaagtgcgagaacttacctcgaaaaacacctagatgaacttccttcctgttccctggagcaactcgtcaaacacggtttacgtgccttaagagataccttgcccccagaggtagacttgactacaaaaaatgttgcgattggttatgttggtaagggacagcctttccaaatattggaagaaaatgaaacggctccatatttggccctgattgagggagaggaaagaagaggtggtggggcaggaggagctggtgttgaggctcagcaagccgatcccctgagggaagatacgggggacgaagggcccagagacccagtgccaacaacagcaatggataccacagattaa

SEQ ID NO: 1732 - DNA, 2502 bp, Leptinotarsa decemlineata
atggtgcaacaatccgaacacatagaaataaaattcagtgatgatgacttgccttatgaagaagagattcttcgcaacccgtattcagtcaagcactggttgcgatatgttgaacacaaaaaggcagctcccaaaggagtcaacatcgtatacgaaagagccctgaggcaactgccaggttcttacaaggtatggtataaatatctacgaactaggagaatgcaagtcaaatctcggtgcataatagaccccgaatatgaagaggtaaataatgcattcgaaagggccctagtgttcatgcacaagatgcctcgaatctggatggactactgcacattccttaccgatcagtgtaaaataacaagaaccagaaatgtgttcgacagagctttgagagcgttacccgtaacacaacataataggatttggcctttgtacttgaaatttgtaaagcagcatgatattcctgagactgctgtccgggtattcaggaggtactggaaactgtgtccagaaaatgctgaggaatatgtggactacctcacagaaataggtcggcttgacgaagctgcccaagtattggcaaaaattgtcaatgatgaaaattttgcttcccagaaaggaaaatccaagcatcaactctggaacgagctttgcgaactcatatcaaaaaatcctgacaagattcgttccttaaatgtggatgctatcatcagaggaggcctgagacgctatactgatcaactgggccacctctggaactccttagcaaactactatgtacgcagtggcctattcgaaagagcaagagatatttatgaggaagctattcaaacagtcactaccgttcgtgatttcacccaagtttttgattcttacgcacagtttgaggaattgagtctcagcaagaaaatggaagaggttgctaatcaggctaatcctacagaagatgatgatacagatctggaaatgaggctatccaggtttgaaaatctcatggaaaggagattactgttgcttaactccgtacttctgagacagaacccgcataacgtccaagaatggcataaaagggtccaactgtatgaagataaaccactggaaataatcaacacttacacagaagcagtgcaaactgtggatccaaaactagctgtgggtaaacttcacaccttatgggtggatttcgcaaaattctatgagaaaaacgggcagattgatgatgccaggcttattttcgaaaaggccacgcaagttccatatgtgaaagtagatgatttggcgaatgtttggtgtgaatgggctgaaatggaaatccgaaatgaaaattatgatgaagctttgcaacttatgcatagagcaacagttatgcctagtcgaaaagtggcctatcatgatgactcagaaacggtgcaaagtagggtctataaatcgctgaaagtgtggtccatgtatgctgatttagaagaaagtttcggtacattcaaatcttgcaaagctatctatgatcgcataatagatttgaaaatcgccacacctcagatcatcatcaactacggattatttttggaagaaaataactactttgaggaagcgttcagggcttacgaaaaaggcatctctcttttcaagtggccaaatgtttacgacatttggaatacttatctcaccaagttcctcaaacgatatggaggtactaaacttgaacgagccagggatcttttcgagcagtgtttagaggggtgtcctcctcagttcgcgaaacatctctaccttctctacgccaagctggaagaagagcatggaatggctagacatgcgatggctgtttacgaaaggtctaccaaagctgtgccagaaggagaaatgttcgaaatattcaatatatacataaagagagcggcagaaatctatggtatcccaaaaactaggcaaatttatgaaaaggcgattgaggtgctaccagaagataaaacgagggatatgtgcattaggtttgctgatatggagacaaaattaggtgaaatagacagagcgagagctatctatgctcattgcagccaaatttgcgatccgcgtataacaaacgaattctggcagatttggaaggagttcgaagtacgacacggcaacgaagacaccatgcgcgagatgctgaggataaagcgtagtgtccaggcaatgttcaacacccaggttaacatgatgtcggcgcagatgctgagtacagctgccagtatgtctgggactgtcgcagatctggcacctggtgtcaaagatggaatgcgattgctggaagccaaagcagtggaaatgtctggaataaactttgtcaggggagaaacccagggagataaaaaagacaaagttgtcaatcctgatgagattgatatcgatgatgaagatgaagaagaggagatacctgtggaaaaacaaagtattccctccgaggtatttggaagtttgcgggtgcaggtacctgtagaggaagatgaccagtga

SEQ ID NO: 1733 - DNA, 1185 bp, Leptinotarsa decemlineata
atggcaaatggaccaatagcagaaagaaatcgagatgctactatatatgttggaggcttggatgacaaagtgtcggaatctcttttatgggaactttttgttcaagctggaccattggtcaatgttcatatgcccaaagatcgggtaactatgatgcatcagggatatggattcgttgaattcatgggcgaagaagatgctgactatgctattaaaataatgaatatgattaagttatatggaaagcctattcgagtcaataaagcctccgcacaccaaaaaaatttagatgttggggctaatatcttcataggaaatttggatcctgaagttgatgaaaaattgttatatgacacattttctgcattcggagtcattttgcaaactcctaagattatgagagatccagaaacaggtaactccaaaggatttgcattcataaatttcgccagttttgaagcttcagatgcatccattgaagcaatgaacggccagtatctctgcaatcgacctatttctgtatcgtatgctttcaaaaaggactccaagggtgaaaggcacggttctgctgcagaacgtttacttgctgctcagaatcctctctcacaagcagacaggcctcatcagctctttgccgatgctcctccaattggtatgatgcccatgacgatagctccaccacctcctcctgttattttaacagggatgatgccacctcccactcccgcaaacatgcaccctcctccgccaccaccagttcctcctccaagtggatttccttcaggtataccgcctcctccattaccaccatcccaaccaccgttacctccgggagctcctcctccacccccaatttcggcctccactggatctacacctagaccaccacttccccctaatccgacttccgctccaggtggtccccctcctccacctcgtttgattccaccaccatggccaggagcaggggcaggtgttatcccacctcccccaccaggtccacctgggtctgtatcgtcaactgcagctacaccatttgcaggaatgtttccaccaccaccgccaccaggaggtcgaccacctcctccaaactggagacctccgccacctcctagttttcctgcggggcgacctccatttcctccgagagggccacctccaccccccgcaacttttgaaagctga

SEQ ID NO: 1734 - DNA, 774 bp, Leptinotarsa decemlineata
atgggtcgtgtaattcgtgcccaacgtaaaggagcgggatcagtgttcaaatctcatacaaagagaaggaaaggagcaccaaaattgcgttatttggacttttctgagcgacatggatatattaaaggtgtcgttaaggaaataatgcacgatcccggccgtggcgctccattagctatggttcatttcagggatccctataaattccaaacaagaaaagagttattcattgctcccgaagggatgtatacaggacaatttctgtattgcggaaagaaggctagtttgcagattggaaatgttttgcctgttggaaccatgccagaaggtacaatcgtatgtaacttagaagaaaagactggcgatcgtggtcgtcttgcaagggcatctggaaactatgcaacagttattgcccacaatcatgacacaaaaaaaaccagggtcaagttaccatctggtgccaaaaaagtcattccttccaacaatagggccatggttggtattgttgcagggggtggtcgtatcgacaaaccaattcttaaagctggacgtgcctatcacaaatacaaggttaagcgtaactgctggcccaaggtacgtggtgttgctatgaatcccgtcgaacatccccatggtggtggtaaccatcaacacattggtaaagcatccactgttaaaagaggtacctctgctggtcgtaaggttggtctcattgccgccaggagaaccggtcgtattcggggtggtaaagtggatgccaagaaggaagattaa

SEQ ID NO: 1735 - DNA, 411 bp, Leptinotarsa decemlineata
atggctcgtaccaagcagaccgctcgtaaatcgactggaggtaaagctccgagaaaacaattagctactaaagcagctcgcaaaagtgcaccggctacgggaggtgttaaaaaacctcatcgttacagacccggtactgttgctctccgagaaattcgacgttatcagaagagtactgaattgttgattaggaaattaccctttcaacgtttagttcgagaaatcgctcaagatttcaaaaccgatttacgattccaaagttcagccgtcatggctttgcaagaagctagcgaggcgtatttggtaggactcttcgaagatacgaatttgtgcgccattcacgccaagcgcgttaccattatgcccaaagacattcagttagcaaggagaatacgcggagaacgagcttaa

SEQ ID NO: 1736 - DNA, 1593 bp, Leptinotarsa decemlineata
atggctataagtttgttgaatcctaaagccgaagtagccagagctgcacaagcactggctgtcaatatttctgctgctaaaggaatccaggatgtaatgaaaaccaatttgggccccaagggaactgtaaaaatgttggtatctggagctggtgatatcaaaataaccaaggatggaaacgtgctgttacatgaaatgcaaatccaacacccaacagcctctcttattgcccgagcctcaactgctcaagatgacatgactggtgacggaacaacatctactattcttgtcataggtgaacttctcaaacaggccgatatttatgttgctgaaggtttgcatcccaggatacttacagaaggatttgataaagctcgggctaaagcgttagaagtgttggaaaaaatcaaaattcctgttgaaatcaacaaggaaagtttgaccgacgtttgcaggactagtttgagaaccaaggttcatcaaaaacttgctgatgtattgacagatgtttgtgttgatgcagtactagcaatcaaacaaggcgataaacctgtagatcttcatatggttgaattgatggaaatgcaacataaaacagaaacagacacccaactcgttaaaggtctggttcttgatcatggtgctcgtcatcctgacatgccgaagagccttaagaattgttacattctaacttgtaacgtgagcatggagtatgagaaaagcgaggtcaactcgggattcttctacaaaacagcggaagaaagagaaaagatggtttctgctgaacgtggattcattgagcaaagggtcaaaaaagtaatagctttaaagaaatctgtatgcgacggtacaaacaaaacatttgtggtcatcaaccagaaaggtattgatccgatgagcctggatatgctggccaaagaaggtattattgcccttcgcagagctaagaggcgtaatatggaaagacttgctttggcatgtggaggaattgctatgaatagttttgacgacctccaggagtctcatcttggtcaggctggtcacgtatatgagcatgtactaggtgaaaacaagtataccttcatagaagactgtaaggttccacaatctgttacaattttaatgaaaggacctaataagcacaccttggtacaaatcaaggattccgtaagagatggtttgagggctatcaataatgctattgaggataaagctgttataccaggtgctggagcttttgagattacggcaaataaagagctattagctttcaaagacactgttaaaggaaaagttcgtcttggtattgcagcttatgccgaggcacttttagtcattcccaaaacattggctgttaattctggatttgatgctcaggacaccattgtcaaactccaagaagaatctcgattgaatcctgaacctgtaggacttgacctgacatctggagaacctatcaatccaaaagatgctggcatctttgacaactacgtggtcaagaaacaaatcataaactcctgctctgtcattgccagtaacctattacttgtggatgagattatgagggcaggcatgagcagtttgaaaggataa

SEQ ID NO: 1737 - DNA, 3147 bp, Leptinotarsa decemlineata
atggacgaatcctcaaaccgcggtctttcgcgtccgatgtctagtgctgcaattgcaggcagctccgtcgatccaccagcaaagaagcgaaagctcgaaacttcaaccctcgaaatggcgaacagttcaggaccgtctcgagccagcgaaatcgacgaggggctgtattctcgccagctctacgttttgggacacgacgcaatgcgtcgtatggctaaaagtgatgtactcatatcgggcttgggggggctgggagtggaaatcgcgaagaacgttatcctggggggcgtcaagtcggtgaccctccacgatgaggtcgtttgtactattagcgacttgtctagtcaattttatatttcagaatctgacgtcgggaagaacagagcggaggcttgttgcaaatctctgtcagaactcaataactatgtacccacgaaggcgtacacgggccctctcgacgaacagttcatcaaaaacttcagcgtcgtggtccttaccacgagttcaaggtctgaacagctgcgcatcagcgaaatcactcactcaaataacatcgccctgattatcgcagatactaggggcttattcgcccaggtgttctgtgatttcggggagtctttcaccgtcgttgataccaatggggaacccaccgtttcggcaatgattgctgatatttccaaagataaggaaggtgttgtcacctgtatagacgataccaggcatggtatggaagacggggattacgtgacattctccgaagttcaaggcatgacagaattgaataactgcgagcccatcaaaatcaaagtactgggaccctatactttcagcatcggcgacactacatccttcgggaaatatgaaagaggcggtaacgcatctcaggtcaaaatgccaaaagagctgcatttcaaacccctcaaagaatcgctgctggctccagagttcgtcataacggatttcgccaagattgacagcccccagcaactccacttagctttcaccaccctccacaagtacttcgagaagaacggtagggttcccaaaccttggagcaacgaagacgctgacgagtttgtttctttggcaaagtctatagccgtagacggttcaaatgatactgaagtcaatggtagtttattggaaacgtttgctaaagttgcggcaggagatttgaatccgatgaatgccacgatcggaggcgttgtggcccaggaagtgatgaaggcttgctccgggaagttccacccgatttatcaatggctctatttcgattcgatcgaatgtctaccccaagatcgttctgaaatcacagaagaattagctgctcccttcggcagtcgttatgatgggcagattgcagttttcggaaaagaattccaaaagaaactagccgcactgaaatacttcgtagtcggcgctggcgccataggatgcgagcttttgaaaaatttcgcaatgatgggtgtgggcactgagggacaaataacggtgacggatatggatttgattgaaaagtccaacttgaacaggcagttcctgttcagaccacacaatgtgcagcagccaaagtctgctacagcagcaaaggtaatcaaaaagatgaaccctgaagtaaacgtcgtggcccacgagaaccgcgtaggcccagagacggaaagcatctacaatgacgctttcttcgagaaacttgatggcgttgccaacgccctggacaacgtcgacgccaggatatacatggaccgcagatgcgtctactaccgcaaacctctgctggaatctgggacgctcggtacgaaaggcaacactcaagtcattgttccgttcttgtctgagtcgtacagctcgtctcaagaccctcctgagaagagcatacccatctgcaccctgaagaacttcccgaacgccatcgaacacactttgcagtgggctcgcgacaacttcgaggggctctttaggcagaacgccgagaacgcgtcgcagtacttgaaggatgccggtttcatcgatcgcaccctcaagttacctggagtgcagcccttggaagtcctcgaatcggtcaaggcagctttggtcgacgagaggcctaaatcttttgaagactgtatcgcctgggcccgcaaccactggcaggagcagtactcgaaccagatcaggcagttgttgttcaactttcctccggatcagctcacaaccaccggccagttgttctggtcggggccaaaacgttgcccggaagcgctcactttcgatatcaataatcctctccatttggattacgtccttgcggctgctaatttgaaagcgcaggtgtatggtattccgaccaacagggacagggcatatattgctgaagtggtcagcaaggttgaggtaccagagtttgtgccgaagtctggcgtcaaaatagctgttacagactcccaaatggccatgaacggtaacaacgtcgacttggatcgagtaactcaaattaaagaggagctaccctccgtcgaagaactgaacgggctccgtcttactccgctagaattcgaaaaggatgacgacaccaatttccacatggatttcattgttgctgcttctaacctccgagcagcaaactataaaatacctcccgcagacagacacaagtctaagctcattgcaggtaaaatcatcccggctattgctaccacgacatccgtcgtaggggggctcgtctgcttcgagctgtacaaactgacacgaagcatgaagagtttagaaccattcaaaaacggctttgtcaacctcgcgctgcctttctttggcttctccgagccgatcgcggcccccaagatggagtactgtggcaacgagtggacactgtgggatcgcttcgaggtccaaggagagatgacgctcagcgagttcttaacgtacttcaaagagaagcacaacctcgagatcacgatgctctcccagggcgtttgcatgctttactcgtttttcatggcaaaggccaaggcgcaggaaagactcggactgaccatgtcagaggtagtcaagaaggtgtcgaagaagaagctagaaccgcatgtgagggctcttgttttcgagttgtgctgcaacgacgccgaaggcgaagacgttgaagtgccctacgtgaaatataatctgtgttga

SEQ ID NO: 1738 - DNA, 792 bp, Leptinotarsa decemlineata
atggcagatgcagatgatcttttggactacgaagatgaagaaaatactgaacagactaccactgagacaacagctaatgaagcacaaaagaaaggggtcaagggcacttacgtatccatacacagttcaggcttcagagattttttattgaaaccagaaattctaagagctatagttgactgcggttttgaacacccttcagaagttcaacacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggccttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgttaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatgtaattgaaaattatttaaatacaaatttagtgcccgcttgctatcctcgtatcgttaaatga

SEQ ID NO: 1739 - DNA, 864 bp, Leptinotarsa decemlineata
atgggtctggttgaaacagacgtcgaaatgaagaacgctgatagccctccaggtttggaagctggggacagcaaacgtgatacagacctacaaagtgttttggagattcgtgagcatgccaggcaaatagagaagtccgtcactagtaaagaaaaccgttttattctaagagttctacggtgtttacccaatacaagaagaaaactgaatggtgtcgttctgagaagtcttatcaatcaaatctatccagtctccgaacgtgaagctctgctgaatttcactgaagaagctgttggagatttagacaccacccaggcaagggccagatctgccaccaaatcgccattaccagaggttgatacatatataaatttattgattttggttcgtctcatcgataccaataaactacaagaagcagaaaggtgttctcaggcactaatgaacaaaataacaactcaaaatcgacgtaccatagatcacatagctgccaagtgttacttttatcactctagagttgctgaactttcaaataaacttgatacgatcagagctttcttgcactcacgtcttcgtactgctacgcttcgaaatgattttgaaggtcaagcagttcttgtcaattgtttactaagaaattacctgcattactcgttatatgatcaagcagataaactggtgagcaaatgtgtatttccagagacggccagcaacaatgaatgggcaagatttttatactatttaggtcgtatcaaagcggctcgattagagtatagtgttgctcagaaacatcttgtacaagctatgaggaaagcgcctcagaacgctgctattggattccgccaaacagtgcaaaaactcacc

SEQ ID NO: 1740 - DNA, 981 bp, Leptinotarsa decemlineata
atgccaggaacaaaagtggatagcaaacagcgaatcacagtaaggaacctgaggataagagaagatactgcaaaatatctgaggaatttggaccttggctcagcgtattacgatccaaagactaggtctatgagggaaaatccaaatcctaataaagatgatacttaccatggagagaatttcgttcgattttctggagacactcaaaatcatgccaaagcccaattatttgcttgggaagcatatgaaaaaggagtcgacgtccatttactggctgaaccgacaaaacttgagctacttaaaaaagagtatgagaaaaaaaaagaacaaatcaagaccaaaattcagagcaatgttctggaaagatacggaggtgaggagcacttagaagaacctcctagaagtctgctgcttgctcaaacagaagattatattgaatactcaagatcaggcaaaattattaaaggagctgagaaggaggtgatcaaatccaagtatgaggaggatgtttacataaataatcatacttctgtttggggatcgtattggcgtggaggccagtggggctataagtgttgtcattcatttatcaaaaattccttctgccttggagaagccggtagaaattcggagattgttaagcctcacgagctgccagaaagtagaggtgatgtgaacgaagatatacctgatgataagaaagggaatagtgatcgagatgagagcagctccagttcatcggacgaaaaatctaagaagaagaaacagaaaagagaaaagaaaaaactcaagaaaatgaagaagaaactgaggcaagaaaaacacataaccaacaaaatggaagaaacagaagaaatcatggatgagagaaaacgaccgtataacagtatgtatgaggtgaaaaagcctacggaagaggagatggaacaatatttcaagaagcgaaagagggatgaagatccaatgaatcagttcttgtag

SEQ ID NO: 1741 - DNA, 627 bp, Leptinotarsa decemlineata
atgggtatcagccgagatcactggcataaacgaagatcaaccggaggcaaaaggaagcctctgcgtaagaagaggaagtttgaattaggtcgccccgcagctagtactaaactaggacctcgcaggatccactatgttcgtaccagaggtggtaatttgaaatatagggctctaaggctcgacactggaaattttgcctggggtagtgaaggaactgcgagaaaaacccgtattattgatgttgtctacaatgctagcaacaatgagttggtgcgtaccaaaacattagtgaagaatgcaatagttgttgtagatgccactccattcagaatgtggtatgagaatcattacatcctgcctttgggtcgcaagaagggagccaaactgactgccgaagaagaggctcttttagcgaagaaacgtagtaagaaagtacaaaagaagtacgaaactcgtcagaagacttctaaagtagaacctgctatcgaagagcaattcacaactggaaggttgttggcttgcttggcgtctcgaccaggacagtgtggaagggcagatggctacattttagaaggaaaagaattagagttctacatcaggaaaattaaatctaagaaagcaaagtaa

SEQ ID NO: 1742 - DNA, 936 bp, Leptinotarsa decemlineata
atggaccgacttttgagacttggaggaggtatgccaggtttgagtcaagcacctcctccttcagatgcacctgtggtagatacagctgaacaagtgtatatttcctctctggctttactgaagatgctgaagcacggccgtgcaggagtaccaatggaagtaatggggcttatgttaggtgaatttgtagacgattacacagtcagagttattgatgtatttgcgatgccacagacaggtacaggtgttagtgtagaggctgtagatccagttttccaagctaagatgttggacatgttacggcagactggtagaccagaaatggtggtgggctggtaccattcccatccaggattcggttgttggctgtcgggtgtcgatatcaatacccagcaaagttttgaagccctttccgaaagggcagttgctgttgtagtagacccaattcagtctgttaaaggcaaagttgtaattgatgccttcaggttgataaaccctaacatgatggttttgggtcaggaacctcgacaaacaacctccaacttaggacacctccagaagccttcagtgcaagctctcattcacggtttgaataggcattattactcgataagtatcaattatcgaaaaaatgaactggaacagaaaatgcttctcaacttacacaaaaagtcctggatggatggccttaccttagcggactatgcagagaactgtagtgtaaatgaaaaaaccgtgtctgacatgctggatttggctaaaaattataacaaagctctggaagacgaggaaaagatgacaccggagcaactagcgatcaagaacgtcggcaaacaggatccgaaaaggcatttggaggagaaagttgacgttttaatgacaaataacattgttcagtgtttgggagctatgttggacaccgttgcatttgaataa

SEQ ID NO: 1743 - DNA, 1215 bp, Leptinotarsa decemlineata
atgacggtgattaataaaatggagattgacggtgccactaaaggtgaaggcttcaggtcttactacataactaagatagaggagttacaactcatagttgccgaaaaaagccaaaatttacgtcgtctacaagcacaaagaaatgaactaaatgcaaaagttcgaatgttgagagaagaattaatgctgcttcaagaacaggggagttatgttggtgaagtagttaaaccaatggacaaaaagaaagtcctcgttaaggtgcatcctgaaggaaaatttgtagtagacattgacaaaaacattgacattaatgatgtgacaccaaactgccgagttgcattgaggaacgagagttatactttacataaaattttacctaataaagtcgatccccttgtatctttgatgatggttgaaaaagtacctgattcaacttacgaaatggtgggaggcttagataaacaaataaaagaaatcaaagaggttatcgaattacctgtgaaacatcctgaactattcgatgcccttggtatagcacagcccaaaggggtgcttctttatggaccaccaggaactgggaaaactcttcttgctagagctgttgctcaccatacggaatgtacttttattcgtgtatctggttccgagttagttcaaaaattcattggagaaggttctcgcatggtgcgtgaactattcgttatggccagggaacatgctccttctatcatattcatggatgaaattgattctattggatcatctcgaattgaatcaggttctggtggtgattctgaagtgcagaggaccatgttggaactccttaatcaactagacggttttgaagctaccaaaaacatcaaagtcattatggctacgaatagaatcgatattttagaccctgcactacttaggccaggcagaatagatcgtaaaattgagtttcctccaccgaatgaggaggcaaggttggatattctgaagatccattctcgaaaaatgaatctaactagaggaataaacttgaggaagattgctgagctgatgcctggggcaagtggagcagaagttaagggagtctgcactgaagcaggtatgtatgcactgagggagagaagagtacatgtaactcaggaagattttgaaatggctgttgctaaagttatgcaaaaagattctgaaaagaatatgtctatcaaaaagttgtggaaatga

SEQ ID NO: 1744 - DNA, 645 bp, Leptinotarsa decemlineata
tttttgttacttgtcaaaagtcttgtaggtgtttgtttattgaaaatggtcaagttgtactgtattagtattttatacaagggccctacttcagctacatggttaaaatctgcattcgaattgcaaacatttaattttttccaaagagggtctgtccaagagtttatgacttttttttgtaaaaccatcgtggaaagaaccatacctgcttctagacagtcagtcaaggaaggagaatatctgtgtaatgtgtatgtccgttcagataatttggctggggtcgtaatatcggaccatgagtatccatccagggtatcacacactttaataacaaagcttttagacgagtttgcagaaagaatatcacctgcaaattggcctaaccttcaagagaaagatgtggcatttccacaagttactacttatttagcaaaataccaaaaccctcgagaggctgatgcattaactaaaatacaagaagacttagatgaaactaaaataattttacataatacaattcaggcggtgttggaaagaggggagaagttggatgatttggtatctaaatcagaaggattgagcatgcagtcgaaggctttttataaaacggcaaagaaaacaaatagttgttgtacatttagttaa

SEQ ID NO: 1745 - DNA, 804 bp, Leptinotarsa decemlineata
atgttcctaacaagaagtgaatatgaccgaggggttaatacgttctctcctgaaggacgtttattccaagtggaatatgctattgaagccattaaattgggttctacagctattggaatatgcaccagcgaaggagtcgttttagctgttgagaaacgtataacatccccgttgatggaacccactacaatcgagaaaatagtcgaagtcgacaagcacatcggttgcgcagtgtctggccttatggcagattctcgaacaatgatagacagagcccgtgtagaatgccagaaccattggtttgtctacaatgagaacatgagtgtagagtcatgcgcccaaggtgtgtccaacttggctattcagtttggggattctgatgatgacggagcggctatgtctagaccatttggtgttgccattttattcgctggtattgatgagaagggacctcagctgtaccacatggacccatctggcacatttgtccaattcgatgcaaaagccattggttctggctccgagggggctcagcagagtctgcaagaagtgtatcaccgcagtatgacactggaagaagctatgactgcagccttgacaattctcaaacaagttatggaagaaaagttgaacgcttcgaatgttgaagttgccacgatgacttcaaaagatttattccacatgttcacgaaagagcaagtggaagaggtgctgaaatgtatggagaggaatgaaccagagcatcatcacatcgggggtatggaggcggcttctggtaaacgtaatactcccacaatgtcataa

SEQ ID NO: 1746 - DNA, 1311 bp, Leptinotarsa decemlineata
atttttaaaattatttcaatgatgcatttcattcatcatcatggcaaaaaagaagacaatggttctaaggaaaaaaaacacgaatgtagcagtaaaaaggaagaaaaagacgatactggtttaaggagaccttcatctgagcacgaagcagtcatggcggaatattggctcatttcggctcctggtgacaaaacatgtcagcagacttgggaaaccatgaataatctcaccagcaaacagaataatttgtgcacaaattataagttccacattcctgatttgaaggttggcacactggatcagttggtaggtctgtcggatgatttgggtaaactggatgggttcgtggaacaagttacccgaaaggtagctcagtacttgggggaagtattagaggatcaaagagataaactgcaagaaaacctgatggccaataacaccgatttgccaaattatctaacgagattccagtgggacattgccaaatatccgataaagcagtctctccgtaacattgccgatattatcagcaagcaggtcggtcagatcgacgccgatctcaaaaccaagtcttcggcgtacaacaacttgaaaggcagcctccagaatttggaaaagaagcaaacagggagtttattatctcgcaacttggcagacttggtgaagaaagaacactttatattggattcggaatatttgcaaacactcctagttatcgtgccaaaacagcagttctcggagtggaacgccacttatgaaaagatcaccgacatgatcgtaccccgttcgacgcagctcatcacccaggacaacgagtacggactctataccgtgacattgttcaagaaagtcgtggaggagttcaaactgcacgccagagaaaagaagttcatcgtgcgcgactttatttataatgaggaagagttggctgcgggcaagaatgaaatcacgaaactcgtcacggataagaagaagcagttcggtccgctagtcagatggttgaaggtgaactttagcgagtgcttctgcgcttggattcacgtgaaagctctgagagtttttgtggagtctgtgttgagatatggtttaccggtcaatttccaagccatgctaatccatcccaataaaaagacaatgaaacggttgagggacgttttgaatcagttatacggccatctagatagtagcgctgccctttctgggcccaattttgatagcgtcgacattccaggcttaggtttcggccaatcagagtattacccttacgtatattacaagataaacgtggacatgattgaagcaaagatctag

SEQ ID NO: 1747 - DNA, 1017 bp, Leptinotarsa decemlineata
atgtcgattttagccagccctttgtccgttgcgggatccagaacgactggatcttcagttcgttcccaaaatgtcatggcagccgcaaccatcgccaatatagttaaaagttctttaggccccgtaggattagataaaatgttggtagacgatgttggagaagtaacggtgacaaacgatggggccaccatcttaagactcctggaggtcgaacaccctgctgctagggtgttagtcgaattggcacaacttcaagatgaagaagttggcgacggtactacttctgttgttgtcattgcagctgaattgctgaagaatgcagatgagctggtcaagcaaaaaattcaccccacttccatcataagtggttacagactggcttgcaaagaagcctgcaggtatatacaggaccgtcttaccataccagtcgaggatctgggaaatgattgcattataaatgttgcgaaaacgtcgatgagctcaaaaattatcggagcagatgcagacctattttcatccatagtagtagacgcagcaaatgccatcaaagtaacggactcgagaggtaatgcgatgtaccccatcaaggctgttaatgttctcaaggcccatggtaaaagtgccagagagagcttcctcatccaaggatatgctttgaactgtacagtagccagtcaagccatgccaaaaaaaatcgtaaatgccaagttggcgtgcttggacttctccctgcagaaggccaagatgaagatgggagtccaggtgttgatcacggaccccgaccagttggaaggcatccgcagccgagagttggacataacgaaggaacgcatccagaagatcctctctacaggcgtgaacgtggtcctcgtctcgggcggcattgacgacctctgcctgaagtacttcgtggagagcggtgccatggccgtgcgccgcgtcaagaaggctgacctgaagcgcatcgccaaagcgacgggcgccgccttcctcacctcgctgacgaatatggacggc

SEQ ID NO: 1748 - DNA, 771 bp, Leptinotarsa decemlineata
atgttcagttcactgtctgatgcaccacccctttggaataatggcccagcaccaggatctttttacaattttccaggccaccaagtgaaacccaatgattatttcacacatactcagtctccagttacaacggcaacttctatcgtcgcaattgcgtacgacaaaggggttttgatagcaggagatcttttggcttcttatggatctttggcacgatatagaaattgtcccagagtgattgaagtcaactccaatattatactgggagctggtggtgattacgctgatttccaatatgtcaaatcattcatagatcagaaaataatcgatgaagaatgtttggacgatggtttgaaattcaaacccaagtcaatgtattgttggcttacaaggattatgtaccagagaaggagcaaatttgatcctttctggaataatcttgtgattggtggaattcaggatggtgaacccttccttgggactgtagacaaactaggaacagcctatgtcgataaggcaatttgtactggatatggagcacatattgcacttccaatgcttcgtgacgcaatggataaaaaaccaaacctcaatcaagctgaagccagagccctcgtagaaaagtgtttggaagttttgttctacagagatgccaggagctttcccaaatatcagttgggcatcattgataaagatgaaggtgttaagatcgagggaccactttcagtaaaacagaattggtcaattggtactatcatcaaatctgtctag

SEQ ID NO: 1749 - DNA, 1455 bp, Leptinotarsa decemlineata
attttggaaaaagttgaaggatgtaaggaattactggaagttccaggacgaatatttttgtatgaaggagatttactagagattgacccgactgaaaatactgcattaaaaagtgtacatgtatacttgtttactgatggatttatgattacaaacagaaactcaaacagccggggtttgatgaagtacatttatgaaattatttatgatctaagtagtctagctgttgtcaatgtgagggatttgggaaatattaaacatgctttcaaattattgatttttccggataccagagtgtttcagtgttcatcaaattcaaataagaaagaatggctggataagtttgatattgcaaagaagacgagattagcacaagagcaacaaaaaagagaatcagttgtagaaaaatccccgtctcgttcagcttcgatggaatcaccaagtttcaatccattcgatgaggtagaagaggatacaggactggttcatccagaatggtttatagatttaccagaagaacttgatgtatgtgttgcacaaagacactttgaagaagcgttggttttattacagaaagccaaagattatattaatgagtgtcttaccacgaatgaccaattagatcacgtaatgattgatatccaaaggaaggtggaacaaagacaaaataatctcacagaagttttcatgaaggaacttgaagttaatcccgataaatctttgcaaggtggtttacgagcagcaagaagagcagtgagattactaaatcagttaggaaggtcaacgcagtcttgcaacctgttcctcaaactatgtagcagtatgttaaaaaatcaatgtaagagggttaaaagagagggatctactgcaacctatgtcagacatctttcaagtgtagtgtttacaaacatgtgtcacatgtctgaagaatttttgagagcatttcaagattcacccacttgtgcttcagcatatgttatgtgggccagcagtgaattgtctcttttcacaacccattttataaaacaagtattcatgccgcaaacttcgctttcaacaattgctgaatgtgtagtattcataaggacacaatgtgaaaggctttatagttatggagttgatttgtgctatcagctggatggatcgttaatgtcttccttgacgaaagctctgaaggatgccagagataaacttattgattcagtgaaattgagggctattgacgataagtggattccaataaatttgcattcaaagtcagcactggcgaggtgtctccaggagcatgcccaaatgggtcttcatttagagagttacatcacaggtgatacgtggctacaactcacacccagtacattagctttcactaaaatgttcctgctatttttgaatgattgtttgaagttaaaaaccaatgaattgatgtttactatcgatgaaatgctttatagtgtt

SEQ ID NO: 1750 - DNA, 2658 bp, Leptinotarsa decemlineata
atgaaatacgtttgccaaatgactggtaaagatttgaaccctcactctcatgctcctttgaagcgtgaagataaagatagaaacccagatagacctgcatacagtagcacatcagtgctgagacttcccgtaagcatcgatgaaggcgaggaggattcaagaaaaagagttacgaggatttctagccctgaacgatgggaaatcaatcagatgatatcatccggatgtattgacaagagtgagttgcctgagttcgatgaagatacagggctgttacccaaagatgaggatggaggcgaagcagatatagaaattgagttagttgaagatgaaccgccatttttacaaggtcatggtcgagctgtgcatgatctgagtccagtacgaatagttaaaaatccagacggatctctagcgcaggctgctatgatgcaatctgctttagctaaggaaaggcgggaacagaagatgctccaacgagaacaggaagtcgattctcagccatcaggaaaaaataagaattggatagaccctcttccagaagaagaatccaaggctacaactgtccgagggattggcttgcaatcacaagacttaccagagtggaaaaaacatgtgataggtggcaaaaaatcttcattcggaaagaaaacaaatctatcaataattgaacaacgtcaatcacttccaatttataaactgaaagaagaactaagaaaagcagtcactgataatcagatcctcattgtaataggagaaacaggatcaggaaaaactacgcagatcacccagtacctggccgaagcgggactaactgctcggggaaaaattggatgtactcagccaaggcgtgtggcagccatgtctgtggcaaaacgagttgctgaagaattcggttgcagattggggcaagaagttggatataccatacggtttgaggattgcacgagcccagaaacaatgatcaagtacatgacagacggtatgttattgcgagaatgtctcatggacttggatttgaaacagtactcggttattatgctggatgaagctcacgaaaggacaatccatactgatgtactgtttgggctactcaagcaagctgttctgaaacgaaaggagttaaaactgattgtcacttctgctacactggatgcagtcaagttttctgagtattttttcaaagctcctatttttaccattcctggtaggacttttccggttgaagttttatatacaaaagagccagagactgattatttggacgctagcttggtgactgttatgcagattcatttgagggagccgcctggtgatattcttttgtttttgactggacaagaagaaattgacactgcttgtgagattttatacgagcgaatgaaatctttaggtcctgatgttcctgatctaatcattcttcctgtttactccgcacttccttctgaaatgcagacacgaatttttgaacctgcaccaccaggcagcaggaaggttgtaattgctactaacattgcagaaacatcacttaccatagatggaattttctacgttgtagaccccggattcgtgaagcaaaaagtttataattctaaaactggaatggattctttagtcgtgacacccatatctcaggcacaagccaagcaaagggcaggacgagctggacgaaccggccctggaaaatgttacaggctttatacagaacgggcatatagggacgaaatgttgccaaccccggttccagaaattcagcgaacgaatctaacaaccaccgtactccaactcaaaacaatgggtatcaacgacttgctgaattttgatttcatggatgcaccaccagttgaatcactaatcatggctttggaacagcttcattcgttatcagctttggacgatgaaggattgctaacaaggctaggtagaaggatggcagagtttcctctagaacccaatctttccaagatgctcatcatgtcagtcgatctactatgctccgatgaaattttaacaattgtcagcatgctttccgtgcagaacgtcttctatcgacccaaagataaacaagctttggctgaccaaaagaaagcaaagttcaatcagcctgaaggcgaccatctcacccttctcgctgtgtataatagttggaaaaacaacaaattttccaatgcttggtgttatgagaatttcgtccaagtaaggactttgaagcgtgcccaagatgttagaaaacaattgttgggtattatggatcggcataaactggacgttgtatcagcaggaagaaataccgtgaggatacaaaaggctatatgttcagggtttttcagaaatgccagcaagaaggatcctcaagaaggatataggaccctggtggatggtcaagtggtttacatacatccttcaagtgctctgttcaacagacagcctgagtgggtgatatatcacgagctagtacaaacaacaaaagaatatatgagagaagtaactaccatcgatccaaaatggttagttgaatatgcccctgcattctttaaattctcggatccaacaaagctgtccaaattcaagaaaaaccagaggctggagccattgtacaataagtacgaagaagccaatgcttggagaatatcaagagtgagaagaagaagaaactaa

SEQ ID NO: 1751 - DNA, 1245 bp, Leptinotarsa decemlineata
atggttcggagaaaaaaaaatgtcgatgatattcttgctcgtattaacttcccactttttacggttcagatattgtctccaagatatgtaatcgttgggggtggtggtggaattgcaaaaacaggaatagctaatggttttgaaattttcgaactgtcccatgatggttccaaattcattgctgaggaagttaccaggcatgaaactgggggaaacgttgtgatgtattgttccactttcactgataacaaacgttcatatgtagtagcaggtcaggaagatcactgtcaactatatcatgtgaatagtgaacttgtcagcgaagaagttgaaaatattgatcataactcgcccgagactcgacaaagaaaaccgcaaaaaactgataggaacaaaaatttgaaaaagagtttgaagtttgtcatgaaacccagtgatagtatacaaactgatttcattggtccagaacctctatctagagtagctaggatacatcataatggtaaactcatggccacaggaggaactgatggacacataagattatggaaatttccgagtttgcaacccttaaccgtgttgaaggcgcacgagaaagaaattgatgacattgactttagccagtttggaaattttctgattactgtagcgaaggatggcttggggattctttgggactgtattaaaggaaaagaatacagtaggttgaattggaaacagcctgaaggttccaaatatttgtacaaacgatgtagatttggtgtaatcgaaggggaagataaaaagtctgcgttatatacaatatccaatcctactggcgttgcaaaaaaacagaaatcttatcttcaacagtggctccctgaagatggactactaaaaaaagttgcagaattcgacgaatgtctttccgctttggcagttagagatgatggtagatttgtagctgtgggtaccatgttcagcggatcagttttaatttatgcgtcttttagtttgcagccaatgttgaatattgttggtgcacattccatgtttgttactggactagaatttttccctgtgttgaatgaaagtcgtactgtttgtagcgtggccgaggctgcagtattatcaatttctgtggataaccatgtttgtatccatacactgccatatagaagaacaatgccgctgtgggtaggaatattgatattaattttcacattgttcctctccttcacattttgctcttatataggattataa

SEQ ID NO: 1752 - DNA, 1242 bp, Leptinotarsa decemlineata
atggctggcgcaatgttgtttgaaagagctcagtccgtaccttctcaacatgataaactgttaaatttaaaaagaaatgaagatgacgatgatcagaacatcgttaataaagaacaggacatcctcaacctcggcgaaaagtacaagaaagagggtaaggctaaagaactggcggaattgataaaggctactcgtccgtttctcagcattataagcaaggcgaaagctgcgaaactggtcaggtctctggtcgattatttcctagatttggaagcaggtatcggaatagaagtccaactgtgtaaagaatgtatagagtgggcaaaagaagagaaaaggacctttcttcgtcagtctttggaagcgcgattgatagccttgtatttcgatactggtatgtatgccgaggctctgattctggaatccaccttgttgaaagaattgaaaaagttggatgacaaaaatttactggtagaagtacagttgcttgaaagtaagacatatcacgccttgagtaacctgcccaaggctcgtgccgcattaacttcagctcgtacaacagccaattccatctattgccctcctaagatgcaagctgcgcttgaccttcagtctggagttctgcatgcagctgatgaaaaagacttcaaaactgcctattcatacttttatgaggcatttgaagggtttgacagcgtagaatcaccaaaagcgttgacagctttgaaatatatgcttctttcaaaaattatgatcaacagtccggaagatgtacaacaaattgtaagcgggaaattagccatcagatatgctggtcaagacatagaagcaatgaaagctgttgcacgagcttctcacaagagatccttggcagattttcagttagcggtgaagcagttcaaacatgaactagaggatgatgttatcgtcagagcccatttaggaactttgtatgataatatgttggaacaaaatctgtgcaggattatagaaccatattccagagtacaggtggactatgttgcaaaaacaatcaaacttccaatgttacaagtggaaaagaagctctcgcagatgattcttgatgctaaatttcatgggatattggatcaaggagaaggtgttctaatagtttttgaagcaactccagtagacaaaacatatgaaatggccctagaaacaatacaaagcatgagtaaagtagtagataccctatatcaaaaagctaaaaagctgtcatag

SEQ ID NO: 1753 - DNA, 1764 bp, Leptinotarsa decemlineata
atggcatcaaaatctaaaaaaagttcaacgcctgcatctacacatcagcggccggcaagccccttaagtcctaccagacattcaagactgcaggagaaacaggacttgcaaaatctaaatgatcgtctagcgtgttacatcgacaaagttcgctacttagaagccgaaaacagcaggttaaccagagaaatacaaacaacacaagaaactgttactagagaagtatcaaacattaagtctatgtatgatcatgaactatcagacgccagaaagttgttagatgaaactcaccgagagaaagcccgtttggaaattgatgttaaacgtctgttagatgaaaacgaagagctaaaagctgatttagccaaaaaaagcaaagatttggttctggctgagaattctgccagaatttatgaaactaggtgcaatgaattacaactcaaagctaatcaggcagctgcagatgctaaaaaagctgctacagatgctagagaccttgaaaaggaaagggataagctaagaaagctccttgatgaacatcgtaagcaactggaggaagaatccttagctagagttgaagtagagaactccaaccagagtctcagagaagaactatccttcaaagaccaagtgtaccaacaacagcttaccgagacgcgcactcgtcgccaggtggagatcagcgaaatcgacggtcgtctcgctgaaaagtatgaagccaagctccaggatgctctacaggaactccgagatcagtatgaatcccagatggcaaccaatcgtcatgagatcgaattgctctacgagcagaagattaaaaacctgcaggcggccaacgatagacaccagtcgtctgctgtaggcgctcttgatgaactgagacaggtcaggaccaggatcgatactctgacttcgaggatctcagacttggagaatcagaacgctggcctgtcaggcagagctagggatcttgagaagttgttggagaatgaaaggcttcggcatgctgaagacctggctctccttgaaagggaattgcaaagatatcgtgatgagatgcaggtgcaactgcaggaatatcaagaccttatggacatcaaagtgtcattagatttggaaatcgccgcatatcgcaaactactcgagtcagaagaagctagactgaacatcactcctcatggtaccgaaagggaggtatcccatcacagcgtgcgcagctcctctcagcgccgcaccccagtacgagcgggtgccaaacggaagcgcacacttcttgaagagagccaggaatctagtttgtctgactacagcgtcaacagttcctcaaaaggagatattgaagtagctgatgtggatcctgagggacagtatgtgaaattgcacaacaaaagtaaccaggaggttgctcttggaggatggcatgttgtcagacgtgtaggcgacaatgagactcagtttaaattccacaggtcgctgaagttggaaggaaatggttttgttacgatttggagctctgatctcaacaaagaccatgaaccgccaaacaacttggtcatgaaaggacagaaatggattgttggagataacatgactacaacagtattgaataacaatggtgaggaggtagcagtatccgaaagagtaaaaaggcagttatccagttcattactgagacacagagaaatggctggaggttatctttctgaagaactccatcatcaacaaggtgatcctcagggtgatgaaaagtgtcgaataatgtga

SEQ ID NO: 1754 - DNA, 2412 bp, Leptinotarsa decemlineata
atggctgaaggaaaaagtcccgacgatctggccactgcaattcttcgtaaaaaggaccgtccaaacaggctcttggtcgaagaagctgccaacgatgacaattccgttgttgctttatcacaagctaaaatggacgagttacagctattcaggggggacacagtattactcaaaggcaaacgaaggaaagaaacagtctgtatagtcctttccgatgagtcctgtagtgacgaaaaaatccgcatgaacagaaatgttaggaacaaccttcgtgtccgtctttcagatgttgtctccatccagccttgtccagatgtgaaatatggtaaaaggatccatgttctgcccatagatgacacagttgaaggcctcacaggaaacctcttcgaagtctacttgaaaccctactttttggaagcgtatagacccatccacaaagacgatgtctttgtcgttcgtggtggtatgagagcagtagaattcaaagtagttgaaacggatcctgccccctactgcatagtagctcccgacactgtcatccactgcgatggagatccaatcaaacgagaagaagaagaggaggctctcaatgccgtcggctacgatgacatcggaggatgcaggaagcagctagcgcagatcaaggagatggtggagctcccgctgagacacccgagcctgttcaaggctatcggcgtgaagccccctaggggtatactgctgtatggtccccctggtacgggtaagaccctgattgctcgcgccgtggctaatgagactggggcgttcttcttcttgataaacgggccggagatcatgagcaaactcgctggcgagtctgagagtaacttgcgcaaagcttttgaagaagctgacaaaaactctccggcgatcatcttcatcgatgagctggacgccatcgccccgaagcgtgagaagactcacggggaggtcgagcgccgtatagtgtcgcagctgctcactcttatggatggcatgaagaagagctcacatgtcattgtcatggctgccacaaacagaccaaattccatcgatccggctctgagacgtttcggcaggttcgacagggagattgatatcggtattccggatgcaacaggcagattggaagttttacgtatccacacaaagaatatgaaactggccgacgacgtggatttggagcaaattgccgccgagacacacggtcatgtgggtgctgatttggcttcgctgtgctctgaatctgctctccagcaaatccgagaaaaaatggacctcatcgacttggaagacgaccaaattgacgccgaggtactgaactctcttgctgtaacgatggaaaacttccgctacgccatgacaaagagcagccccagtgctctcagggaaacagttgttgaagtaccaaatgtctcttgggaggacattggtggtctcgaaaacgttaaacatgaactgcaagaactggttcagtaccccgttgagcatcctgacaagttcctcaagttcggtatgcaaccttctcggggtgtgctcttctacgggccgcctggttgcggtaagacgctgctggctaaggccatcgccaatgagtgtcaggccaattttatatccgtcaaggggccagagctgctcaccatgtggtttggtgagtctgaggctaatgtcagggatatttttgataaggctagatctgcagctccttgtgtattgttctttgatgaattggattccattgcaaaatcgagaggtggcaacgtaggcgatgcaggtggtgcagcagacagagttatcaatcaaattttgacagaaatggacggaatgggtgccaaaaagaacgtattcatcattggtgcaacgaacagacctgatatcatcgatcctgccatcttgagacccggtagattagatcagttgatttacatcccattaccagacgagaagtctagagaggccattttcaaatcgaacctgaggaaatctcctatcgccaaggatgtagatttaggatacatagccaaagtgacacacggtttctctggtgctgatctgaccgaaatatgccagcgcgcttgcaagttggccatcaggcagagcattgagagcgaaatcaggagggaaagggagagggcgatgaatcccaatattgccatggacttggacgaagacgatccggtcccagaaatcaccagggcccacttcgaagaggccatgcgcttcgcccgaaggtcagtttctgataacgatatcagaaaatacgaaatgttcgcgcaaactctgcagcagtctcgaggcttcggcacgaacttccgcttcccgacggccgccggggggccggccgcgcccgggggcaccggcggggaccaggccaacttccaagacgatcccgaggatgatttatacagttag

SEQ ID NO: 1755 - DNA, 825 bp, Leptinotarsa decemlineata
atgggtgaccagttcgattgtgctttagatttaatgcgacgcctacctccccaacaaatagagaaaaatttgagtgatttgatcgatttagttccaagtttatgtgaagatttgctgtcttcagtagaccagcctttgaaaattgccaaggacaaagaaactggaaaggattaccttctatgcgactacaaccgagatggagactcatacagatccccatggtctaatacctattatcctccattagatgacggttccatgccttctgaacgtttgagaaaacttgaattagatgcaaatcatgcttttgatcagtatagggagatgtactttgaagggggagtttcgtctgtttacttttgggatttggatcatggttttgctggagtaattttaatcaagaaaactggcgatggaagtaagaaaatcaaaggttgttgggactctttacatgttgtagaagttcaggaaaagagttcgggtcggaattcacattacaaaatgacttcaactgccatgctgtggcttcaaactaataaacagggttctggaacaatgaatcttggcggtagtctaaccaggcagatagaacaagatgccacagtaaatgaaatcaacccacacattgccaatattggcaggatggtagaggacatggaaaataaaattcgtaacactcttaatgaaatctacttcagcaaaactaaagatattgtaaatagtttgaggtctgtccaatcgctgactgagagccgtcaacagcaggctctaagagaggatttggctgctgctttgcaacgcaggcacaataaatctgacaactga

SEQ ID NO: 1756 - DNA, 2439 bp, Leptinotarsa decemlineata
atggaacgaccgcctcgtaacgaacctccagtggaacccgtaaatggcatagtccaacctgctgttcaacctcctccagacatgccagggcgtgtaaccaatcagctgcaatttttgcagaaaactgtactaaaggctgtttggaaacaccagtttgcatggccttttcaacaaccagtcgatgcaaagaaacttaatttgcctgattaccacagaataataaaacaacccatggacctgggaacaataaagaaacgtttagataacaattactatttgtcgggtaaagagtgcattcaagattttaatacaatgtttacgaattgttacgtttacaataaaccgggagaagatgttgtcgtaatggcacaaactttagaaaaagtgttcttgactaaagtagcggacatgcccaaagacgaatttgtagtggaaacacctacgaaaggactcaagggaaagaagggaagaacaagtacaggccctgctggtcctgtttcaagtgtgggaaggggtagaccacctgcgacagtatcttcaaccagtgctacaccagtggctactactacaggttcctccggcctgcctttgggaactcaggctccggcaactgtccctggtagcaccgccaccacaacgatagctcctgctaccactaatagctctcttccttctcaacctccagcacaaccttccaattttcatggtgcaccctccatagttaattctttagattcgaatgtgaatccgggggtgctaccgggaagtgttgtacctccttcacaaccagctaaggtgaaaaaaggggtgaagagaaaggccgacactacgacacccacggctactgcatatgattatgcaccaccgttggagtcaaagtcggcaaaaatatcaacaagacgtgaatcaggtagacagatcaagaaaccggtaaggccagaattggatggccatgttccccagccagcatcacagaaactgaaagagaaactttctgaatctttgaaagcgtgtaatgaaattttgatggaattgttctccaagaagcatgctaattatgcttggccattttatcagcctgttgatgctgacttattggggttacatgactatcacgatataataaagagacccatggactttggcacagtcaaacaaaaaatggataacagggagtatcgtactccacaagactttgctgccgatgttagactgatttttaccaattgttataaatacaacccttcagatcatgatgtagttgcgatggctagaaaactacaggatgtatttgaggttaagtttgctaaaatccctgacgaaccactaaataggataggtggtagtgctgcagtatcgactttagctgtaaaatctgaatccagtagttctggttcaagttcggagtcatcgagtgatacagaggattctgaagaagaaaagcggaacaaacagttgaagttattagaaaaagaactgacggcaatgcaggaaaaaatgaagaaactcgttgaggaaagcacgaagaagaaaaaagaaaagaaaaagaccaaggtgaaaccgaaaaaacctcccgcagcagcattgccaaatagtagtagcagtattggtaagcctggagcgcacggggctctaaacaagcccaactcccttgcagacagcgttgacgacagcatcgccagtgttgtgtcgggggctgatctcaagattgccgccgaggcacatcatccgacggccaacaagtctctcaacatgcaccacaacatggcggctggcgccaacgcttctgcccaagctaaaactcctaaaagtaaaggtttaagaggtaacaaacctgcaactactcccagtgctccacctaaacgagtgaaagcaaacaataaggctggcccaggaaggaaaaaatctgcagcccaaccacctccagcacagtgtgaatctgaggaagaggacaacgcgaaacctatgtcttatgatgaaaagcgtcagctgtcattggatattaataaattaccaggagataaactgggaagggtagtacatataatccagtcacgagaaccatccttgagggattcaaacccagacgaaatagaaattgattttgaaacattgaaaccatcaacccttagagagttggagagctatgttgcatcgtgtcttcgaaaaaagccacataaaaaggttactggaaaatccaaggatgaacaaatagctgaaaaaaagcaggagctagagaaaagacttatagatgtgaatgacaaaataggaaattcaaaaaaggccgctaaaaaagaagaagccagtaagtcagatccaactggtgcggggggaccttccggtcgaatgtcttctagttcaagtagttcagactctgatagtagtagtagcagcttatcaagtagttcgagtgattccagcgacagcgaagcaggttag

SEQ ID NO: 1757 - DNA, 1221 bp, Leptinotarsa decemlineata
atgtctttatcaactgctaggccactgatcagtgtctacaatgaaaaatcagaagtcgtcaaagaaacgagcattgcccttccggcagtattcaaagcccccatcaggcctgatgtagtcaactttgttcatcaacaagtatcgatgaaccatcgtcaaccctacagtgtcagcgacaaagctggtcaccaaacttccgcggagtcttggggtaccggtcgtgctgtcgcccgtattccccgtgtcaggggcggcggtacccaccgttccggtcagggtgctttcggcaacatgtgtcgcggaggtcgcatgttcgctcccacaaagccatggcgcaggtggcaccgcagggtcaacgtcaatcagcgccgatacgccctggcttcggcagtcgccgctagcggagtgcccgcccttgtgatgagcaaagggcacgtcgtcgaccagatccctgagctgcctctggtggtgtccgacaaagtgcaggagatgagcaagaccaaggaggctgtgcagttcttgaggaggatcaaggcatggtctgatatccaaaaggtatacaagagccagagattccgggctggaaaaggtaagatgcgtaatagaagacgcatccaaaggaaaggacctctcgtcgtttaccacaaagatcaaggcctccgccgtgccttccgtaacattcctggcatcgatctggtcagcgtggagaagctcagcttgttgaaactcgctcccggtggtcacgttggacgtttcgtcatctggaccgaatctgccttccaacgattggacaaactgttcggcagctggaagaccccttccttggaaaagaagggttacaacctgccacagcccaagatgtccaacacggatttgtccaggttattgaaggctgatgaaatcaaggctgttcttcgtgctccacagaagaaggttgttcgtcgtgtacgccgtctgaatcctttgaccaataccagagctttgttgaaactcaatccatacgctgcagtcctgaagcgacaagctttgttgactgcccagaaaaggaagttgcagagagacgaacagctcgctaagaagagaggaataactttgtcagctgatagtgcggtcatcaagtcagcagcattacagaagagaaggagggaacagttgttgaaagtcaagaaagaaggaaaagctaagcctgtaaaagccaagaagtcctctggcaagaaatga

SEQ ID NO: 1758 - DNA, 4596 bp, Leptinotarsa decemlineata
atggcagactttatagatagagaagctgaagagagcagtgaggaggaagacttagaaccacgcgaccgcaagaaagcaaagaaagctaaagctgttgacagttctgacgaggaggaagaagatgatgaagaccgtttacgtgaagaactaaaagatcttattgatgacaatcccattgaagagagtgatgcagaatctgatgcatctggtagtagtagaagtcaaaagcgaaagaaatcagatgaagaagatttagacgatcgtttggaagatgaagattatgacttacttgaagagaatttgggtgtcaaagttgtgagacgtaaattcaaacgtctacgtcgttttgatgataatgagagtgaaggagaagaggaacaaaatgctgatcaagatcgagatcaaattgccatggatatattctcagaagatgatgatgaacgaagatcggagcgtagccatagggcccctgaacctgaagcatttggagatgaagaagatgaaggagaatactctgatgccgacgacttcattgtggacgatgagggtaggcctatagccgagaagaaaaggaaaaaaaagcccattttcagcgatgcggctcttcaagaagcccaagaaactttcggtgttgactttgattatgatgaattttccaaatatgaccaagatgagtatgatgagtctgaagaagatgaggaagacgagtatgaggaagacgacgaaggagaaagaaggaggagatctaagaaagctgctaagaagaagcctactaaaaaatcaatcttcgaagtctacgaacctagtgaactcaaaaggggtttctttactgaccttgacaatgaaatccgaaacacagatattccagaaagaatgcaactacgagacgtcccagttacgtctgttcctgacgactcttctgaactcgacgatgaggccgaatggatctacaaacaagcgttttgtaaaccgtcagtgtccaatatggacgcgaacttatctcctgaagctcgagataaaatgaaaaaagggccgcaaacaatcgtcaagatcaggaaggcgttggatttcatcagaaatcagcagctggaagttccttttatcgctttctacaggaaggagtatgttcaaccggaactgaatatcaatgatctttggaaagtttatagatttgatgcaaagtggtgtcaactgaaaacacgtaaagaaaacatgctgagactattcgagaaaatgagatcatatcagttggacatactaatgaaagatcccgacgctcccatacctgataacgtgcgagttatgaaagattcagatatagagcagttgaagaatgtgcagacccctgaagaactcaatgacgtgcacaatcatttcattctttattacgctgccgacttgcctgccatgcatgcggcttggaggatcaaggataaagaagagaaaaaacgggccaaaagggaagccaggatgaagctcattgctgaaagcgaggaaggagcagacattcctgaagaggtagaagaagttgaggatgatgagccggaacctgagactttgaagtatgcaaatagatctggcagttactcattgtgtgtaaaggcgggattggacggtttaacgaagaaatttggtttaacacctgaacattttgcggaaaatctacgagacaattatcagaggcacgaagtagatcaagaacacgtggaaccgctcgaaattgcgaaagaattcatatctcccaaattctcaacagttgaagaagtcctccaagcggccaagtatatggttgctctgcaaattgctagagagcctttggttcgaaagtgtgtgagagaaactttttacgaaagggcaaaaatgaatgtagtaccaactaagaaaggtcagaaggaaattgacgagtcccacaactgttacagcatgaaatatgtcaagaacaaacctgttagagacttgaccggcgatcagttcctcaaactttgccttgcagaagaagaacatctgctgaccatttccataaatgaaacgattgaaggtaataccagtggatcatacattgatgaagttaagcaactgtatatcaaggacgaattcagcaagaacgtacaagattggaatgctctcagaatggaatgtgtagagagagctttaacaaaaagtgttttcccagatttgaaagcagaactaaagagagtgctgctatccgaagcgaaggaatgtgtactgagagcttgttgtagaaaattatacaattggataaagattgctccatacacaataacattttccgaagaagacgaggatgactgggacacttccaaaggaatcagaactatgggccttgcctatgttccggattataccgtgtcagctttcgcttgtattgctgctccagacggagaaataaccgattatttgaggctcccccatatgctaaaaaggaaaaatagttacaggaatgaagagaagttgctgaaggagtccgacttgcaagcagttaagaactttatctacaccaaaaaacctcacgtgatcgccatcggtggagaatctagggaggcactgatgatcgccgaggacctacgaggggttataaatgagttggtggaatcagaccagttcccccagataaaggttgagattgtggacaatgagctggcgcaggtgtatgccaactctaataaggggcaagcagatttcagagactacccagaacttctgaggcaggctgtatcagtggccaggaaaatgcaagatcctctcgttgagtactcccagcttttcaatgcggatcaggaaattttgagtttgaggttcagtccgctacaggaatctctcccaaaagaagaattgctcgaagcgttatgtttggaatttgtcaacagaacaaacgaagtgggcgtagatgtcaatctggccgttcaacaagcccacaaaagtaatctggttcaattcatctgcggtctcggaccgcgtaaaggccaagctttattgcgagttttgaaacaaaccaatcagcgactggaaaatagaacgcagcttgttacatcgtgccacatgggtccgaaggttttcataaactgttcaggatttataaagatagacacgagtagtttgggagacagtacggaggcttatgtggaaatactggatgggtctcgcgttcatccagaaacatacgaatgggccaggaaaatggcagtggacgccttagaatatgatgatgatgagggagcgaaccccgccggagccttggaggagatccttgaggcgcctgaaaggttaaaagatttggatcttgatgcttttgcagaggagttagagaggcaaggatttggtaataagagcatcaccctgtatgacataagggcggaattgaactgcagatacaaagatttgaggcaaccgtttcgttcagctaatcctgaggagttgttcgatatactcacgaagcagactcccgaaactttctatataggtaaaatggtcacggcttcagttatcggtatcgctagaagaaaacccaaaccggatcaactagatcaagcgaatcctgtcagaaatgatgaaactggcctctggcaatgtcctttctgtttgaagaatgattttcctgagttgtctgatgtgtggaatcattttgatgctggctcttgtctaggacaagcgactggtgtaaggttaaggcttgataacggtgtattaggttatatttatataaaaaatatcagtgacaaaccagtatcgaatcccgaagaaagagttaaagtaggccaactcattcattgcagaatacaaaagattgatgtagaacggttcagcgttgactgtacttcaaaatccagtgatcttttggataaaaaccatgaatggaggccccctcgagatccttattacgatcaagaacaagaagataaagacaaaggcatagaagcggagagaaaaaaagacttacaacgtaaaacgtacgtgaagcgaatcatagttcatcccgccttccacaatatttcctatgctgaaacagaaaaatgcatggccaatatggatcaaggggaagtcattataaggccttcaagtaaaggcttcgaccatttgacaataacgtggaaagtggcagatggtatttaccagcatatcgatgtcaaggaagagggtaaagcaaatccattttcattgggaaaatcactgttgattggtaaggaggaatttgaagatttggatgaaataatagccagacacatcactccaatggcttcatacgcaagggacttgctttactttaggtatcacaaagactttgaaggtgggcaaaaagataaagcggaggagttcttgatcgaggagaagaagaaaaattcttctaaaattcactatgtcatcagcgctgctaaaaacttccctggcaaatttttactctcttatctaccacgaaacaaagtcattcacgaatatgtaacggtaactccagagggattccgatacagacagcaaatgtttgactcgctaaattctctgttcaaatggttcaaagaacacttcagggatccacctcccggaggacttactccaggtactccgcggtcttctggtcgc

SEQ ID NO: 1759 - DNA, 2415 bp, Leptinotarsa decemlineata
atggaaaaaaaacggccgagaaaatcaagatctagatctcttgaaaatggccaaggaaagaaaaaatcacaagattatgatgatcttccaaaggactatccaagatattatggtgaagatcggccaaatagtgacagatattggaataagtatccaagaaaagataacataaaagttggtcagagatattatgaagctggatgtgagaagaaagaaaaaaaacgagaggagaagccagccattgataaggaacctgaagacaaatctgttataaaacctcgagaaagaaaaacagtggatctcttaacttctaggactggcggtgcttacatcccccctgcaaaattgagaatgatgcaggaaagtattactgataagtcttctgctgcttatcagcgcattgcatgggaagctctcaagaaatctatccatggatatatcaacaaaattaatacatccaatattggtataattgccagggaactgcttcatgagaacatagtaagaggtagaggtctgctatgtaaatctatcattcaggcccaagcagcttctcctacattcaccaatgtttatgctgcccttgtagcagttataaattctaaatttccaaatataggtgaactcttattgaagaggttagtacttcaattcaaaagaggatttaaacaaaataacaaggtcatctgtatatcagccacaacatttgttgcccatttggtaaatcagaaagtggctcatgaaattttagcattggagattctcactctgctggttgaatcaccaaccgacgattctgttgaagtggcaatttctttcttgaaggaatgcggacaaaaactcacagaggtatccagtaaaggtataacagctatatttgaaatgttaagaaatattcttcatgagggaaagttggaaaaacgaattcagtatatgatagaagttatgttccaaattcggaaagatggcttcaaagatcatgcagctgtcttggaagaactggacatagtggaagaggaagatcagttcacccacttgattaccttggaagatgtgaagcaagttgatactgaagatattttgaatgtcttcaagtttgatgacaagtatgaagaaaatgaaggaaagtacaagacactcagcaaagagatactgggaagtgatagcgagtcagggtctggatctgaaggttctgaagacggttccgaagacgatgaagaagatgaagaagtgaaggatcaaggaaaaataatagacaataccgaaactaatttgatagttttgagaaggacaatatatcttacaatacagtctagtttggattttgaagaatgtgctcacaaactcctaaaaatggaactcaaaccaggacaggaaatagaactctgtcatatgtttttagattgttgtgccgaacagcgtacatatgagaagttttatgggttattggcgcaaaggttttgccaaattaataaaatttatattgagccttttcaaaaaatttttaaagatacatatgccactactcacagacttgatgccaacagactaaggaatgttagtaaattctttgctcatttactgtttactgatgcaattagttgggaagttttagaaataatgaaactcaatgaagaagatactaatagttccagtagaatattcattaaaatcctctttcaagaacttgcagaatatatgggccttgggaagttgaataccagactgaaagatgaaactcttcaggagcattttgctggtttgtttccaagagatagtcctaaaaacacgagattttctatcaatttttttacgtctattggtcttggaggattaacagatgaactaagggaacatctgaaaaatattcctaaaaacacgagattttctatcaatttttttacgtctattggtcttggaggattaacagatgaactaagggaacatctgaaaaatattcctaaaaacactgaattgaatttagcagttgggaaagaaagcagtagcagcagtagctctagcagttccagcgaaacaagttctgaagaaagcagtgatgaatcatcaagttcagaagatgaaaagcagaatagaagaggaaaagtttataaaaagaaaaatgaaatagagagaaaaggtgatcatcacagtaccaagaaaaaagaaagatatacctcaaaagatgatcacaaacaagaaaatgagagacataacgattcaagtgatagaagaaaaaaaaaagattatgaaagggttaaaagtagatctgaagacaatggccatcgattgaagaatgagcggagagtttttgagaaacatacttctgaaaaacgatcacaatctaaagatcatggaaaatatgaaaaaagtagacgtcacaaaaataaggatgacagagaacgcaggaatagttga

SEQ ID NO: 1760 - DNA, 1782 bp, Leptinotarsa decemlineata
atggctctaaaggcccaagttggtcaaaaaataatgaatgaagtcattaaacataaacctgtcaagaagaatggtcctgttgcacaacaacagtctcatggcgttgaatggaggatcttagtggtggatcaacttgccatgagaatggtgtctgcatgttgtaagatgcacgacatatcggctgagggaattactttggtcgaagatataaataaaaaaagggaacccctaacaactatggaagctgtttacttgatcacgccttctgaaaaatctgttcgtgccctgatgaatgattttgaatcgcctcgatacatgtataaggctgctcacgtctttttcacagaagcatgtccagaccaattgttcaatgagttatgccatcacccaatagcaaaacacatcaaaaccttaaaagaaatcaacatagcatttattccatctgagtcacaggtgttttctttagattcgccagatacattccagtgcagttacgatcctacctttgctgcagctcgtaacggcaacatggaaagaatggcggagcagattgctacactgtgtgcaaccctcggagagtatccccacgtgagatatcgtagtgattgggaaagaaacgttgagcttgctcagttgattcagcagaaattggacgcatataaagcagatgagcccactatgggagaaggtcccgaaaaagctagatctcagttgatcattttggatcgcggcttcgattgtgtttcccccttgttacacgaactaaccttccaagctatggcatatgatctgttgcccatcgaaaacgatgtgtacaaatatgaagcatcagccggagtcctgaaagaggtcctcctggacgaaaacgatgaactatgggttgagcttcgacaccaacacattgctgtggtatcacaaagcgtaacgaaaaatttaaagaaattcactgactcgaaacgcatgacacagagcgacaaacagtcaatgaaggatttgtcgacaatgataaaaaaaatgccgcagtaccaaaaagaattgtcaaagtacgccactcatttgcacttggccgaagattgcatgaaagcttaccaaggctacatcgacaaactctgcaaagtcgaacaggatttagcaatgggtacagatgcagaaggtgaaaaaatcaaagaccacatgcgcaacatcgttcccattctgttagaccctaaaataaccaatgaatatgacaaaatgcggatcatagccttatatgcaatgacaaaaaatggtataacagaagaaaacttgtcaaagcttgccactcacgcccaaattaaggataagcagacaattgctaatttgcaatatctaggcgtcaatgtcatcaacgatggtggcaagagaaacaaaggttacaccataccgagaaaagaaagaatcacagagcaaacataccaaatgtcgaggtggacaccagttatcaaagacctgatggaggattgcattgaggataaattggatcagaaacactttccatatctcgtcggtagagctcagtccactggatatcatgctgcaccatcaagtgctcgatatggccaatggcataaggatagaggtcagcaggccgtcaaaaatgtaccgaggcttctagtcttcgtagtgggaggaatcagtttctcagaaattcgttgcgcttatgaagttaccaacgcccagaaaaattgggaagtcataatcggttcttcgcacatactcactccagaaggtttcctcagtgatttggctacgcttgctggctag

SEQ ID NO: 1761 - DNA, 2139 bp, Leptinotarsa decemlineata
atgatgcaacagtacatgaaagaattagaacaggagcctttcaatgccgaagaattcgtggaacgtttagcttggcgaacaattgctgagacaaaaaatgatggcgaggaagaggagtttaacccaaatttgttacatgagtcattcgtactggccataaaagacctcactcttctccaagatcgtcagcagaagaaatgtgaaaagttggagatggccgtcagagaagacgaggcaatgtttttccaggaaatttataatttgttggagcaaaacaaacaagctatagacaccttccaagaactggatggtaaaataaaccacgttgccactaaagtattgcatttgggagatcaacttgacagcgttaatggtcccaggcttagagttgtcgatgcccaacgtttgatgactcatctgaatgagtttctaaccactggaccgccatcctcagcaatattcactgatccctatttaatagatgaggctgcagatatgattcaaaaattgtacatgatatcccaagatttgccttccaaatttgacagtgttaaacgtaaaatagaacgaaaatattgtgatatcgaaaaaagcttaatcgaggaatttgtgaacgcaatggctaacgaagatctagatcgaatgaaggaaatagccagtgtcttatcacaattcaagggttattctcagtgcatcgatgcttacatcgatcaaagtcaagtgggatgcctttcaaccaaagacgtgtttggccatctgttgactttgtgcaaatacaacaatgatataatcagaagggttttcaacaatcctgaacaggttatggccaagtttgtccttaacatctaccagttgaaaatcgtggagtatatcgaccaaagattgggccccaatcttggcagttacaattacctacaaactctgtttgaactctattcgaaaactaaccagctatcgagtaacttgagcaccttcaatttaggaaacgacaaaaactatttgaccaagcttactacgaatattttcaataaatacgtaaacgaatatattacgatagaattgaaatgcctcaaagaaagatgttccgccaatttacaaaagtattatgaatccaaacaccaccagaaaaaacagatccagtctggaggattccaagacctgcgaagggacttacaagccgtcataggtaccagagccaatataaacattgcgcaaatagaaaactatggaggcgagacttttttgtcagaagaagttgccatcatgatactccaagataccaagcaagccttccaacgttgtcagttgttatcaaaacctaaagagaaagaatcaaatgctacgcagattttggacagacttatcaacagccttttgatcgaacacgtagattacgccgtagaattaggactccaagctgtcccagttgtcgaaggcgctaaaagtcctccagttctctatttttttaacgtagttcatcagagtaacaatattacgcacttgatggagaagcagttcacggatctggtcgtgcctctagtcgagaatacaccgaaatataatgactgcatacagaagaaaaagtttgttttggaagacattgaaaggaaaataaatacaggcttggacagatgtctcaatgccgttgctacttgggcaaaactgtacctgcagtcggaacagaagaagagtgacttcaaacctgagactgacgattttgacacagtagcgtctccagcctgcaaaaccgttctgaactacgttaaaagaataatcaaagagataaaggccagtttagatggaaataatgtaacggcagttcttcaggagttgggaatacggttacacagggtggtgtatgaacatatgctacagtttcagtataataccgcaggtgctatggtggccatttgcgatcttaatgagtaccgttcatcaactaagactctgggacctctggttacggaactattcgacacgttacattctctttgcaacctgctactggtgaaaccggagaatctacagcaagtctgctcggaagacaccttggctaaattggaaaggccgattctccacaactttatacagctcagaagcgattttaaagtacaaaaacaaatgattttaaatttttag

SEQ ID NO: 1762 - DNA, 465 bp, Leptinotarsa decemlineata
atggatttccaaaatagacccggaggtaaaaccggaggaggtggcgtggcctcttggtcagaaacaaatcgggaccgaagagaaaggctgagacagctagctttggagaccatcgacttgcaaaaggatccttattttatgaaaaatcacttgggatcttatgaatgtaaactttgtttaacactacataacaacgagggaagctatttggcccatactcagggcaaaaaacatcaagccaatttggcaagacgagcagccaaagaagctaaagattcgccgtctcttttacaacctgaaaaaccaagagttgaacccaagaaatttgtgaagattggaagacctggttatcgggttacaaaacagagagaccctgaaaatggacaacagagcttgttgtttcaaattgactatccagaaatcaatgatatggttttgcctcgtcatcgatttatgtctgcttat

SEQ ID NO: 1763 - DNA, 411 bp, Leptinotarsa decemlineata
atgtctattggtgttcctattaaagttcttcatgaagccgaaggtcatattgtaacctgtgaaactattaccggtgaagtctacagaggaaaactaatagaagctgaagataatatgaattgtcaaatgacacaaatcactgttacataccgagatggcagggtagcccagttagaaaatgtttatatcagaggatcaaaaatcagatttcttattctaccggatatgttgaagaatgctccaatgtttaaaaagcagacgaaagcgggaactgcagggagaggaaaatctgcaatacttagagcacaagctcggggaagaggacgggggcagcagcctcagatgcgtggtggtcggggaggtacttggcagaaccagcaaggtggtgcacctaccggtcgtggaagataa

SEQ ID NO: 1764 - DNA, 1473 bp, Leptinotarsa decemlineata
atgctcactgattcattcccgctcgaaacaaaatgtgtcactttttcgctctggagcaactttcagccttcagttcgtattttgagcaccttgaaaaatccctactccccaacactggtttcgtgtttgtgtaataatttatttaggtggagaaacatggcttcaaagttgcaaaaagctccattacttcgattatttatgagcagaggattttctcaactagcaccagtttccggaaatccaaattatgaactgaaaacaactattctttcaaataagctgactgtcgtatgtgctgataacgaatccagcttggttcgagtttcggttatattcagggcaggtagccgatatgagtccagtgataatttaggagtcacacacgtattgcgtactgcagcagggctgtcaacaaaaaatgcttcccagtttgccattattcgtaacattcagcaagttggtgctaacttgacagctacatctgatcgtgaaactatttcatatactctagaaggtacaagacaagcagttgaaaaagttctcccattccttactgaagtcgcaacccagcaaatattcaaaccctgggaggtttcagatatcacttccaggctccaattagatattgcaacgagatctctaccgttgagagcaattgatctactccacaatgctgcatttcgtactggtttgggcaattcaatgttcatccctaaatcacagattgggaaaatatccagtgagactctgcagcactatgttgccagcaattttctatccgggcgtgccgctgtaattggatttggtatcgatcagtctgaactcattcattatgcacaaactttaaacattgagtctggggagggatgtaataattcctctagttataaaggtggtgaattgagatcaaacaaaggtggagatgtagcttttgtcactgtagctggagaaggcgcctctttgaaagaccccaaggaagctctagcttttgcaattcttcaaaaagcaattggtgttggacctcaagtgaagtggggtaataataatggaatttttagcagagttgtaggtactggagagcatacatcatctgctatcaatgtcagctactccgatacaggactttttggtattttgattgggactcctgcaaaatctgcaggaaaattagtagaatctgctgtcaagttattgagaagtgggagtgtttccgacgaggatgtcaatagagggaagaaacagctaaagtcttcacttcttttggaagctgaaagtggagcagatgctgtaagagatattgcttcacaatctgttttgactggtaatcctcaaactgccagccagatagttgcagcggtggattctatttgtacaagtgatgttcgagatgccctcagaaatgctggacgaaaaataactttggcctcaattgggaaccttagtaatgttccctatctggacgaattgaaataa

SEQ ID NO: 1765 - DNA, 333 bp, Leptinotarsa decemlineata
atgagaagggctcatggtggtaactattaccagcccctttcccaagattccaacgaaatcgaagatgaaaataatcgaatgactcaagaactacaagagaaaattggtgttctgaaatctttatctattgatattggcaatgaagtgaaatatcaagacagattacttggagatgttgatgatgacatggatagaactagtggattcttgggaacaactatgaaaaaggtgttgaggctatccagaggatctcacaactactatattctgtacatgttcttattttcaataattgtattttttattctttacttagtcattaagttcaggtaa

SEQ ID NO: 1766 - DNA, 1476 bp, Leptinotarsa decemlineata
atgatttcgtcaagacaggcagccaaggagcatgttttagcagtttccagagattttgtatcacaaccaagactcacctacaaaacagtctctggtgtaaacggccctctggtaatcctcgaagatgttaagttccccaagtacaatgaaatcgtacaactcaaactggctgatggcactatacgttcgggacaagttctggaagtcagtgggtcaaaagctgtggttcaagtgttcgagggcacatcaggaatcgacgccaaaaacaccgcttgtgaattcacaggagatattttgaggactcctgtttctgaagatatgttgggacgtgttttcaatggatcaggaaaacccattgacaaaggtcccccaattttggctgaagacttcttggacatccagggtcaaccaatcaatccgtggtcccgtatctatcctgaggaaatgatccagacgggtattaccgctattgacgtgatgaactccattgctcgtggtcagaagatccccattttctctgcagctggtctgcctcacaatgaaattgctgcccagatctgtagacaggctggtttagtcaagattcctggtaaatctgtacttgatgatcatgaagataactttgctattgttttcgctgctatgggtgttaacatggaaacagctaggttcttcaaacaggatttcgaagagaacggttctatggagaacgtctgcctgttcttgaatttggccaacgatcctaccattgaaagaattattacaccccgtcttgcgttgacagctgcggaattcttggcttaccaatgtgagaagcacgtcttggtcatcttgacagatatgtcttcgtatgcagaagctttgcgtgaggtatcggctgccagagaagaagtgcctggtcgtcgtggtttcccaggttacatgtacaccgatttagctaccatctatgaacgtgccggccgtgttgaaggacgtaacggatccatcacccagattcctatattgactatgcccaacgacgacatcacccatcctattcctgatttgactggttacattactgagggacagatatacgtcgaccgtcagctccacaacaggcaaatctaccctccgattaatgtgttaccatctctttctcgtctcatgaagtccgctattggtgaaggcatgaccaggaaggatcactctgatgtgtctaatcaactgtatgcttgttacgctatcggtaaggatgtccaagccatgaaagccgtagtaggagaagaggctctcaccccagacgatctcctctatctggagttcctgaccaagtttgaaaagaatttcatctcgcaaggaaactacgaaaaccgtacggtgttcgagtcactcgacatcggctggcagctgctccgtatcttccctaaggagatgctgaaacgtataccagcttccgtactggcagaattctacccaagagactctcgtcactag

SEQ ID NO: 1767 - DNA, 2388 bp, Leptinotarsa decemlineata
atgagttacatccagggtaacaggccaatctaccagggctctggagacttaccaatgccttcgtcaaaggaacaaaccctgatgtggcaacaaaattcatatatggatgactctggaatccattctgcaggtgctactgcagttccctcactgacaggtaaggaggaagaggatatggatctcttcatggatcaaggataccaaggttttacccaagaccaagttgacgaaatgaacaatcagcttaatcaaacaagatcacaaagggtgagagcagccatgtttccagaaactctggaggaaggtcagttgagaattgagataccatcaactcagttcgaccctggtcatcagactgctgtacagcgacttgcagagcccagccagatgctcaaacatgccgtggtgaacttgataaattatcaagatgatgcagatttagccacaagggccattcctgaattgatcaagcttctcaatgacgaggatcaggtcattgtttcacaggcagctatgatggtacatcagctgtcaaagaaagaagcttctcgccatgccattatgaatagtccccagatggttgctgctctggttcgggctatttctaattcaaatgatctggaaacaaccaaaggagcagttggaacactgcacaaattatcacaccatcgccaaggtcttttggccatcttcaagagtggaggcattccagctttggttaagttgctgagttctccagtggaaagcgtgcttttttatgctatcaccactctgcataacctgttgctgcatcaagatggttccaagatggcagtgagactggcaggagggttacaaaaaatggtggcattactgcaaaggaacaatgtaaagttcttaacaatcgttacagactgcttacaaattctggcctacggaaatcaagaaagtaagcttattattttggcttcgcaaggacccatcgaattggtaaggattatgagatcctatgattatgagaagcttttgtggaccacttcaagagtcttaaaggttttgtcagtttgttccagtaacaaacctgctgtggttgaggcaggtggcatgcaggctttggccatgcacttaactaattccagctcaaggttggtgcagaattgtctttggacactccggaatttgtcagatgcagcaacaaaagttgatggtttggagagtttactccagtctttggtccaagtacttgcttcttcagatgtgaatgttgtgacgtgtgcagctggaattctttctaatctcacatgcaacaatcaacgcaataaagtgacagtctgtcaggttggtggggtagatgccctggttcgcaccatagtgagtgctggggatcgtgaagaaatcaccgagccagctgtctgtgctttgcgccacttgacttcaaggcatgttgagtcagaaatggcccagaacgctgttagactaaactatggagttcaggtcattgtaaaactattgaacccaccatctcgttggccattggttaaggctgtaattggtttgataagaaacctcgctctatgtccagcaaatcatgctcctctgagagaacatggagctatacaccatctggtacagttattgatgagagcattccaagatacacagaggagagcaagcgtagccagcggaggcagccagcaaccaggaaattatcctgatggagtgcgtatggaagaaattgtcgagggcacagttggcgcactccacattttggcgagggaatcgcataatagagcgataataaggggtcaaatggtcatccccatatttgttcagctactcttcaatgatattgaaaatattcagcgtgttgctgcaggagttttgtgtgaattggcggctgacaaggaaggagctgaaataatcgaacaagaaggggctactgcccccttaactgagctcctgcattcgaggaatgaaggggttgctacctatgcagcagcagttctcttccgaatgagtgaggacaaacctcaagattacaagaaaagactctcaatggaattaactaattccctgtttcgcgaagaaaacctgtggaacccggatctcggcatggggcctgatctacaggatattttgagcccagatcaagcttacgatatgtatgggcaaggacctccttcagtgcacagtagtcatggtggtaggccataccagcaacaagggtatgaccagatacccttagatatgcaagggctcgagatcgggtcacacgctggaggttccaactacagcacccttgacgctatggatgtcgctgacgcagatgctgacctcaatttcgatcaactccccaccccccctcaagataacaaccaggttgcagcatggtacgacaccgatttgtaa

SEQ ID NO: 1768 - DNA, 483 bp, Leptinotarsa decemlineata
atggcacgtaacgctgagaaggctatgaccaccttagccagatggagagcagctcagttgggagaaacagaaaagcacaaaaaaaggaggccttacctagcatcggaatgtaaaagtttatatgcttgtgaaaagtggcgaatgcagatcattagagaaattgccaagaaagttgctcaaatccaaaacgcgggtcttggagaattccgaataagagacctgaatgatgaaattaacaaacttcttcgagagaagcaccattgggaggatcagattgaagagctgggaggaccagattatcagagagtggggcctcgtatgctggatcatgaaggaaaagaggttccagggaataggggttacaagtatttcggtgctgcgaaagaattgccaggggttcgcgagttgtttgaacaagagcctccgcctcctccccgaaagactacagcggaactgatgaaagacatcgacgcagattactat

SEQ ID NO: 1769 - DNA, 648 bp, Leptinotarsa decemlineata
atggctactgaacaagaaatgcccaccttcaaatgtgttttagtcggagatggaggtactggaaaaacgacatttgtgaaacgtcatatgactggtgaatttgaaaaaagatatgtagccactttgggagttgaagtccatcctctggtcttccatacaaacaggggccctattcggttcaatgtatgggacactgccggtcaggagaagtttggtggtctccgtgatggatattacattcagggacagtgtgctattatcatgtttgatgtaacttccagagttacatacaagaatgtaccaaattggcacagagatcttgtcagagtctgtgaaaatatcccgatagtactttgcgggaacaaggttgacatcaaagatagaaaagtaaaagcgaaaagtattgtctttcataggaagaagaatttgcagtactatgatatctctgccaaatctaactacaactttgagaagcctttcctatggctagctaggaagctcattggtgatcccaatctagaatttgtagccatgcctgccttggtgcccccagaagttcaaatggatccacaatggcagaaacaaattgaaaacgatctcaaggaagcgcaagaaactgctctacccgaagatgatgaagagttgtaa

SEQ ID NO: 1770 - DNA, 480 bp, Leptinotarsa decemlineata
atgactagtatggaaacagtgggtacccttttcataaaactgctgaaattggtgatcaatataatcgttttaattttatatcgaacaggattccagggggaatttttgggagtaggtggaacatggaatttgaacgaagagaagaatccggatgcagaaatcgtggcctccggtgtttttgttggttatataatatataacattgtcagtatgatcagcttttgcttcgccactttggatcacaaatacaacttcacagatatcctgatgaatataattggtcttttgctgtgggtagcagtaggagcaactgctatccactattggcacggttatttggccgaacataaatatacccacgtcgactcggagagatcggttggattggccatggggtccctttgcgtcctgaatggtgcagcatatttgatagattcagtgctatcgataatattcttggttaaaacaaaaatgaattga

SEQ ID NO: 1771 - DNA, 1839 bp, Leptinotarsa decemlineata
gaaaaactcttacatttggccaagcttatgccaacacaatggagaactattgctccgattattggaagaacagcagctcagtgcttggaaagatacgagtttttactggatcaagcccaaaagaaagaggaaggtgaagaagttgacgatcctcggaaattgaaacctggagaaatagatccaaacccagaaacaaaaccagcacgtcctgacccgaaagatatggacgaagacgaactggagatgttgtctgaagcccgagctcgtctagcaaacacccaaggcaagaaggcgaaaaggaaagctcgtgaaaagcaactagaggaagccagacgcttggcagcgttacagaaaagaagggaattgcgggcggcgggtatagaagttacttccaggagaaagaggaagcgtggggtagattacaatgctgagattccattcgaaaagagaccggctataggattttatgatacgtctaatgaggagttagatcctatggcaccggacttttcaaaaatgaggcagcaacatttggatggagaattgaggagtgaaattgaagagaaagaacggagaaaggataagcagaaattgaaacaacgtaaagaaaatgattttccgcaagccatgttggaaaaccgtgaaccagccaaaaagagatccaagttggttttaccagaacctcaaatttctgatcaagaaatgcaccaggtggttaaattgggcaaagccagtgaagtagcgcgggaggttgctttagagagcggagttgagacaacagacactctattgagtgactatacttttactccacaagctactgccactccaagaactccagctcctcaaactgacagaatccttcaagaggctcagaacatcatggccctaactcatgtagacactcccttgaagggaggtctgaacacacctctacacaattcggatttcagtggggcattgcctcaagcacaaactgtttccactccaaacacagtcctggcgaccccttttagatcatccagaagtgatggcagcgctaccccaagcagtactgttgggttcatgactcccagaagcggcgcagttgtgccagtaggtgctcagggtgcttatgtaccatctgtcagagataaattgaatataaacccggaagacggaacagttgacgtgaccactactccagcaacccagaaaatgtatcaaaattctgtgaggagtcacgtaaaagtaggtctcagtagtttaccgcagccaaaaaatgactatgaaattgttgttcccgagcatgaagaccaggagatgccagaacaagcccaagagcagttggttgaagatcaggcagacatcgacaaaaaaatccaagaggaactgaaagctaaagcagcacgggagcttgcaagtcgatcgcaagtaatccaaagaggcttccccagacctcaagaagttaacatgtctgtgttacgtcctccccatgagagctattctttgacagatctccagaaatccgaggaactgataaaatgtgaaatggtgacaatgctgctacacgacaatctgaaaaacccggtaccaaactcgaataagaggtctaatttatcacaagctgaacaactggctttcctggaacaacatccgtatgaaaacttccgagacgaagacatagccatcgcaaaaaatatgttgaaacgcgagatggatattgtaaaagtcggcatgagccacggagaacttcccttagatgtgtacactcaagtctgggaggaatgcctcggtcaagttctttttctccctaatcaaaacagatacaccagagcgaacttggcaagtaagaaagat

SEQ ID NO: 1772 - DNA, 474 bp, Leptinotarsa decemlineata
atgatgcagttcatgttactattcagccgtcaaggcaaattaaggttacagaagtggtatgtggctcatcctgataaactcaagaaaaaaataactagagaattaatcaccacgatcttggcgaggaaacccaaaatgtgtagtttcttagagtggagagatttgaaagttgtatataagagatatgccagcttatacttctgttgtgcgattgaacaaagcgacaatgaactgctaactttggagatcattcaccgttacgtggaacttctcgacaagtattttggcagtgtatgtgaactggatatcattttcaatttcgagaaagcatacttcatcctggacgaacttttgttgggtggggaggtccaggagaccagcaagaaaaatgttctcaaagccattgctgctcaggatcttttacaagaggacgaagctgttgaaggagctttgagggatatcgggttgctgtaa

SEQ ID NO: 1773 - DNA, 1251 bp, Leptinotarsa decemlineata
atgtaccggatacactgtgtaatgcgtaaatatgccttcactaatgggttacgactctattctcgagagcctcagaagcgcagttcttttttatcgagattgtatgataactttagagaagaaatggcaaaaaacaaagaaatgaaagagtctttgaaaaagtttcgggaagaagcagaaaaattagaacaaagtgatgctctaaaggctgctcgacaaaaatttgaaactgtagagaaagaggccagcaagggcagtgaagtcttcaaagatagtttgggaaccattaaagacagggttaagggtgttatagatgaagccagtaaatcagatatagcgaaaaaagctggcaaattcactgaagaagtaggaaaacagactcatagaataagtgaaaaggcccaagaaataagtaaaactggtgcttttcaaagtatttctcaggctacacaagctgttaaaaaggaaattgacaccacaagcatggaaggtagagtttaccagagtcccacaaaattacgaaagcgaaccgaaactggtgcagtagtgcaccaaaaatattatgagccaaacgtagatgctactggagttgaacttcacaaggattcaaagttctacgagtcgtggcaaaacttcaaagataacaacccctatgtccacaaagtgatggactggaaattgaagttcgatgaaagtgagaatcccgtcattcgtgcatcaagagccctcactgaaaaagtgggtgatatcatgggtggtctgttccagaaaacagaactttcagaaactctcacggaaatctgtaagattgatacgactttcgaaacgaaacgctttttaaaacagtgcgagaccgacattattcctaatgtacttgaagcaatgacgcgaggcgatttagaaattctcaaagactggtgtcatgaaggccccttcaacctgttcgctgttcccatcaaagaggcttacaagaagggttatacaatcgaatctaaaattttggatgtggacaacgtcgatctagttatgggtaaagtaatggaacaaggtccagtattgataatttcttttacttctcagcaagtgatggctgtacgtgatgctaccggcgccgtcgtagaaggagatccaaataaaataatgcgggttaattacgtgtgggttctgtgtagggacccctcagaacctgaccctagagctgcgtggaggttacttgatatatcagcaagcagtaacgaacaactagtgtaa

SEQ ID NO: 1774 - DNA, 618 bp, Leptinotarsa decemlineata
gcaccaagtgaagatccagtgttgaatgattttaaaagggaaatgcttttctaccgtagagcacaagctgcagtatcagaagctattcccaaattgaaaggcttgggattgttgacaaaaaggcctgatgattactttgcagagatggcgaagacagacgaacacatgcaaaaaattcgggaacatttgatgaagaagcaggaacagcaaaagagaagtgaaagggtcaaacaacttcggcaacagaggaaagaggggaaaatggttcaaattcaaacgaaactacaaagacaggaagaaaagaaagaaatgttgaatcaggttaagaaagttcgaaaggggatgtctaaagatcttgattttcttgatggtaaaaaaaataaatctattggaagaaaatctatggaaaagaggaaaatgaaagataaaaagtttggctttggtggaaaaaaaagcggcatgaaaagtaatacaaaggatagtgctgctgatattagtgaattcagaaatcctggaaaatctggtaaaaaattccccaaaagaaacagcaaacatggaaataaaaacagacccggaaagaataggcgggggaaaattaaagccagaggaaaaaaatga

SEQ ID NO: 1775 - DNA, 828 bp, Leptinotarsa decemlineata
atgaatgaaactaaaaaattagagcacgtctcccttgtttcgaaaatatgtacacaactggagaatcatatagggttaaacgacaaggacgtagctgaattcataatacatttatctgaagaaaacaatactcttgagagttttacaaaagtaatcaaagataatgacattgaattgtcggattctttcattgctgatctgcttcatattattcaagacaataatggtagaatcgctaaaatgagtgagaaagctcctactactgaaaagatgaatgaagtagaaaaattggaatacctgtctcttgtatcgaaagtgtgtacagaattagaaaatcatcttggactcaatgataaagacgtagctgaattcatcatacatttatctgaaaaaaacaatacgcttgaaacattcaccaaagcactcgtggactgtgggtctggattttctgattcttttattgctaatctactacgaattattcaacacatgaaacccccaaaaaatcagtcgaaggaagaggctgccattactcaaaaggaagtattagccaagaaatttccaggattatccattcctaatgagcctcagaaaccacttgatcttgaagggaatgaaaatgacagcattgatacagatattgtagcagatatgatgaaacagtttgaagcagatgcaccttcaaaaaaagataacattgaaaaggattcaagccgaagtaaagatggtaaaaatagaaacgatagaaaaaggtcaacttcccgacacagaagtagcagaagatcaagaagtagatcacctaagagacgaagattaagtcctagatct

SEQ ID NO: 1776 - DNA, 1884 bp, Leptinotarsa decemlineata
atgaatcctgctgccccgaattatcccatggcgtctttgtacgtcggggatttacattctgatattactgaagctatgctttttgaaaaattttccaccactggacctgtgctctcaattcgcgtctgcagagatttgattacacggcgatcattgggttatgcctatgtgaattttcaacaacctgctgatgctgagcgtgccttggacaccatgaattttgatttgattaagggccgaccaattcgaattatgtggtcccagagagatccctctttgaggaagtctggtgttggcaatgtattcattaaaaacttagatcgttctattgacaacaaagctatgtacgatactttctcagcttttggtaatattctcagctgtaaagtagctcaagatgaaactggcaccagtaaaggttatggttttgtccattttgaaaccgaagaagctgccaacaagtccatagaaaaggtcaatggtatgttgctgaacggtaaaaaagtctacgttggccgcttcattccgcgcaaagaaagggaaaaggaattgggagaaaaagcaaaactgttcactaacgtctatgttaaaaattttggggaagatttgtctgaagatcagcttcgatccatgtttgaacaatatggcaagataacaagttacaagattatgagcaaagatgatggaaagtccaaaggatttggatttgttgcatttgaaaatcctgaagctgcggaaaatgcagtagaagcattgaatggaaaggaaattatagagggcaaatcgctatatgttggccgtgcccaaaagaaagctgagcgtcaacaggagttgaaacgtcgcttcgaagcattgaaaatggaaagattgaaccgttatcaaggtgtcaatttgtatgttaaaaacttggatgataccattgacgatgaacgtttgcgaaaggaattttcaccattcggaacaatcacatctgccaaagtcatgatggaagagggccgaagcaagggattcggttttgtctgcttctcttcaccagaagaagccaccaaggccgtcaccgaaatgaacggcagaattgtagggtccaagcctttatatgtagccttagcgcagcgtaaagaagaccgaaaagctcatctgacttcccagtatatgcaacgcatggcaaatatgcgtatgcaccagatgggacaatttatccagccgggagcttcaagcggttacttcgtacccaccattcccacctcccagcgcttctacggtccagctcaaatggcacagatccgtacaagtccaagatggcctgcccagacaccggtgagacccgctggtcaaggaggcactgccgcttacacaggcatgcccaacacatacagagcagcagctaggcctccaaatcaatccactgccatgcgcggaaatattagcgtgccaagacccattacaggccaacaaccacaaaccatgcagggacgtccattagctggacaaggtgttgtacctgctacgggaagtcgaacaaacttcaaatacacctctaacatgagaaatccaccacaagccttaactttgcaaggagctgctgctcctgttcaacaagctgtccatatccaaggccaggaaccactgacctcaactatgttggcctcagctcctccacaagagcaaaagcagatgttgggcgaaagattgttccctctcatccaacgcatgtatgctgatatggctggaaagattactggaatgttgctggaaattgacaacaccgagctgttgcatatgttggaacacaatgaatccctcaagaacaaggttgaggaagctgttgctgttcttcaggctcatcaggccaagcaggctgccactcaaatcaagaaagagtga

SEQ ID NO: 1777 - DNA, 2751 bp, Leptinotarsa decemlineata
atgaccgactctaaatattttacaaccacaaagaagggggaaatcttcgaattgaaatcagaattaaacaatgacaaaaaagagaagaaaaaggaagctgttaagaaggtgatagcctctatgacggttggtaaagatgtctcagctctatttcctgatgtagtaaactgtatgcaaaccgataatctagagttgaagaagttagtttatctatatttaatgaactatgccaagtcccaaccagatatggcaataatggctgttaacacttttgttaaagattgcgaagatcctaacccacttatcagagcactggcagtaagaactatgggatgtataagagtggacaagatcacagaatatttatgtgaacctttaagaaagtgtctgaaagatgaagatccttacgtacgaaaaactgcagctgtttgtgttgctaaactttatgatatttcctcaggattagttgaagatcaaggatttctggaacagttgaaagaattattgagtgattctaatccaatggtggttgctaatgcagttgcagcactgtctgaaattaatgaaagcagcccaactggtcaacctcttgttgaactcagcaccaacacaataaacaaactgctgacagctctcaacgaatgtactgaatggggtcaagttttcattttggattccctttccaactatactccaagagacgaccgtgaggcccaaagtatttgcgaacgtataacaccacgtttggcacatgcgaatgctgcagttgtactgtcagctgtcaaagttctgatcaaaatgatggagattctagcaggggatactgaattctgcaccactatgagcaagaagcttgcaccacctctggttacgctacttagttctgaacctgaagtccagtatgttgcattgagaaatataaatttgattgtgcaaaaaaaaccggatattctgaaacatgaaatgaaggttttctttgtcaagtataatgaccctatctatgtcaaactagagaagcttgatatcatgattcgtctagcctctcaagttaacattgcacaagttctgagcgaactgaaagaatacgcaactgaagtggatgtggactttgtgagaaaagccgtgagagccattggaagatgtgccattaaggtagaaccttccgcagaaagatgtgttgctacactccttgacttgatacaaaccaaagtgaattatgtcgttcaagaagctatagtggtcatcaaggatatcttcagaaaatatcctaacaaatacgagagtatcatcagtactctgtgtgaaaatctcgacacattggatgaaccggaagcaagagctagtatggtatggattattggagaatatgcggaaagaattgacaatgccgatgaacttctggacagttttctggaaggttttgctgacgagaatgctcaggtacaactgcaactgctcacagctgtggtgaaactttttttgaaacgtcctcagcatactcaaggtttagttcaacatgttctcagcttagctactcaagattctgataatcccgacttgagagatcgtggtttcatctattggagattattaagtaccgacccagctgccgctaaagaggttgtactagccgacaaacctttgatatctgaagaaactgatttgttggaacctacattacttgatgaactgatttgtcacatatcatcattggctagcgtgtatcataaaccacccactgcttttgttgaaggaagaagtgcaggagtcagaaaatctcttccagcaagacaaggttcaaatgaagaagtatctagtgcacctgaagctacagtcattccgaatcaggagagtctgattggcgatttactctctatggatctgggtgcgcctgctccaccagtttctgcacctgctccagtcccaacaagcaatgtagatttgcttggtgggggattggacgttttgttaggcggacctgatctcagtgcaggtgctgctccatcaactacaggattattgggtgacatatttggtttaacctctgcccctaccatgtacaccccgccgaagatctgctggttgccagcagataaaggaaaaggtcttgagatttttggaacattctcaaggagaaccaatcaaatttctatggatatgaccttgactaataaagctatgcaggcgatgacagggtttgccatccagttcaacaaaaacagtttcggtataactccaagtgccccactcaatgtacctgccttgcaacctggtcagagtttggagtacagtcttcccttgagcaccactggtccagttcaaagaatggagccgctaactaccttgcaagttgccatcaagaacagtgttgatgtgttttattatgcttgtcaagtaccaattcaggttctgttcaccgaggatggtactttggacaagagagtatttttgactacttggagagacattccttctgcaaatgaggttcagtacaccataaatgatatcaagggaacaactgatggagtttccaacaaaatgaccctcaacaatattttcactattgctaagcgcaacgtagaaggacaagacatgttatatcaatctctgaaactaactaacaatatttgggtacttttggaactgaagttgcaaccaggtataacaacagccacgctgagtttgaaatcaagatctgtggaagttgcaccttatgttttccaagcatatgattcaattttgaagaactaa

SEQ ID NO: 1778 - DNA, 489 bp, Leptinotarsa decemlineata
atgccaccaaagttcgatcccactgaagttaagtatgtttacttaaagtgtgttgggggcgaagtgggagctacatcttccttggctcctaaaatcggtcctctaggattgtccccaaaaaaaattggagatgatatagccaagaatacagccgactggaaaggtctgaaaatcactgtccagctgaagatccaaaacagacaggccaccatttccgttgtaccttctgctgcctctctcatcatcaaggccttgaaagagcctccaagagataggaagaagcaaaagaatattaaacacagtgggaatatcagttttgatgaaattatttccattgccaagcagatgagacctcgatcgatggcaaagcaactgtctggaacagtgaaggaagttttaggaactgcccagtcagtgggctgcaccattgacggaaaacctccacatgatgttattgacgaagttaatgatggtactatagaagtaccc

SEQ ID NO: 1779 - DNA, 1095 bp, Leptinotarsa decemlineata
atgggggaagaaggaaaacgagccctgattttggttggaggatatggtacaagactgagacccttgacattaagtcgacctaaacctcttgtagaatttgctaacaaaccaatccttcttcaccagattgaagcattggtagaagctggtgtaaccgaagtaattcttgctgtgtcctacagggccgaacagatggaacaggagctgacggcagaggcagctaaacttggaataactgtagtgttctcccatgagactgaaccattgggaacagcaggacccatagctttagctagagaacacctctcaaaaagcacaaagccattttttgtgctcaattctgatgtcatttgtgattttccttttagagatttggctcgtttccacgaggcacatggaaaagagggtacaattgttgtgacaaaggtagaagagccttcaaaatatggagtggttgtatacggtaaggacaactgtatacaaagtttcgtagaaaaaccacaagagttcatttctaataaaatcaatgctggcctttacgttctcaatcccagcgtaatagatcggatcgagctgcgacctacttctatagaaaaagaggtttttcctggcatggcagctgataagcagttgtttgcttttgacctacagggcttttggatggatgtgggacagcccaaggattttctcactggaatgtgcttgtatttgaagcatttgagatccaccaatggaagcaaattatataaagggccaggtgttgttggaaatgttctagtggatccatctgccaaaattggaaatgactgtcagataggtccaaatgtaactattgggcctggagttgttgtagaagatggtgtgtgtataaagagaagcacaatactccgagacgcaacaattcgatcaaattcctggctagagagttgcattgtaggatggaactgttcggtaggtcgctgggttcgaatggaaggcactaccgttcttggagaagatgtcatcgtcaaagatgagacttacataaatggagggcaagtattgcctcataaaaatattactacatctgttcctgagccacaaatcataatgtag

SEQ ID NO: 1780 - DNA, 873 bp, Leptinotarsa decemlineata
ctaaacatggcgtccgacggtgaagatgttatcacagaccaagaaaaagttaaaatagtatcggatttcattctccattcgccgcctggcgaatttaatgaagtctttaacgacgtacgaaaactcctcaataatgacgacctactaaaggagggcgccagcggggcattcgcccagtacaacaaagaccaactgaccccagtgaaaatagaaaactccgataacttagtgctcatcaccgaatacaacgatcagggaaacaacagatttttcgacccgcgaagcaggcagagctttaagtatgaccacctgcgaaaagaggcctccgactaccagacgtacaccccggatccagcggcggagccctggcgctccgctctcgacgctgagttcatccagtacaccaggaatcattaccgggacggggtgtgcagtgtggtgggcaggaaccaagggggcaacgtggtcttgacagcttgcatcgaagaccaccagttccagccaaagaacttctggaacggcaggtggaggtcgcagtggtcgatctctctgaatggaggatccgtggcagaagttagaggtgtgttgaaggtgcaggtacactactacgaggaaggcaatgtccagctggttagcacgaaggaaatcaaagagtcagtggtggtaacgaacgaggctcaaacggcgaaggaaatagtccaggtcatcgaaacggcggagaacctctatcagacggcgatttcggagaactaccagacgatgtctgacaccacttttaaagctctgaggagattgctacctgtcaccagaacgaaaatcgactggaacaagatcgtgtcctacagcatcggcaaagaactcaaaacgcagtga

SEQ ID NO: 1781 - DNA, 3663 bp, Leptinotarsa decemlineata
aacactgggccttcagatactacaaacccaaattatgctgtagtgccccctgtagtttctgatagcaaacctgcaataacaaatagtgaaacaaatgacactaacaatgatgttgtaatgttgagtcctacgaaatttctcatgaaaaagggacgatctggacgtttattggaatatccgactgattacgatcctatgacttcccatattgctccaccggatagtgatcagagaggatattcaggagtaccatatgtcttgacggaaaccagactgcaacagatccgccaaaatttcatgtatccctactacaacagaggcggtaatgcagatgacgaaggagactaccagaaagaaattcagtcatctattccgcaagtgtacaagaacctcaacttccaactccctttcttcggatttcgattcaattacacgagggtctccttgaacggttatttggaattcagcgatcctcctccaaattacgactatcctttggtctttccagtaaaggaatggcctaaaaagaacgacccttctttcatcggtatctttttcagtaaatgtagaatcggtaacctgagggacggagatattgatcaaagagaccctggagtgtactttaggatggaaagggatctcagaaataggcaggacaggatgggagtggagatcagagaacgactgaaatgggatataagggaaggggtgatagggtcagaaacattcaatcccaaacacgccattatcgtcacatggaaaaatatctctttcaatggaggttttggcaatgctctctaccagactaacactttccaaatgatcctcgccactgatgaagttttcacctacgccatgttcaactacttgaatcttgactggaccacccacactgaagcgggaggcgacacaagaaaaggagaaggaggagttcccgcttttgtgggattcaacgctggaaacggtactagaagttttgaatacaaaccatacagtcaagaatctgttattcgagatctcacacaaactggtttcgctaatggtttcaaaggaaggcacattttccgaatcgacgaaaatatcctaactggaacatgcaataaagatatagatggtgctaatctaccgctaatgatatctccagaaagtggaaatatgctgggtggaacaatagtgaatataacaggaccttgtttcggcctagacgaccaagttaaatgcaaatttgatgtagccgatgaaataaatggcgtcgttatagataaaaacagggctatatgcatccaacctagactgtatgccgaaggatgggtgaatttacaaatagccataggggctggggtatacaaatggaagggaaaatattatgtcgaatcccccgcagcggcttctcaaaaaatctacttcaaggacatgaaggttcatgaaaaatcgcctagtgaaataagaataacttgggaaaaatacaacttgaccactaacgaaaacgctaacattcgcatctccttatggggttacagagaaacaacaataaggccaacgttcgtttacatcactgatatcgcagacagtctccaaaatactggagagtataccatcgtaccgtcccaatatagaacaaaagttaatgagtttctcacggatatcaaatttggtttcttgcaaattaacttgactgaatctatcaaagtgaacacttatacatctgtacaaagatcggtggaaatagttcctgttgtatggagtcgacccattcccctaggatggtactttcagttccaatgggaaaatatgtatggacgaagctggcccaaagcactctgcgatgactggctaagaacagacagatacctgaaaaactttgctcatgagttacctcaatgcccttgcactgtagaacaggctttggcagacaaagggaggtatatgcccgactttgattgcgacaaggactcaaatcccgtatgctactacaataaccaagctctgcactgtgtgaaaacaggatcaccaacgttggagggatcagaacagcagtgctgctatgacaaaaacgggtatctcatgttatcatacgatcagcagtggggttcaagtccacggcgttgccacaatctgggaaaaatgccctacaacgaagcaacaaaagttccaaccttatcgcaatggttcaacgatatggtaccgaagtatctttgctgtttgtggcaggaagaacaggcggtgggttgcgaaacgctgagattcgaaagaagaccaactcaggactgtgtcgcgtaccaagctccagggattgctgggatttacggagatccccacgtcatcactttcgatgacgtcgagtacaccttcaacgggaaaggagagtttgctcttgtgaaatctgtgacacaaactgacaacttggaggtgcaaggcagatttgagcaaatggaccctaacgcctatggagaagtacgtgcaactcaactgacttcaattgtggcaagaggaaacaacactatagcagtggaggtcagaaggaggccattggatgctaggtggaggtataggctggatgtcatagctgataacaggaagttgttcttcgacaggccgtctttgaaattccaacatttccaaggagtgactatttatacacctacttatatcctcaatcagtctgaagtcatcattatgtttgataacggagcaggagttcaagtaatggataaccagggattcatgaccgcgagggtgtatcttccttggtcattcatcaacaaaactgttggtctctttggcaactggagtttcaataaggaagatgacttcactcttcctgatgagtcgaaggctgccgtcgtgggtaatatcaatgatatggaaagggtctacaatgactttggttccaaatggatggtggacgacgtactagatccgaaaagaggtagatccctatttttcagagaattcggcagatcatcggcaacgtacaacaacaaaactttcaaaccgcagttccttatgttacctgaggacataatacccgcaaacaggtcgatacagatacagagaacttacgacatttgtagcacaaaaatgtacgaatgcttctacgattatgccatgacgctcaacagagatcttgcccattttactcagaattataaagcaaccatatatcaactcaaagaaacgacgaggcagaaggttgtttcttgcggagttctggaaacaccgcgattcggtaggaagagtacttttctttttatacctggaaccaaagtcacttacgagtgcaatcaagacttcgtattggtgggagatcccagaagagaatgtttggcagatggcacatggaatgctcctgaatatggctacaccgaatgtttacgtcaacaagaatattctcagcgccaatcagccattgcctctggagccgttctcgcaataattattccactagttctattatttgtatatctggcttatatgttcctcaagaagaaacagaaagaacgagacgaagaaaatttacaaacgcaagcgtacgagcaacagaaaagacaagctcaggaagctgctgctagaaaattaactgctgccgaagagtacaactcagatgaagacgataataacagcaacgttacgagcacagcaaaagaaacaacagtgtattag

SEQ ID NO: 1782 - DNA, 300 bp, Leptinotarsa decemlineata
atgtcgtcatcttctgattctgattcctcttttttctcttctttcttggattctttcttttcttcggcggctgctggtgctgcagaagctgctgcagcagcaggagcagctcctccagctggcatggagctcaatttctcacgtccttgggcgatgagttcatcaatagattttccacctagttcagcaatgacctttttcagccgttctccttcagcttcaattcctacagatcctaaaattttttcaagatcagcagcagatggggaagtttttccgcccaaaacggccaaaagataa

SEQ ID NO: 1783 - DNA, 2121 bp, Leptinotarsa decemlineata
atgactgatcgtttcggattaaaatgggaccccaaaaatttagagattagaacaatgtctgtagaaaagacactggaacctctagtgttgcaagttacaacacttgtgaatactaaggggcccagtaaaaagaagaaaggtaaatctaaacgtgccaatgctcttgtgagtactgtggaaaaagctactgaaaactttattgaaaagggagagcaaattgcctatgaaaatccagatattactgatgaaatgctagcagcagtagaagaagtgaagaaaacaggcactgctatgagtgtagcagcaagggaattttctgaagatccttgttcttcgctgaaaagaggcaatatggtccgagctgccagaaatttactatcagcagtaacacggttacttattctggctgatatggttgacgttcaccttttactgaaatccttacatgtagtagaagatgatttagagaaattgaaaaatgcatcaagtcatggtgaacttcttgataatatcaaagctttcgggcaaaatgccaatgagttgatgaatcaggcagctaaacggcaacaggaactcaaagatccacaacttcgagatgatcttgccgcagctagagctgtattgaagaagcattctaccatgctgttgacagcttccaaagtttacgttcgtcatcctgaattggcagctgctaaggcaaatagggactacgtattgaaacaagtttgtgaggctgtccatactatcaatgatgttgcacagggtcgtactccgcaaccagcttgtggaccttacgatggcccaggtgaattggctgcagcactagacgatttcgatgatcacatggtgatggaaccattagcttataatgaagttcatactagaccatctcttgaggaaagattggaaagcataataagcggagcagccctcatggctgattccagttgcaccagagacgagagaagagaaagaattgttgctgaatgtaatgctgttaggcaggcattacaagacctcttgtcagaatatatgactaacatgggaaataaggataagagtgaaagcctcaatagagctattgataatatgggaaggaaaaccagggatttgagaagacagttgagaaaagccgttgttgatcatgtttctgacagtttcttggagaccaatgtaccattgttggttctcattaaggctgctcaaaatggaaatgaaaaagaagtggaggaatatgcagttgtcttcactgaacattccaataaattggttgaagtcgccaacctcgtttgcagcatgtctaataatgaggatggcgtgaaaatggtccgttacgcagcagctcaaatagaaaatctctgccctgaagtaataaacgctgctcgtatcttggcagccagacctcgtagcaaagttgctcaagaaaatatggctgctttcaaacagtcttgggagaatcatgtcagaattctcacggaagctgtcgatgatataacgactattgatgactttttggctgtctcggagaatcatattttagaggatgtcaataaatgtgttttggcattacaagaaggggatgctgacacattggaccgtacagccagtggtattcgtggaagatcgaacagggtttgcaatgttgtttctgctgagatggacaattatgagccgtgtatatacacgaagcgcgtactggaagctgtcaaagtgctcaacgatcaagtaatgccaaaattcactcaaagagttcaggttgcggtgcaagcattaggaaacaatccaccaaaagaagttgatgaaaatgacttcatagatgcgtctcgcttggtttatgatggagtgagggaaatacgtagagccgtgttgatgaatagagctgacgaagatttggacccagaggatgttgaactggatgaaaactatacattggagaacagaagcaaatcgagtgctcctactgaagaagatccagttgatgagtatccagatattagcggaatcaccacagcacgagaagcaatgggagaaatgctggaagaagataaacagaagattctgcaacaagtggagctcttaagaagcgaaaaacttaaatttgactgtgaagttgccaaatga

SEQ ID NO: 1784 - DNA, 1101 bp, Leptinotarsa decemlineata
atgtctttcaattttggaaacacacccgtctccaaaccaggtgctacggttttcgcattgccaactaatcctactacaacttcagcgacaggatttcagttttccgctgcttcaggagatacaaaaaatcagaagcctactagctctgccttcacttctttaacgcaagtcaaacctactgggactttaggaggacaaggtaccactgctgcttttcctacaggtggttttagtttcggaaatactaaatcagcaactacaaccactgcctttgtccctatttctggatcaactccagttaccaaacctaccactactacaggactttctttgggcgtcccttctgtcaccagtacggctgctggtattacaactacttctgcaaccaaattgagtttcggactatcatcaggatcatctactactacagctgttgtgacaacatcaggaacatcttcaaccattgttccagctgcaaccacggtaacatcgtcaacttcgataattccagcaactgggttactaacttttagccaactagaagactctataaataaatggacaatagatttagaagaacaaggaaaatttttcataaatcaggcaaaacagttaaatgcttgggattctttattgatttcaaatggtgaacaaatattgaatttgaatggcagtgtagagcgtgtcaaacagcaacaacaacaactagatcaagaactggactttgtacttgctcagcaaaaagaattggaagagcttatagctcccttagagaaggaattatgggacatacctgttactgatattgatagaaatcaaatgtaccagttttcagaaatgattgattctcagctaaaacaaatgtcggaagacttgaaggaaatcatcgaacacataaatgagtctaatagaaatgaagcggcatctaatccaattgcccaaatcagccgcatcctgaatgctcatatgaactccctacagtggatagatagaaacacttcgcaaataagttctcatttggagcaaatcaccaaaatgcaagattcgaataggagaaatttggcccttagcaactctttcaatcactctatgaatatgtag

SEQ ID NO: 1785 - DNA, 582 bp, Leptinotarsa decemlineata
atgttcatctgggattggtttaccggtgtacttggttacttgggattatggaagaaatcaggcaagctgcttttcctaggcctggacaatgctggaaaaacaactttactgcatatgctcaaagatgataggctggcacagcatcttcccactttacatcctacatcagaagaattgtcaatcggcagcatgaggttcacgacttttgatttgggaggccattcacaagcaaggcgagtgtggaaggactacttccctgctgttgacgccattgtctttttagtagatgccaatgataggaacagattcaaagagagtaaacaagaattggattcgctactcacagacgagactctttcgaattgtccggttcttatattaggtaacaaaattgatttgcctcaagcagcttcggaagacgaactaagaaattactatgccttgtatggccaaacaactggaaagggaaaggtggcaaggtccgatttgccaggacgtcccctcgagctcttcatgtgctccattctgaagaggcagggatacggagaaggtttccgttggctggcccagtacatcgactga

SEQ ID NO: 1786 - DNA, 642 bp, Leptinotarsa decemlineata
actgtcaggtggtacaggtgtcactctggtgagtctggtggaaaagaagtggaaattttattttgtatttgtgttactttattgcgtgtaatttttctgatggatccaataaacttgttagagagccgtattgaaaatctggaaattcagattttcggagataaattaccaactacaaatactaaaaatgttactagtttacttttggaaactcatgcaatgattacttcagctttaagttgcagagaagtaattagttccatgcttcaccatttgtctattataaatgaatatctagatccaaaccttggagtagatgagctagaagctgaagctaagaggtatcacttactccaattatactcggaattgaaagatactgtacagaagattggaactttagagtcactgttacccttcattgattctgagaacatagcgaaagtaactgaactatcaggaaatatagagcagctggcagttggtaatatgaatacatattctgaatgccaagaagttactcagaatgtattgaaatctttgcgaaattacaatgagatcatttcgactataaagatattatttgctgatctggatactgaagtttctcttctggaaaattctttaattacagaagaatag

SEQ ID NO: 1787 - DNA, 1740 bp, Leptinotarsa decemlineata
atgaccacttcggacgtttataatgacttgagtctatatgttacacccgagaaattctaccttgaacccagaaacagcgacgaactcttgattatcgaccgaccttcggagcaaatcacgatacagagaaatgtcggccagattcctgcctcgagcagcagaagggacttctgtggactgctgggtacgatccatctactggcaggaccctacctagtcgtggccctccagagagacctggtggggtacatcgccggccacgctgtctggagactagccaaagccgagctagtgccttacaatagaacattgttgcatttagatgctgagcagcagaacgacaacaacgtctacctttccatggtggaacagatgctttccacacccttccattacttcagctacgactatgacatcacgcattccatccagcgcctgcatgacatcagccccgacttctggcagcaatctctgtacgagcgagctgatcaacgattcgtttggaacaatcatttgctgcaacccttcaagagcgcgggcgtcaagcgtttctgcttgccgctactccacggattcgtttcgattaaccaatgtgtcatcaatggccacaatctcagctggactatcatctcacgccgaagcgtgttacgcgcagggacaaggctgttccgaaggggcatcgacagggatgggaacgttgctaattttgtagaaacagagcagatagtggagttcctaggcgaccgcgctagcttcgtacagataagaggatccatacccctgttctggcatcagaacccggatttacggtacaaaccaccgcctacacttctggatgtggacccccaggagcagcaggctgcgtgtctacgtcacttggaggaaatgactgctatatacggcaagcaagttctggtgaatctcatcgatcagactggtagagaaggtggaattgagaaggccttcagggataccatcagtattttagggtttgcttctgcaagatacgagcctttcgatttccaccacgagtgtagaaagatgcgctgggataggctctcaatcctcatcgacagaattgctctggaccaggatgaaatgggcttcttcctgattcttcgggacggctctttgagctctcttcaggacggagtgttcagaacgaactgcatcgactgcctggataggacgaacgtggtacaaagtatgctcgcccacagaaatttggatgtggtgttgaagaaactgaatattctgcatccgaatcagaggttggacgagcagtcatcgttcgagatgctatacaagaacgtgtgggccgacaacgcggatttcatcagcattcagtactccggaactggagctctgaaaacggacttcactaggacaggaaagcgcacacagctgggattgattcgggacgggatcaactctctcgtgaggtactataagaataacctgacagacggctaccggcaagactccatagacttgtttctgggttacgggaagattatctcgcctctgacagtggagaagggctggcgatacatgacgttcccttcggttcttctgatggccatcgcgatgtttgtggcctccgccgtcttcccttcggagtactctacggaaaatctattgtacttgctgttctggggctccatggtttacgtttctgcgcacaccatcctcaagtatggtgtggagtttgttgataagccgaggctcacgcagtcgtag

SEQ ID NO: 1788 - DNA, 1650 bp, Leptinotarsa decemlineata
atgcctccaacgatccagcaaagtggtcaaagtactgccaatggtgtagagaaaagacctgtaaaacccgtggaaaaaaggtcagatttaatatgtaaagttaaatattgtaatacgttaccagatattccgttcgatttgaagttcatatcctacccttttgaatcgataagattcatacagtacaatcccacttctttagaacgcaattatcggtatgaagtgctaacggaacatgatttaggagtaagcatcgatctaatcaataaagatatatatgcaattgagccaggtgcatatttagatccagccgatgagaagctgttagaagaagacattttgacgcctcaggactctaaaagatctcgacaccatgctaaatcagtatcatggctccgccgtacagaatatatttcaacagaacaaacccgctttcagccccagaccatggacaaggttgaagccaaagttggttacagcatcaagaagtctcttaacaatgagacattgtatatggatcgtgattcacaaatcaaagccattgagaagacgtttgaagattctaaaatacctatcgagaaacattatagtaagccgaatgtggtacctgttgatattcttcccgtgtatcctgacttcaatctgtggaagtatccttgtgctcaagtcatctttgattcagatccagctccagtgggaaagcaggtgcctgcccaaattgaagaaatgtcacaggctatgattcggggtgtcatggatgagagtggtgaacagtttgttgcctactttcttcctacggaggaaaccttgcagaagcgaagggaagattttgcaaatgaaataccctatcaagatgatgaggagtatgaatataaaatggctagagaatacaattggaatgtcaagagtaaagcaagcaaaggatacgaagagaattacttctttgttgttagacaagacggtatttattataacgaattggaaactagggtaagactgagtaagaggagacagaagattggccaggcacccagcaatacgaggctcattgttaagcacagaccaatggatgccaatgagtttaggatgcaacgctacagagagaaacaacttgaacctccgggtgaagaagacgaagaaatggaggtagaggaaacccaggaggagactcaggaagagactcaggaagggcaaggcaatgacagtcaagcagaatctgatcaggaaaaccgagaaaaagcaggaagcggaaaggaagaaggttcacgagcctcttcgagatcttccaggaaatcaaaatcccgttcaagatcccgatccaattcatcagcaaagtcacgttcaagatctagatcgaaatcagcttccaaatcgaggtcccaatctagatcaaggtccaggtcaaaatctaagtcaaggtcacgttctgtatctaggtctcgatcaagatcaaagtctggctcaaaatctccgtcgaggtctagatccagatctggctcaaaatctccttctagatctagatcttcatctaaagcatcgtcaagatctagatcaaagtctaggagtagatctggttctcgttcgagatctaattccaaatctccttcaagatctagatcgggttctagatctggatctgacagtgagtga

SEQ ID NO: 1789 - DNA, 1170 bp, Leptinotarsa decemlineata
atgcctattgaaaatttggaggaccaaggtctggaaaagaacccagacttggaattagcgcattataaatttctactaaccttaccagagtatcagaatgatacattggtacatacaaaaatcacagaagcaatcaaaaaagatgatatggctccttggtatgaattaatttgtaaggactctggctggaaagtggatcagaacttattgaaagccatgaaaatgaaaaatgatgaacaaataaaacttttggatgaggccattgaagatgctgaaaaaaacttaggagaaatggaagttagggaagcatatttgagaaaggcagagtacttcagtcgaattggtgataaagataatgccgtgagcacatttaggcaaacttatgataagacagtttcgcttgggcacagactggatattattttccatttaataagaataggcttattcttcatggatcatgatctcatcactagaaatattgaaaaagcaaaaactttaatagaggaaggtggtgattgggataggagaaatcgcttgaaagtatatcagggtgcttactgtatggcagtaagagattttaagactgcagcaaacttgtttatagacacagtcagtactttcacatcttatgagttgatggattataaagcatttgtccgctacacagtttatacatctatcattagtcttccaaggaaccaacttcgagataaggttgttaaagggtcagaaattctggaggttcttcattctgaaccattcgttaaggattatttattttcactgtacaattgccagtatgcagaattcttctcaaatttagcggaagtagaaaccactctcagaaaagactacttcatgaatcctcattatcgctattatgttcgagaaatgaagattttggcctacacacagttactagaatcatatagatctctcaccctacagtacatggctgaagcttttggtgtttctatggaatacattgatcaagagttgtcaacattcattgctgcgggtcgactacattgcaaaattgatagagttggaggaattgtggaaaccaaccgtccagatctaaaaaatgcacaattcaattctgttgttaaacagggagatttgcttttgaatcgagtgcaaaagctgtctcgtgtcattaatatttag

SEQ ID NO: 1790 - DNA, 450 bp, Leptinotarsa decemlineata
gctttctccgaaccaccaagtccttgggtaagtgcgagtgatccacccgaaattgacagcaccaatgtcggtgtaccttcaacctacaatcagcgttcttctgaaaaaatgaaagccgacgaagggttgggaaaaggagctaccatttctgcagtcctgtatgctaatgttaatcatcctgagtggaaaaaagagttccctagttggtcagataggtacaaacagataatcaaaaaatggaggactttgagtcaggatcagaaggctccatttttgcagctcgcgagggataataggagccaattgaggatgaagaagtcccaacaagatcaggacaagatggccctacagcaaaaatctgctcgagaggcggaacaagagaggcagtggaaacagttgcaggctttgagacaacaacaagctcaacaacagcaacacgttatccatgaa

SEQ ID NO: 1791 - DNA, 4305 bp, Leptinotarsa decemlineata
atggaagattcatctgaagaacgtagaccaaaaagatcgaaacgggaaacttcatataaagctaaagcatttgaaaaattcaaacagctcaaaagtggtattagaaacaagtatgaagtcgaagaactggatagtgtttatgaggtagttgaggaaaaagagtatgttaagaaagttctttctcgtcaagatgatgactggattgttgacgatgatggtagtgggtacttggaagatggtagagatatatttgatgatgatttggactccgaatctattgctcaagcaagtgcaagaggaaaaggtgtcaaaagaaagaaaaaaaatgtctcggaaaatgccggaagaggaaatttgcaacaaatgctttcaagtatgccaaccaaaaagaaagaggaaaccaaacttgatgacgatgaaatgctgtctgaaatcttaggtgaaattgatgaaacttctgctagtatcccaaaaccaaaaattaaagaatactcggttatgtctcgaaaacttgctgctaagaattatatgaagaacttaagtgttccaaacaaaaatatttctattactcgacccataagtgacatattgaaaaaagaagctactggtaacatattgaaagaggtacaaaacaaagtaatagaaaatggcgacttgaatgaaattgctgaatttccacaagttgatattgtagaagaaaactctttacgaattactgaggaggaagaacagcctgttgaattaagtgaaaacttgactatcgaggatgattttacccaagagtgttttgaagatgacatcgacatgacacaaatagaagaatttgagtctcagcaacttcctgatatttcagtcgatgaagaaaaaatttcagatgagttacaagcagaatttatgagtgaatgggaaaatttcacaaacgaatcagatgatattgatatggacaagttagtggatagatctgacatacctcttgttgaagttgataataaaaaggtattccggttttattggtgggacgcttatgaagatcctgaaaaacaaaggggggtggtatttctgtttggaaaaacatactgtgataagactaaaagttttgtgagctgctgtgtggctgttagaaacattagtagaagagtttttcttttaccaaggccatttgaacttggagaagatgggacacctacagaagaaccagttacctttaagaaaatgtacaatgaattgaatgaaaaaataataaagccattgcatatcagttttttcaaaacaagatctatcaagaaaaaatatgccttcaatcctgaaataccaaccgaatctgaatacatggaactccgatacccggccactgacgcaagaatagatttaggagatctgaagaagaaacctcaaactatttcgaaaatatttggaacaaactccagctttcttgaaatactccttttggaaagaaaagtcaagggtccatgttggttagatatcagtaatccatcgcctgtttcaaatcctttgagctggtgcaagtttgaagttaactgcataaaagtcacagatctcaacataatggaatcagataaaccattaccacctccaccgttagtggtggcagctattaatatgagaagttttgtgaatcccaagacgtatgccaatgagattctcatgatgtcctgccttacacaaactaaatatgctgttgacaaaaaacctccaaatcctccattccagcaacatttttgtgttttttcatgtcctgcacagcaagttctacctcttaacattcatgaggctctgggaaattatagggtaacgaaagtacaaaaaatggactctgaacgagcgctcctcaactatttcattacacagttttccaaaatcgatccagaccttatagtagggcatgatctgcaaggatatcaaatcaatattttagctgatcgtcttacaaaacaggacaacaaaactttcagtaaattgggaagaataaaaagatccgaaaagaaaagactggaaaagcatttatttgctggtagactcgtatgtgatatcaaaatatcagccaaagaactaataaaatcgcgatcatacgacctagatgctctttgtcaagtcattcttaaactcaaagaaaatcaaagaattgaactagaacctgaagacattcccaaaatgtatcagtcaaccaaggatctactgaaactgatatcatttacagtgcaagatacatcgtacattctcaaaatgatgtacgacttgaatgttattcctcttgccttacaaatcacaaacatagctggtaatataatgtcgaggactttgatgggtggtagatcagaacgaaacgagtttttactattacatgcattttcagaaaagaattatatagttcctgataaggaatataagagaaaagataccacactgtcgagttcagcaagaaagaagccaacttattcaggaggattagttttggaacccaagataggcttctatgataagctcattttgcttatggattttaattctttgtatccaagtataatccaggagtacaatatttgcttcaccactctgccagtaactaatagcgaggataatctagttttacctgatcgagggttaccacctggtatattacctactgaaattagaaaacttgtagaaagtcggaggcaagtcaagaaattgatgaatagtgctgacatatcacttgatttgaaaatgcagtacaatattcgtcaaatagcgctcaaattaacggccaacagtatgtatggttgtcttggtttttcgaattcacggttttatgccaagaatctagcagcactggtcacccataagggacgagagattctcacaaatactcgagatatggttgagaagatgtgttatgaggtagtttatggtgatactgatagtataatgataaacacaaacatcttggaatacgatcaggtattcaaaattggaacaaaaattaaacaagaagtcaataaattgtacaaacaagtggaacttgatattgatggagtattcaagtaccttctgttgttgaagaaaaaaaagtatgctgctgttactttgacaaaaataaacgacaataaattgaaggaggtgaaggaatataagggattagacatcgtaagaagggactggtcacagctagcctgtggagctggtgaatatatattggaccacattttgagtgatcagtcaccagatgatagaataaataatatccacgagtacttgagaaaaataaggaaacatatggaggaaggtcaagttcctatctctctactagttataacaaagcaattgaccaaagacccaaaaatgtatactgacaagaattcactgcctcatgttcaagtagcactacgatacaaccaacaaagtggcggtcatttcagggctggggatacagttccttatgttatatgtgaggatggcacttctaattctgcttctcaacgtgcttaccatattgaggaactgaataagtctgaaacgttaaaaatagatgttaaatattatttaggacaacaaatacacccagtggtgactagaatttgtgaaccgatagaaggtacagattctttccaaatagcagaatgtcttggtctcgatactaactctttcaaaaaacccaaacaacactctatggaagtcattgggcaaaacatttctaagcctgaagtcaagtttagaaatgtggataaatttaagttcaaatgttacatctgtaagcaagagaatgtcgttgataatctgttggatggcaatatacgttttttggaaaaatgcaagaattctgaatgcggagtcaggcctgtagagtacctaccttatatccaaaaccagctagcattggctattcagttgtacattactaaatattatgataatgaacttacttgtgaggatccagcttgtacgaacgaaacaaatcgactgccattgaagttttttaagaaatatcctgtctgtaccctttgccagaaaggagttatgtatcgaacatatactgaacaacaactttacacgcaactcacctactttcagcacatatttgatttgggaaaactaaataaaggactggaccctgacctggaatctggatatcattcacttcgagaaacagttgaaaaatatttaaaccactcaggttattcagttattaaccttacggagctgttttccggatttctggttagaaataaacatccaaatacaattgaaaggatagacgtaccatatgaagaacttgaaaatttcgatgaagaagatgaagagttttaa

SEQ ID NO: 1792 - DNA, 1398 bp, Leptinotarsa decemlineata
atggccgctgcagctgctgcgaaaatcgtagaagttcgagagtcaactaaagttgaacgaataggagctcactcccatataagaggtttaggtttagatgacagtcttgaggctagacatgtttcacaaggaatggttggacaagtttcggcacgacgtgccattggtgtcgtactccaaatggtacgagaaggtagaatagctggtagagcagttttgttggctggacaaccaggaactggcaaaacagccattgctacagctttagcagcagctttaggtgttgacactcccttcactagcatggctggatctgaaatatattctctagagatgagtaagactgaagctataacgcaggccattagaaagagtattggcgttagaataaaggaagagagcgagatcatcgagggtgaagtagttgaggtacagattgaacgaccagctactggggtcggtacgaaagtagggaaactcattttgaaaaccaccgatatggaaaccgtctatgatcttggtgggaagatgatcgacagtattttgaaggagaaagttcagtctggagatgtaatcactatagataaagctacaggaaaaatcactaggttaggcaggtcctttgcaagagctagagattacgatgctactgggcaacaaacgaggttcgtacaatgccctgaaggtgaactccagaagagaaaagaagtggtccatactgttacattgcacgaaatcgatgtcataaacagcagaacgcatggtttcttagctttgttttcaggtgataccggagaaatcaaagctgaggtccgcgagcaaatcaacggcaaagtagcggaatggcgagaggagggtaaagccgaaattattccaggggttttgttcatcgacgaagtccacatgctcgacatcgagtgtttctcgttcctgaacagggctctggaaaacgaaatgtccccgatcgttatgatggcaacgaacaggggcatcaccaagatcagagggacgacctacaagtcacctcacggcatcccattagatctgctggacaggacgataatagtgcctactcagccatacgaggagaaggagttgaaggagattttgagcatccgttgcgaggaagaagactgtcagatgtcagacactgccctggctgttctcactcgcatttgcaaagagacctctttgcgttacggcatgcaacttatcatgacttcgagtctcatagcgaggaaacgcaaagctcacgaggtagacgttcaagacattaaaagggcttacgagctgttctttgatgaaggcagatctgtgcagtttttgagggagtaccaacaggagttcatgttcaatgatttggatgacaaagatgatatggaaatcgaaacaaattag

SEQ ID NO: 1793 - DNA, 1116 bp, Leptinotarsa decemlineata
atggcattgaggacatatggagacaagcccataagctttcaactagaagaaaatggagaatattattgtgtgggatcagaggttggaaactatgtccgactcttccgagggtctctttataaaaaatatcctggaatgttcagaagatctataaccaatgaagaaagaagacgattgatagatcttggcttgagccaacatgttttagctagtagcgtttctttgttgaaagcaacagaagttgaagatatcatagaaggcaatgacgagaagtacaaagctgtatcagttcacacgtctgaacctcctgctcccagagagagcaagtcaaagaagaacatgcaatgggtaccttccttaccaaattccagtcacttagatgcagttccccaagctacacctattaatagaaatagagttgcatctaagaaggttagaacttttccattatgttttgacgatacagatccacaaattaatgttgaaaatgcttgccaaggagaagtattggtacctataagactcgacatggaaattgaaggacaaaaattgagagataccttcacatggaataaaaatgaaagtttgattaccccagagcagtttgctgaggttctttgtgatgaccttgatttgaatcctctgacgtttgtaccagctattgcacaagcaatcagacaacaactggaggcttttccagctgaaccttcaagcattattgaggaaacttgtgatcagagagttattatcaaactcaatatccatgtcggaaatacttctttagttgaccagattgaatgggatatgagtgaaaaacaaaataatgctgaggaatttgcactgaaactttgcgcagaacttggcctaggtggcgaattcgtaacggctattgcttattccattcgtggtcaattatcttggcatcaaagaacatatgctttcagcgaggcacctttgccaactgtggaggtacctttcaggactccgagtgagtctgatcagtgggccccattcttggaaactttgactgatgctgaaatggagaagaaaatcagagatcaagacaggaacacacgtagaatccgacgattagcaaatactactcctgggtggtag

SEQ ID NO: 1794 - DNA, 624 bp, Leptinotarsa decemlineata
atgttttgttgttgttctgaccaagaggactacggaaaaggtccgatggctgcaatacggaaaaaattggttattgtcggtgatggagcctgtggaaaaacatgtctgttaattgtattcagtaaggatcagtttccagaggtgtacgtaccaaccgtgtttgaaaattatgtagcagacattgaagtcgatggaaagcaagttgaactcgccttatgggataccgctgggcaagaggattatgatcgtctacggcccttatcgtatccagacaccgatgtgattttaatgtgcttctcggtagattcgcccgattccttggagaatatacctgaaaaatggactccagaggtgaaacatttctgcccaaatgtgccaattattctggtgggcaacaaaaaggacctgagaaacgatcctagtaccattaatgaactaaagaaaatgaaacaagaaccagtcaaacctcaggatggtcgatctatggcagaaaaaatcaatgcttttgcttatttagaatgttctgctaaaagtaaggaaggtgttagagaagtattcgagaatgctactagagctgctctgcaggttaaaaagaagaagaagcatcgttgcgtaatattttga

SEQ ID NO: 1795 - DNA, 4014 bp, Leptinotarsa decemlineata
atgaatacatctactttccacaatcagagagccgatacctcacaaaatcccttgaatagaatggaacacgcgtctagaaacgttgagaagtcattgcaactggactgtaacgctccgaaactcgttgatctcatgggtatcgggccccaaactgggtccacagctagcggtctcatagatcatgactatcctacattgtctgctttgccactcgtcaacaacaatatgactcagatcaaatgcgtaaacagcgtgcctctgccatcggaaatagtagatcattttacacatgttcaatgtcactgtatgatgggtttattttctgaaatcaatagagcttggctgactgtcgatagcgatatttatgtctggacatatgaagaaaacactgacttggcttactttgatgggatcaacgagactatcctgtgtgtgggattggtgacaccgaaaaatagagtttttcatgctttcatcaagcacctgctcatcttagcaacttcggtcgatatagttgtgttaggtgtcacattcacagaaaaacccggggaaagtacggatgaaatacagcttatacctgatccggtatttactattcccactgacggatcgactgtttcaattataacaggaactgaggatggcagaatattttttggaaccaaggaggggtgcttattcgaaatttcttatcaggccgaaagcggctggtttggcaaacgatgtaagaaagtcaatttatccactagttctttctccttcttagttccttccttcttgaacgccgccctcagcgaagatgatggcatcacccaaatttctatagacaacagcagacatattctgtacactctcaccgaaaaaggaaccatcgaagtatgcgatctgggagaaaaaggaaattcattttcgaggatagcgaaaatgactcaaaacactctggtcaaccaggccatgaacacagttaagactttggacagtcaaaacttccgtcccatcatcagcatctccgccatagaatcgttcgagtctgcaaatctgaaccttgtcgcagtatcccaaacgggaatcagattctacatgtcggtggtgagcctttccaactttctgccgaatcagagaccatacactttgactctcgttcacgtgaggatgcctcctggatattctgccaacgtaacggtgagacccagggcggtccacgtgtctcaatacagggataggaattcattgttgatctcaactgttaatgagaaagacgttttgtggtgtataagttcggatttatttcctttcagtcaaacgctgatggaagcctatactacggtgaatttggatggacctgctctggctgtggctgaggttcatcaatccgtacctttattgtccacgcaaaacgaagaagcacctccactggttatccgccagcatgccgaaccaccgaaaaagtttatcgttctcacatctcacggcgttcagatattcgttaaactcagacctgtggatttgttgcggcaaatcttgaaggacagtcgcgggcaagagacggaagcgctgaagactttcttcgccatccaaaaggatgatcaggcgtgtgccacttgtttgattctggcatcgctggaaaccagtaacactagtgagattgtggagtatgcgacaagggcgttcttccttttcggaggggaaccaaaactggcgccggtcagttcaggaaatatgttttcaggagcctcgatattctctccaaacatcatatctactcctgctccgcatcagtttcagcagcagcagcaacagtttcagcagaatttgtctcttaccatgtcgccagccaaccaaactcttgacatgatatgtccgttcatattttcggccaagcataatggactctatctgtatttgagtaggattttgagacctatctggtatcgaaggtgtatcgaaagaacaactgtggatggaaaaactataacgaacctcagtacgatttcgagtgaagactgcatctcgatcttgaccaacctgaccgccttgcataattttctgatgcacaacactcagctttcggctgttagcaccggaagctgcaacttgcagaactctgtgtcgctgaacaacacgtcgatgaacatgacccgaatgaatcaaaccatacaggatgcccagcaagaggaaaagcagtctctcaagtcgttgaaggtgttcgtgtgtcactgctgccagatattaggcctgtggcagatcttgtgcgaacatcaattccattcgttgatcggagctctcccggaaaatgagcagcagctcctgcagaatatggcgttcaaagatctgttcctgtacaggcaggatatctgttcgctgctgatcaccaatctagtcgacagttaccttggcgataatgcttccgtcgactcgatcagtaataagctgagggaggtctgtcctcatctgtataagactgaagacgctgctttctcaaaggccatcgaaattcttaaagcagctcgaacgatacaaaacgcagatgagaaggaagaaatgttattgtccgctctacaaatttgtaagtgcatatcgccgaatataaatatgggtgaagtttgcagggagtttacatctctcaaagcgtacagagcagtaatagagttatgtatgcattacggtagaatgatggatccggaaaaagttgcggagaactattacaacacggacgataattcggcggatcaggagggtttcaatttttatcaaagaaggatggaaatctacaagcatatcctgcaaatgctggaatatgtatataatgaacagcagcaggttcccaataatagatgtgaacctgactatactactaatcaatcgattttgttgaatgataccagagaatcacagattggatgtacgttgaaacaggtcatcgaagaaattttggaaacccccgacgaaataatgcaagttgctctatatgaatggctagtttcgaaaaatatgtccggagatctcataaaaattcacaactcctctttggaagtctacttgaaaaaaacctctgctcaaaatccgaataatatcagtgtcatggatctcttgtggaaatattacgaaagtaataataatcatgcagcagctgccaaagtactaaataacatcgcttgtaaaacaggaaattatgtgccattgaaagaaagactgtcctaccttgccaaagctataatgtgcatgaggagtgacaaagtgggttacgcaccttatctgggagtctttttgagagatttggaggacagaatggaagtggccaaggtgcaagaacagatacaagaggccatttcgaatttgcaagggcaggtaccgaacgtgcaagaagctgtcgccgctctaaattctggcttgtacgaaatttcacaactgtatgaaaactttgcggaaccgttcaaactactggaatgccaactggcgatcattgactgttccggttacagtgataaagttctagtagaatcgatttggcagcaaattttagccgacgaactgagaaaggcgtctggatccgtcaacgacaaactcagccaagttttagctaaagttaaacacttggccaagcagtactcaaaatcagtttatacttttccgttagattcagttatcttcgaattggaatcggtcaactccaaattgaaaggtgacaagagacttgttccagaagctttggaatctgtgaatattccattcgaagttttaattaatgcgtataacaatttgaaccaaatgtcgcacaatgaccgtttctggcagctggaagagcacgagttccatctggctgaagctactgctgctttaattgattgtttcctcaataaaagtgactgttacaacagcatagaaaagagaaaacttgcttctatgtgtcaggatactgtggtaggcttactttcgcatttatatagcaaaccgaacactgaccatttggttaataggataagaggtattcaagcaagactttcgaggatttga

SEQ ID NO: 1796 - DNA, 3843 bp, Leptinotarsa decemlineata
atgaccgaatttacattaaattaccgtgaaatcacaccagatcaaactgtttccgataactggaaagaaattacgcttacaacaggtgggactcaaagtactctccaagacataaaggtcgctgaaagagcaaatggcttctgttacgaagattctacaaaacaccataccaggaacagatttatttattggagaatcaactatgacattctggaattagtagaacacagtcttgatgtgaatctaacagcaaatcgagtgaggtacagattcacagacactcctattttagacggagtgtcaatatatgaaacatatgaaaatgtgatagtcttagttcctacagtgtgcagtgtacatcgtttgatatttccacatcctgaaagatttcacagacaagacgagcttttaggagcttacacagatctttctgttccatcaattttttctaaagcttcagcaattgatgcaagaaatccatctaccttttatgtgttcagtaatcccagtactgccagtgaccaacttccaaatttggctagttcttatttgtttcctgaaactgaggaagccttctttgtactagcttatccgtctacagaactcttacttatcaaacagaaccctgatgatggacaagttgtcgccacagaattgaaaggcgaatctctgatgcccagatttttgtcgggacttgcagagaaatttcgacagaaaaattcagatggaagcaatatagtcagtctcttattctacgtggtggattatgaaacatatgtgttaactctaagcagggacggacatttgaaattctggtcttgtgctaaaggacagtgtgtggcagtagttgatattctcgaaaaatcaggggaggtctcaagaaccaggatccaatcagcaagtttaaggaaagctgtcgacggaaacagcagcgaaagtctgttggctgtgtttttgagttttgctaatggatgtcagtttcaaattttgagccccgttataagaggacaggaaattacagtggatcgtttggatacgagacattctccagagagtgacctcatcgattttgctctccaaacaaatcgtttgtggacagcatggagatgtgaagatggcgaatgtgtggtatacactacttctcttcaaccaggaatgagccaatcttctcgccactcgggtttgttacaatctagtaactgggcccccgttgtcttggaaacaataccagacgcaaatcaagcacctgtcaatgatggcgagagcgatccgagacagatatatttgcaacacattttccaccctggacggtttcctatgcatatcattaccaaagctctatctatttataaaagatcgactcttgtagcagaaacacatatttctgcttctatactgaaacaaaggatatgtctggctgtcgataatgaaatccagaacactctaaacggaacaaatgtaactgatgatgaatatctagaatgtgcagagtggtgttggcagaaattttattcttgctgtgttcagtaccaaatagcaagtctgaaacctttgggtttgatgctcttgccttctgtgtcaggagcagtatttctcaaaaagtcctccttttctttcttgaggcctttggacccattggaacacatgactctctgtaacgatagcacatacagcgaccagtttgtcaacttttcaatgttagctgaagatgtagaaaccaccgacgatgttatgagactttttgaagtgttggtttatttggaacaacaaatgagtgaaatgttcattcaagcattcgaaaaggagttgtttaccttgcaagtaccggatattgtaatggagaatattttagaaaaaattcaatcggaaatggattgtcaattcacatctcatatcttgaacatgctcaacaacatcgttgatttatacagagccatgcacaaagttttggaacttttaagatacgaaaacacactagccaatccagataacgaaataaacccatcagcgatgttccatttcagttcccagttgggcacatctgttgtagcgggttgtttgaagcaacaagccgagatcaggtttcagatctgccggaatctccttctcgtctgtaacattttgctgagtggtaaagcttttgacagtggcgttttggaagctataaggtctgtgtgtatgccggaaatagtggttttgacacaagctagttatgtgatgctctggttgagtggactgtcagcgttgggtaatttaccacaagactccggcatgcagaaactgacacccctcaaattggcaccagtttttaatttgagacctgccggcatattcatatctctactggaacttttcatctcttcaactggaggacaggaagctaggaaatcatttgccagggtgaactgtagaggtgaagatttggcacattggcatctttcgttattacctttcctgaaccatttaaggcatattatatggccaataagtggtggcacggttctagccgagtggttgttgagtagtggccaacatttatggttgcagcaatatgttagattactaggcaattggtgtgaatggaacagctgtacacgaaactttttactcgctgcttcttttctgactacgggcgaaaactacaaagctcaggaactgttcgaaagagcagccaaaggaatttttactgataccttcctgcaagagagagtcttaaaaggtgctgaagacaatccgacaaaggcatatatcaattattatttgaaggtcattcaactgttcgagttacataaggccagagattgtgcaataagtattgcaaatactgcactgagtgttgtcgaaccaactgaccctcttacggccaccctgtactcgatcaaattcaaacatcagcttgccctgaaacactacgagctcgctttcgactccctttattcgaatccggatgctgagcgtaaaaaggataacttgagagacctggtaaaaacattactggacgaaaaaaagttggacaagttactgaacttcacctatggaaatttggatgaatttttcacgaatattctgttgagcagagctagagcatcagatggaatcaataatatcttctatgattttctttactcgtaccaaattaagaggggagcactttctcatagattagctgcttctgtaatgtacgagcaagcattcagattaaatcacatcaatactgcagaatctttggaaaagcaagtgaaatgctatctagcggctaaaaacgtgttacaactctgtaaaccggaacatgcttgggtagtgagaccatctgacccagatgaagaagaggaggaaattatcattcaaccgttggcaggatccaaacaggaactgaaagtagtgaagctacaaaaacaggttgaagtagtcaacatcgaagttataaagactgaactgattttcgcaagcgctaaactcaaactagctagattcaatagtgctgcaccggtgactattacaagcgcagtggagttggtaactcttctcaacaacgcaggtcttttcaagacctcattggaaatttgtaagactttcaacctaccatacagcagcgtttttgaaactcttaccaaacactgtgtcaatctcactgaacaggaccagccaactgcttggaactggcttgtagagaacgacttacaagatcttcctgtcaatagagacagtgcctctgatgttgtatggcaattattacaggactacttagaaaagtacgagcagccatatatgacaactttacattacgtagtctgtaagaaaatcatcaatatgaggatgtacatacctcactggctcttggct

SEQ ID NO: 1797 - DNA, 2115 bp, Leptinotarsa decemlineata
atggaaatatctgaggaaaacctaaaaacattggcaaaatatttacaggaaactctcaatcctgatattaacgtcaggaggccggctgagaagtttttagaaggagtcgaggtcaatcaaaattatcccgtgattctcttaaatgtagttaataaatcagatgttgatatgactattcgcattgctggagctgtagcattcaaaaattatattaagcgaaactgggaattagaagaaaaccaagcggatcgtatccacgagtcagatcgagcagaaattaaaaattcaattgtaactctaatgttgagttcaccagaaatgatacagaaacaattgagtgaagcaataagtattattgggaagattgattttcgcatggaatggccaaacttgattccacaaatggttgaaatgtttgccacaggcaacttcaatgtgattaatggtgtgcttcgaacagcacattctcttttcaaaaagtatagatacgagttcaaatctcaaaaactgtggatggaaataaaatatgtacttgagaaaatagcgcaacctcttaccgatcttttcattgcaacaataaacctttcccaaactcatgccaatgatgtaaatgcattgaaagtaatctatagttctttagttctcatatgcaaagtgttttattctttaaatttccaagacttaccagaattctttgaagataatattcaagtttggatgtcaaattttcacactttgcttactgtggaggtaaaaagtcttcaaaataataacagtgaagaagctggagttattgaacaactgaaatctcaagtatgtgataacattgctctgtatgctcaaaaatatgatgaagaatttcaaccttttctgcaacagtttgtgactgatacttggagccttctagttggaaccggtctcgaacctaaatacgatctgatagtttcaaatgccctacaatttttgtcgtcagtagcagaacgggcaaaatatagaagtttatttgaagacgatactgttttgagtagtatctgtgaaaaagtaatcatacctaatatggagtttagggtatctgacgaagaattgtttgaagacaatcctgaggaatatactcgtagagatattgaagggtcagatgttgacacaagaagaagagctgtctgtgacctagtaaatactctcagtcagaattttgaaaagagaattattgagatttttggtcaatatttacacgtgatgttgacaaaatatgcagaaaatccgaaacaattttggcgaagtaaagattccgctctgtatttagttacttctctcgcaagcagaggatcaacacaaaagcatggagtaactcaaactagtcaacttgttaatataactcagttttgccagcaacaagttttaccggaattagaaaggccagatgtaaacgaactaccagttctcaaagcagacgcaataaaatatgtcatgacattcagaacaattttacccaatgaaattgtggtcagtactttacctcaattaataagacacatgtctagtgagagtgctgttgtacatacctatgcagcatgtgctttggaaaaaattcttatcatgaagaataacaataatcaaccaatcgtatctggaatgcagctagaaactatctcgaacgatttgttttcaaacttgtttgccatattggaaaggccagtttcagaacaaaatgagtatgtaatgaaagctataatgcgaacgtttgcaaccctgcaagaaagagttataccatttttaaatatgtctcttccaaaactgacagaaaaattacaaatggtggctaaaaatccttcaaaaccccatttcaaccattatctattcgaaaccttctcacttgcaatcaggatcgtttgcaaagcaaaccaatcagctgtaacatcctttgaagatatccttttccccatcttccagggaattctgcagcaagatattcaagaattcatcccttacgttttccaaattctttccctactgatggagaatacgcctactggttcaatacctgaaccatatatgcaactattgccatgtctgttagcacctattctttgggagaggcctgctaatatcaatcct

SEQ ID NO: 1798 - DNA, 609 bp, Leptinotarsa decemlineata
atggcaaaagttcaattgtgtaatattacagtaatggacaatcctagtcaatttttgaacccttttcagtttgaaattactttcgaatgcatagaagaactgaaagaagatctagagtggaaaatgatatatgtaggctctgctgaaagtgaagagtatgatcaagtattggattcagtatttgttggccccattccagaaggaaaacatatgtttgtatttcaggcggatcctccaaatgtatctcgaattcccgagaatgatgccataggagtcactgtcgtgctattaacatgttcatacagaagtcaagaatttattagagtaggatattttattaataatgaatacagtgacccagaattgagagaaaatcttcccagcccaccacagtttgataaggttgtaagaaatattttagcatcggaaccaagggtaactagatttaaaataaactgggaagagacaaacccacaagaaaatgtgacacatacggaacaaactgcgacagggtcgtcagttaatgtagaaaataacagcagtactccagctgatgtaccatctttcaacgaaaattcaaactcctgggcaacaatggaatgttcgtaa

SEQ ID NO: 1799 - DNA, 927 bp, Leptinotarsa decemlineata
atggatcaaatgctacctagtccagggtttagtatacccagcatagggacgcctcttcatcaaccggaggaagatcagatgatcctccctaatgcccttcagcagcagcagcaacctagcacttctcaagttccacccttggcaccaatgggtggtctaacgccaactttgggtctcggcatgggccatgccatgtctatgaccccaactaagtatgttactggattcgctcttccaatgagtaccattacccagcaaactccacaacatactatgatgagtcctctggttaacttggggggatcagtagttaccggatcaacacccaccatggctccagcaaccccttctccattgactccaatgactccacattctgctgatccaggaataattcctcaactacaaaatatcgtatcaacagttaatctgaactgtaaattggacttgaaaaaaatcgccctccacgcaagaaatgctgaatacaatccaaaacgttttgctgccgtcataatgaggatacgagaaccccgtaccactgcattaatcttctcctccggtaaaatggtgtgtacaggcgctaaaagcgaggaagactccaggttggctgcaagaaaatatgccaggatcatacaaaaacttggtttcaatgcgaaattccttgatttcaaaatccaaaacatggtcggcagctgcgacgttaaatttcccattagattagaggggctcgtgctcactcacagttctttcagtagttacgaacctgaattgttccccggattgatctaccgaatggtgaaacctaggatagttctgttgattttcgtttccggaaaggttgtgttaacgggtgccaaagttaggcaagaaatttatgaagcttttgataatatttatcctatattgaaaagtttcaaaaaacagtga

SEQ ID NO: 1800 - DNA, 474 bp, Leptinotarsa decemlineata
atggcagcagtacgatcagtttcccgacttttttctttgagatccctcactacaactgcgaagagaagttatgctgatatgagcttcacttttgctgctggaaatcaggtctattacgatgctaaatcagttaaacaagttgatgtcccatcattttctggcagttttggtattttaccagctcacgtacccacactagcagtccttaaaccgggagtagtgacagtctatgaagaaggaggcaatgtcaacaaaatttttgtgtctagtggaactgttaccatcaatgaggattcttcagtacaaattctagcagaagaagcacaccctgttggaaacctagatgcttcagcagccagagaagttcttagcaaagcacaaagtgaattatcgtcagccacaactgatgaggcacgagcagaagcggcaattgctgtagaagtcggtgaagctttagtgaaagcagttgaataa

SEQ ID NO: 1801 - DNA, 972 bp, Leptinotarsa decemlineata
atgagtggcagtggtgacaaaactgaacatttcgattctatgttcctctcgattgctcagcatcatccagaaggagcttctcagcttctcgatacattcgtcagttttctcggaaggaaaacagatttcttcactggaggaaaagagggggaatgggagaagctagttatgaatacattcagaaagcatgaaaaacaaagtagagaaaagcaagaagctgagctgaaagagaaacgtgagagggaagctcgagcaaaagcagctgcagcaaaaaaagctgaagctgaaagagttgagcctgccaaaataacagaactaactgatgctgaagccgaacagcttcaggccgaaataaacgcaaagaaaaatccgtcatcgtccagttcacaacctgctgcccctatcggagataaaatcaaggaagacgaagatgaatcagaaaaggggaagattttgccgaacaaaggaaatggctgtgatttggacaagtacaagtggactcagactttgggcgatattgagcttcgagtgccactaaacgtcaacttcagagtcaagcagaaagatcttgtggttaaccttacgaagaaacatttgacatgcggaatcaaaggtcaaccgcctatcataaacgacgattttccttatgaaatcaagctagaagaatccacttgggtcatagaagatggaaaatcactgttgttcaatttagaaaaggtgaataaaatgaactggtggaacaaactagttaactcagatccggaaatcagcacaaagaaaataaacccagagccgtctaagttgagcgatctagatggtgaaaccagggggctagtcgagaaaatgatgtatgaccaaagacagaaggaaatgggacttcccactagtgacgagcaaaaaaaacaggacgtcattaaaaagttcatggagcagcacccagaaatggacttctcaaaatgcaaattcaattga

SEQ ID NO: 1802 - DNA, 474 bp, Leptinotarsa decemlineata
atgcagtctcatagtggtgcacatttaggtcatgtacctgttttacagtggagccccgataagaaacatagtgatagagaaaggtggatatgtatttacccagcttatatcaataataagaaaacgttagctcaaggaagaaagataaataaggataaatgcgttgaaaacccaacacaccaagaaattagagatgtattagtggcagcaaatcttaaaataggagttgaaaataaattatatagcagagaaaaaagcaaggaacctctttatcgaggcagaattagagttcaattgaggaatgatgacggaagtttgttcaatagcgctttcccaaccagagagagcataatgtatcatcttggtgaaatgattcctaaattaaaatctagacaaaataaaggtgcaggggaagcaccacaacaagcatcaaccagcaataaggggaaaggaaagggcaaaggaaggcgatga

SEQ ID NO: 1803 - DNA, 1068 bp, Leptinotarsa decemlineata
gaggaatctcagaaagacatacaacgtgcaagatcagtttgggagagagctttagacgtggatcatcagagagtcccaatatggttaaaatatacagaaatggaaatgagaaatcggcaggtaaaccatgcaagaaatttgtgggatcgagctgttacgatattacctaggattgatactttttggtacaaatacacttatatggaggaaatgttggaaaatgtacctggagcccgtgctgtctttgaacgatggatggagtggcagcctgatgagcaggcatggcaaacttacatcaattttgaacttcggtataaagaaattgatagagctagacaaatatatgaaaggtttgttatgactcacccagaagttaaacactggattaagtatgcaaaatttgaggaaaaacatggtttcattcattctgctcgcaaaatctttgaacgtgctgttaatttttttggtgacgatcatttggacgaaaatttgtacattgcttttgctaaattcgaagaaaatcagaaagagcatgaaagagcaagggtaatctacaaatatgcgcttgatcacatacccaaagaccagactaaagaactctataagtcatacacaatacatgaaaaaaaatatggagacaaaagtgacatagatgaggtgattgaatcgaagcgaaaatttcagtacgaacaggaaattttgcaaaatccaactaattacgatgcttggtttgattatattaggttagtagaaggtgaaggagacttagaatttatcagagagacgtatgaaagagccattgccaacatacctccttcaaatcaaaagcaattttggagaagatatatatatctttggataaactatgccttgtttgaagaattagaagccaaggactatgaccgtaccaggcaagtgtataaggcgtgtttagagttactgccccacaaggttttcactttctcaaaaatatggttgctttttgcaaagtttgaaattagacaaaaaaaatttaactcctgccagaaaaattcttggaatggctttgggaatgtgtccgagggataa

SEQ ID NO: 1804 - DNA, 930 bp, Leptinotarsa decemlineata
atgggaattaaatttctggaggtgatcaagccgttttgcagtattctgcctgaaatagcgaagccagaaagaaaaattcaattcagggagaaggtactatggaccgcaataactctattcatcttcttagtttgctgccagatccctctatttggtataatgagttcagattctgcagatcccttctactggattcgagtaattctagcatcgaatagaggtactcttatggaattgggcatatctccaatcgtgacatctggattaataatgcaacttttggctggagccaaaattatagaagtaggcgacactcctaaagacagggctctgtttaatggtgcacaaaaattgtttggtatggttatcactgtcggtcaagcgatcgtttatgtaatgaccggcatgtatggagaccctgcagaaatcggagcgggagtctgtcttctgatcatcatccagctctttgtggccggtctcatagtgctgctgctagacgaacttcttcaaaaaggctacgggctcggttcgggaatttccctctttatcgccactaacatctgcgagaccatcatttggaaggctttctctccagcaactgtcaacactggacgcggaaccgagttcgagggagcagtcatcgctcttttccacttgcttaccacccgacaggacaaaatcagaggactcagggaggcgttttaccgtcaaaatctacccaatctgatgaatcttctagctacagtctttgtatttgctatagtgatatacttccagggattcagagtagatttacccatcaagagtgctaggtaccgtggccagtactcgagctaccccatcaaactgttctacacctcaaacatccccatcatcctgcaatctgcgcttgtctctaacctgtacgtgatctcgcagatgttggccgtc

SEQ ID NO: 1805 - DNA, 486 bp, Leptinotarsa decemlineata
atggccatgatcactactccttcggtggatctcagttcttatcgtgaccaacatttcaaaggtactagagctgagcaagacaaactattgagagttacttctactttgtatgtaggaaatctttctttttatacaactgaggaacaaatttatgaactattctcgaaatgtggggatataagacggatagtgatgggtttggataagtacaaaaaaactccatgtggtttttgctttgtagagtattatactcgaattgatgcagagaactgcttaaggtatattaatggcacccgtctggacgatagaatagtacgaactgactgggatgctggtttcatagagggacgacaatatggtagaggaaaaacgggtgggcaggtaagagatgaatataggacagactttgactctggaagaggtggttatggcaagattatccagcagaagattgggggtattgaaacccctgcgtttttaagataa

SEQ ID NO: 1806 - DNA, 432 bp, Leptinotarsa decemlineata
gaagctgcccgtgctgccaacaatggtgcctatcccccggatcttagctacattacctctgccagacatggaggtgaggactacatcttcgccctactaacaggctactgcgatcctcccgcgggcgtggtgctgcgagaaggccagtacttcaacccctacttcccaggaggggctatttcaatggcgcaagccctgtacaacgaagccatcgagtattccgatgggacgcctgcaacggccagccagttggccaaagatatatccactttcctgaaatggaccgcggaacccgagcacgacgacaggaagaaaatgctcatcaaatgtataggcatattcgcgatgctggcaggtctttgctactacatgaagagactcaagttttcttcgctgaagacgcgtaagatcgagttcaggcccaagaagtag

SEQ ID NO: 1807 - DNA, 1710 bp, Leptinotarsa decemlineata
atgttggctttacaacagtattcaggaagtagtgatgaagattgtggagaggatactcattcttcaaatgtggaagtgtttccaactattcctaaaaattcacagttattacaaaaacagcttgcgatatgttcggctcccgacgtaattccaacgggtttaaatgaagaaaacatttatatccatcctgaaacaacagaactaaccttcaatcccaagtatgaagagttgtttgctccattggttggaccaaaaaatcctttcaaaacacaacaacaaagtatcgatagaaacattttatcaggccatgtagaacctgctcatgtcagtgattttcagtttgaaaaccaaagacgaactttcacaagctatggttatgccctcgatccatctgttagtactgatggtcaggttaaagtggtaggttccacagatgacggcaaaaatcctgatgatatcaaaactgtttttgaatcatcaaaggacagacctttggacaaaaggaaacgtaaaagaaatgctgaccctagcgacattgatggttttttgggaccgtggggtggttttgtcgatgaacaaaaaattgctaagcctagtgaagaagaacaagcagaattagatgaactaatatctaaaaagaacaaaagaggtaaacctacagaagataaacctgttgaagagaaatctgttcttcacatcaaggacgctgttgattatcaaggtcggtcattcttgcatgctccacaagatgtaggtgttaatcttaaatcagacacaccaccagaaaaatgctttttgccaaaatctcatattcacacctggtcaggtcattccaaaggaattgcagccatacgatggtttccaagaacagcacatttatttttatcagctagtatggattgtcgtattaaactttgggaagtgtataatgaaagaagatgtgtaaggacatattatggtcatcgacaagccgtaagggatatcaatttcaataactccggaaaacacttcctctctgctggttatgacagatatatcaaattatgggatacagaaacagggcaggttctctcaagattcaccagcaggaaaattccttactgtgtcaagttcaatcctgataagaataagcagcacttatttgttgcgggaacttcagataaaaaaataatatgctgggatactagatcaggtgatattgttcaagaatatgataggcatttaggagcagtcaattcaattacatttgtggacgaaaacaggagatttgtgaccacgtctgatgataagtcactgagggtgtgggaatgggatattccagtggatatgaagtatatcgctgacccaactatgcacagcatgcctgcagtcactccagcaccgaatggaaagtggcttgcttgtcagagcatggacaataaaatagtcatcttttcggctatgaatcgcttcaaaataaaccgcaagaaaacttttactggtcatatggtagcaggttatgcctgcagtttagatttttcaccggatatgagttacttggtttctggagatgccgatggaaagtgttatatttgggactggaagacaaccaaactttataaaaaatggaaagcacatgacaatgtatgcataagtgctttgtggcatcctcatgaatctagcaaactgataacggcaggttgggatggactcattaagtattgggattaa

SEQ ID NO: 1808 - DNA, 807 bp, Leptinotarsa decemlineata
atggtccagaaaaagcccaagaagaaggtcggaaagaaagttgcagctgctcctttggcagtcaagaaagtagagtccaagaaggaggttaaccctcttttcgaaaagagggtaaggaactttggaatcggtcaggatattcaacctccacgtgatttatcgaggttcgtcaaatggcccaaatacattcgaattcaaaggcagaaggccgttttgcagaagagattgaaggttcctccgccaatcaatcagtttactcaaaccgttgacaaacaaacagccacccagttgttcaaactcctagagaaatacagaccagagacggctctccaaaaaaggaataggctgaaggctaaagccgaagctaaagtggccaagaaagaggaagcccctaccaagaggccaaacaccctcagggctggaactaacactgttactaaactcattgaacagaagaaagctcagctggtagtgattgcccacgacgtggaccctattgagttggtgttattcttacccgccctctgcaggaaaatgggtgtaccatattgcatagtgaaaggaaaagctagactgggacttttggtgaggcgcaaaacttgcactgcagtagctcttacccaggttgattctggtgacaggtccaacttcaacaaggttgtggaggtcatcaaaaccaacttcaatgaccgctcagacgaaatcaggagacactggggtggtggtttgttgggttccaaatccgcagctcgtatcgccaagatcgaaagggccagggctaaggaactcgcccagaaacagggttga

SEQ ID NO: 1809 - DNA, 1002 bp, Leptinotarsa decemlineata
atgacgaccttaaccaaagatattacgcttcaagaaaacattccatcaaacattcttatggaaaaacatattgaattcatcagagactatgggcaaaaagaaaatagctatgaatatggaatgacggattatcttcgagtatctggtatgtactggggtctgacagctttggaactgatgaacacttcaccacctcagagtaaagatgagattgcgaagtacatcaaaagctgccaagacccggaaagtggaggaattagtgcttgtcagaaacatgatcctcatatcctccacaccttgagtgctgtgcagattctttgcatttatgacaacttggatgctgtagacattgaagccgtcgtttcttatgtagccagtcttcagctacctgatggtagtttcatgggcgataaatggggagaagttgatacgagattttccttttgtgcagttgcgattctgtccttgttgaataagatggatgtaattgatgtgaacaaagcagtggatttcattgcttcgtgcaggaatttcgacggtggtttcggttcaagacccttatcagaaagtcatgctggtcttatttattgctgtgttggatttttatctatcaccaataggttagatatcgttaaccgtgatactttagcctggtggctttgcgagcgtcaacttccttccggtgggttgaatggtcgccctgagaaactcccagacgtttgctattcatggtgggtcttatcaaccctcactatacttggaagactacattggatcgatgcaagtgcactaaagaacttcattttggcatgccaagactctgaaacaggaggatttgctgataggcctggcgatattgctgatccgttccatactttgtttggtttagcagcaatgtcgctcttaggacatgagtctgtacagaaagtcaatcctacttactgcatgccacagaatgtcatcgatagactgcagctcaagcctcagagactaacagattga

SEQ ID NO: 1810 - DNA, 2346 bp, Leptinotarsa decemlineata
atgcatcaagaaactcttcaactcattcagattctggaaaaaacagtttctcccgataaaactgagctagaacaagcttcatcttttctggaacaagccgcggctaccaacttgttagagttcataaaaactttatctgatatcttgagacatggaggtaatagccctgtggctcgcatggcagctggtttgcaactcaaaaatcaattaacttccaaggatccatctgttaaaacaacctatcagcatcgctggttagcctttcctgaagaaatcaggaattatattaaaaaaaatgttgttggagccttaggtacagaaactaatagaccctcttctgcagcacaatgcgtagcctatattgcggtaacagaattgcctcagaggcaatggccagatttaatagcaaatctggtcagcaatgtatgccaaggaaactctacagaaatgcagaaagaagctaccctggaggccatcggctacatttgccaggagattgattctgatgtactcgtaacccagtcgaatgatatattaactgccatcgttcacggaatgagagccaccgaaccaagcaatcacgtacgtttggccgcaacgcaagctctgctcaactctctggaattcaccaaagccaactttgaccaacctaccgagaggaattatataatggaagttgtgtgtgaggcaactcagtctcccgagtctcaaataaaagtcgccgccctccaatgcttggttaagataatgtcgttgtactatcagcacatggaaccatacatggctccggcgctctttccgatcacgctggaagcgatgaaatccgaaaacgatgccgtggccttacagggcattgaattctggtcgaacgtgagtgacgaggaagtagatctcgcgattgaagattccgaggctactgaagcgggaaggcctccagctagagtttccagacattatgcaaagggagccctacagtacatcgttcccatcctgcttcagaaactcaccaaacaagaagaactcgatgatgaagacgattggaatccgagtaaagcagcaggagtttgtttgatgcttctcgccacatgttgcgaagatgagatcgttccccacgttctgcctttcatcaaagacaacatcaaatccgataattggagattcagagatgcttcgctgatggccttcgggtccatcctcggcggattggaaagcacgactttgaagccgttagtcgagcaagccatgccgactttgatagagctcatgtacgacaatagcgttattgtgagagacacagccgcgtggactttcggtagaatatgcgaaataataccagaagcagccataaacgaaacgtatttgaaacctcttctggaaagtttgataaccggtctcaaggccgaaccccgagtcgccgctaacgtatgctgggccttctctggtttggtcgaggcggcgtacgataacgccgatgttagcgacgaaatgggaacgccagacacatacattctctctcagtactttgagttcatcattcagagacttcttgagactacggaccggccggacggcgctcaggccaatctcagaccagctgcctacgaggcgctgatggaaatggtgaagaattctccgaaagactgctacgtcaccgtacagaaaactacgatggtgattctggagcggctgcagcaagtgctccagatggaaacgcatataagtagtcacaatgacaggtcgcagttcaacgatctccagtctcttttgtgcggaactctgcagtcggttctcaggaaggtcactcctgaagatgcaccacaaatatctgatgcgatcatgacagcaatgttgaccatgttcaattcaaattcttgtaaaaatggaggagttcaagaagatgctttaatggctgtctccactttagttgaagtactgggtgaaggattcataaagtacatggatgctttcaaaccattcctctatcttggattgaagaaccaccaggaatatcaagtgtgtggcacagccgtgggcttaactggcgatattttcagagccctcaaactcaaagttctgccatactgtgatgaaataatgacactgcttctagaaaatttaggcgaccaatctgtccatcgcagcgtcaaaccccagatactgtccgtattcggagatatggttctcagcattggaccggaattcaagaagtatctggacgtcgttctatcaactcttgctcaggcttctcaggcgcacgtcgatagaaacgatttcgatatgattgattacctcaatgatttgagggagggagtattggacgcttacacgggaataatacaaggactc

SEQ ID NO: 1811 - DNA, 1503 bp, Leptinotarsa decemlineata
atggaaaccattttggaacagcaacgaagatatcatgaagaaaaagaacgtttgatagatgctatggtgaaagaaatgctgactaaaaaaacaatgtaccgcgaagcgataaattcagaccatcgtcaaaagtttctattggacagatatatgactgctacagaccgcttaattgagctttatgaagataaagatggtcagcgtaaagctgaagttgcatctttaactggcccaaatgaatttcaagaattttacaataggctcaaacaaatcaaagacttttatagaagacatccaaatgaaataagcgtgcccatgtctgtagagtttgatgaatttgctaaggcaagggaaaatccaaacgatgatatggccaattttgtggaattcacagatgaggagggatacggaaagtatttggatctgcacgagtgttatgaaaaatacataaatctaaaaggaattgagaaagtagattacatcacgtaccttggaatgtttgatcaactttatgacattcccaaagaaagaaaaagtggtgaataccgaaaatatttattatgtcttatagagtatttgatgtggtttgtccaaaggatcaagccattaatggatttagaaagtggtttacaggaagaagttgatagagttattgctacatgggaaagtggcacagtacctggatggcctaaagaaacgggttctgctttagccaatgttggtgcacatttggatctttctgcattttccagctgggaagaattggcttctttaggtctggatcgtcttaaatctgctcttatggcattagggctgaaatgcggagggactttggaagaacgagctcaaagattgttttcaaccaaaggaaaaggttctttggatccttctcttatgactaaaaccaataaaggaaaagctagcaaagaaaaggaacaacttcgtcaaagggagctagctacattggaggcacaggtttacagattggcagaattagttgctgttcagagaacagcaacaaaagagaatgtacaaagaaaacaagcacgcacagatggtgaacgtgatgatagcgaaaatgaagaaagtgatgatgacagtcctgatgagggtgacgacgatgttccatataaccctaaaaatcttcctctcggatgggatggaaagcctattccatattggctgtataagcttcatggtttgaatataagttacaattgcgaaatatgcggaaactatgtttataaaggaccaaaagctttccagagacatttcgctgagtggagacacgcccatggaatgagatgtttaggaattccaaatactgcacattttgcgaatgttacacagattgaagatgctttagccttatgggaaaaactgaaagttcaaaaacaaagtgaacgttggcaacctgaaactgaagaagaatatgaggattctcaaggaaatgtagttaaccgaaaaacttatgaggatcttaagagacaaggtcttttatag

SEQ ID NO: 1812 - DNA, 642 bp, Leptinotarsa decemlineata
atgactatcggcaagaataataagatgatggctcacctcaactacagggtacgagtaactttacaggactcccgaacatttattggaactttcaaagctttcgataaacatatgaacatgatcctaggtgattgtgaagaatttcgtaaaatcaaacccaagaattcaaaagtggaaagggaagagaaacgagttttagggtttgttttggtgagaggggagagtattgtctcattaactgtggaaggcccgccacctcctgaagagggcttgcccagagttcctattccaggagcagcacctggaccaggaataggtagagcttccggaagaggcatgcccccaggaatgggaggagtacccgttggtttgcagggaccggtaagaggggtcggtggaccatcgcagcaagtcatgacaccaggtggaagaggacaggtgtctgccccaccccaaatgaatcaaggtcccccaaggatgggtggtccaccaccaggtgtaatggggccccctccaggaatgatgggaatgcctcctcaaatgggcatgggacgaggaggccctccacctccgatgggaatgagaggacctccacctggtatgatgagaggaggacctcctgggccaccaaggccatactag

SEQ ID NO: 1813 - DNA, 1059 bp, Leptinotarsa decemlineata
atgatgagtgatgctgattttaccaattacttccgcatgaatcgcaaccagttttttgatgttcatgggatgattcaacaagacattgactcaaatggatgtaatgctcaaaagccgatatcaacagaggaaaaacttgcagttttcttgagatatttggcttctggagacagctacaaaagtattgcttataactacctgttgggagatcgaacagtgtctaatattgtccaagaagtagctaccgctatatggaataatatgcaaccagtctatttagccgaacccaaaacagaaacatggaaatctatagctttacggtttgaggatagatggcaatttccacactgcgtcggtgctgtcgacggaaaacatattgttattaaaaaaccaggcaaaagtggatcatcatactttaactataaacatacattctctattattttaatggcaacagtggacgcggattataaatttatcacaatagatattggagcgatgggaagatttagcgatggaaatgtatttgcaagtagtggattgggcaagaaaatgatcaaacacactatactacttcccaatcctgaacaaatacctacgattgccgagcctctgccgtatgtttttgttggagacgaggcttttcctttatcggaaaatctaatgagaccatatccaagaaggcaaataactggaaattatcaacaccaagttttcaatgcacgactttctcgagctcggcaaacagtggaatgtgccttcggtatactgtcttcgcggtttcgcgtattccgaagaccatttgaaagtaaagtggacactgtgagagatgtagtaaaagccgcttgtgttttgcacaactacttacgaccctcagccctggtagaagatgtaaatgatatcgaacagctgccacaaactcaactgttacatgttcaaggaaacagggcgagaacttcattagctgcatttagagtcagggatagttttacggaatattttaacaattgtggggcacttccttggcaacatcaatccgttatgcttggaaagtattga

SEQ ID NO: 1814 - DNA, 1221 bp, Leptinotarsa decemlineata
accagcgacgatgagttcataatgcaaggaaaaaccaaaaagtataacctagttccccatactggcgaactattgaacatgcacggcgcgccggaatcgccggatcaagaagagatgactgcagaaccatctcctgaagcaatcgatgaagaaggcttgaataattatgacggttctgagttgctgattattgatcaaaataacaagtctcccgaagattcgatttcgacaaaagaagatttcgaggaacttattgacgaaggatccagaaaaaataacttgtctaaaagagaaattaccactaaacacttgaacgactttcacaagtatgctaatattttcaattataccaaaaacgttcaaaccatacaaactccaccgcaaaatactggtagagttaccaatgtaccacagaaaatgactccaaaaatttctctcatcggcaattctgtagtacatagcgccaagacggttgcagacaaacttatcctaacaccttcagcgacaacggttataaacacaacgcaagcatcaaaagttacaagcatcattttaactcacaactctgctgttaggggaaatgttatcaatgtcacaaaggttgtgagcaccgtatcaccagctataactatagttactgctagcacttcacaaatagcctcaattttgccttccaaattcacggtgcccgtcataagtgctagcgctgtgcgacacctatcgaacgttaaagtaatagataagccatcgtcctctctatcgctcacttcccacgacagtgccttgcccaacaagatatttgaagatgactccgtttctccagatagttccaatttcgaagacgacaagtccaaagactctttcgaagagaagtccaagtctgaatcgcccactcaagacgcgaaacctccagtattctccaagaatgttgaagtcactatcaataactgcgttccgccaaaagctgtgatcgactataaacccaaggaacaggaacagacaaaaaagatcgaacatctccaagtaaccaatctagtatctaaagaacatgttcagaaacatagggttcctagccctataatatcgaaaacttcttcgcctatgattattcacaatactcccgaactcaaaatgacggcacaggtcattcaggagacgcaaacgcacatgcagatgagttcaactaccaacacggttgatgcatatggtggctccatagac

SEQ ID NO: 1815 - DNA, 697 bp, Sitophilus oryzae
cacgaaccgtacacatatcttaatggacttcatataaaagatttggaggatcttgttgaggatattaaagtctataaagaactggaaagaggaaagaatttagattattggaacgatattacagttattgttgaagatgagttacaaaaaatgagaaagattcaaaaggaacaggactttgatgctggggttggtagaagagaaggtataaatcaagcagtagctcaagatgttacatcagtttttaaaggcaaaacagccattcagttggcagcccttcaaaaacaaattgaaagtaaaatttctggtaaagcagatggaatcgatatcggttattgggaatctttattgtcccaacttaaagctcacatggccagggcaagacttagagacaggcatcaggaaagtttgaaaaggaaactacaagttttaaaagccgaacaggcggttgctttgcctgaaaacaaccagaatattgaaagtactaaacatagcgataatgagaaacccagtacctcccaagagtctacagaagatagccaaagtgatacagaagctaatgagaatgcagcaaatgatattttgaatgaatgctttattttatatcaaaatggagggtacagtcctaaattattaagtcctgacgagattgaaccaggcactatagtagtgacagaagaggatgacacaaacagac

SEQ ID NO: 1816 - DNA, 719 bp, Sitophilus oryzae
tatgaagccaccgaagaaaaactcaaagatatctttggtgaggtcggtcaagttttgtcgttcaaacttgtttttgatcgagagactggcaaacccaaaggatatggattctgcgagtatcgtgaccaggaaacggcacttagtgccatgaggaacttaaacagctacgaaataggcggtagaaacttaagagttgataatgcttgtacagagaagtcaagaatggaaatgcagaatcttctcaatcagccaccagtggaaaatccttatggagagcctattcaagctgaaaaagctccagaggctatcagcaaagctgtggcttcactacctcctgaacaaatgtttgaacttatgaagcaaatgaaaagcacaattcaaaataatcctacagaggctagacagatgctattacaaaatccacaacttgcatatgctttgctacaagctcaggtggttatgaaaattattgaccctcatacagcagcttcacttctgcatccagtaaaccaagtgccagctactctgatgcctggagacaagaatgttcctgttcaggtaccaattagtgctcagttccaacagcctccaactccagttgcacctcccagacaagagttccaacccgttcctgctccaattatgcacccaaattcccataacgcccccgtatttacaggccaagatgttgacttaagatctctagatcctcgtggtac

SEQ ID NO: 1817 - DNA, 676 bp, Sitophilus oryzae
  misc_feature (478)..(478): n is a, c, g, or t
cagctcacagaagagaagtttattgtaaaagcaacaaacggaccccgctatgtcgtgggctgtcgcaggcaattggacaaggccaaattaaaagcaggtactcgagtagccttagatatgactactttaactattatgaggtatcttcctcgtgaagttgatcctctagtatacaacatgagtcatgaggatccaggtgatgtgacctattctgctattggaggattatcagaacaaatccgtgaactaagagaagttattgaactgccactcctcaatccagaactttttatgagagttggtattacacctccaaaaggctgtcttttatatgggcctcctggcactggtaaaacattacttgccagggcggtggcctcccaactcgatgcaaatttcttgaaagttgtctctagtgctattgtcgataagtatattggtgaatcggccaggctgattagagaaatgtttaactatntcgataagtatattggtgaatcggccaggctgattagagaaatgtttaactatgctaaagatcatcaaccctgtatcatatttatggatgaaattgatgctattggaggtcgacgtttttctgaaggtacatctgctgatagagagattcaacgtacgttaatggagcttctgaatcagatggacggttttgattcac

SEQ ID NO: 1818 - DNA, 638 bp, Sitophilus oryzae
gccatttctttagcaggaacctgcctaggaattttagccaacgatggcattttattagccgctgaaagaagaaatactaataagcttttagatgaagtattcacttctgaaaaaatttacaaattaaatgatgacatggtatgtagtgttgctggtataacatcggatgccaatgttctaactaacgaactaagattgattggtcagagatacattttccaatatggagaatcaattccatgtgaacagttggtttcttggttgtgtgatgttaaacaagcttatacacaatatggtggcaagaggccatttggtgtatctattctttatatgggttgggataaacactatggctaccagttgtatcagtctgaccctagcggaaactatagtggatggaaagctacatgtattgggaacaatagttctgctgctatttcaagcttaaaacaagaatataaggagggagaaatgacactgaatgatgcaaaaagtttggctgtgaaagtattgagtaaaactttagatatgacaaagctaacatcagaaaaagttgaaatggcaacactaactagagtgaataataaaacagttattcatattcttactgctaaagaagtggaagagttgatctcaca

SEQ ID NO: 1819 - DNA, 757 bp, Sitophilus oryzae
tgttgatggagattgaacgtcttgatttgcttgaagaatatgttgatgacaatatttatcctagagtttgcttatatcttacaagttgtgtaccatatgtagctgacccagagaatacaactttacttcagacagctctgttattatttaggaagtttaatcagtatcctcagtccttaagactagctttgcagttaaatgaccatgcacttatagaagaaatatttttgtcgtgcaaagatacgacaatccaaaaacagcttgcattcatgttggggcgtcaacagatttatattgaaattcctgaaactactccagaatatgaggaccttgctgaaataatggctaactgtcatttgaataaccatttcttgaatttagcaagagaacttgatattatggaacccaaaactcccgaggatgtgtataaatcccacttagaaaacaccagaccctcttttggtggaagccaagttgattctgccagacagaatctagctgccagttttgttaatggttttgtcaatgctgcttttggccaagacaaactgttaatggaagatggtaataaatggctttacaagaacaaagaacatgggatgcttagtgctactgcatctcttggtttggtgcttttatgggatgtcgatggaggtttaacacctattgataaatacttgtattcttctgaagatcacatcaaatcaggagcacttctagcttgtggtattgtaaactgtggtgttaggaatgagtg

SEQ ID NO: 1820 - DNA, 331 bp, Sitophilus oryzae
ccgggaaacaatatggaagatggtggtgctagcgtgggcacttctggcggccaacaccagcagcgatctggcacagagactggcaacagaagaacaggagtttcatgtgcgaactgtaaaacagtgaacacgacactttggagaagaaataatcaaggtgaacccgtatgcaatgcttgcggactatacttcaagttacacaacgtgaacagaccaattagcatgaagaaagaggggatccaaacgagaaaaaggaggccaaaaaattccaacagcaatcagcaacatcccaacagtccaaccacatccggcatgcaccaacaaagaatga

SEQ ID NO: 1821 - DNA, 731 bp, Sitophilus oryzae
tcggcagaaaatctctcaaaagtaccatcgccagaagaacaacaattcatagccatagccaaagaatgtctgaaggattgtaacttagatcagctaatcacagattcgaaattcttgcacgaagaggctctgctggaactggcaaaggccttgattgaactgtccagaggtccagatggacagagaagcgtagagtatggctataacgagagcgagactgtgttttttatggaattacttttcaaaatcgtcattcagaacagggatcgtgttatgacagtttggcaacctgtcagagaccacatctacaccctaatgatgaacgcatcactgtttgactaccagttcctcctcgaaagatcggtaataggcttactgcgcatagcgattcgcctgatgcgcaacgaagacatgtgtccaatagtaatacagtcgctgcgcatgttgctgctgctcaaaggcacgactttgtgcaggatttccaagcagatttctttcgggttatatgaactactcaagacttctgcgcagaacatccataccactaccgattggacgattatttttactttgcttgagtgtgttggagctggagctcagcctcctaagcccattgtggacgatggagtcagtcatgttgatcctggtacaaagtcagaaggcgagaaccaaataaacagcgacgacgaaagtatcgtttcggacagaggctacacctctgataccgaact

SEQ ID NO: 1822 - DNA, 473 bp, Sitophilus oryzae
agaagatttggtatccaggcccaaactgtcgcgacaaactttgagaaaatcttcgaaatgggtccccaattatacgtaggccttcctggtttagccactgatacgcagacggttatggagaaactccgtttccgaaagaacctctacgaactgaaagagaatcgatcaatttcacctaaggtatttagcgctatggtatctcatatgttgtatgaaaagcgttttggcccattcttcgtcgaaccggtcatagctggtttggatccgaaaacttatgagccttttatctgtaatatggacttgattgggtgcataaatcaaccaaaagattttgttgtgggaggaacagccagtgcacaactttacggtatgtgtgaagctttgtgggaaccaaacttaggtccagatgatttatttgagatcacttctcaagccctcattaatgctttcgatagagatgctatgtctggttg

SEQ ID NO: 1823 - DNA, 720 bp, Sitophilus oryzae
agcgcacctaataatatgcatcactctgtgaaaattttagatttagtgttgatgtgcgtgggacatcacgattatgaagttgccgagattacttttaatctgtggtatcttctcagcgaacagctctaccagttgagcaacaataacataagtgacctttttagaccgtatattgaaagattgattactgcgctgtgtaggcattgccagatggaacccgattgtgaaggaatattagaggatggagatgaatttaaggactttagaataaaagtatctgagctaattagggacgttgcatttatagtaggaagcaccagttgttttaggcagatgtttctcaatttgcaaaatccgggtgtgacctgggatcagactgaagcggctctttatattatgagggctgttggtaaatatgtattaagttctgaaaatgaggtcgttccaaatgtaatagaagcaatcataaatattccagaaaccactcatatcgcagtgcgttacacttcagttttactactaggagaattatgcgaatggattgaatcccattctcaagtcttagatccagttttaaattttctaattcatgctcttgcccaacctggtttaggtgctgcagctgctaatgcattacagaacatttgcgcaacgtgcagtgacaatttgtctagacatgtgccgattcttttgcaattgttgcaccaaattgacactttc

SEQ ID NO: 1824 - DNA, 683 bp, Sitophilus oryzae
  misc_feature (610)..(610): n is a, c, g, or t
atgccaagaatgatcccaataaggtcaaaagaaaattctcttcattctttaaatcactagtgatagaattggataaggaattatatgggccagataatcacctggtggaatggcatcgcaccttaactacccaagagacagatgggtttcaagtcaaacgaccaggagataaaaatgtccgttgtaccatactactccttctagactaccaaccgttgcaatttaaattggatcctagactggcacggttgctgggcgttcacactcaaaccagacctgtcattatatcagctctgtggcaatacatcaaaacccataagctgcaagattcacatgagagggagtatattgtttgtgataaatatctggaacagatttttaactgttcaaagatgaaatttgctgaaataccgcagagattaaatccattgttgcacccaccagatccgatagtaattaatcacgtgatctcggtcgagggcggagctgagagcaaacagactgcctgttacgatattgacgttgaagttgatgatacgttaaagacccagatgaacaatttcctgttgagcactgctagccagcaagagattcagggattggattcganttcgaaaattcacgaaaccgtcgatacaatcaatcaactgaaaaccaacagagaatttttcctgagctttgcc

SEQ ID NO: 1825 - DNA, 305 bp, Sitophilus oryzae
gaaccaaccttagatgagctagaacagaaaatgagagaagctgaaactgaatcgcacgagggtaaacgaaaaaacgagtcgttatggcctattttcaaaatccaccatcagaaatccagatacatttacgacctgttttatagaagaaaggcaatttccagagaactgtacgagtattgtttaaatgaaaatatagcggacaagaaccttatagcgaaatggaaaaaacaaggatacgaaaacttatgttgtttaaggtgtattcaaacgagggacaccaattttgggactaattgcatttgtcg

SEQ ID NO: 1826 - DNA, 745 bp, Sitophilus oryzae
  misc_feature (582)..(582): n is a, c, g, or t
gcactatcagacagatcgttcagaaataccagtatgttgccatggatactgaatttccaggagttgtggctcggcctataggggaatttagaagttcggctgattatcagtatcaaatgttaagatgtaatgttgatttgttaagaataatacaacttggtcttacattcttagacgataatggcaagacacctggtggatcatacactacatggcaatttaactttaaatttaatttacaagaagatatgtatgcacaagacagtatagacctgttaaccaactccggaatccaatttaaaaaacatgaagatgagggtattgagccattagaatttgccgaactacttatgtcttctggcattgttttaatggataatatcaaatggttaagctttcattcggggtacgattttggatatctgatcaaattacttaccgataataacttgcctcaagatgaaaacgaattttttgacttgttgaaattgtactttccaacaatatatgatgttaagtacctcatgaagtcttgcaaaactttaaaagggggtttacaggaggtagctgagcaacttgagnggggtttacaggaggtagctgagcaacttgagttggaacgtgtaggaccccaacatcaagctggatctgattctctacttactggaatggcctttttcaagatgaaggagatgttttttgaggatactattgacgattctaaattttctggtcacctgtatgg

SEQ ID NO: 1827 - DNA, 752 bp, Sitophilus oryzae
gaagatgtggacgttatcgataaattctctaaaatgaaccttaaagaagaactaactagaggaatatacgcatacggtttcgagaagccctcggctattcagcagcgagctatcaagcccattatcaaaggcagagacgttatcgcacaggcccagtccggtacaggaaaaacagcaacattttccatttcaatcttgcaaacactcgacctgaccgttcgtgaaactcaagtcttgtgcttgtctcccaccagagagctggcagtacaaattcaaaaggtaattctcgctctgggcgattttatgaacgtgcagtgccatgcttgcattggggggactaatttaggggaggatattagaaagcttgattacggacagcatgtggttagtggaacgccagggagagtttacgatatgataagaagaagagcacttcgtactcggtcagttaggatgcttgtccttgacgaagccgatgagatgttgaataagggattcaaagaacagatttacgatgtatacagattcctacccccctcaactcaagtggtcctaatttcggcaacactaccccacgaaatcctggaaataacctcaaaattcatgacggatcctatcaggatcctggtcaaacgtgatgaattgactctggaaggtatcaaacagttctttgtggccgtggaaagggaagaatggaagtttgacactctttgtgacctgtacgatacactgacaataacacaggcggttat

SEQ ID NO: 1828 - DNA, 681 bp, Sitophilus oryzae
gactatgccgctatggatagagttttgaaagaagaacgagcatatattttaaacattgttaagcaagtgaagaaagctggctgtaatgtgttacttgtacaaaaatctatcttaagagatgccatctctgacttggctttacactttttggataaaattaaatgtatggtggttaaggatattgagagggaagatatagagtttgtttgcaaaactttaggctgcaggcctattgcatctttggatcattttgtagctgagaatttagtgtcggcagatttagccgaagaagttggatttggagcaaacagaatggtcaaaatatcagggattcagaatcctggacgtaccatcaccctcttggtgcggggttcaaacaagctggtccttgaagaagcagagcgatctttgcatgacgccttatgtgtagttagatgtcttgttcgtaaaagagcggtaatagcagggggcggggcccccgaaactgaactggctctgcgattggctgctcttgcagataaaatggaaggagtcgacgctatctgccttagggcatatgctggagccctggagattattccatttactttggcagaaaatgctggtttgaacccaattcagactgtaactgaattaagaaataggcacgcaaagggagagatttctgcaggaatcaacgta

SEQ ID NO: 1829 - DNA, 710 bp, Sitophilus oryzae
  misc_feature (319)..(319): n is a, c, g, or t
cagcaatgccttagttgatgtattgcctcccgaagctgattcatcaatcagcatgcttcaagcagatgagaagcctgatgttagctacagtgatattggtggtatggatatgcaaaagcaggaaattcgtgaagcagtagagctacccctaactcactttgaattatataaacaaattggtattgatcctccaaggggtgtgttaatgtatggaccaccagggtgtggcaagactatgttagctaaagctgttgctcatcatactacagctgcctttatccgagttgttggttccgagtttgtgcaaaaatacttgggnggcaagactatgttagctaaagctgttgctcatcatactacagctgcctttatccgagttgttggttccgagtttgtgcaaaaatacttgggtgaaggtcccagaatggtaagagacgtttttcgtctagccaaggaaaactctccagccattatttttattgatgaaatcgatgccatcgctacaaaacgtttcgacgctcaaacgggcgccgatcgtgaagttcagagaattcttttggagttgttgaatcaaatggacggatttgatcaaactactaatgttaaggttattatggctacaaacagagctgacaccctcgatcctgcccttcttagacctggtcgtttagataggaagatagaattcccgctacctgacagaagacaaa

SEQ ID NO: 1830 - DNA, 442 bp, Sitophilus oryzae
  misc_feature (310)..(310): n is a, c, g, or t
cggttaccatcaaaaccatgttggaagatctaggtatggatgacgaagaggaagaaatagtgcctctgcccaatgttaattcagccattcttcgaaaagtcctacaatgggctaccttccacaaagatgatccaccgccacccgaagatgacgaaagtaaagaaaaaaggactgacgacatttcatcgtgggatgctgatttcctgaaagtcgatcaaggaacactgttcgaactgattttagccgccaattatctggacattaaaggcctgctagatgtcacctgcaaaactgttgccaatatgatcantcaaggaacactgttcgaactgattttagccgccaattatctggacattaaaggcctgctagatgtcacctgcaaaactgttgccaatatgatcaagggcaaagcgcctgacgaaattcgcaaaacgttcaa

SEQ ID NO: 1831 - DNA, 739 bp, Sitophilus oryzae
aggggcttattaatatggcgattgacgaaaaggcatcatgtaaggagttggaccagtggattgaacaactaaacgattgcaaccaattaacggaaaatcaagtgaagaccctatgtgataaggctaaagaaatattgtccaaggaatccaatgtacaggaagtaaaatgtccagtcacagtatgtggagatgtacatggtcaattccatgacttgatggaattgttcagaataggcggacgaagtcctgacacaaactacctgtttatgggagattatgtcgatcgtggatattattcagtagagacagtcacattgttagtagctttaaaggttcggtataaggagagaattacaattctaaggggcaatcatgagtccagacaaattactcaagtatatggcttctacgatgaatgtctccgaaaatatggaaatgcaaatgtttggaaatttttcactgatttgttcgactacttgccactgacagctctagttgatggtcaaatattctgtttgcatggtgggttaagtcccagcattgacactttggaccatattcgtgcattggatcgtttacaagaggtacctcatgaaggaccaatgtgtgaccttttgtggtccgatcctgatgaccgcggtggatggggcatcagtcctcgaggtgcgggatacacttttggacaagacatctctgaaacctttaatcattctaatggattaaccttagtttcgagggc

SEQ ID NO: 1832 - DNA, 754 bp, Sitophilus oryzae
gttaaggggaggtatgcaaatttttgtaaaaaccttgactggcaaaaccatcactttggaagtagaagcctctgataccattgaaaacgtcaaggctaaaatccaagacaaagaaggtattccaccagaccaacagcgtttgatcttcgccggcaaacagttggaagatggtagaaccctatcagactacaacatccagaaagagtctacccttcacttggtactcaggttaagaggaggtatgcaaatctttgtaaaaaccttgactggaaaaacaatcaccctagaagtagaaccctctgataccattgaaaatgtcaaagccaaaattcaagacaaggaaggaattcctccagatcagcaacgtttgatcttcgccggtaaacaactggaagatggcagaactctttcagactacaacatccagaaagagtctactcttcacttggtactcaggttaagaggaggtatgcaaatctttgtaaaaaccttgactggaaaaacaatcaccctagaagtagaaccctctgataccattgaaaatgtcaaagccaaaattcaagacaaggaaggaattcctccagatcagcaacgtttgatcttcgccggtaaacaactggaagatggcagaactctttcagactacaacatccagaaagaatctacccttcacttggtactcaggttaagaggaggtatgcaaatctttgtaaaaaccttgactggcaaaaccatcactttggaagtagaagcc

SEQ ID NO: 1833 - DNA, 657 bp, Sitophilus oryzae
  misc_feature (428)..(428): n is a, c, g, or t
tctggcaaggctacaatatctaatgatggagctactataatgaagctccttgatgtagttcatccggctgcaaaaactctggtagatatcgcaaagtcacaagatgctgaagtcggagatggcaccaccagtgttgttcttttagcgggtgaatttttaaaacatataaagccatatgttgaagagggagttcaccccagaattattatcaaggctgttagaaagtccctgcaactctgcttggagaaaatacaggaaatttctgtgaaaattaataaatccaatgctttagaattcaggtcattattagaaaaatgtgcttcaactgcaatgagttcaaaactcattagtcaacaaagggcatttttctctaaaatggtagtagatgctgtattattgttagatgatctcatgccattaaatatganctctaaaatggtagtagatgctgtattattgttagatgatctcatgccattaaatatgattggaattaaaaaggtgcaaggtggaggtcttgaagactcaactctagttgctggtgtggcttttaagaaaacgttttcatatgcaggatttgaaatgcagcctaaagtctataagaactgtaagattgcattgctcaatattgaacttgaattaaaggctgaacgggat

SEQ ID NO: 1834 - DNA, 687 bp, Sitophilus oryzae
aaacttcctgtcaacctgttacgagccggaagaatatttgtatttgagcctccgccaggcatcagagctaacttattaagaacatttagcacagtaccagcaagcagaatgatgaaagctcccaacgaaagagcaaggctgtacttccttctcgcttggttccatgcaattgttcaagaaagactgagatactgtccgttgggatgggctaagtattacgaatttagtgaatctgatctgagggttgcctgtgatactcttgacacttggattgatgctacggcaatgggaagaacaaatttgccaccagaaaaagtgccatgggatgctttggttactcttctttctcaatctatctatggtggaaaaatcgacaacggtttcgatcaacgacttctgcaatcattccttaacaaactcttcactttcaaaagttttgaagctgattttgctctggttgctaacattgataatggacctaacggtactagacacattactatgccagatggaaccagacgcgatcatttcttaaaatggattgaaagtctagcggataggcaaactcctgcatggctcggactaccaaataatgctgaaaaagtgctgttgacaacaagaggtactgatctgattggtaaattgcttaaaatgcagcagttagaagacgatgatgagcttgcatat

SEQ ID NO: 1835 - DNA, 696 bp, Sitophilus oryzae
gctcaggaaatgggagttaaattaggcaatgaagttggatatgcaataagatttgaagactgtacatctgaaagaactataattaagtatatgacagatggtactttgcacagggaatttttatctgagccagacttacaatcatacagtgttatgataattgatgaagctcatgaaaggactttgcatacagatattttatttggtttagtaaaggatattgccaggtttaggcctgacttaaaattattgatatctagtgcaaccttggatgctcaaaaattttcagaattttttgatgatgctccgatatttagaataccaggaaggagatttccagttgatatttattatactaaagctcctgaagctgattatgtagatgcatgtgtgatttcaattttacaaatacatgtcacccaaccattaggtgatattttagtattcttaactggtcaggaagagattgaaacatgtcaagaattattacaagatcgtctaagaagactgggttctaaagtaaaggaactaattgttttaccagtttatgcaaatctgcctagtgacatgcaggcaaaaatttttgatcccacaccaccaggggccaggaaagtagtattggcaaccaacattgcagaaacatcattaactattgataatattatttatgttattgatcctggatttgctaagcaa

SEQ ID NO: 1836 - DNA, 762 bp, Sitophilus oryzae
cgaactcacacctgtagaaactgagaaccccgctggaggctacggtaaaactgtgagtcacgtcgtcatcggtctaagaacggccaaaggcagtaaacagctgaaactggaccccagcatttacgaggcactccagaaagagaaggttgaagtgggtgatgttatttatattgaggctacaagtggggctgttaagagacagggaagatcggatgcttatgctactgagtttgatttggaagctgaagagtatgttcctttaccgaaaggtgatgttcataagaagaaagaggtggttcaagatgtaacacttcatgatttggacgcggcaaatgcaaagcctcaaggaggccaggatgtcttgtcgatgatgggacaacttttgaaaccaaagaaaacagaaataactgacaagttgaggaaggaaataaacaaaattgttgataaatacattgatcagggaatcgcagagttagtaccaggagttctttttattgatgaagttcacatgctagatattgagacttttacatatctacacagggcactagaaagtgccattgctccaatagttatttttgctacaaacagaggaagatgtcttatcagaggtacggatgatattttttcacctcacggtatacctctggatcttctcgacagacttttgatcattaggactgtgccgtatgatcggcctgatatggaacaaattttgaaactgagagctaaaactgaaggcctggaaattgacgaagaagc

SEQ ID NO: 1837 - DNA, 659 bp, Sitophilus oryzae
agtagtgctgacttggaaagcgggttttcgagggaattattcttgcagtggtgttctaattcaaacaatagtgttattatcactacaagaacatgtcctggaactctagcgagagatctaatagacaacaacgaaaaaggcagaaccatcgatatgattgtagaaagaagagtgaaattagaaggtgcagagctggaagagtttgaaaaaagacagcaacaaaggacgcatataagcaacgggaccaaagatgatgtagattcagattccgatagtgatatagagatgtcggttatatccaaaggaaggcacgatattgttataaaacaggaaggtaaagttagtggaggatttttcaaagtgaccaaaaaacagtatcctatgtatccgtttcgtgaggacaagataaagtgtgatgaatatggagaaattgttaaaattgaagattacaggctggccgatgttaatcctgaagctgaagataataaagaaaacttagaggttaagagagaggaagaagaagaagaaataattgaaattctggaagttccatcgaaatgtatcgctctggagaggacggttcaagtgaactgtcaagtacaatacatcgatttcgaaggccggtccgacggggaatccctgatgaaaatcctgtccca

SEQ ID NO: 1838 - DNA, 746 bp, Sitophilus oryzae
agaaatggacgagcttttctaacacaactcatgaatcgcgaacagagaaactttcagtttgattttttgagacctcaacattcactctttcagtattttaccaagttactggaacaatacactaaggtcttaatcccaccaaaaacgatgcaacaaaaactgaaagaggaagtcaaaagtaccaaaaccgttctggaacaggtgaagtaccgggcggaatggcaaaagtaccaggaagcccagaaagccaaagaagaagagatattggaaagagaaagaatcgcgtacgctcaaatcgattggcatgattttgtagtagtggaaactgtcgattatcagccgtttgaaattggaaattttccacctccaacaacaccggaagaggtgggggcaagaattctaattcaagaaaggcttgaagatggggacgatattgagatgcaactggaaagcgacgaagaagatggtggtcaggaggatcaaagtttaagctatatggaagatcgtaccaatacgaacagaaaagatgcgagggataataatcaagtgcaagatatggacgaggagagttcagatgatgaagatcaggataaacgttcagatcaaccgtcaattcagcctccactaccgccagttcccgataaagttttggttaagaaatacgatcctaagcaagctcctaaagtcactcggccgactgttggtgacgattatctagtatcaccaatcactggggagaaaattcc

SEQ ID NO: 1839 - DNA, 776 bp, Sitophilus oryzae
attggcaatcaaaaacgtgttgtgggtgttttattaggctgttggagagctaaaggtgttttggatgtatcgaatagctttgcagttccttttgatgaggacgaaagagataaatctgtatggttcttagatcatgactatctagaaaatatgtatggaatgtttaaaaaagttaatgctagagaaagagtggttgggtggtatcatacaggacctaagctccatcaaaatgatattgctatcaatgaacttgttagaagatattgccctaattctgttcttgtaataattgatgctaagccaaaggaccttgggttacctaccgaagcttatcaggctgtggaagaagtccacgatgatggatcacctacttcaaaaacttttgaacatgtgccaagtgaaattggcgctgaagaagctgaggaagtaggagttgaacatttattgagggatattaaggatactacagtcggtactttgtcacaacgaattaccaatcaacttttgggattaaaagggttatattctcagttaagagatatacgtgactatttaattcaagttagcgaagaaaaacttccaattaatcatcaagtaatttatcagttacaagatatatttaatctcttaccagatataaatcagatgcaattcaataaatctttttatgtaaaaaataacgatcaaatgttagtcgtatacttagcagctttagttcggtctatagttgctttacacaatctaataaataataagttaacaaacagagatgccga

SEQ ID NO: 1840 - DNA, 707 bp, Sitophilus oryzae
tacaaaaagggcgaatctcagaccaatgtagaaataactgccgaaggcgattttaccaggatgctagagattgaagaagagcatgtcagaaaacagtgcgatgatattatagccttgaagcctgacgtagtgttcacagagaagggtgtgtcagacttggcccaacatttccttttaaaggctggaataagcgcagttcggagagttcgcaaatctgacaataacaggatcgcccgagcttgtggggccgtcatagtgaacagaacggaagaactacaagcctcggacattggaactggagcgggactctttgaaatcaaaaaattgggtgacgaatacttttgttacatcactaaatgcaaaaatcctaaggcctgtactatcgttctgcgtggggccagcaaagacatcctgaatgagaccgagaggaatctccaggacgcgctccaagtggccaggaatattgttttgaaaccccgtctggttcctgggggtggggctatagagatggctgtagctcagagacttttacagaaagccactcacgggccttacagggccttagcccatgctttggagataatacctcgaacgctgtcccaaaactgcggcgcgaacactatcaggactttgacggctttgagggcgaagcacgccaatcataccgatcaaaacagtccttgtacgtggggtattgatggtgaaag

SEQ ID NO: 1841 - DNA, 549 bp, Sitophilus oryzae
cttatgccgataatggagggagcatagttgctatcgccggtaacgactttgtaattattggagctgatacacgtcttagcgcaggattctctatttatacaagagagcaaaacaaattattttcattgtctggtacaacagtactaggatgttcaggatgctggtgcgatacactaactttaacgcgtattttaaagtccagaatgcagatgtaccagcaggaacataataaagttatgtcaactgaagcatgtgcacaaatgttatcaacaatgctatattataagcgattttttccatactacatatccaatgtattagttggattagataatgaaggtaaaggatgtgtctacagctatgatccaattggacactgtgaaaaagcaacatacagagctggaggatctgcaggagctcttttacaaccacttttagataaccaaattgggcaaaagaatatgctaaatgtcaaacccgaatcggtaacaaaagaaagggcattgtcaattattaaagatgtgtttatctctgctgctgaaagagata

SEQ ID NO: 1842 - DNA, 709 bp, Sitophilus oryzae
ttaacatgttcccggacattcccaggccctttaacgttacgtaccactgttattccgtggctatgcttccaggaaacgaacgacaagatgtagaaagaggaggaaaaattattatgcctcccagtgctctcgaacaactaacaagattaaatattaactatccgatgctgtttaagttaacaaataaaacaaccagcagagttacgcattgtggtgtattagagtttgtagcggacgaaggaaaagtttatctgccattatggatgatgcacaatatgacactggaagaaggtgatttagtacaaatggaaagtgtctccttacccgtcgggacattctcgaaattccagcctttatctcccgagtttttagacataaccaaccccaaagcagtcttggaaaattgcctaagatcatttgcttgtttaaccactggagatgtcattgcagttcaatataatcaaaaagtatatgagctgtgtgttttagaaaccaaaccgggcgatgctatcagtattatcgagtgcgatatgaatgtagaattcgcagctcccgttggttataaagagcctgaaattgaaaggaaaattgaagatgaagagatggcagtcgatccttcagatttaatgcctgaaccatcgggttttgttgcttttaaaggcgcaggtaaccgtctggatgggaaaaaacgcaaggattctgtaacaac

SEQ ID NO: 1843 - DNA, 652 bp, Sitophilus oryzae
  misc_feature (171)..(171): n is a, c, g, or t
cctgtttcagacaaaaacccagaacctttgattaaagttgcaatgactactttgggttcaaaaataatcaacaagtgtcacaggcaaatggctgagattgcagtcaatgcagtattagctgtagccgatttagaacaaaaagatgttaattttgaattaattaaagtggangctgtagccgatttagaacaaaaagatgttaattttgaattaattaaagtggaaggaaaggtgggtggtaaacttgaagatacagtattagttaaaggtgttgtgattgataaaaccatgtcacatcctcaaatgcctaaagaacttaagaatgtgaaattggcaattctcacatgcccatttgaaccaccaaaaccaaaaacaaaacataagttggatgttactgatgttgctggatataaagagctcagacagtatgaacaagataaatttaaggaaattgttggccttgtgaaaaaggccggagctaccttagctatatgtcagtggggatttgatgatgaagctaatcatcttttgctacagcaacagcttcctgctgtgcgttgggttggaggtccagaaattgaattaatagcaattgctactggtggacgcatcgtgcccaggtttgaagaactcagccctgaaaagttaggat

SEQ ID NO: 1844 - DNA, 209 bp, Sitophilus oryzae
ctctaaaggcgaccgaaaacgcttcgaagttaaaaagtggaatgctgtcgctttatgggcttgggatattgtcgttgataattgtgctatttgtcgcaatcatattatggatttgtgcatcgaatgccaagcaaatcaagcttctgcaactagtgaggaatgtacagttgcttggggagtatgcaaccatgctttccattttcattgca

SEQ ID NO: 1845 - DNA, 725 bp, Sitophilus oryzae
gggtagggttgaaaatgctaaaattctaattgcaaacactcccatggatacagataaaataaaagtttttggatcgacaatcaaagtagactctatggcaaaaattgccgaattggaatcagccgaaaaggaaaaaatgaaggacaaagtagccaaaatactgaaacataattgtactgtgttcattaatcgtcagttgatttacaattatccggaacaactctttgctgatgctggagtgatggccattgagcatgcagactttgatggaattgaaaggttagcattagtaactggaggtgaaatagtctcgacttttgatcagccagaaagtgtcaaacttggaacttgcgatcttattgaacaaattatgattggagaagacacattacttagatttagtggggttgctttaggagaagcttgctcgattgttattcggggtgcaacacaacaaattattgaagaggcagatcgttctctgcatgatgcattgtgtgttttggctgctacagtcaaggaaagccgcattgtgtatggaggaggttgcagtgagacactgatggcggtagctgtgagtaaagctgcactgagtacagcaggaaaagaagcagttgctatggaagcctttgccagagctttgctgcaactacccacaattattgctgataatgctggttatgattcagctcagcttgtaactgaacttagagcagcccatacta

SEQ ID NO: 1846 - DNA, 672 bp, Sitophilus oryzae
  misc_feature (309)..(309): n is a, c, g, or t
gctgtaaatttgggatctgcaacagttggccttaaaagcaatgcatatgcagtactgattgcacttaaaagggcttcttcggaactttctgcgtaccaaaaaaaggttattaacattgatgaccacattggagtgactatatcaggattaacagcagatgcaagaattttgagtcgttatatgagaactgaatgtttgaactataaatattcgcatgatacttatttacctttaaatagacttataacaacattaggcaacaagatgcaagtatgtactcaaagatatgaccgcagaccatatggtgtnaaatattcgcatgatacttatttacctttaaatagacttataacaacattaggcaacaagatgcaagtatgtactcaaagatatgaccgcagaccatatggtgtagggcttttggtagctggttatgatgataaaggaactcatatatatcaaacatgtccatcagctaattattatgactgtaaagcaatgtctattggctcacgttctcaaagtgcaagaacttatctagaaaaacatttagatcaattttctaatagtagccttgaagaattaattaaacatggacttagggcattgagagatacgctacctccagaagttgatttatcaaccaagaatgtgtcaatcggttatgttggt

SEQ ID NO: 1847 - DNA, 680 bp, Sitophilus oryzae
tatggctgtgtatgaacgagcaacaaaagctgttccagaaaaagaaatgtttgaagtatttaatatttatattaaacaagcggctgatatatatggaatacctaaaactcgagaaatttataaaaaagccattgaagttctgcctgacgataaaacgagagaaatgtgtttaaggtttgctgacatggagacaaaacttggcgaaattgacagggctagagcgatttatgactattgtagtcaaatttgcgatccaagggtaacagtcgaattttggcaaacttggaaagagtttgaagtgagacacggcaatgaagatacaatgagggaaatgttaagaataaagagaagcgttcaagcgatgtataatacacaggttaacatgatgtctgcccaaatgctcagttctgccgggtcattaacgggaactacggccgatcttgcgccaggtgaaaaagatggaatgcgtcttttggaagcaaaagctgcagaaatggctggtgctggtacatcaggaataagttcccgaccaggtaatataatgtttgtgagaggtgaaactcaaggcgacaagaaagataaagtcgttaatccagatgaaattgatatcgacgatgatgacgaggaggaagaagacgaagttgaagtaccccttgagaaacaagctgtaccttctgaag

SEQ ID NO: 1848 - DNA, 677 bp, Sitophilus oryzae
agataatgagagacccggaaaccggcaactccaaaggcttcgccttcatcaacttcgccagcttcgaagcctccgacgcctcgattgaagccatgaacggccagtacctctgcaaccgacccatatcggtgtcatacgccttcaaaaaagactccaaaggcgaaagacacggctcggcagccgaaagattactagcagctcaaaacccactctcccaagcagacagacctcaccagctgttcgccgatgcacctccgatgggcatgatgggcatggccatggctcctccacctcctcctgttattttagggggtcttatgcctatgcctcctccgacggccatggctcctccacctcctcctgttattttagggggtcttatgcctatgcctcctccgacgccggcgagtatggcgcctccaccaccgcctccggtgcctccgccatcgtcgtttccctcggggattcccccgccacctttgcctcccagtcaacctccgctgccgcctggagcgccgcctatatctgctgcgggggcaggtggagcgcctaggcctccgctgcctgcaggagggatgccgagggggatgatgcctccgccgccgccgtggcaggctggagggatgcctccactgcctacttcaggacaagcagctgctaacagcaatttcccgaac

SEQ ID NO: 1849 - DNA, 640 bp, Sitophilus oryzae
gccccaaaactgagatatctcgacttctcagagcgacatggatacattaaaggtgtcgtcaaggatattatgcacgatcctggcagaggagccccgttagctgttgtgcatttccgtgatccttacaagttcaagacgagaaaggaactgtttattgcccctgaaggaatgtacacaggacagtttgtctattgtggaaagaaagctaacttacaaattggaaatgttttgcctgtgggtactatgcctgaaggtactattgtatgtaatttagaagaaaagactggcgatagaggtcggttggccagagcttcaggcaattatgctacagttattgcacacaaccatgatacaaaaaaaactagagttaaattaccatctggtgcaaagaaagttattccatccaacaacagagctatggttggtatcgttgctggaggaggtagaattgacaaacctattcttaaagccggtagagcgtaccacaaatacaaggttaagcgtaactgctggcctaaggtgcgtggtgttgccatgaaccccgtagagcatcctcacggtggtggtaaccatcaacacattggtaaagcttcgacagtcaagagagggacctctgctgggcggaaagttggtcttattg

SEQ ID NO: 1850 - DNA, 264 bp, Sitophilus oryzae
gaaaacagttggccactaaggctgccaggaagagcgctcccgcaacaggaggtgttaaaaaaccacatcgttacaggcctggaactgtggcgcttcgtgaaatccgtcgttatcagaagagtaccgaattgttaatcagaaaattgcccttccaacgtttggttcgtgaaatcgcccaggatttcaaaaccgatcttcgtttccaaagttccgctgttatggctttgcaagaggccagcgaagcttatttggtcgggctttttg

SEQ ID NO: 1851 - DNA, 662 bp, Sitophilus oryzae
taacagatgtttgccgtacaagtcttaggactaaagttcatcagaaattagcagatgttctaactgacgtttgtgttgaagctgttttggctttgaaatcgcaagataaacctgttgacttacacatgattgaacttatgcaaatgcaacataaaactgaaactgatacaactcttgtaaaaggtttagtattagaccatggttctcgtcatcctgatatgccaaaacgtttggaaaattgttacattttaacctgtaatgtgagcttggaatatgaaaaaagtgaagttaactctggatttttttataaaacagcagaagaaagagacaagatggtagcagctgaaagagaatttatagatcaaagagtgaagaaaattattgagttaaagaaaaaagtatgtgctgggaacaataaatcttttgtagttataaatcaaaaaggtattgacccaatgagtttggatcagttggctaaagaaggaattattgcattaagaagagctaaacgtcgtaatatggaacggttagcattagcctgtggtggtgttgcaatgaattcctttgacgatctttcggagtctgttcttggatatgctggtgtagtttatgaacacgtacttggtgaaaataaatatacctttgtagaggactgcaagaac

SEQ ID NO: 1852 - DNA, 780 bp, Sitophilus oryzae
agcagctttggttgatgataggcccaagtcgttcgaagagtgtattgtttgggctcgaaaacattggcaggaccaatatcacaatcaaatcagtcagctgctctacaattttccaccagatcagctcacaagtaccggtcagttgttctggtccggtccaaaacgttgtccagtaccactcacctttgacataaatgacacgttacacttggattacgtcatagccgctgcaaatctgaaggcgcaggtgtatgggattcccacgaatagggatagagcgtatatcgcaggagtggcttcaaaagttgaggtcccaccgttcgtaccaaaatccggcgttaaaattgccgtaaccgactcacaaatggcagcaaacggcaacagcatcgacatggaccgcattacccagctcagaggtgagctacctcctcccgaagaagtcgcaggtttagtgctgactcctctggacttcgaaaaagacgacgacagcaatttccacatggacttcatcgttgcagcgtcgaatttaagagcggcgaactataaaattcctccagccgatagacacaaatctaagctgatcgcaggtaaaattattcctgctatcgcaacaacaacgtccgtcgtagccggtctagcctgcttggaactgtacaagttggctcgttcattgaagagtctcgaaccgtttaaaaacggtttcgtcaatttggcgttaccgttctttggatttagcgaaccgatcgcagcgccgcagatggaatactgcggaaacaagtg

SEQ ID NO: 1853 - DNA, 684 bp, Sitophilus oryzae
ttcttacgcctcaattcacagttcaggatttagagattttttgttaaaaccagaaattttgagagctattgtagattgtggttttgagcatccatctgaagtacaacatgaatgcattccccaggctgttcttggaatggatattctttgtcaagcaaaatctggtatgggaaaaacagctgtttttgttttggccactttgcaacaacttgaaccgaccgaaaatgttgtgtatgttctcgcgatgtgccatacgcgtgagctagcttttcaaatcagcaaagaatatgaaaggtttagcaaatatatgcccaacatcaaagttggtgtattctttggaggaatgcccattcaaaaagatgaagaagttttgaagaataattgtcctcatattgttgtcggaacgcctggacgtattttggccctagtaagatcgaaaaagctgaatctaaaacatttgaagcattttattcttgacgaatgcgataagatgctcgaagtgctagatatgagacgtgatgttcaagaaatctatagaaatacaccacatggcaagcaagttatgatgttcagcgccacactaagtaaagagattcgtccagtgtgcaagaagtttatgcaagatcctatggaagtttatgttgatgatgaggctaaactcactttacatggtcttcaacagca

SEQ ID NO: 1854 - DNA, 685 bp, Sitophilus oryzae
  misc_feature (120)..(120): n is a, c, g, or t
cagctacaaagagtccagttcctgaagtagacgtttacattaatttactcatattggttcgtttaattgatacaaacaagctggaagaggcttctagatgttctcaagcattaatgaatntgaataaaataacgagtcaaaatcgtcgtaccatagatcatctagcagctaaatgctatttttatcactcaagagtagccgaattaacaaacaagttggactccataagaagtttcctacatgcgagattacgaactgctaccttaagaaatgattttgagggtcaagctgttctaatcaattgtcttctcagaaactacttacattattctctctatgatcaagctgataaattagtttcaaaatgtgttttccctgaaactgctagtaataatgagtgggctagatttttgtattatttaggaagaattaaagctgctaggttagaatacagtgttgctcacaaacatttagtacaagctttgaggaaggccccacaaaacactgcagtaggttttagacaaactgtgcaaaaactattagtggtcgtagaacttcttttgggagatattccagaaagacaagtattcagacaagctcaaatgcgtcattctctgagttcatattttcaacttacccaggcagttcgtatgggcaatttacagagattcggtgaagttttgga

SEQ ID NO: 1855 - DNA, 686 bp, Sitophilus oryzae
cgagcctacaaaattggaactgctacaaaaggaatatgacaaaaagaaggaacagttcaaaaccaaagttcagtctaatattttagaaaaatatggaggagaagaacatttggaagctccaccaaaaactttattgcttgcccaaacagaagattatgttgaatattcaagatcaggtaaaattatgaagggccaagaaaaagaggagatacgttccaaatatgaggaagatatttatattaacaatcatacaagtgtttggggttcatattggaaaggtggtcagtggggttataaatgctgtcattcttttatcaagaattcatattgtttgggtgaatctggaaaaagtactaacaatgacacagaattaaaaaatagttctgatgctaatattaaccaaagtgaatgtattaataatacatcagaaactacacaagaaagtgaattgacttgtgataaagaatcagatgattccagtgaagatgatatcagaacaaagtctgaaaaaaagaaaaagaaaaataagcataaaaagaaaaagcacaaagagaaaaaagccgaaaaagacaaattatcagaggctttaaaagctgaagaacagcatcaaaaacaagccgattatttgttgtctttggatgaaagaaagcgaccttacaacagtatgtttgaagcaaagaaaccga

SEQ ID NO: 1856 - DNA, 483 bp, Sitophilus oryzae
tctccgtaagaagaggaagttcgaattaggtcgcccagcggctaatacgaaactaggagctagcagaagagttcactatgtaagaactcgagggggcaaccttaaatacagagccttaaggctgacccatggcaactgggcttggggtagtgaaagtatcacccgagaaagccgtattatcgatgtcgtttataatgcaagtaacaatgaattagtacgtacaaaaacattggtcaagaatgccattgtagttgttgatgccacaccattcagacagtggtatgaaggtcattacattctaccgctaggacgtaagaagggtgctaaattgactgcggaagaagatgcagcatttaacaaaaaaaggagtaagaagattcagaaaaaatatgaaaccagacagaaaaccgctaaggtagaaccagctatcgaagaacaatttcacactggtagattattagcttgtatttcatcgagaccagg

SEQ ID NO: 1857 - DNA, 650 bp, Sitophilus oryzae
  misc_feature (569)..(569): n is a, c, g, or t
tactggagtgagtgtagaggctgtcgaccctgtatttcaagcaaaaatgttagacatgttaaggcaaacaggccggccagagatggtggtaggatggtatcattctcaccccgggtttggatgctggctttcaggtgttgacattaatacacagcaatcatttgaggctttgtcagagagagccgttgctgtagttgtagatcctatacaatcagttaaaggaaaagttgttattgatgcatttagattaattaatccaaatatgatggttcttggtcaagagcctagacaaacaacctcaaatttgggacatttacagaaaccttcagtgcaagctttaatccatggattaaatagacattactattcaatcagtataaattatagaaaaaatgaacttgaacaaaagatgcttcttaatttacataagaaatcctggatggacggtttaactttggcagattattcagaaaattgcactactaatgagaaaactgttgctgatatgttagaattagcaaagaattataataaagctcttgaagaagaggaaaaaatgacccctgaanatatgttagaattagcaaagaattataataaagctcttgaagaagaggaaaaaatgacccctgaacaactcgccattaaga

SEQ ID NO: 1858 - DNA, 776 bp, Sitophilus oryzae
ctccctcatgatggttgaaaaagtaccagactctacttatgagatggttggtggtttagataagcagattaaagaaataaaggaagtaattgaactccctgtcaaacatcctgaactattcgatgctcttggaattgcccaaccaaaaggtgtactgttgtatggtccaccaggaacaggaaagacacttttagctcgtgccgtagcccaccacactgaatgtacatttatcagagtgtcgggttcggaattagtacaaaaatttattggagtcagagtgtcgggttcggaattagtacaaaaatttattggagaaggatctcgaatggttagagaattgttcgttatggccagggaacatgccccttctataatttttatggacgaaatcgattccattggttcttcacgtattgaatcaggttcgggaggtgactctgaggtacaaagaaccatgttggagcttctgaatcaactggacggattcgaagctaccaaaaatattaaagttattatggccactaatcgtatagatattttggatccggccctcctcagacctggtagaatcgataggaaaattgaatttcctccaccaaacgaagaagctcgattggacattttgaaaattcactctagaaaaatgaatttaacgagaggaattaatttaaggaaaattgctgagcttatgcccggtgctagcggtgcagaagtcaagggtgtttgtaccgaagctggtatgtacgctttaagagaaagaagggttcacgttactc

SEQ ID NO: 1859 - DNA, 488 bp, Sitophilus oryzae
tacttggctaaaatccgcattcgatttgcagagcgtaagctttttccagcggggatctgtacacgaatttatgcagttttgttgcaagactgtcgtagaaagaacactcccggcctcaaggcaatcagtacagcagggtgactacttttgccatgtgtatgttagatctgacaacctcgctggcgtagtaatatcagatcatgaatatccacagagggtatcacatactttactcacgaaaattcttgacgagttctcagaaaaaataccagcctcgaattggccaaacctacaggaaaaagatgtggcttttccacaacttaacacctacttagccaaataccaaaacccgcgagaagcagatgctttgacgaaaatccagaatgaactagacgaaactaagattattttacatagtaacattcaagccgtattggagagaggtgaaaaactagatgatttggttgccaaatcggaggtgctaagta

SEQ ID NO: 1860 - DNA, 687 bp, Sitophilus oryzae
  misc_feature (595)..(595): n is a, c, g, or t
ggtcgtctttttcaagttgaatatgctattgaagcgattaaattaggatctacagcaattggaatatctacaagcgaaggagttgttttagcagttgagaaacgcattacttctcctctaatggagccaacaacaattgaaaaaattgttgaagtggataagcatattgggtgtgcattttctggtcttatggcagattcaagaacaatgatcgatagagcgcgtgtagaatgtcagaaccattggtttgtctacaatgaaaacatgagtgtagaatcttgtgctcaagctgtttctaatctagcaattcagtttggtgattcagatgatgatggggcagctatgtccagaccttttggagtggcgatactatttgctggcattgatgaaaagggacctcaactataccatatggacccttcaggtacatttgttcaatttgatgctaaagctatcgggtcaggttctgaaggtgctcagcaaagtcttcaagaagtgtatcatcgtagtatgactttagaagaagctacaactgcagctttgacgattttaaagcaagtcatggaagaaaagttgaattcatcaaatgtagaantgaattcatcaaatgtagaagtgatgaccatgactccaaagaatctgtttcatatgtttactaaagaacaggtggaagaggccttaacaaat

SEQ ID NO: 1861 - DNA, 752 bp, Sitophilus oryzae
tgggaaacgatgaacaatctcacggccaagcaaaattccttgtgtgtaaattataaatttcaaattccggacctcaaggttggtactctggatcagctggtgggtctctccgatgaccttggcaagctggacggattcgttgaacaggtgaccaggaaggtcgcttcgtatttgggggaagtactggaagaccagagggataagcttcaagaaaacttgacggctaataacactgacctgccgagctacctgaccaggttccagtgggacattgccaaatacccgatcaagcagtccttgagaaacatcgctgacattatcagcaaacaagtgggtcagatcgatgccgacttgaaaaccaagtctaccgcttataacaacttgaagggcagcttacagagcttggaaaagaaacaaactggcagtttgctgacccgtaatctggccgatctagtgaagaaggaacattttattttggactctgattatctgcagactttgttggtgattgtgcctaaagcgtcttttgccgattggaatgccacctacgaaaaaatcaccgacatgatcgttcctagatcgtctcagttgatcacgcaagacaacgaatatggcctgtacacagtcacgctgttcaagaaggtgattgacgagttcaagcatcatgctcgcgagcgcaagttcatcgtgagagacttcacttacgacgaggaacagttggcggccggcaaaagcgagatcactaagttgac

SEQ ID NO: 1862 - DNA, 667 bp, Sitophilus oryzae
atgccctaaattgcactgtagctagtcaggctatgcccaagaaaattgtaggtgcaaaaattgcctgtcttgatttttcattgcagaaagctaaaatgaaaatgggtgtccaggttttaataaacgacccagaaaagcttgagggaatcagagcccgagagttagacatcactaaagaaagaatccaaaaaattttatccactggtgttaatgttatactaacttcaggaggaatcgacgatttatgtttgaagtattttgtcgaagccggtgctatgggagtgcgaagagttaagaaggtcgatttaaaaagaatcgcgaaagcaacaggagcgacatttttgacgtctttatctaacatggatggtgatgaatcttttgatgctagtatggtcggagaagcagctgaagtatatcaagaaagagtatctgatgatgaattgattattattaaaacaccaaaacagcgtacagccgcatctattattttacgtgggcccaatgatttctattgtgatgaaatggaaaggtcagttcatgacgctctgtgtgttgtcaagagagttttggaatcgaagaccgttgttgttggtggtggagcagttgaagctgctctttccatttacttggaaaactttgccacgacactgagtagcagggaacaatt

SEQ ID NO: 1863 - DNA, 680 bp, Sitophilus oryzae
gctccaggaagtttctacaactttcccaatttgcaaccacaagtacaacaacctcaagatttcagacaacattctcagtctccagtaacaacatcaacatctttggttggaatcacatacgataaggggattctagtagctggcgatttgctagcatcatacggttctcttgcacgttacagaaactgtcctagaatagtaaaaattaacgagaacatcattttgggtgccagtggagattatgccgattttcaatatgtaaaagactttgttgagcaaaaagtcataagtgaagaatgtctagatgatggtcttgctttaaaaccaaaatctctgtattgttggttgactagaattctatacaatagaagaagcaagatggacccattgtggaacaactttatagtagcaggaattcaagacggacaaccgttcctgggaacagttgataaacatggtactgcttatgctgataaagttatctgcacaggttatggggcacatattgccacacctttgctgagggacagtttggacaagaatccccaattaaatttagccgaagctaaggctttaatcgagaaatgtctggaagtcttatactacagggatgccagaagttatccaaagtatcagttgggaattattgatgtcgaacaaggagtgtctattgaaggacc

SEQ ID NO: 1864 - DNA, 699 bp, Sitophilus oryzae
tcctgattcagttgactgtgcctctgcttatgtagtctgggcgagtggagaacttaatctattcactacacattttatcaaacaagtttttatgccacaaactagtctttctacaatcactgaatgcgtgctgttagtaagatctcagtgtgaaaggttatgttcatacggtgttgattttcgttatcagttagatggggcattaagatcttcatttgtaaaagcattgagagatacaagggagaaacttgtagattcaatgaagttgagagcctctgaagacaaatggattccaatgaatttagtatcaaaagccagtttggccaaatatctacaagaatacagcaatatgggacttaaattagacttctatgttactggagacgtgtggcttcaattaacatcatgtaatgtagctttcacaaaaatttatttgacattagttgacgattgcctaaaactgaaaaccactgaattactacacgtgatagaagaaacgctttatattgtttttgagtcccaaatgaggcacaatgttgtttcttacaataatgagcaacaaatagagcaaaaaaggtttattttgaagaacattgaatttttgttagttgctgttcttgaactggtgcagaaaaaattcaagggcgaaacaggatacgaatcagaacatttaaacaaactctggaacgagtattctgg

SEQ ID NO: 1865 - DNA, 665 bp, Sitophilus oryzae
gacaaagatcgtaatccggatagaccaatgcatagcagcacatcagtactgagacttcctgtaaatctagatgaaggtgaagaagattctagaaaaagggttaccaggatatcaagtcctgaaaggtgggaaataaaacagatgatatcttctggatgtatagacaaaagcgaattgcctgactttgatgatgaaactggactccttcccaaagatgaagaggatggtgaagcagacattgaaattgaattagtagaagacgagcctccatttctgcaaggtcatggtagagctttgcatgacctaagtcctgtcagaattgttaagaatcctgatggatcccttgctcaagcagctatgatgcagtcagcactagcaaaagaaagacgcgaacaaaaaatgcttcaaagagaagccgaagttgattcacaaccctctggtaaaaataaaacttggatagatcctttgcctgaagaggaatccaaagatgtgtcagcaaggggaattggtttgcagtcccaagacttaccagaatggaagaaacacattattggtgggaaaaaatcttcctttggtaaaaaaacgaacctttctatcatagaacaaagacagtcgctgcctatatataaactgaaagaggaacttcgtaaggcggttactgataa

SEQ ID NO: 1866 - DNA, 712 bp, Sitophilus oryzae
taccgtccaaatgcttacaaacagacatgtattagttggtgggggcggaggctcagcaaaaactggtgttgcgaatggatttgaaatttttgaactgtcgcatgacggaaacaaattccatgtcgaggaagtaactagacatgaaacaggtcctaatgttgttatgaattgtgcagtggctttaaaaaataatcatacttatttagttgctggtcaagagagtcattgtcaattatacaatgtaaactctgaattggtagctcaagaaaacggtgatattgaaaaccttggaactgaccaccatactaatggtaaactgaggcacagaaaatcagcgcctaccagtaaaaataatgacattaataagaatttaaggaaaaggttaaaatttattttaagtccgtcagatagtgtacagactgattttaatgagcctgaacctttatgtagagtggtaagggtacacccagaagggaatctaatggctacaggtggaacagatggcactatacagatgtggagatttccaagtcttaagcctctaaccaaattaaaaggtcacacaaaagagatagatgatatagattttagtttattcgacaattatattataacagtggcaaaagatggtcaagcaattttgtgggactgtgttagaggaaaagaaattaaaaaactaacatggaatcaaccgcagggttcgaaatatcta

SEQ ID NO: 1867 - DNA, 738 bp, Sitophilus oryzae
aagaaggtaaggccaaagagcttgcagacctgatcaaacaaacacgtcctttcttaagtgaaattagtaaagcaaaagcagcaaaattagttagatctctagtagatttctttttggatctcgaggcgggcattggtatagaagtacaactttgtaaagaatgtatagaatgggcgaaagaggaaaaacgaacatttttacgtcagtcattggaggcgagattagtagccctatatttcgatactggaatgttctcggaagctcttcaattaggatcaactttattgaaggaattgaaaaaattagatgacaaaaatttattggtagaggtgcaactgttagaaagtaaaacgtaccatgctttaagtaatttaccaaaagccagagcagctcttacctcagcccgtacaactgcaaacgctatctattgtccacctaaaatacaagcttctttggatcttcagtcaggtgttttacatgccgcagatgaaaaagactttaaaacagcttattcatatttttacgaggcttttgaaggttttgacagtgtcgaatctcctaaagcattaacagccttaaaatatatgttgttgtcaaagatcatgcttaatacccctgaagatgtccaacaaattgtaagcggaaagttggcaattaaatacgccggtcgggatattgatgcaatgaaggctgtagctcaagcatctcataaaagatcgttagcggactttcaacaag

SEQ ID NO: 1868 - DNA, 669 bp, Sitophilus oryzae
cgggaaattcaaacaacacaggagactgttactagagaagtgtccaacataaaatctatgtacgatcatgaactaagcgatgcacgtaaactattagatgaaacacacagggaaaaagcacgattagagatcgatgtgaaacgtttgttagacgagaatgatgagttaaaacaggaactagccaagaagtcgaaggatttaacgttggcagagaattctgctcgaatctacgagactaggtgtaacgagttgcagctgaaatacaaccaggctaatgccgatgctaaaaaagccatcggtgatttgaaagatctggagaaggaacgggacaaacttaaaaaacttctagacgaacatagaaaacagctcgaggaagaatctctggctagagtggaagttgagaatgccaatcaaagtctaagagaagaattatcctttaaagaccaggtctaccaacagcagctaaccgaaacacgtacacgtcggcagatcgaaattagcgagattgacggacagttggctgaaaaatatgaagccaagctgcaacaagctttgcaagatctcagggaccagtatgagagccaaatggctagcaacaggtcagagatcgagctgctctacgaaaataaaatcaagaatctccaagctgccgcaaatagacagtcaaac

SEQ ID NO: 1869 - DNA, 718 bp, Sitophilus oryzae
  misc_feature (349)..(349): n is a, c, g, or t
ttcaaagtggtggaaactgatcctgctccgtattgtattgtagccccagatacagtgattcattgcgatggagatccaattaaacgtgaggaggaggaggaagctctgaacgctgtgggctacgacgacatcggaggctgtcgcaagcaactggcccaaatcaaagaaatggttgaactgcccctacgtcacccatccctcttcaaagccatcggcgtgaaaccgccgcgtggcatcctcttgtacggcccccccggcacaggaaagaccctcattgcccgagccgtagccaacgaaaccggcgctttcttcttcctgatcaacgggcccgaaatcatgagcaagctcntcttcctgatcaacgggcccgaaatcatgagcaagctcgctggcgagtcggaaagtaacctgagaaaggcctttgaggaagccgacaagaattctccggctatcattttcatcgatgaattggacgccattgctccaaagagagaaaaaacccacggcgaggtcgagagacgtatcgtgtctcagctgttaaccctgatggatggtatgaagaaatcctcccatgttattgtcatggcggctacgaacagacctaattccatcgacgcggctttgagacgctttggacggttcgatagggagatagatatcggtatcccggacgctacaggaagactggagatcttgcgaatccacacgaagaacatga

SEQ ID NO: 1870 - DNA, 663 bp, Sitophilus oryzae
atttagttcccagcttgtgtgaggatttgttatcatctgttgatcagcctttaaaaattgctaaagataaccaaaatggaaaagattatttattgtgtgactacaacagagatggtgattcatacagatctccatggtccaatacatattatccaccactggatgatggtcaaatgccttctgaaagattaagaaaactggaactcgatgccaataatgcctttgatttatatagagaaatgtattttgagggtggtgtaagctcagtttatttttgggatttagatcatggatttgccggtgttattctaatcaagaagactggagatggcagtaaaaaaattaagggatgttgggactctttgcatgttgttgaggttcaggaaaagagttctggtcgtacttctcattataaaatgacatctacggctatgttatggctacaaactaataaaccaggatctggaactatgaatctaggaggaagtttaactagacagacagagcaagatgctgcagttaatgaaaataatcctcatattgctaatataggaaaaatggttgaagacatggaaaataaaattcgaaatacactaaatgagatctattttagcaagactaaagacatagtaaacagcttaagatcagttcagcccttaactg

SEQ ID NO: 1871 - DNA, 783 bp, Sitophilus oryzae
agtagagacacaagccaaaggtgcaaaaggtaaaaaaggtagaactagtactggacctactggagttactaccccaggtagaggaagaccaccagcaactgtgtcatccacagtatcaaatcctgtagctacaacaacaggttctatgggtattcctttgggtaccagcgccccagtcacagttccgggcagtaccgctaccaccaccatagcacaacccaacaatgcccaagtcacgcctattactcctacggggccctcttacgctgctgctcaggccatggacactccagtatccgcgctgggcgtggtacctcctgcccagccggccaagagcaaaaagggcgttaagagaaaggctgatactaccacgccggccacagcttatgattaccttccatctggcgctgattcgaattcctcgtcgtccgcgagcaagatctccaaacgtcgagaatccggtcgccagataaagaagcctctacgtaatcaggagctggacggtttggggccttatggaggttcagcggcggctggtgctgtaccatcaccagcagctcaggccggggcgcacgcgcttaaaaacaaggaaaaactcaatgacacattaaaagcctgcaatgagatactgaaagaactcttttcaaagaaacattgtagttatgcttggcctttctacaaaccggtagatgcggaactgttaggtttacatgactaccacgacattataaagaaacccatggatctcggaacagtgaaggaaaagatggacaatcgcgaata

SEQ ID NO: 1872 - DNA, 683 bp, Sitophilus oryzae
ttggcacagacgtgtaaatatcaaccaacgtcgttttgccctagcagcagccattgctgccagtggcgtcccagctttggtaatgagcaaaggacacgtcgttgaccaagttccagaactcccattggttgtctctgacaaggtacaggaattcaagaaaaccaaggaagcagtgcatttcttgagaaggttgaaagcatggcctgatatacaaaaggtatacaaaagtcagagattccgtgctggtaagggtaaaatgcgtaacaggaggagaattcaacgtagagggccattggttgtttaccatcaagatcaaggtttgcgtagggctttccgtaacatccccggcatcgacctaatcagcgtagaaaaactgaacctgttgaagttggctccaggcggtcacgttggccgtttcgtcatttggaccgaatcggccttcaaaaaattggataaagtcttcgaaaactggaaggcaccatcgacgaagatgtccaataccgatttgtcaagattattcaagtcggaagaaatcagagcagtacttcgtgcaccacaaaagaagattgttcgacgtgtacgtcgtctcaatccattgaataataccagagctctattggctctgaacccatacgctgccgttcttaagagacaagctgtcttggacgacaagaagagaagtt

SEQ ID NO: 1873 - DNA, 683 bp, Sitophilus oryzae
gacgcctgaaagattgaaagatcttgacctcgacgcatttgctgaagaactggaacgtcaaggatttggaaacaagagcattactctatacgacataagagcggaattaaactctagatataaagatttaagaacaccttacagatccgcgaatccagaagagttatttgatatgttaactaaagaaacaccagaaacattttacatcgggaaattagtacaagcttcggtaataggaatcgctaggagaaaaccacaaggcgagcaactggattcagccaatccagtccgtaacgatgaaactggactgtggcaatgtccattctgtttaaagaatgattttccagaattatcggatgtatggaaccactttgatgctggttcttgcccagggcaagctactggggttaaattgagattagacaatggtatttctggctatatttatattaaaaatttaagcgacaaaaccgtttccaatccagaagaacgcgttggaattggacaacttatacactgtagaataatgaaaatagacgtagaacgattctccgtggattgtacatcaaaatcaagtgatttgttagataaaaatcacgaatggagacctcctagggatccatattatgaccaagaacaggaagacaaagataacagaactgaggcagagaagaagaaagaca

SEQ ID NO: 1874 - DNA, 698 bp, Sitophilus oryzae
aaggagtgtggacaaaaactaacagaagtgtctagcagaggtatcaatgcaatttttgaaatgttaagaaacattcttcatgagggacagcttgaaaaaagaatacaatatatgattgaagtaatgtttcaaatcagaaaagatggatttaaagaccatgctgccgtaattgaagaactagatgtggtggaagaagatgatcagtttacgcatctgataaagcttgatgacgtcaaacaagccgattcagacgaaattttaaatgtctttaagtttgacgatgactaccaattaaatgagggaaaatataagattctgagtaaagaaatcttacaaactgatagtgaatctggttccggatcagaagagggaggatcggatgatgaagaggatgatagtgatgacgaagaagaggaaggcgaagaagccaaagtcaaagacactattattgataatacggaaacgaatttgattgtgctgaggagaacgatatacttgactatacagtctagtttggactttgaggagtgtgctcacaagttgctcaagatggagttgaagcctggccaagagattgaactgtgtcatatgttcttggattgctgtgctgaacaaagaacctacgaaaaattctacggacttctcgctcagcgattctgtcaaatcaacaaaacttacgtggaaccgtttcaacaaat

SEQ ID NO: 1875 - DNA, 786 bp, Sitophilus oryzae
accctttgtgctactttaggagaatatccttcagtacgctacagaagtgattgggacaaaaacgtggagttggcacaactaatccagcaaaaactggatgcttacaaagctgatgaacccactatgggagaaggaccagaaaaagccagatctcaactacttattctggataggggttttgactgtgtctctcccctgttacatgaactcacatttcaagctatggcatatgatttgttgaacatccaaaacgacgtctatgagtatgaagcatctgcaggtgttaaaaaagaggtactgctagacgaaaacgacgacatgtgggtggaacttcgccatcagcacatcgctgtcgtttcacagagcgtcacgaaaaatctcaaaaaattcaccgattccaagaggatgaccgccagcgataagcagtccatgaaagacctttctacgatgattaaaaaaatgccacagtaccaaaaggaactgtccaaatacgcgactcatcttcagcttgccgaagactgcatgaagcaatatcagggatatgttgacaagctctgtaaagttgaacaggatttagctatgggaactgatgcagaaggtgagaaaatcaaagaccacatgaggaatattgttccgattttgttggaccccaaaatcaccgatcagtatgataaaatgaggattattgctttgtatgccatgacgaagaacgggattactgaggaaaatcttcaaaaacttgccactcacgcccagatcagtcagaaacagaccattgccaatttg

SEQ ID NO: 1876 - DNA, 678 bp, Sitophilus oryzae
gggaagtcacggatacttacagatgctctatgagttatactcaaagacaaatcaattttctaacgagctcagtgtctataacttggggaatgacaagaactatttaacaaaattaacatctaacatatttacaaagcatattagtgaatatatccaaattgaacttaaatcattaaaagacagatgtgctacaaaccttcagaggtattacgatacaaaaaatcaccagaaaaagcagattcaaagtggaggatttcaagacttaagaagagacttacaagcggttataggtacaagagcaaatataaacatagcccaaatagagaattatggtggggaaacgtttctatctgaagaactagcgattatgatacttcaagacaccaaaaatgctttttctaggtgccaattattatcaaaacctgaagaaagagctggcaatgcttcaaaaattcttaacaccttggtaaatagccttctgatagagcatgtcgactatgctgttgaattagggctccacgctattcctgtggttgagggggctaaaaattcccctgttctttatttctttactgtagttcatcaaagtaacaacattacacatcttgcagaaagacaatttatggatttggtagtcccattagttcataataccccttaccacaatgattgcatcca

SEQ ID NO: 1877 - DNA, 662 bp, Sitophilus oryzae
ggcaattggctttagaaacaatagatttacaaaaagatccttattttatgaaaaaccatttaggctcttatgaatgtaaactatgtttaactttacataataatgaaggaagttatttagcccacactcagggtaaaaagcatcaggccaatttggcaaggagggcagcgaaggaagctaaggatgctccctcattacttcagccagagaagcctagagtagaacctaagaaatttgtaaaaattggtcgtccaggttacagggtgactaaacaaagagatccagaaacaggacaacaaagtttactatttcaaattgattatccagagattagtgaccatgttttaccaaggcataggtttatgtctgcgtacgagcagaaaattgaaccaccagatcgtaaatggcagtatctgctttttgctgcagaaccctatgaaactattgcatttaaggtgcctagcagagaagtggagaaaactgataataaattctggactcattggaacagggatacaaaacagttctttttgcagtttgctttcaaaactgaaaataagaagcagccaactattattaatagacaaacaatgatcactggagtaccaccgcctccaatgctaccagtaccaccaccaccaagacctcctatgttcaatccc

SEQ ID NO: 1878 - DNA, 276 bp, Sitophilus oryzae
ccggtgaagtttatagagggaaactaatcgaagcggaagataacatgaattgccaaatgactcaaataactgtaacttacagagatggtagagttgcacaactagaaaacgtttatattagaggatcgaaaattagatttatgatacttccggatatgttaaagaatgcacctatgtttaaaaaacaaacaaaatcaggtactgcgggacgaggaaagtcgggcattcttcgagcccaagccagaggaaggggtagaggtggacctcctactagag

SEQ ID NO: 1879 - DNA, 664 bp, Sitophilus oryzae
ctcaagtggctccagttaatggtatcgccaattacgatttgaaaaccactactctcactaacaaactggtagttgtagcagcagaaaatgaatccgctttgaccagaatttccgtcacgttcagagctggatcgcgttacgaaaccagcgataatctcggtgctgtacacgttatccgtaccgccgctggattatccacaaaaaacgcatcccagtttgctattatccgtaacatacagcaagttggggctagcctaactgctacagcagaccgtgaaactatctcttatactttggaaggcaccagaaaagctgtagagcaagttttacctttcttgaaagaagtggctactgagcaagtattcaaaccctgggaactatccgaacttggagatcggttaaagattgacttggcagttcgaccattgcagttacgtgcacttgacttacttcacaaagctgcctacagaacagggttgggcaattcccagtttgttcccaaatttcaaataggtaaactttcctgcgaaacattgcaacactacgttgccaataccttcacttcaagcagagcggctgtagttggttttggaatagataattccagtctgacgcagttcgctcagtctttgaacttggagcccaatgaaggtgtctccaatcc

SEQ ID NO: 1880 - DNA, 190 bp, Sitophilus oryzae
agaaaatgaacgtatggcacaggacctctcagacaaaatcggggtgcttaagtctttatcaatagatataggaaacgaagtaaagtatcaagacaggctactcagagatgttgatgatgatatggaacgtacaggaggttttcttggtcgaactatgcaacgagttgttaaactgtctagaggttcacaa

SEQ ID NO: 1881 - DNA, 789 bp, Sitophilus oryzae
ttcaagtattcgaaggcacatcaggcattgacgctaaaaacacactatgtgagttcaccggagatattttgagaactcctgtatcagaagacatgttgggaagagtttttaacggctcaggaaagcctatcgacaaaggacctccaattttggctgaggacttcttggacattcagggacaacccattaacccttggtcgcgtatttacccagaagaaatgatccaaaccggtatctctgctattgatgtcatgaattctattgcccgtggtcagaaaatccccattttctccgctgctggtttacctcacaatgaaattgctgcccagatctgtagacaggctggtctagtaaaagtaccgggaaaatcagtactagacgaccatgaagacaactttgctattgtgtttgctgctatgggtgtcaacatggaaaccgccagattcttcaagcaagatttcgaagagaatggttctatggagaatgtatgcttgttcttgaacttggccaacgatccaactattgaaagaattattacaccgcgtttggctttgacagctgctgaatttttggcctatcaatgcgagaagcacgtactggttatattaactgacatgtcttcctatgctgaagctttgcgtgaagtatccgccgccagagaggaggtacccggacgtcgtggtttccccggttacatgtacaccgatttggccaccatctacgagcgtgctggccgtgtcgagggcaggaacggttccatcacccagattcccatcttgactatgccta

SEQ ID NO: 1882 - DNA, 177 bp, Sitophilus oryzae
agcaatattcaaggaccaggttctagagtttattatgaatattctactggatcatcccgaagacattatggaatacggccaaagctattttaaaaaagtagaagaaaacaggcgtaccaccatagtttatgatttagtcaaagttagcaatgaaaatttaactggaggtggtcaaag

SEQ ID NO: 1883 - DNA, 724 bp, Sitophilus oryzae
agaggaacaacaccaagtttttggctattgtcaccgactgtttgcagattttggcgtttggcaatcaggaaagcaagctgattattctggcttcgcaaggacccattgagctggtcaggataatgaggtcttacaattacgagaagctgttgtggaccacttcaagagttttgaaggttttgtcagtttgctctagcaacaaaccagctatagttgaagcgggcggtatgcaagccctagccatgcacttgggcagtggaagtcagagattggtccaaaactgcctgtggactttaaggaatttgtctgacgctgctacaaaagtcaacggactggacactctcctgtcatccttggtacaagtcttgtcatcgccagatggcaatgtagtcacttgtgctgcaggaattttatcgaatctgacttgtaacaatcagtttaacaaagagactgtttgtcagtatgatggcatttccgcgttggtgaggaccatcgtgaacgctggagatcacgaagaaatcacagaacccgccatatgcgctctcagacatttgacatcgagacacgataaatcagaactcgcacaaaatcaagtcagagttgttggtggtattcccgtaatcgtaagattgctgaaccctccgtctcgctggcctttggtcaaggcagtcattggactgatcagaaacctagctttatgtcctgacaatttcttgcctcttcg

SEQ ID NO: 1884 - DNA, 661 bp, Sitophilus oryzae
ccaactgggagagaatgaaaaagttaaaaagcgacggccctatctcgcatcggaatgcaaaagcctctatgcctgcgagaaatggagactgcagattatcagagagattgcgaaaaaggtggcccagattcagaacgccggcctgggcgagttccgaattcgtgacttgaacgacgaaatcaacaaactgttaagagaaaagcgacattgggaggaccaaattaaggaattgggcggaccagactatcaaaaggtaggacctcgaatgttggaccacgaaggtaaagaggttccaggcaacaggggctacaaatactttggagcagcaaaggaactaccaggtgtaagagaattgttcgaacaagaacctccaccacctcccagaaaaacacgggcagaactgatgaaagatatcgatgcagattactatggttatatggatgacgatgatggcattttaatacctttagaaatcaaagctgaaaagatagctctgcaaaaggtggacgccgaatggaaatctaaaaaagaacaagcaatggaaacagataccccagaagaggaatacgaagaagagaatatctataaagtccatgattctgacgaagagcaagaaaaagaaattgttgatggttcccaacaaagattcgttgcacatgtc

SEQ ID NO: 1885 - DNA, 511 bp, Sitophilus oryzae
cttgactggtgaattcgagaaaaaatatgtagcaactttgggagtcgaagtccatccattggttttccatacgaacagggggcctattagatttaatgtatgggatacagcgggtcaagagaaattcggaggtctccgtgacggatactacatccagggacagtgtgctattgttatgttcgatgttacatctcgtgtaacctacaagaatgtaccgaattggcatagagatttagttagagtttgtgaaaacattcctatcgtattgtgtggaaacaaagtagatattaaggatagaaaagtcaaagccaagagcattgtatttcacagaaagaagaatttacagtattatgatatttctgccaaatcaaactataacttcgaaaaacctttcctatggttggcaagaaaactgattggtgatcctaatcttgaattcgtggccatgcctgctttggtgcccccagaaatccagatggatccccattggcagcaacaaatcgagaaggat

SEQ ID NO: 1886 - DNA, 495 bp, Sitophilus oryzae
  misc_feature (304)..(304): n is a, c, g, or t
gattccaaggcgattttctgggagttggtggaacatggaacttgtacgaagacaaaaactcagatgtggaaatcattgcttcgggtgtattcgtgggatacatggtctacaacatcgtctctcttataagcatgtgttttgcagacagcgaaaacaaaagcacctttacggatattctcatgaacatcgttggtatatttttatgggtggctgtgggagcaacagcccttcactactggcatggttacctggctgaacacaaatatacatacgtcaattccgagagacaggttgggttggcatnaatatacatacgtcaattccgagagacaggttgggttggcattaggatctctatgtgtcctcaacggtgcagcttatctcgtggattcagtcttatcagttattttcattataaaggccaaaatgcaatagtaaacgaatacaaagtgttatacgaacaagttctagtgttaagtagatcatcatccttca

SEQ ID NO: 1887 - DNA, 731 bp, Sitophilus oryzae
gataaaatgcgaaatggccactatgctacatttcgacaacttaaagaatcccatacccaatcaaagtaaacaatctaccaagtcgcaagcacaacagttagcatttttagaagagcatccgtatcaaaattttagaccagatgaactggaactgtcgaaaaaaatgttaaaaaaagaaatggaaattgtcaaaatgggaatgaatcatggtgaattgcccatagaagcgtacactcaagtgtgggaggagtgtttgggtcaagtgttgtttttaccaaatcaaaacagatatactagggccaatttagctaataaaaaagacagattggagtctgcggagaagcgtttggaacagaatcgatcgcatatggccaaagaagccaaacgggctgcaaaaatggagaagaaattgaaaattttaactggaggttatcaatctaaggcccaggtactcattaaacagctccaagatgcttacgagaatattgatcaagctaatttggaattgaacacttttaagtttttgcaagaacaagaaaagaatgctttgcctagaagggtcgagtcattaactgaagacgttgaccgacaaatggaacgagaaaaaggattacaaaagcggtataacgatcttcagaacgaaatcagggaattacaagagcaatacaagtatgtgcaacaggaagtgtacgaggagcaaagccaacaaaacgttgtgacagatgaaactg

SEQ ID NO: 1888 - DNA, 354 bp, Sitophilus oryzae
agaaaatcacgagagagctgattaccacaatattagctcgaaaaccaaagatgtgcagttttcttgaatggagggacctcaaaattgtctataaaagatatgcaagtttgtatttctgttgtgcaatagaacaggatgataatgaactgttaactttggaagttatacatagatatgttgagttgcttgataagtattttggaagtgtgtgcgagttggatataatttttaactttgagaaggcctattttattttggatgaattaatgttaggtggggagattcaggaaaccagtaagaagaatgtattgaaagcaatagctgctcaggatctcttacaagaggaggagacac

SEQ ID NO: 1889 - DNA, 708 bp, Sitophilus oryzae
aggaaattgggaaaactggtgcgtttcaaagcatttctaaagcaacagaggctgtcaagagtgaaatagataccactagtatgcaaggaagggtttatgtcagccccacaaaacttaggaaaagaaaagaaaccacagctgtacagcatcaaaagtattatgagccaaatacagaagcttccggtgtagaattacataaagattcaaagttttaccagtcgtggcaagacttcaaagataacaacccttatgtacataaagttatggactggaaattgaagtatgacgagagtgagaatccactaattcgtgcatctagagctttaactgaaaaagtatcagatgtaatgggaggtttatttcaaaaaacagaactatctgaaactttaacagaaatctgtaaaattgacaatacatttgataccaagcggtttttaaaacagtgtgaaactgatattattcccaatgtacttgaagctatgacaagaggtgacttagaaatattgaaggattggtgccacgaagggccttataatgttttcgcaataccaattaaagaagcctacaaaaaaggttataaaattgagtcaaaaatattagatatagataacgtagatctagtcatgggaaaagttatggaccaaggaccagttttaatcatttcctttacctcgcagcaagttatggtcgtaaaggacttggaaggaa

SEQ ID NO: 1890 - DNA, 660 bp, Sitophilus oryzae
aacttggctagaaagactggatagtgtaaacgatcaggcaccactagcacctgaattagcagcccaaatgttagcccacgaacataaacgtgaaaaccagttgaagaataacaagaaattgccacaattttcacccaccgaagatccagtgttgaatgatttcaaacgagagatgtgctttcatcgtcaggcacaggcaacaattttagaggctattcccaagcttacaaaattgggattacctactagaagaccagaagattactttgctgaaatggctaaaactgacgagcacatgcaaaaaatcagggaacacctaatgcaaaagcaacaacaacaacaaagaagtgaaagagtcaaacaactaagacaacaaaggaaagaaggaaaaatgctacagattcagacaaaactacaacgaatgcaagagaaaaaagaaatgttggaccaagttaaaaagtacaaaaagggtgtttcaaaggacttggacttcttagattccaaaaagaacaccagtagcaaagcaatttctagaaaatctttagagaaacggagacagaaaaataagaagttcgggtttggtggtaagaaaaagggcatgaagctgaacacaaaagacagtgctgctgatataagtgagtacaggaaaccttcaaaggg

SEQ ID NO: 1891 - DNA, 474 bp, Sitophilus oryzae
agaactagagaatcatttgggtatgaatgataaagatttggctgaatttataatatttctatcggagaaaaataatactgtggatacattcaagaaagccctgacagaaaatggagcagagttttcagattcattcgtctcaaatttgcttcgaattattcaacacatgaggcccaaaaccaaagatgcttccagcgaaataaacgatgaagataaaattgaaaaaagctttttagctcaaaaatttccgggccttgctcttccaaacgagccgcaaaaacctctaagtgatgatgaagtggaaaaagatgaagagactaataatgaagaaggtgatattgtagccgatcttatggcacaatttgaagcagatgctccttctgctgttaagaaaactaaatccaaagaaacagaaagggatagacacagatctaggtctcgccatagagataaatcaagatccagatcaaggga

SEQ ID NO: 1892 - DNA, 683 bp, Sitophilus oryzae
tggcgtgggaaatgtatttattaaaaacttggatcggtccattgacaataaggctatgtacgacaccttttctgcatttggtaatattcttagttgcaaagtagctcaagatgaaaatggggcaagcaagggctatggttttgtccattttgaaactgaagaagctgctaagaagtccatagaaaaggttaacggcatgttgttgaatggaaaaaaagtttacgttggacgtttcattccccgtaaagaaagagaaaaggaacttggagaaaaagccaaactctttactaacgtctatgtaaagaattttggagaagacttatctgaagaacaattgcgcaacatgtttgagaagtttggaaaaattactagttacaagatcatgagcaaagatgatgggaaatctaagggatttggatttgttgcatttgagagccctgaagcagcagaagcggctgtggaaaatttgaatggtaaggaaatggtagaaggaaaatctctttatgtaggccgcgctcaaaagaaggctgaacgtcaacaagaactgaagcgtcgctttgaagcactgaaaatagaaagattgaaccgttaccaaggagtcaatctctatgtcaaaaacttggatgacactatcgacgatgaacgtctacgcaaggagttttctccatttggaacgatcactt

SEQ ID NO: 1893 - DNA, 685 bp, Sitophilus oryzae
tttgaaacgtcctcagcatactcaaggactagttcagcacgtgcttagtttggccactcaagattcggacaacccagatctaagagacagaggattcatttactggagattattaagtacggatccagctgcagcaaaagaggtagtcttagctgacaagcctctcatatcagaagaaaccgatcttctcgaaccaacgttgcttgatgaacttatttgccacatttcttctttggccagtgtttaccacaaaccacccactgcttttgtcgaaggcagaagcgcaggtatcagaaagacccttcctgttcgccaagggtcagacgaagctccggctcaggaagctacagtcatacccaatcaggagagccttattggagacttgttatccatggatcttggtgcacctacaattccatccggtcccgcacctaccacagctccgataagtaatgtggatctacttggaggcggattagatgtattgtatggaggcacggaacttagtggtgctcctacagctgctgctccttcaactacagggcttttaggagatatatttggtatcaccacaacaccaactatgtatactccaccaaaaacattatggttaccagctgataaaggtaaaggtttggaaatacggggaactttttcaagaaaatctggacaagtacacatggaa

SEQ ID NO: 1894 - DNA, 351 bp, Sitophilus oryzae
aaatcggtcctttaggtctgtctcctaaaaaagtaggtgacgatattgcaaaaggcacagctgactggaaaggtcttaaaatcactgtacagttgaaaatccaaaatcgtcaagccagcatttcagtagtaccctctgcagcttccctgatcattaaagctcttaaagaaccaccaagggatagaaagaagcagaaaaatattaaacacagtggcaacatttcctttgatgatgttttggctattgcaagacaaatgagaccgcgatccatggctaaagcactgtcaggaacagtaaaagaagttttaggtagtgctcagtctgttggttgtacaattgatggaaaagcgc

SEQ ID NO: 1895 - DNA, 741 bp, Sitophilus oryzae
  misc_feature (492)..(492): n is a, c, g, or t
cagcagagcatttgacaaaagataacaaaccattctttgtattaaactccgacattatttgcgactttccttttaaaaaactaatggacttccacaaagctcacggtaaagaaggtacaatagtagtgacaaaggtagaagaaccttcaaaatatggtgtggtagtgtacgatgaaacaaagtgtatagaaagtttcgttgaaaaaccacaggaattcatttccaataaaattaatgccggtttatacattttaaatcctagtgttattaatcgtatagaattgaaaccaacctctattgagaaagaagtatttccaaatatggcagctgaaaaagaactgtatgctttcgaattacaaggcttttggatggacgttggacagcctaaagatttcttgatagggatgtgtctttacctcaaacatttaagaactacagatccggagagattatacagtggtcctggagttgttggaaatgtcttggtacatnctacagatccggagagattatacagtggtcctggagttgttggaaatgtcttggtacattccactgccaaaattggaaaaagttgtcaaataggacccaatgtcgttattgggcccggtgtagttatcgaggatggtgtatgtataaaaaggagtacaatactggaagatgctactatccgttcaaattcgtggttagaaagctgtattattggatggagatgtatagttggacaatgggttagaatgg

SEQ ID NO: 1896 - DNA, 661 bp, Sitophilus oryzae
ggcgagtttaatgaagtgttcaacgatgtccggaagctcctggacgacgacgacctgctcaaagagggggccagcggggccttcgcccagtacaacaaagatcagctcacgccagtgaggatagataacgccgatcatttagttttgatcaccgaatacaacgatttaggcaataacagattttttgattcccgttccaaacaaagctttcggtacgaccatttaagaaaagaggcttcagactatcaacctttcacgcccgacgcaacagcagagccctggagatcggcacttgacgcggaatttattcagtacacgcgtaatcactataaagacggagtcagtttggtggtaggccgtagtgagggaaacacgataactttagctgcctgtattgaggaccatcagttccaacctaagaatttctggaatggtagatggcgtagtcaatggtatatttcactaaatggtacctctacagctgagttaaggggcgttttaaaggtgcaggtgcactattacgaagagggtaacgtccagctagttagtactaaggaaattaaggaaactataactgtttcgtcggaaacgcagactgcaaaggaaattgtgtgggctatcgagaatgcggaggactcctatcaaactgctatttcggtga

SEQ ID NO: 1897 - DNA, 652 bp, Sitophilus oryzae
atccccacattgtaaccttcgacgatttggagtacacgtttaatggaaaaggagaatttgttttgataaagtccaacgccagactagataacattgaagttcagggccgatttgaacagatggatcctaacctatatggtgaagttagagcgactcaactgacatctgtagtagcaagaggcaattcttctactgtggtagaagttaggagaagaccagaatacgcaagatggagatacagactagatgttataacagatggaaaaagggtttactttgacagaccgtccttaaaattccaacattttcctggtgtgaccgtttatactccgacctacattttgaatcagtctgaagtgattatgatgtttgacaatggagttggagtggaggtcttggacaatcaaggttatatgacagccagagtatatctgccatggtcattcattaacaaaaccgccggtctacttggaaattggagttttaataaagaagacgattttactttacccgatggctctagagtaagcgtagtttcaaatatcaacgacatgcagagagtatacaccgattttggatcaaaatggatgatagatgatgtattagattcacagaaaggcagagcactattccttcgagaaaatggcttgac

SEQ ID NO: 1898 - DNA, 233 bp, Sitophilus oryzae
ggatcattgcgacattgaaaaaattcttggctcggtaggaattgaagctgatggagaaaaactgaaaagggttatttcagaactaaatggaaaatctattgacgaattaattgcacaaggtcgggagaaactgagctcaattccagctggtggtggtggagctgctccagctgcagctgcaggaggtgctgcaccagctgctgaagaaaagaaagatgccaagaaagaggaag

SEQ ID NO: 1899 - DNA, 794 bp, Sitophilus oryzae
gaatgaagcagacacattggaacgtaccgcagcggcaatcagaggccgtactgggcgtattgctgttgtggtcgcggcggaaatggataattatgagccttgtatttacacgaaacgagttttggaggcagtgaaggtgctgaatgatcaggtgatgcctaaattcacacagagggtccaggtggcagttcaaacaattttgagtggccagcaaggacaacctgcgaaagaactggatgaaaacgaatttattgacgcttcccgtctggtctacgatggtgtgcgtgaaattcgtcgtgccgtacttatgaatcgggccgacgaagacttagaccctgaagatgtggagcttgatgaaaattacacattagaaaccaagagcaaatcaagtgcccatacaggagaacataacgtggatgaatatccggagataagcggtataacgacagctcgcgaagccatgggcaagatgcctgaggaagataaacagaagatcctccaacaggtggaatatttcaggagcgagaagctgaagtttgacagggaagtggccaagtgggacgacacgggcaacgacatcatcgttctggcgaaacacatgtgcgtcatcatgatggagatgaccgacttcaccagaggtcgcggcccgttaaaaaccacaatggatgtcatcaacgcggcgaaaaagatatccgaagccggcacaaagctggataaactcacccggcaaatcgcagaccagtgtccagaaagctcaacgaagaaagatttgttggcgtatttgcaacgtatag

SEQ ID NO: 1900 - DNA, 665 bp, Sitophilus oryzae
caccatcgcctattacttcaacaggaccctcgacaggtcttcagtttaattttgggggtgcgtcaacaactcctgcaaatgctaatacatctttgacaaccagttttactccaattttagctccagccagtgcagctactaatacaggtattacattcggtacaccagcagcaacagttggtgcttctacagctacatttggtgcaccaacaacgacatttggtgcaccaacaacgacatttggtgcgccaaccactacatttggtgctccaacaacaacatttggtgcaccaacaacgacatttggtgtcccaacaacaacaacaactgcagtagttttgggtcaaactacatcagtagctcctgttacaacttctgctcctagttttcctagtagatctatagcagcatctaatgtagccccgacagtaactacaaccacgacaacatcaattccagcaacaggatctttaacttttgttcaactggaagatctaatcaataaatggacgattgatttagaagagcaaggaaagtattttgttaatcaggctaaacagttaaatgcctgggacactttgttgatttccaatggtgaaaaaattttaaacttaaacagcagcattgaaagagttaaacagcagcaatcgcagctagatcaagag

SEQ ID NO: 1901 - DNA, 494 bp, Sitophilus oryzae
  misc_feature (474)..(474): n is a, c, g, or t
aggcaaaaccactttattgcatatgctgaaggatgatcgacttgctgtacatcttcccacacttcatcccacatccgaagaactctcaattggcaacatgaggtttaccacatttgatttaggtggacacgttcaagcaagaagagtatggaaagattacttcccagctgttgatgccatagtattcctagttgatgcaagcgatagaatgaggttcgacgagagtagacaagaactaatatccttgctgacagatgaaagtttggcaaactgccctgtattgattttgggtaacaagattgatttgccagttgcagcttctgaagacgaactcagaaatgtatttgcattgtttggccaaacaacaggaaagggtaaagtaccaaggtccgatttacccggtcgtcccctagaattgttcatgtgctccatcctccagagacagggatacggagaaggttttcgctggttggntgttcatgtgctccatcctc

SEQ ID NO: 1902 - DNA, 474 bp, Sitophilus oryzae
aattcagatatggatgccgttgacttattagagaaacgtatagaagctttggaactgcaaatattgccaaaagacaaatcagttctcagtaacaaatctcaaaccattgccgatcttttaactgaaacccaaacaatgatatcttcagctcttagctgcagagaatcggttacatcgctcttacaacatatgcacacaatcaatgagtatctcgacccatcgagtggtgaatatgatttagaagctgatataaaaaagcagtatttgttgcagatatatccagagttaaaggcaagagttgaactcattaaaacgttcaacaatctcattcagtttactaattcggaaagtcttcaaaaagttactgaattatcaggtaaattacaaactttggctggttcaaacgtggaaatttatgaagaatgtaaagaggttaacgaaaatgtcctcaaagccttacaggagtacaataat

SEQ ID NO: 1903 - DNA, 655 bp, Sitophilus oryzae
ggagaaggcatttaaggacaccataagctatttatctcatccgtcagttcgttacgaaccatttgacttccacgccgaatgtcgaaaaatgaaatggcacagactatccatattgacagatagagttgctttagatcaggatgatatgagttatttcctaattctttctgatggaacattttcttctttgcaagaaggggtgttccgaacaaattgcattgactgtttggatagaaccaatgttgttcagagcatgttggctcataggaacttagagattgtattgaggaaatttacgatcttgagctatgatcagaagttagaagattatcggacttttgagtcattgtttaagaacgtatgggctgatcatgctgatttgattagtatacagtattcaggcactggggctttaaaaacggattttaccagaaccggtaaaaggacgaaatcgggcatgatccaagatggtatcaactcgctgatccggtattacaagaacaactttaacgacggctccagacaagactctatagatttgtttctgggtaatggaaaggtggtatctcctttggccccaccccctggttggagatacattaccttcccttctgttttgctagtggccacagcaatgtttgtcgcttctgtcata

SEQ ID NO: 1904 - DNA, 767 bp, Sitophilus oryzae
tttcctacccttttgagtcgtccaggtttattcagtacaatcctacatctttagaaagaaactaccgctatgaagtgttaacagaacatgatctaggcgttagtatcgacttaatcaataaagatatatatgccgtcgatcacggggctactttagacccggcagatgagaaattactggaagaagacatcctgacgccacaggattcgaaaagatcccggcaccatgcaaaatctgtgtcctggttgcgtagaactgaatatatttcgacggaacagaccaggttccagcctcaaactatggacaaagtcgaggcaaaggttggatttagtattaagaagtcatttaatagtgaaacactttatatggaccgtgattctcaaatcgaagctatcgagaaaacattttccgatacaaaggtgcctattgaaaagcattatagtaagccaaatgttacgcctgttgaagttttgcctctgtatcctgactttaacttgtggaaatatccttgtgctcaggtcatatttgattctgatcctgctccagtaggaaagcaggttccagctcagattgaagaaatgtcacaagcaatgattcgaggtgtgatggatgaaagcggtgaacaattcgttgcatacttcttaccaactgaggaaacattgactaaacgtagagaagactttgctaataatgtaacgtatcgggatgatgaagaatacgaatataaaatggctagagaatacaactggaatgtcaaaagcaaagct

SEQ ID NO: 1905 - DNA, 781 bp, Sitophilus oryzae
gacaaaacagtccatgcaaaaatcaccgaagctataaaaaaagatgatatggctccttggtatgagttaatttgtcaagaaattggctggaaattggacgagaaattgttgaaaaccatcaaagcgaagaacgatgaacaagtgaagaaactaaacgaagctattgaggatgcagagaaaaatcttggcgaaatggaagtaagagaagcttatttaagaaaagcagagtattacagtagaatcggcgacaaagaaaacgctttaagcaccttcagacaaacatacgacaaaacagtctctctaggacatcgtttagacattattttccatttaatcagaatcgggttgttttttatggatcatgatgttatcacaaggaatattgataaagcaaaaactcttattgaggaaggaggcgattgggacagaaggaatcggttaaaagtatatcaaggagcttactgtatggctgtaagagattttaaaaccgcctcaaacttgttcttagatactgtcagtacttttacttcgtatgaacttatggattataaagcatttgttaggtacactgtgtatacttcgattataagtttacctcgtaatcagttaagggataaggttgtaaaaggctcagaaatattggaagttctacattctgaaccatttgtgaaagattatttgttctcactgtataattgtcaatatgcagagttttttggaaatctcgcaaaagttgaagaagttcttaggaaagattattttctaaatccccactatcggt

SEQ ID NO: 1906 - DNA, 731 bp, Sitophilus oryzae
aaaaacacggagttggaaacgttgggagatgagggagaattgtcacaaaccctgggaagcacggaaagctccaaagatgccaaagatgaacttagtgatattttaggacctcactttagcttggagtccatacaaaacattaacagcaaagacgttgaagacattttcaagggcgttttaactgacgagtcgcaagaatcgcaactgtcccaagaaactaacatatttcctcctatacaatcaagtacgcaggcgatgttcgccggaagcatgtcgcagccttcgcccgtttcgattccgcaaatgccacaaattacgtctggcgctgtgcgtccaaccgctttaccgggtgtacaacacgccagttttcctccatctccatatcactctgagtatagcaatagtccacaatttagtccagccttttccgaaccgcctagtccttgggtgagcatgagcgagggtgttgaaattgacagtaccagtgttggagtagcatccacgtataatcaacggtcgtcggagaaaatgaaagccgacgaagctctaggtagtggagccaccatatcagcggtactctacgccaacatgaatcatcccgaatggaagactgaatatcctgcgtggtctgacagatataaacaattaattaaaaaatggcgtactctaagtcaagaacaaaaggcaccttatcttcagcaagccagagacaatcgaagccagttgagaat

SEQ ID NO: 1907 - DNA, 321 bp, Sitophilus oryzae
gagttggtgcaagtttgaagtaaattgtgtagtaaaaaatattgttaaagtcgatgaacagttagaaagaccgccattagttgtgtccgctttaaactttcgtcattatcgaaatcctagaacgcaccagaatgagattttgatgatatcttgtattactcaaactaaatattctgtggataagcaacaacctaagccaccttttaatgaacatttttgtgtttttacatctccagccaaacagccccttccaatgaacatttacgagtgcctaaaaacttataaaggaaccaaagtacaaaaaatggactccgaaaaagc

SEQ ID NO: 1908 - DNA, 714 bp, Sitophilus oryzae
attgaaagaccagctacaggtgtaggtaccaaagttggaaaattgatcctaaaaacgactgacatggagacagtatatgatcttggtggaaaaatgattgacagtattttgaaagaaaaagttcagtctggtgatgtaataactattgataaagccacaggcaaaatcacccgcctgggaagatcatttgcgagagctcgtgattatgatgcaacaggacagcaaacaagatttgtgcagtgtccagagggtgagcttcaaaaaaggagagaggttgtacatactgttactttacatgaaattgatgtaattaatagtagaactcatggtttcttggctctattttctggtgatacaggagaaattaaaccagaggttagagagcagattaatggcaaagtggctgaatggagggaagagggaaaagcagaaattataccaggtgttttatttatagatgaggttcatatgttagacattgaatgtttttctttcctaaacagagcgttagagaatgaaatggcgcctatagtaataatggctacaaatcgtggtattactaaaatcagaggaactaattacaaatcgcctcatggtattccattggatctgcttgatagaactataatagtccctaccacaccttatgatgagaaagaacttaaagaaattcttagtattcgttgtgaggaagaggattgccaaatgtcagat

SEQ ID NO: 1909 - DNA, 741 bp, Sitophilus oryzae
cagcattgtcttgcaagtagtgtctctttacttagagctacagaagtagaggatattatagaagggaacgatgacaaatataaggctgtttcggttcataccagtgatcctcctctaccacgcgaaggtaagagcaaaaagaatttgcaatgggttccatccttaccaaattcaagtcatttggatgcagttcctcaagcgacacctattaaccgtaatagagttgctgccaaaaaagtaagaacatttccgctatgctttgatgatacagatccacagctaaatcaagagaatggttgtcagcacgaattgcttgttccaattcgacttgatatggaaattgaaggtcaaaaactaagagatacttttacgtggaataaaaatgaaagtctcataacaccagaacaatttgctgagattttgtgtgatgatttagatctgaatcctcttacttttgtgccagcgatagctcaagctatccgtcaacaactggaagcttttcctaacgaacctcctagtattatagaagagaattctgatcaaagagttattgtgaaattaaatatccatgttgggaatacatcattagttgatcaagttgaatgggatatgagtgagaaacaaaacaatcctgaagattttgctctgaaattatgttcagaattaggtctaggaggtgaatttgttacagctattgcatattctataagggggcaactaagctggcatcaaagaacttac

SEQ ID NO: 1910 - DNA, 583 bp, Sitophilus oryzae
cgaaagaaattggtgatcgtgggcgacggtgcatgcgggaaaacttgcctgctgattgtttttagcaaggaccaatttccagaagtgtacgtgccaaccgttttcgagaactatgtggccgatatcgaagtcgacggaaaacaagtcgaattggccctatgggatacagcaggacaggaagactacgaccgtctgcgtcccttatcctatccagataccgacgtgatccttatgtgcttctctgtggattctccagactcgcttgaaaatatcccggacttatcctatccagataccgacgtgatccttatgtgcttctctgtggattctccagactcgcttgaaaatatcccggaaaaatggactccggaagtgaaacatttctgtccgaacgtccctatcattctggtaggtaataagaaagatttacgtaacgaccccacaactataaacgagctaagaaagatgaaacaggagcctgtcaagcctcaggacggtcgttcgatggcagagaaaattaacgcctttgcttatctcgagtgctcagctaaaagtaaggaaggtgtgagggaagtgtttgaaa

SEQ ID NO: 1911 - DNA, 656 bp, Sitophilus oryzae
ggtttggaaaacgctgtaaaatgattaatctttccacaagtgcattatcatttttggtaccttcatttttgaatgctgctcttagcgaagaagacagtatcgttcaaattgctattgatgacagcagaaatataatgtatactttaacagaaaagggatcaattgaagtatgtgatttaggagagaaatgcaacactttctcaaggattagtaaaatgacacagaacactttagttactcaagcaatgaatactgtcaagacattagatagtcaaaattttagaccaatcattagtatttctccgattgagtcttatgaatctgcaaacctaaatcttgtagctgtcactcaaacaggtgttagattttatctatcagttgtaggattatctaatcaacagcctaatcagaggccttatacattaactttagctcatgttagattgccaccaggttattcagccaatgttactgttaggccaagaagtgttcatatgagtcactacagagacagaaacttgattttaatatccaatgtaaaagataaggatgttttgtggtgtttaagttctgacttatttcccttcagtcagtctttaatggaagcttatactacagttaatttagatggcccagctctagctttagcagaggtg

SEQ ID NO: 1912 - DNA, 257 bp, Sitophilus oryzae
ataacattacacacagggggcacccagagcacattgcaggacataaaaatcaccgaacgagctaatgggtacagttacttagattccacaagacattatacaagaaatcggtttatatattggcgaattagctcggataccttggagctaattgagcagagtttagatataaaccttacgggaaacactgtgaggtacaggtttatggatagtccgataattgatggtatttcagtacaagaaactgaagaaaacgt

SEQ ID NO: 1913 - DNA, 650 bp, Sitophilus oryzae
  misc_feature (425)..(425): n is a, c, g, or t
agacagcaacaatcaagctatagtttcaggaggtcatattcaaccgtttgccaaggatttgattagtcaattattggaggtgttggagagacctgtatcagaggaaaatgaatatattatgaaagctttaatgaggacattttcgactctacaagaactggttataccctacttgggcgtggcattaccgaaacttactgaaatacttaaagctgttacgaagaacccatctcggccacatttcaatcattacttgtttgaaacgttctccctttcagtcagaatcgtatgtaaatctaatcaggctgctgtaaaatcgtttgaggacattttgtttccgattttccaaggaatcttgcaacaagatgtacaagagttcatcccctacgtcttccaagtattatcaatgctattggattacaccntacaagagttcatcccctacgtcttccaagtattatcaatgctattggattacaccccttcaggatcgttatctgatgcatacatgcaacttttaccatgtttgttggcccctgtactttgggaacgacctgctaacatcagcccgttagtacgattgttacggtcgttggtaagccaggcggcccaacagattattgctcaggataaattgcctggctttttgg

SEQ ID NO: 1914 - DNA, 508 bp, Sitophilus oryzae
acatttgaatgcattgaggaacttaaagaagatttggagtggaaaatgatttatgttggatctgctgaatctgaagaatacgatcaaattttggattcggtatttgttggacctataccagagggcaagcacatgtttgtttttcaagctgatccaccaaatgtctcaagaataccagaaaatgatgccttaggagttacagttgtattactaacatgttcataccgtgctcaagtactaacatgttcataccgtgctcaagaatttatacgagttggttactttataaacaatgagtataatgatccagagttacgagaaaatttgccaagtccacctcaatttgataaagttacgagaaatattctggcatctgaacctagagtgacaaggtttaaaattaactgggaggagcctaatgcacaagaagttgtgtcaaatttagagaatacagaaaatagttcgattacgactgaacaaagtaataatgcaactcaatcccaaattc

SEQ ID NO: 1915 - DNA, 670 bp, Sitophilus oryzae
accaaatgcattacaacagcaacaacagtcccaacctgccaccagtcaagtaccatctttagctccgatgggaggtctaacgcccacattaggcctgggcatgggaaatgccatgtccatgccacacacaaaatacgttacagcttatcaaatgcctatgtccactatgcatagtggaatgacccctcaaacaccacagcacactatgatgtcacctatggtaaacttgggtggttcggggggtagtggtgccactccaaatgttggcggccctgctactccttctcctatgactccgatgactccacattccgcagacccaggaattgtaccacaattacaaaatattgtatcaactgtaaacttaaactgtaaattagacttaaaaaaaattgcgttgcatgctaggaatgcagagtacaatccgaaacgttttgccgcagtcattatgagaattagggagcctagaactacagcactgatatttagttcgggcaagatggtgtgtacaggggcgaaaagtgaagaggattctagattggcggctagaaagtatgctagaataatacaaaagcttggattcccagcgaaatttctggattttaaaatacagaacatggtaggcagttgtgacgtcaagtttcccatccgtctagagggcttggtattg

SEQ ID NO: 1916 - DNA, 337 bp, Sitophilus oryzae
acttttgcctcaggaaatcaaatattttatgatggaaaaagcgttaaacaagtagatgtcccttcgttttctggtagttttggtatcctacccaaacatgttccaactttggcagttttaagaccaggagtcgtgtctgtatatgaaaacgaaggagctgttaagaagatctttgtatccagtgggactgtcacaattaatgatgattcctctgtacaaattatcgcagaggaagctcatcctgttgaaaatatagatctatcagctgccagagatcttttaagtaaagctcagagtcaattgtcttcagcagccaatgatcaggctaaggctgaag

SEQ ID NO: 1917 - DNA, 788 bp, Sitophilus oryzae
ggatttctcggtcgaaaaactgatttcttcaccgggggaaatgaaggggattgggaaaaacttgtcatgaatacatttaaaaaacacgaaaagatcagccgttctcggcacgacgctgaagtaaaggagcgtaaagatagagaagccgctaaaaaagcgaaaaaggctgaagcggaagctgtaaaaccagcagaaattactgaattgacagatgaagaagctgaccgtcttcagaaagagattgataagaaaaagggaattgatgctgtcccttctgtgataaacaacgaagaatctaatccttccacgtctgcaagttctgcagagaaaattgaagaggacgaagatgagtccgagaagggaaaattaaaacctaataaaggaaatgggtgtgatttggagaggtataaatggacacagactctgcaggatattgagctccgagtgcccctagaaatcaactttagagcgaaacaaaaagatctggtagtcaatcttgccaagaaacacttgacgtgcggcgtcaagggtcagccaccaatcatagacgacgacttacaacacgagatcaagctggaagagtccacgtgggtcatcgaggatggaaaggttttattatttaatttagaaaaggtaaacaaaatgaattggtggggaaaactggtacagtccgatccagaaattagcacgaagaaaatcaatcctgaaccttcgaaactgagcgatttggatggtgaaacccggggtatggtagagaaaatgatgtacgatcagcgacagaaagagat

SEQ ID NO: 1918 - DNA, 316 bp, Sitophilus oryzae
tggatttgtatctatcccgcttacataaacagcaaaaaatccatcgccgagggtaggaggattgcaaaaagtagggcagttgaaaatccaacttatcaggagatacgagatgttttagttgcttcaggattaaatgttggcgtggaaaacaagcaatatagtcgcgaacgcagcaaagaacttctatgcaggggtagaatcagggtacagttaaaacacgacgatggttcactctacaactcctcatttcctaccagagacagtgtattgttgcatttgggtgacatgataccgaaactgaagacccgacttagta

SEQ ID NO: 1919 - DNA, 741 bp, Sitophilus oryzae
agtgtataaggcctgtttggagctactcccccataaaatatttactttttctaaaatctggttgttattcgcaaagtttgaaataagacagaaaaatttaacagcagctcgaaaaatattgggcacttccattggattgtgtcctagagataaactgtttcggggatatattgatttagaaatacaacttcgagaatttgatcgcagtagaaaactttatgaaaaatttttagaatttggaccagagaactgcgtgacttggatgaaattcgccgaacttgaaactcttttgggtgatattgacagagccagagcgatttacgaactggcagtaaatcaacctaggttagatatgccagaacttttatggaaagcatttatcgattttgaaatatcccaagatgaatcagataatgccagacaattgtatgaaagacttctagagaggaccactcatgtcaaggtgtggctatcatatgctaaatttgaattaaatcaacaaacggatgatggtttaaatattaggcttgctcgaagaatttttgaaagaggcaatgacaatctgaaaaattcagtagagaaagaaagcagagctcttttactggaaaactggaaggaatttgagctcaaccatggcgatgagtcttcccaagcaacaataaatagtaaattgcctaagagaattaagcgtagacaaaaagttgtcgatgaggatggtaatgaacaaggttgggaagagat

SEQ ID NO: 1920 - DNA, 657 bp, Sitophilus oryzae
caggacaaaattagggctcttagagaagctttctaccgacaaaatttaccaaacttgatgaaccttcttgctacagttttggtgttcgctatagtgatatacttccaaggatttagggtggatttgccaatcaaaagcgctagatacagggggcagtattctagctaccctatcaagctgttttatacatcaaatattccgattattcttcagtctgcgttggtgtcgaacttgtacgtaatttcacagatgttggctgttaaatttcaaggaaatatcctcattaatttgttgggagtttgggccgatgttgggggtggtgggccagctagatcttaccctataggaggtctgtgttattatctatcacctcctgagagtgtaggacatatactggaggaccctcttcatgctttgttatatattattttcatgctgggatcttgtgcgttcttctcaaaaacctggattgaagtatcaggaagttcagctaaagacgtagccaaacagctgaaggaacagcaaatggttatgcgaggacaccgagataactcaatgattcacgaattaaacagatacatccctactgcagcggcgtttggggggttgtgtatcggagccctgtcggtcttagctgactttttgggtgctataggg

SEQ ID NO: 1921 - DNA, 370 bp, Sitophilus oryzae
atttcaaaggtacacgagctgagcaggacaaattattaaggctctccactacactctatgtagggaacttatcgttctttacaaccgaagaacaaatttatgaactattttcaaagtgtggagatataagaaggattattatgggtttggataaatataaaaaaactccttgtggtttttgttttgtagaatattacactaggcctgatgctgaaaattgtttaaggtatgtaaatgggacacgtcttgatgatagaattgttaggacagattgggatgctggatttattgaaggacgtcaatatggtagaggaaaaactggtggacaagtaagggatgaatacagaacagactatgatgcaggaagagg

SEQ ID NO: 1922 - DNA, 789 bp, Sitophilus oryzae
ggccttgtttgagtcagataagctcctattccacgacgagagaatggtcgagaggcaaaaaagcacttttgggaagtttaggtgtaattgctgggggagccggagccttaatcatagctctggataagtcagtacgagcttcagaactcatactgcatcctcccaagaatccatggagtcataacggctggttcaatggtttagatcatgcgagtgtgagacgtggttatgaagtttataaacaagtatgtgctgcgtgtcactctttacgttatgttgcttaccgtgacttggttggtgttacacacactgaagaagaggctaaagctgaagctgaggaacagttagtgacagatggcccagatgaggcaggaaatatgttccaaaggccaggaaagttgtcagactacttccctagtccttatcctaatgaagaagcagccagggcagccaataacggtgcttttcccccagatttgtcttacattgtacctgccagacatggaggtgaagattatatatttgctctacttactggatattatgatgctccagcgggtgttgttttgagagaaggtcaatactacaatccctatttccctggcccctatttccctggcggtgctatttctatggcacaagctttatacaatgaagttatagaatatgctgatggtactccagccactgccagtcaactagctaaggacataggaacgttcttaaaatggaccgccgagcctgaattagaagaccgaaaaataatgacgattcgggccattggtatat

SEQ ID NO: 1923 - DNA, 728 bp, Sitophilus oryzae
ctctgggaagtttacaacgaaaggcgatgtatcaggacttattatggccacagacaagcagttagagatattaacttcaataatagtggacatcatttcctatcagctggttacgatagatatatcaagttatgggacactgaaactggacgtgttatatcgcgatttactagtagaaaaataccttactgcgtaaaattcaatcccgatcataataagcagcatctgtttgtagctggtacgtctgacaagaaaattatttgttgggatacaagatcaggcgatattgttcaagaatatgataggcatttgggcgctgtaaataccataacttttgttgacgaaaacagacgttttgttactacttccgatgacaaatcattaagagtgtgggaatggaatataccagttgatatgaaatatattgctgatccgactatgcacagtatgccagctgtaactccaagtccaaatggtaaatggttagcatgtcagagtatggacaataaaattgtgattttttctgcattaaatagatttaaactaaacaggaaaaaaacatttacaggtcatatggtagcaggatatgcctgccaattagatttctcacctgatctttcgtatttggtctcaggagatgctgacggaaaatgttttatatgggactggaaaaccaccaaattgtacaaaaaatggaaggcacatgatggtgtgtgtattggttctct

SEQ ID NO: 1924 - DNA, 659 bp, Sitophilus oryzae
ccctggttgttaagaaggttgagcccaaaaaggaggtaaaccctctttttgaaaagagaccaaggaactttggaattggtcaggatattcaaccatctcgcgatctctccagatttgtaaaatggcccaagtacatcagaattcagagacagaaagcagtgcttcagaaaagattaaaggttcctccaccaatcaaccagttcacacagaccttagataagcaaacagcaacacagttgtttaaaatattggaaaaatacagaccagaaagcattattcaaaggaatgaaaggtttaaagctatagtcgactcgaggaaacaggataaggaatatgttcctagcaagcgcttgtttgtacgttttggcacaaacaccgtaacaaaactggttgaacagaaaaaggcacaactggtagtcattgcgcatgacgtcgacccaattgagttggtcctgttccttccagccctctgcagaaagatgggagtaccatactgtatagtaaagggaaaagctcgtttaggcgtgctggtcaggcgcaagacctgctcgaccgtcgctctgacccaggtggattccggcgaccggtcctccttcaacaaggtggtggaggcgatcaagaccaacttcaacgaccgcggcgacgagatcagaaggcac

SEQ ID NO: 1925 - DNA, 651 bp, Sitophilus oryzae
cagtgaaccagtacaaggaaaagataaaattgttgaatatataaaacaatgtcaggatccacaaagtggaggaattagtgcatgcattgggcatgaccctcatatacttcataccttaagcgcaattcaaattttagtcatgtacgatagactagctgcaatagatattgaaggcgtagtccggtatattcaaggacttcaacaagctgatggtagttttgctggagataaatggggtgaaatagataccagattttcattctgtgctgttaatgcactgtctttactgaagaaaatggatgtaatagatattgaaaaggctgttgaatttgtagcaagttgtaaaaactttgatggtggttttggatcaagacccttatctgaaagtcatgctggtttaatatattgctgtgtaggatttttatctattactaatagattagatataatagatcaagatacattagcttggtggttatgtgaaagacaattaccatcagggggattaaatggcagacctgaaaaattaccagatgtctgttattcatggtgggttctttcttcgttagctatattaggcagattacattggatagacactgaagctttaaaaacctttatatttgcatgtcaggatacagaaacaggagg

SEQ ID NO: 1926 - DNA, 752 bp, Sitophilus oryzae
tggaggtgttcaagaagatgctattatggctgtttctactttaacagaggttttaggagatggtttcttaaaatacatggacgctttcaagccgattttatatcttggcctgaaaaatcaccaagagtatcaagtttgtggcactgcagtgggtcttactggtgacatcttcagggcgttaaaaattaaggccttgccttattgcgatgagatcatgacacttttgttagaaaatcttggggagcctaccgttcatcggagtgtaaagccacagatcctctcagtttttggtgatattgctctgagcataggaaccgaatttaaaaaatatttagacatagttttagctactctagcccaagcatcccaagcgcaggtaaaggttgatcgtaccgactacgatatgattgactacctaaatgaattgagagagggcgttctagatgcttacactgggctcattcaaggtttaaaaggcgacagtaacactccttctggcgacatttccctcttagaaccccacataccgttcattatccagtttatcacagttgttgctcaagattctgagcattctgatggcaccatggccgtagctgcaggcattattggtgatttatgtgtatgttttggagcacccatgctccctctgctagatttggaaccgatcaatgagatgttgtctcaaggtagaagatcgagggttcaacgcacaaaaggcctgtgtaattgggcaactaaagaactgagga

SEQ ID NO: 1927 - DNA, 671 bp, Sitophilus oryzae
agttagcttctctgggtttggacaggttgaagtcagccttgttggccttgggacttaaatgtggagggacactggaagaaagggctcaaagattattctctactaaagggcagagttctttggatccatctctaatgacaaaatcaactaaaggaaaagctagtaaggacaaggaacttttgcgtcatagagagttggctatgttagaagcccagatctataagttagctgatattgtcagtcctcaaagaggggcaaccaaagagaacgtgcaacgcaaacaagcaagaaccgacggagaaagagacgacagcgaaaacgaagagtccgaagatgacagtcccgatgaaaatgacgatgacgtcccttacaatcccaaaaaccttcctttgggttgggacggaaaacctataccatactggttatacaaattgcatggtctaaacataagttacaactgtgaaatttgcggaaattacgtgtacaagggtcccaaagcgttccagaggcattttgctgagtggagacacgcccacgggatgaggtgtctggggataccaaacaccgcccattttgctaatgtcacgcaaatcgaagatgctcttgcactgtgggaaaaactgaaagttcaaaaacaggcggaaaggtggcagcctgaaactgaagaagag

SEQ ID NO: 1928 - DNA, 496 bp, Sitophilus oryzae
aattacgcttcaggactctcggacgtttatcggtactttcaaagccttcgacaaacacatgaacatgattttgggagattgcgaggagtttcgcaaagtaaaaccgaaaaattccaaagtagaacgggaagagaagagagtactagggttcgtacttcttcgaggggaaagcattgtttccttgaccgttgaaggcccacctccacccgaggaaggtttgccaagagtaccgattcctggagcaactcctggaccaggaatggggagagcagccggccgtggtatgcctgcaggcatgagcggagtccctgtagggcttcaagggcctgttaggggtgtcggtggaccctcgcagcaagtaatgactccgggaggaagaggtcaagtatcagcgccacctcaaatgaatcacggcccacctagaatgggtattccaccacccggcatgatggggggtcccccaccaggcatgatgccacctaacgctatgggtatg

SEQ ID NO: 1929 - DNA, 685 bp, Sitophilus oryzae
tcagactaattgttcggcaaacttgtgtggcagtatggaataaaatgcagccgttggaaatgccacagcccgatgcggaattgtggacgaaaatagcagaagaattttacagaaaaagtaattttcccaattgtttgggagccatcgacggcaagcatatcagacttgtttgccctccgaatacagggacgcagtattttaactacaaaaaatatttctcgattgttttattggcagtaagcgatgcagattattgctttaccgcaattgacgtgggagcttacggcagagaagcagatagtaatattttcaaatcttcagttttcggtcgaaggttggcacaaaagaatcttgatctaccaggaaacagaccgcttccaaacaccccaaatatttcactccctcatgtttttgtagctgatgaagcatttggtttaggtgaaaacgtgatgagaccttatgcacggaataatctgtcaattgaaaagagagtatttaattatcgattaactcgagctcgcagatatgttgaatgtacttttggtatactcgccaacaagtggagagtatttcacacaaatatactggtttcggaagattttgccactgacgtaacaaaagctgcttgtttgttacacaattttgtacgaagaagagatggagttgaatcaaacgacgaatcgag

SEQ ID NO: 1930 - DNA, 436 bp, Sitophilus oryzae
atcaagatgcaactaccgaaccttctacggagcccgaagacgaagagctgacacaaccttttgaagaatctgaagtagttgttatagatcaacctgttaagtcaccagaggagcaaatatcaacaaaagaggactttgaagaattaatagacgaaggttcgaggaaagaaaaactaatgaaacctgatcctaaacaaattgcagattttcacaaatacgcagcaccgacaaacgtgttcagttttccacctaaagcgcaggccacaattagacccgctaatgttattggaccgaatacgaaaatgcctcagaaaatttcgctcattactaccccgatcatacagaattttacaaatagatctgacggttcgaagccaactttggaaacccaacaattaattttaacacctacaacaaaaataaacaccacagcagc

SEQ ID NO: 1931 - DNA, 720 bp, Diabrotica virgifera
gcagaggagaagagaatgaggcggctcgtaaagaaggagaacaaagagagatccaggaaagagagaatgggctgggataacgagtatttacattatacaaacagtgacaatcctttcggggatggaaacttgttgtctacatttgtgtggtccaagaagttaaacaaagaaggattgaaaggtgttagtcaagaagaaatcgaagcaataaacaggatgaaacaagaagaaaacaaaagagaactggaaaaagtaaaaaagagacgtctagaaagggaattagaaagacagaagagggacgaagaaacccagatgctccaaagaagcaaggaagcagcacaatttgaagagtgggagaggcaagaagataagttccatctggaacaagcaagactgagatcacatataagaatccaagatggcagagccaaacccatagatttgttagccaaatatataagtgcggaagaagaggtagatgctgttgaaatgcatgaaccttacacatacctaaacggtttacatatcaaagatttagaagatctagtagaggatattaaggtctataaagagttagaaagggggaaaaatttggattattggaatgatataactgtaatagtggaagatgagttgcagaagcttaggaagctggaaaaacagaatgattttgatttaggtttgaatagaagagaaggtatacatcagtcagtagctgga

SEQ ID NO: 1932 - DNA, 729 bp, Diabrotica virgifera
gtgaaactggaaaacccaagggatatggtttctgtgaatatagagatcaagaaaccgccttgagcgcaatgaggaatttaaacggttacgaaataggcggaagaaatttaagagtggacaatgcttgtactgaaaaatctagaatggaaatgcaaaatctcctcaaccaacctccagtagagaatccctatggagaggcagttcaagctgaaaaagctcctgaggctataagtaaggctgttgcatctctacctcctgaacaaatgtttgaattgatgaagcaaatgaagacaactattcagaataatccaacagaagcaagacagatgcttttacagaatccgcagcttgcctatgctcttttacaagctcaagttgtaatgaaaattattgacgcagctactgcagttagtttacttcatcccgtgaaccaagtgccagcgacacttatgcctggagacaagaatgttcctgtccaagtaccagttaataatcagtacagggagcctccagcacctgttcaaccgcctgtccatccaagacaagacttccaacctgttcctcctcctgttatgcatccatctcaaaatcaagtatttccaagtcaagatatagatctgagatccattggtggtgtgccagatctaagaaacctaagacccatgggtgaccaggatatgagacaaatgccatctgctattcaaaatcccttaccaccaactatcggag

SEQ ID NO: 1933 - DNA, 654 bp, Diabrotica virgifera
gaagatcccggagatgttacttattctgctattggtggtttatctgaacagattagagaacttcgagaggttattgaactgcctttgttgaatccagaattgtttatgagagttggaatcactccacctaaaggttgtttgttgtatggtcctccaggtactggcaaaactctactagctagagctgtagcatctcagttagatgcaaacttcctcaaagtcgtctccagtgctattgttgataaatatattggagaatctgcaagactgatcagagaaatgtttaactatgctaaagaccatcaaccttgcattattttcatggatgaaattgatgctattggtggtagaagattttctgaaggtacttcagctgatagagaaatccaaaggactcttatggaactgcttaaccaaatggatggttttgattcattaggacaggtaaaaatgattatggcaaccaacagacccgatactctagatcctgctctgctccgtccaggtcgtttggacagaaaaatcgagatacctcttccaaacgagcaagcccgtcttgaaattttgaagatccatgccctcccgatcgctaaacatggagaaatcgattatgaagccatcgtaaaattatctgacacattcaatggagctgat

SEQ ID NO: 1934 - DNA, 630 bp, Diabrotica virgifera
ggctatttctcatgcaggtacttgtctgggcattttagcaaatgatggaattttgttggctgctgagaggcgtaacactaacaaattattagatgaagtttttatttcagaaaaaatatacaaactaaatgatgatatggtttgtagtgtggctggaataacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataaacattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgattaaaattttaagcggcaaggaagtagaagaact

SEQ ID NO: 1935 - DNA, 794 bp, Diabrotica virgifera
ctggtaactcacatgtgacaacatcaataatgcaagttcttatggaaaagtccgaaatagaattaaaggacacttacgccagatttttgcctctgggtcttggattgtgtcatttaggtaaacaagaaagcattgacacaattatagcagcattagaagttatacctgaccctttcagatccatggcgactactatggtcgatatttgcgcttatgcaggcacaggaaatgttttaaaagtacaacatttgttacatatatgttcagaacattacgatgctcctgaaactcctgacaaaacttcaaaggacaaagataaaaaagaagcagagaaagaaaaagataaggatctttcagctagacaagctattgcggttttgggtatagctttaattagcatgggagaagacattggtagcgagatggctttccggacatttggtcatttactaagatactgcgaaccagcgatcagacgtgctgttcccttagccctaggcttaatctcagtttcaaatccaaaattaagtattctcgatactttgagtaaattttcacatgatagcgatgctgaagtggctcataatgccatctttgcgatgggtctggtgggagctggtactaacaatgcaaggttagcagctatgctaagacagttagcacagtaccatgccaaagatcccaataatttatttatggttcgcatcgcccagggtctcactcatcttggcaaaggaactttaactctcagtccattccacagtgataggcagctgatgagtccagtagctgta

SEQ ID NO: 1936 - DNA, 798 bp, Diabrotica virgifera
ttcaactccacaggaacaaagtcctgtggaacataaaattgagccaacagagacaacaacttatcaagatctgcgcatggaaacgcatcaaagggaacagtttacggaaccaaaacagtacacagtagaaatgccagcagaaagcttctcaggacaaaacttttcacaggatatcggttacaccagtaatatagctactgttaatatagaaggtaatgaggtgcctataacgatatcttcggaaatagatcaacccggaggtgattatacaagtctgcagacagcccaatacaataacggttataccgacggtccacagtatttacaacaacatcagtatcaaaatttatacgttgacagaggcagtgttgaaaattcacctccagcaactttattgtttaaagacgatcccaatttagcaacagctagatatccgacaaactacgacgtatctagcagtcaatcgcagctgaatcttcttccaaatgacacctacttcaccacaacagccaattgggcttcaacgagcaccggatcctaccaacaacaatacagcaataccatcaacatccttcaccaagcggacagtacgcagtcatatggaggaggtccctacgtgaatacagcatggtcatccagtccgatggaggatggacgtccaccaagccaagaggtactagtcaaagagtgcgtgaattgtggtgctagtgttacacccctttggcgtagagacggtaccgggcattatctatgtaacgcgtgcgggttataccacaaaattaatggggttcacagacc

SEQ ID NO: 1937 - DNA, 752 bp, Diabrotica virgifera
ataatcatgctcaacgtcgaccaacataacgaaaatgccaaaaaacaaacgactcccatgtcggctaatgctttcaagaaaaatttgaaaggcgttaacggaggtaacgactttgacgaagaaatgttagatgatatatatacaacaataaaaaacgaagaaatagttatgcccgccgaacaagccgggttagttagggaaaattatttctggaagatcttgctgagaaagggacagacgaaagatggcatctacatccatgataatagtggtacttatgattctgagcttttccagattgtttatggacctatagtagcagctctgtcttctgtttacgagaaggctgaaaacgaaagtgtacataaaaaagttatgcaaggattcgaaagatgcgcctttattgctgcaaatctcaatatatctacaaatttggatatgcttattctaggcatttgtaaattcactgtgttctacaatcaacagaaacagaacaacattgtggtgcaatttggaatgaacagcaaggctcagttggcacttaggacggtattttctctaattcatcaacacggaaacaccatgagggagggatggaaacatttatttgatctcttgttagcgctctatagcaacggactgttgtcaaaaacgtttgtagaggtagaagactttattgaaccaagtggcaaattaatgctagtctacaaggaagcaccatctgcggcgaagcaggataccggtttactgag

SEQ ID NO: 1938 - DNA, 469 bp, Diabrotica virgifera
tgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatgtgtgaagcactttgggagcctaacctaggacctgaggatctttttgaaaccatctctcaagctctcatcaatgccttt

SEQ ID NO: 1939 - DNA, 731 bp, Diabrotica virgifera
ggatccagtaatgtggctagatagacttagtgcggtgcttagatatgttaatgtacatattccggaaggtgtggaaaacccttgtaaaccggtaattctcgaagtgtggccggtattgtctcgcacgttcgataaattccaaagtgacattaggataatggagagatgttgtcgtgccgtgcgtttcatgctgcggtgcgtcgcgcaagaagtgcgtgaactcttagaaagcctagttggacaaatagtgaggatctatacgttataccaacattcgtgttttctctatgtcggtagtatactcgtggacgaatacgcaatagatccgatatgcgtgccaggtctgctggatatgctgcaagcgtttctggaacctaccttccacgtgttgcaggaggagaacgggctgaagaatcatcccgatacagtggatgacttttttaggttgtgtgcaagatttatgcagagggcgcctttagcatttttaaaatgttcttccttggtccacatcttacagtgtgcccttttggcttcttccctggaccaccgagaagcgaatatgtctgtgatgaaattcttttacgatttgataaaccagggccagagtgggagagctgatcccgaattcaatcaacgacagatgttagttaaaagcatcctcgacgagtatggccaacaactagtctcaaatctaatccattcttgtgtcttctacctccattcctacatgc

SEQ ID NO: 1940 - DNA, 744 bp, Diabrotica virgifera
caatcctccaccaccaaatataccatctagtggcggtacgatgattcaaagacctgctggtgctccctattcaccaatgagaggtggaattattccgccacagcaaggaaataaaaggcctgcagacaataggactcaaatgcaacagaaaagtaatgaatacagccatagtacaagtaagaagaagaaaaagctggcggataaaatcctgccacagaaagtcagagatttggttccagaaagtcaagcttacatggatctattagcatttgaaagaaagctagactctactattatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcatcttgggaattaagagtagaaggtcgtcttttagaagatccaaagaacgatccaaataaagttaaacgcaagttttcttctttctttaaatctctggttatcgaattggataaggagctgtatggaccggacaatcatttagttgaatggcacagaaccctaaccacccaagaaacagatggttttcaggtaaaacgccctggtgacaagaatgtgagatgtactattttgttgcttcttgattatcaacctctgcagtttaagcttgatcctagactagctagacttttgggagttca

SEQ ID NO: 1941 - DNA, 285 bp, Diabrotica virgifera
gaacccacattagacgagttagaacaaaaaatgagagaagttgaaacacagtcacatgagggtaaaaggaaaaatgaatcattgtggccaattttcaaaatccatcatcaaaaatccagatatatatttgatcttttttatagaagaaaagcaatcagcagggaactatatgactattgtcttggtgaaaacattgcagataaaaatttaatagcgaagtggaagaagcaaggatacgagagtctttgttgtctaagatgtattcaaacgagagacaccaacttt

SEQ ID NO: 1942 - DNA, 702 bp, Diabrotica virgifera
ggaggatgaattcagaaccatcagacaaatagtacaaaaatatcagtatgttgctatggacacagaatttcctggtgtagttgcgaggcctattggagaatttagaagttctgcagattaccaataccaaatgctgaggtgcaatgtcgatttattgaggataatacagcttgggctcacatttcttgatgataacggaaaaactccagggggtgcctatactacatggcaattcaacttcaaattcaaccttcaggaagacatgtatgcacaggatagtatagacctcctgcaaaattctggcattcagtttaagaaacatgaggatgaaggtattgaacctcttgaatttgcggaattgctgatgtcatctggtattgtcctggtggaaaatataaaatggctgtccttccattctggttatgattttggctacctgataaaactgttaacggacaacaacttacctcaagacgaaacagaattcttcgatttgttaaaattatattttcctaccatatatgatgtaaagtaccttatgaaatcatgcaaaaatcttaaagggggattacaagaagtggcagaacagctagaacttgaaaggattggaccacaacatcaagcaggttctgattctcttctgacaggaatggcatttttcaagatgaaagagatgttcttcgaagacaccatagacgactc

SEQ ID NO: 1943 - DNA, 738 bp, Diabrotica virgifera
tctggtactggtaaaacagctaccttttccatttcgattttacaagctttagatttgacaatgcgagaaacgcaagttttatgcttgtctcctactagagaattggctgtacagattcaaaaagttattctagctttaggtgacttcatgaatgttcaatgtcatgcttgtattggaggcacaaatcttggggaagatattagaaaacttgattatggacagcatgtcgttagtggaacacctggaagagtttatgatatgatcagaagaagagctctaagaacaagatctgtaaaaatgttggttttagatgaggctgatgaaatgttaaataaaggattcaaagaacaaatttatgatgtctacagattccttcccccatcaacacaagttgtactcatttcagctacactgcctcacgaaattttggaaattacttccaaatttatgacagatcctattaggattttggtaaaacgtgatgaattgacattggagggtataaaacagttctttgtggctgtggaaagggaagaatggaaatttgacaccctctgtgacctctacgatacattaaccattacacaggctgttattttctgcaacacaaagaggaaggtagactggctgacggagaaaatgagggaaaacaattttacagttagttcaatgcacggagatatgccacaaaaggaacgtgacaatattatgaaagagtttaggtcaggacagagtagg

SEQ ID NO: 1944 - DNA, 727 bp, Diabrotica virgifera
ctggtagagaacaagcttgtaatttatctgatatcaaagttattaagcaacttggaggtacagtagaagataccgaattagtagaaggaatttgtttccctcaaagatctgcaaatgtctctggaccaaaaaggattgagaaagctaaaattggtttcatccagttctgtatttcacctccaaaaacagatatggaccacaatgtcattgtttctgattacgctgctatggatagagtattaaaagaagagagagcatatattttgaatattgtcaagcagataaagaaagctggatgtaatgtacttttggttcaaaaatcaattttgagggatgcagtttcagatcttgccttacactttttggataaaatcaagtgtatggttattaaggatattgaaagagaagatgtcgaatttgtatgtaaatctttaggatgccgccctattgcatctttggatcattttgttgctgaaaacttggttactgctgatttagttgaagaggttggattggcaggaaatagaatggtcaaaattacaggtgcacaaaatgcaggcaggacagtaactctgctggttagaggatccaacaaattagttcttgaagaggctgatagatctcttcatgatgctctctgtgtaattcgttgtcttgttcgcaagaaggcacttattgccggaggaggagcgcccgaggttgaggtggctcttaaactagcggctat

SEQ ID NO: 1945 - DNA, 718 bp, Diabrotica virgifera
aacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggttagagacgtgttccgtctagcaaaagaaaattctccagcaatcatctttattgatgaaattgatgcaatcgctaccaaacgttttgatgcccagacaggtgctgatcgtgaagtccagagaattttattggaactgcttaaccagatggatggttttgatcagacaacaaatgttaaggttatcatggcaactaacagagctgatacattagatcctgcacttctgagacctggtcgtctggacagaaaaatcgaatttcctttaccagatagaagacaaaagcgtttgattttcagcactatcacatctaaaatgaatttgtcagaggaggtcgacttggaggactatgtagctagaccagacagaatatcaggagc

SEQ ID NO: 1946 - DNA, 371 bp, Diabrotica virgifera
atgctccgtcactatcaaaactatgttagaagacttgggaatggacgaagaagaagaagaagtggttcctttaccaaacgtaaattccgccatactcaggaaagtcatccaatgggcgacttaccacaaagatgatccaccaccaccagaagatgacgataacaaagaaaaaagaacagatgatatttcctcatgggacgcagacttccttaaagtcgaccaaggaaccctcttcgagttgattttggctgctaactatctggatatcaaggggctcttagatgtcacatgtaagactgttgctaatatgatcaaaggtaaagctcctgaagaaatcagaaagactttcaacatcaagaatgacttcacgg

SEQ ID NO: 1947 - DNA, 696 bp, Diabrotica virgifera
gaatgcaagcaattaacggaaaatcaagttaaaacactatgtgataaggctaaagaaatattgtcaaaagaatcaaatgtacaagaagtgaaatgcccagtaacagtatgtggagatgtccatggacagttccacgatctgatggaactgtttaggataggaggtaggagcccagacactaattacctgttcatgggagattatgtagatcgtggatactattctgttgagactgtcaccttattggtagcactgaaagtcaggtacaaagagagaattacaattttgagaggcaaccacgaatcaagacaaatcacacaagtttacggattttacgatgaatgtctaaggaaatacggaaacgcgaatgtatggaaattcttcaccgatctgttcgattatttgcccctaacagcgctcgtcgatagtcaaattttctgtctgcacggcggattgagtcctagcatcgacaccttggatcacattagggcgcttgatcgtttacaagaggtacctcatgaaggccccatgtgcgaccttctctggtcagaccctgacgaccgcgggggctggggcatctccccccgtggagccggctacaccttcggacaggacatttcagaaacgttcaaccataccaacggtctgtctttagtatctagggcgcatcaactcgtcatggagggttacaattgg

SEQ ID NO: 1948 - DNA, 715 bp, Diabrotica virgifera
tgatcttcgctggtaaacaacttgaagatggtagaactctatctgactacaacatccagaaggaatctacccttcatttggtccttagattgagaggaggcatgcagatctttgtcaaaaccttgacaggcaagaccatcaccctggaagttgagccatccgatactattgaaaatggtagaactctatctgactacaacatccagaaggaatctacccttcatttggtccttagattgagaggaggcatgcagatctttgtcaaaaccttgacaggcaagaccatcaccctggaagttgagccatccgatactattgaaaatgttaaagctaagatccaggataaggagggtatcccaccagatcagcaaagattgatctttgccggtaaacaattggaagatggaagaactttgtctgattataacatccagaaagagtctactcttcatttggtacttagattgagaggaggtatgcagatcttcgtcaagacactaactggaaagaccatcactttggaagttgaaccatctgataccattgaaaacgtgaaagctaaaatccaagataaagaaggtatcccaccagatcagcaaagattgatttttgcaggaaaacagctagaagatggtagaaccttgtctgactataacatccagaaagagtccactcttcacttggtactgagattgagaggaggtatgcagatctt

SEQ ID NO: 1949 - DNA, 685 bp, Diabrotica virgifera
ggatttgaaatgcaacccaaggtatacaaagattgtaaaatagctctgctaaacattgaattggaacttaaagctgagagggataacgcagaagtaagagtagataatgtaaaagaatatcagaaaattgttgatgcagaatggactatcttgtacaataaacttcaaaaaatttatgagtctggagctaatgttgttttgtcaaaattacccattggagatgttgctacccaatactttgctgatagggatatgttctgtgctggtcgtgttcaagaagatgatatgaaacgtaccctgaaagcatgtggaggtgctgtaatgaccactgttaatgacatcagcgattctgtactcggtaaatgtgagctgtttgaagaaaaacaaataggaggagaaagatttaatttctttaaaggctgcccaaatgcaaaaacgtgtactttaattttacgtggaggagcagaacaatttttagaagaaactgaaagatcacttcatgatgccatcatgattgttagaaggactattaaaaatgacgcagttgtagctgggggtggtgctatagagatggaattatcaaaaattttacgggatcattctcgcacaattgccggcaaagaacagcttctgattggtgcaatagctaaggcattagagatcatccccagacaattatgcgata

SEQ ID NO: 1950 - DNA, 722 bp, Diabrotica virgifera
tgggtctcactagaacgtatccaatttgtcggtgcctgtaatcctccaactgatcccggcagaaagcctctatcccaccgattcttgcgacacgttcccgtcatttatgtagattatcccggagagacatctttgaaacagatctacggtactttcaccagggctatgttaagattggcgcctggtctgaaaggttatgccgaaccattgactaatgctatggtggaattttatttggcatctcaagatagatttactcaagatatgcaaccacattatgtttattctccaagagaaatgaccagatgggtaagaggaatttgtgaagcaataaggcctcttgataatcttgctgtggagggtttggtaaggctttgggctcatgaagctctccgtctcttccaagacagattagtcgaagacacagaaagacgttggactaacgaaaacattgatgctgtagctttaaaacacttcccatcagctaactgcgagaaagctttggaaagacccattctttacagcaattggttatccaaggattatgtacctgttggaagggaacaactaagagaatatgtaaaggccagactgaaggtgttctatgaggaagaacttgatgttcctttggtgttgttcgatgaggtgttggaccatgttttaaggattgacagaatattcagacaacctcaaggtcacttactactgatcggagtttctgg

SEQ ID NO: 1951 - DNA, 772 bp, Diabrotica virgifera
atagaaacgtgccaagaacttttacaagataaagttcgtaggctagggtcaaaagttaaagaattacttatattgccactatatgcaaatttacccagcgatatgcaaggtaaaatttttgaaccgacgcctccaggtgctagaaaagttgttttggccacaaatatagctgaaacgtctttaacaatagacaatattatatacgttatagatcctgggtttgcgaaacaaaatcatttcaattcgagaacagggatggagagtttgatggtagtaccaatatccaaagcttctgcaaaccagagagctggcagagctggtagagtagcagctggaaaatgttttaggctatacactgcttggtcttataaacatgagctagaggacaatactataccggaaatccagcggataaatttaggaaacgccgtactcatgttgaaggcgctaggaataaatgatttggtacattttgattttttggatccacctcctcatgagactttggtgttagcattagaacaattatacgctttgggggctttaaatcatcacggagaattgaccaaattgggcagaagaatggccgagttaccggtggatcccatgatggccaagatgatattagcttcggaaaaatacaaatgctctgaagaaatagtcaccataggagccatgttatcagtaaatggtgccatattttaccgaccaaaggataaaataattcacgctgatactgctcgaaaaaatttcagtcacttagcaggagatc

SEQ ID NO: 1952 - DNA, 672 bp, Diabrotica virgifera
ggtaaaacagcaattgcacttgcaatagcccaagagttgggaaataaagtacctttttgcccgatggtaggatctgaagtctacagttctgaaataaaaaagactgaagttcttatggagaactttcgaagagcaattggtttgaggattagggaaaccaaagaagtttatgagggggaagtcagtgaattgacaccagtagaaacggaaaaccctgctggaggttatggaaaaactgtaagtcatgttatcattggtctaagaactgcaaagggaagtaaacaactcaaactggatcccggtatatatgaagcactccagaaagagaaagttgaagtaggagacgtcatttatattgaagccacaagtggtgcagttaaaagacaaggaagatctgatgcttatgccaccgaatttgacttagaagctgaagaatatgtgccattaccaaaaggagatgtacataaaaagaaagaagttattcaggacgttacattacacgatctagatgccgctaatgctaaacctcaaggtggacaagacgttttgtcaatgatgggccaacttctaaaaccaaagaaaacagaaatcacagataaacttagaaaagaaatcaacaaaatagtagataaatatattgatcaaggtattgcagaattggttcctggtgta

SEQ ID NO: 1953 - DNA, 742 bp, Diabrotica virgifera
ttaaatggttgtgagctcgatagactgcaaaaaccttccttacttattactgatgcgtttaatgctacttatcaacaagccagaagaagggctagagatgaaaaactaatgaccaatattcttcaaactcttcggaacaatggtaacgtacttatagcagtagacacggcaggcagggttctggagttggctcacatgttggatcagctatggcgtaacaaagaatctggcctattggcctactctttagcgtttttaaacaacgtcagttataacgttatagaatttgccaaatcccagatagaatggatgagtgataagttaatgagaagttttgaaggcgccagaaataatccctttcaatttaaacacttgcagtggtgtcacagtttagcagaattaagtaaagttcctagtccaaaggttgttcttgcaagttcacccgatttggaaagtgggttctccagagagttgttcctgcagtggtgttctaattccaataacagtattatattaacaacaagaacatcccctggtactttagctagagacttaattgacaacggagcagaaagaaatatagatttaacggtagaaaggcgagtaaaactcgaaggcgtagagcttgaagaatatgaaaaacgacaacgagcgcgaggtcaaaatgtagaaaaggaagatgcagattcggactctgattctgacatagaaatgtctgttatcaccaaaggtagacatgaca

SEQ ID NO: 1954 - DNA, 738 bp, Diabrotica virgifera
aacagccctttatacccaaggaaacaccttcagaatttgaatttatagctgatcccccatcaatttcagctctagatttagatattgttaagcttacagctcagttcgtagctagaaatggtagagcttttctgacacaattgatgaatagagaacagagaaatctgcagtttgattttttgagacctcaacactctttatttcaatacttcaccaaattactggagcaatatacaaaggttcttattcccccaaaaagtatgcatgaaagcctgcgaaacgaggctaatagtccgaagaatgtgttagagcaagtcaaatatcgtgcagaatggttgaagtatcaagagcaacaaaaagctaaggaagaggagcttttagaacgagaaagggttgcgtatgcacaaattgactggcatgagtttgtagtcgtcgaaactgttgactaccaacccttcgaaattggaaattttccggctccaactacccctgaagaagtcggagcccgtattttaattcaagagaggatagaagaaggggaagatatcgaaatgcaattagagagtgatgaggaagaaccaccagttatggaagctggtttaagcagcatgcaggacaaaaccaatcggaagacacgcgacgataccagaattcaagatatggaagaagaaagctccgatgaagaaaaagaagaagaagaggaattagctttacctccaccaccaccatctattcaac

SEQ ID NO: 1955 - DNA, 793 bp, Diabrotica virgifera
ttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgcatttaatacatcgttttacgtgaaaaataacgatcaaatgttagtcgtttatctagcagctttagttagatctattgtcgctctacacaatcttattaacaacaaactaacaaatagagacgcgga

SEQ ID NO: 1956 - DNA, 742 bp, Diabrotica virgifera
cgacaatcataattcgccagtacagacaagcactcgaagatatgattcagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattattagaagaaaatggcagaactgaagttgatatcaagaggtatgccaaagtcgagaagattcctggaggatccattgaagaatctaaaattttaagaggtgttatgcttaataaagatgtaacccatcccaaaatgaaaagatatatacagaatccgagaataatacttttggattgtgcattagaatataaaaaaggggaatctcaaacaaacgtagaaatttcagcagaaacagacttcaccaaactattagaactggaagaggagcatgtcaagcgtcaatgtgatgagattattgcactcaaacctgacgtcgtcttcacagaaaaaggagtatcagatttggcccaacactttttactgaaagctggtattaccgctatcaggcgtgttcgaaaatctgataataacagaattgccagagcctgtggagccacgattgttaaccgaacagaagaattacaagaaagcgatgttggcttaggagctggactcttcgaaatcaagaaaattggtgatgagtatttctgctttgtggtcga

SEQ ID NO: 1957 - DNA, 566 bp, Diabrotica virgifera
atgcaacgtcaaattaacccctatgcagataatggagggagtgtagtagcaatagcaggtgaagactttgtaataattggtgcagatacacgtttgagtactggattttccatttataccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggggaacctcttagtcaggagaaagctttgtctacccttaaagatgtatttatttctgctgctgaaagaga

SEQ ID NO: 1958 - DNA, 691 bp, Diabrotica virgifera
gctactcagtggctatgtttcctggcaatgaacgagaagacgttgaaaggggtggaaaaattattatgcccccatcagctttggaacaattgactaggttaaatataaactatcccatgttgtttaaacttgtgaataaaaagacacatcgcacaactcattgtggagttttagaatttgttgctgatgaaggaaaagtttatttgccactttggatgatgaacaacttagtactgactgaaggagatttggttcaaatggaaagtgtttcccttccagttggcacattttcaaaattccaacctcttaatccagacttcttggacattactaatcctaaagcagtcttagaaaatggtttgagatcttttgcctgccttacaacaggagatgtcattgcagtaaagtacaatcaaaaggcttatgagttgtgtgttctagaaaccaaacccggagatgccattagtatcattgaatgtgacatgaatgtggaatttgctgctcctgttggatacaaagaacccgaacaagtcaaaaaggaagaagaagaaatggctatagatcctgcagatttaatgccagaaccttctggatttgtagcattcagaggtgcaggaaatcgacttgatggcaaaaagcgtaaagatacttcaggaactgatagttcagtggccaaaccaacttatgtcag

SEQ ID NO: 1959 - DNA, 726 bp, Diabrotica virgifera
accacaggtgttgtagttttggctggtgccctgttagagcaagcaggatctttattagacagaggtattcatcccataaggattgctgatggttttgagctagcttgtcaaacagctgtagctcatttggaaaaaattgcagaactatttccagtatcagcagaaaacactgaaccattaataaaagttgcaatgaccactctgggatctaaaatcattaacaagtgtcataaacagatggcagaaatagctgttaatgcagtcttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcacttattgttacaacaagaattaccagctgtaagatgggttggaggtccagaaattgaacttatagcaatagctactgggggtaggatagttccccgttttgaagag

SEQ ID NO: 1960 - DNA, 198 bp, Diabrotica virgifera
aggagaaaagaaacgttttgaagtaaaaaagtggaatgctgtagctttgtgggcctgggacattgttgtggataactgtgccatttgccgaaatcatattatggatctatgtattgaatgccaggcaaaccaggcgtcagccaccagtgaagaatgtactgtagcttggggtgtttgtaatcatgcctttcacttcca

SEQ ID NO: 1961 - DNA, 774 bp, Diabrotica virgifera
gatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttggggaagcttgcacaattgttatcagaggtgctacacaacagatcattgatgaagctgaccgttcccttcatgatgctttgtgtgtattagcagccacagtcaaagagagtcgaattgtgtatggaggaggttgcagtgaaaccctaatgtccacagcggtatcaagagctgctgctaacactccaggaaaagaagctgtagcaatggaagcgtttgccagagctttgttgcagttgcccacaattattgcagacaatgcaggttacgactctgcccaattggtcagtgagcttaaggcagcacataacagtggccagagcaccatgggacttaacatggaaaagggtgaattgggggatatgaaaaccttgggaatcacagaatc

SEQ ID NO: 1962 - DNA, 728 bp, Diabrotica virgifera
gcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccattcggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatggattgagggctcttagagatactctacctccagaggttgacctcacaactaaaaatgtctccataggctacactggaaaaggccagaccttcaaaatccttgaagaagaagaaacttccccctacttgtcccttattgagggtgaagaacgtagaggaggaggagctgcagctgctgcaattgaggaccttcctgcagatccattgagagatg

SEQ ID NO: 1963 - DNA, 687 bp, Diabrotica virgifera
tcaaagtagacgatttggcaacagtgtggtgtgaatgggccgaaatggaaataaggaacgagaattatgatgaagctttaagactcatgcataaagcaactgttatgcctagtcgaaaagtagcatatcatgatgacactgaaacagttcaaagtcgactatataagtctctcaaagtttggtccatgtacgcagatttagaagaaagtttcggcacctttaaatcctgtaaagctatttacgacaaaataatagatttgaaaattgcaacacctcaaattattataaactatgggatatttctagaagaaaataattattttgaagaggcattcagagcgtatgaaaaaggaatatctctatttaaatggcccaatgtatacgacatatggaacacctatttgacgaaattcctgactcgttatgggggatcaaaactagaacgtgccagagatctgttcgaacaatgcttggatggatgcccacaacagtttgccaaacatctttacctgctctacgcgaaactagaagaagaacatggaatggctagacacgctatggctgtatatgaaagatcaaccaaagctgttccagagcaagaaatgttcgacgtttttaatatatatatcaaacgagccgccgaaatctatgggattcccaaaacgaggcagatctacgaaaaggcta

SEQ ID NO: 1964 - DNA, 664 bp, Diabrotica virgifera
ccttattgtgggagctctttgtacaagcagggcctttagtcaatgtacatatgccaaaagatcgagtaacgaccatgcaccagggctatgggtttgtagaatttatgggagaggaggatgcagattatgctattaaaattatgaatatgataaaattgtatgggaagcctataagagtaaacaaagcttcggctcatcagaaaaacttagacgtaggagctaacatttttattggaaatttagacccagaagtagacgaaaaattactctatgatactttttccgcatttggagtaatattacaaacacctaagattatgagagatcctgatactggcaactccaaagggttcgctttcatcaattttgcaagcttcgaagcatcagatgcctccatcgaagccatgaatggccaatatttgtgcaatagacccatatcagtgtcttatgctttcaagaaagactcaaaaggagagagacatggatctgcagctgaacgtcttcttgctgctcagaatccattatcacaggctgataggcctcatcaactgtttgctgatgcacctccaataggtttgatgcccatgtccatggccccacctcctccaccagtcataatgacaggaatgatgcccccaccgcctccaacactatcaaacttgcc

SEQ ID NO: 1965 - DNA, 643 bp, Diabrotica virgifera
agcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgacacaaagaaaaccagagttaagttaccttctggagccaagaaagttattccatcaaacaacagggccatggtgggtatcgttgctggaggtggtcgtattgacaaaccaatcttgaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagtcggtcttatcgct

SEQ ID NO: 1966 - DNA, 295 bp, Diabrotica virgifera
aaacagttggcaactaaagctgctcgcaagagtgcacctgctactggaggagtcaaaaaacctcatcgttacaggccaggtaccgtagcccttcgtgaaattagacgttaccagaaaagtactgagctacttatcagaaaactacctttccaacgtcttgtccgtgaaatagctcaagattttaagacagacttacgttttcagagttcggcagttatggctttacaggaagcgagtgaagcatatttggtaggtttattcgaagataccaacttatgcgctattcatgctaaga

SEQ ID NO: 1967 - DNA, 669 bp, Diabrotica virgifera
cgttggaagtactggagaaaatgaagatttcaattgaagcgaacaaagaaactttaacagatatttgcaggacgagtttaagaacaaagctgcatcaaaaactggctgatgttttgacagacgtttgtgtggatgccgttctagctataaagaaagatgacaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaaggtcactctgtaatggaactgataagacttttgttgttattaaccaaaaaggtattgaccccatgagcctggatatgcttgccaaagaaggaataatagctctcagaagagctaagagacgtaacatggagcgtctatcattggcttgtggtggagtagctatgaacagctttgatgatctgcaagaatctcaacttggtagagccggacatgtatatgaac

SEQ ID NO: 1968 - DNA, 710 bp, Diabrotica virgifera
agcccaagaagtaatgaaggcatgttctggaaaattccatcccattttccaatggttctactatgatgccatagaatgcctaccacaagataaatcagaaatcactgaagaactagctgcacccactggtagcagatatgatggccaagttgctgtttttggaaaagaattccaaaagaagttagcatcactgaaatattttattgttggtgctggagctattggttgtgaattgttgaagaactttgctatgatgggtgtaggaacacaaggagaagttacagtaactgatatggatttaattgaaaaatctaatttgaacaggcagttccttttcagaccacataacgtccaacaaccaaaatctgccacagctgcaaaggtcattaaaaagatgaatcctgatatcaatgttgttgcacatgaaaatcgtgttggacccgaaactgaaagtgtctacaatgacgatttctttgaaaagcttgatggagttgctaatgcactggataatgtagatgctagaatttatatggatagaagatgtgtctactaccgcaagcctcttctagagtctggaaccctaggaactaagggaaatactcaagtggtggcacctttcctctctgaatcatacagttcttctcaagatcctccagagaaaagcattccaatctgtactttaaagaatttccccaatgctatcgaacata

SEQ ID NO: 1969 - DNA, 641 bp, Diabrotica virgifera
aggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccttaagtaaagaaattagaccagtttgcaagaaattt

SEQ ID NO: 1970 - DNA, 657 bp, Diabrotica virgifera
gttgctgaattgaccaacaaattggattcaattagagggtttttacattctcgtctacgtaccgctacactcaggaacgactttgaaggtcaagctgtgcttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaaaacagctataagatccataggattatcatactccagaatatctccccaagacatagctaagaaactggggctggattcagctgaagatgcagaa

SEQ ID NO: 1971 - DNA, 668 bp, Diabrotica virgifera
gagtactcaaacatcgacgaatggtacaagcggggtgttgacacttcaaaaatagttactaaatatcgtaaaggtgcatgtgaaaattgtggagctatgactcataaaaagaaagattgtatggaaagacctcgcaaagttggagccaaattttccggggcaaatattgcaccagatgaatttgcccagaaaaacttagcgttgagctttgatggaaaaagagatcgatggagtggatatgacccatctgagcacaaagcagtaatagaagagttccagaaagttgaggaagctaaaagacaactgaaggctgataagttaaatgcaaacgaatcttctgacgatgaagaaaaagatgaggacaaatatgtagatgaagttgatatgcctggtactaaagtagacagcaaacagagaattactgtaagaaatttgaggataagagaagacactgcaaaatacttgaggaatcttgatttaggttctgcttattatgatcccaagacaagatctatgagggaaaaccctaatcctgaaaaagatgctacgtacagtggagagaatttcgttcgttttacaggcgataccaccaatcatgcgaaggctcagttatttgcttgggaagcgtatgaaaagggtgtggatgttcatcttttagccgaaccaac

SEQ ID NO: 1972 - DNA, 499 bp, Diabrotica virgifera
tctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataagaaacgtagcaaaaaagtacagaaaaaatatgaaactaggcaaaaaacagctaaagtagaacctgcattagaagaacaattctcaactggaaggttattagcttgcttagcgtcaaggccaggacaatgtggtagagctgat

SEQ ID NO: 1973 - DNA, 735 bp, Diabrotica virgifera
ggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaacctcgccaaactacatccaacttaggacatctacagaaaccatcagtccaggctttgattcatggtctaaatcggcattactactccatcagtattaattacagaaagaatgaattggaacaaaaaatgctactaaatctccataaaaaatcctggatggatggtctaactttagcagattactctgaaaattgtagtgtgaatgaaaagactgtagctgatatgttagaactagccaagaattacaacaaggcattagaagaggaggagaaaatgactccagaacagct

SEQ ID NO: 1974 - DNA, 783 bp, Diabrotica virgifera
gcaagctcagagaaatgaactcaatgccaaagttcgtatgttgagagaagaactgatgttacttcaagagcaaggaagctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccctgattcaacttatgaaatggtaggaggacttgacaagcaaattaaagaaatcaaagaagtaattgaacttccagttaaacatccagaactttttgatgctcttggtattgcacaacctaagggtgtgttgttatatggaccaccaggcactggaaaaactcttctggcacgtgctgtagctcatcacacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgaatcaggatctggtggtgattctgaagtccaaagaaccatgttggaacttctaaatcaattggatggttttgaagctaccaaaaacatcaaagtaattatggctaccaacagaattgatattttggatcccgctttact

SEQ ID NO: 1975 - DNA, 472 bp, Diabrotica virgifera
ccttcgaacttcaaagcttcagctttttccaaagagggtcaattcaggagttcatgtcattcttttgcaaaaccatagtggaaagaacaataccagcctcaaggcagagtgttaaagaaggagaatatttgtgtcatgtatatgtacgagctgataacttagctggtgttatcataactgatcatgaatacccatcaagggtttctcacacactaataacaaaaatactagacgaatttggtgccaaaattcctgcagctaactggcccagccttgaggagagagatgtaccatttccacaattaaatacctacttagcgaaatatcaaaatcctagagaagcagatgctattacaaaaattcaagaagatcttgatgaaacgaagattattttgcataataccatacaagcagttttggaacgaggcgagaaactagacgacttagtgagcaagtcggaaggtttaagcat

SEQ ID NO: 1976 - DNA, 581 bp, Diabrotica virgifera
aggatctaccgctattggaatatgcaccagtggtggagtagtgcttgctgtagaaaaacgcattacttccccattaatggaacctactacgattgagaaaattgtagaagttgacaaacatattggatgtgcggtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctagaccttttggagtagcaattttgtttgctggtatagatgaaaaaggacctcagttgtaccatatggatccatcaggaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttcc

SEQ ID NO: 1977 - DNA, 725 bp, Diabrotica virgifera
aatgacggagctaccattttacgtcttttagaagttgaacatcctgccgccagagtattagtagaattggctcagttacaggatgaagaagtaggagatggtacaacttcagttgttatcatagctgcagaattactaaagaatgctgatgaactcgtgaaacaaaagatacatccaacttcaattataagtggatacagattagcatgcaaagaggcttgtaggtacattcaggatcatttgactattccagtcgaagaattgggaaaggagtgcatcataaatgttgccaaaacctcgatgagctcaaaaattattggagctgatgctgatcttttttcacaaatcgttgtcgatgccgccaatgctgttaaagtgacagattcaagaggaaatagcatgtatcccataaaggctgtcaatgtcttgaaagcacatggtaaaagcgccagagagagcttccttgtaccaggttatgcattaaactgcaccgttgccagccaagcgatgcccaaaaaaattgttaacgccaaaatcgcatgtttagatttttcattgcagaaggctaaaatgaagatgggtgttcaggttttgattactgatccaaatcaactggaagcaatccgcacaagagagctcgacatcaccaaagaacgcatccagaaaatcctctctaccggtgttaatgttattcttgcgagtggtggtatcgatgatctttgcct

SEQ ID NO: 1978 - DNA, 606 bp, Diabrotica virgifera
ttttacaattttcccggcaaacagaccagctattccaaccctataacacatacacagtctcccgttacaacatcaacttctgtattagctattacttacgataaaggagtattgatagccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgagagactctttagataaaaatggagctcttaacttggccgatgccaaaactctgattcacaaatgcatggaagtattgttctatagagatgccagaagttttcct

SEQ ID NO: 1979 - DNA, 790 bp, Diabrotica virgifera
atccctttcggaagagactagcaataatttgaagaaaaacgtgtatgaaaactatgttcaatttattgagactgccaaagaaatatctcatttggaaagtgaaatgtaccagttgtcccatttactatcagaacaaaaatcattattaagtgctctgtcaacaacatctattttagaagacactcaacacttgaatattgaaagagagaataagagtaatgacaaggacatagaagaggaaaataagcaaaaacttgcagccattttagaaaaagtggaaggatgcaaggaattgctagaagtaccgggaagaaaatttctatatgaaggagatttgttagaaattgatccaacagaaaatacgtctttgaaaactgttcatgtgtatttatttacagatggatttatgataacaaatagaaattccaatagtcgaggtttgatgaagtacatttatgaaataatgtacgatttaagtagtctagcagtggttaacgtcagagatttaggaaatgttaagcatgcatttaaattgttaatttttccggacacgagagtttttcaatgttcttctaattccaacaagaaagagtggttggacaagtttgaccaagcaaagaagactagattagcccaagagcaacataagagggagtcaatttcggaaaaatcaccctcacgatcagcttcgatagagtctcctagttataacccttttgacgaagttgaagacgatgtaggaaccgttcagccagaatggtttttggacattccagaggaacttgatgtg

SEQ ID NO: 1980 - DNA, 667 bp, Diabrotica virgifera
agatcgagagacaggagaaacagatctaaggatcgaaaatacaaaaattattctagagataaagataggagagaaagaagcaattctagggatataaaacgggatagaagtactgagaagaagttcaaaagtgaaaaagataatccagagtttgaagatgatcctaccccaggaaaaatatataatggaaaagtatcaaatattgtaccttttggatgctttgtccagctggagggacttaaaaggagatgggaaggcttggttcatatttcacagcttagagcagaaggcagagttactaatgtatctgaagtaacatctagaggagctagagtaaaggtcaaagtattgacggtaacaggtcagaaggtgtcattatctatgaaagatgtctgtcagattactggtaaagaccttaacccacattcccatgctccgactgaaagagaagatagagatagaaatcctgacaggcctgtaaacagcagtacgtctgtattgagactgccagtaaacatagatgaaggagaagaagactcccggaaacgagtaacaaggatttcaagtcccgagagatgggaaataaaacagatgatttcatcaggatgtattgctaaaagtgagttgcctgattttgatgaagaaactggattgttacccaaggatg

SEQ ID NO: 1981 - DNA, 698 bp, Diabrotica virgifera
ttctcttttggtagctggacaagaaagtgagtgtcaattgtacaaactgaatcctaaactagtcgaggaagtggaaaatatcggtaataatactcatctcaggcaacggaatacaaaaaacaaagaagttacagatgacaacaaaaacgtgacaaaagagttatattttgatgttaatgcaatagaaaatgttcaaactgactttaatgggagtgaaccattatcgagggtggtaaaaattaatcatgatggtacattattagctacaggtggtacagatggagatgtacgaatatggaagtttcctagtatgcaacctctatttattcttaaggcacatacaaaagaaatagacgatatagattttagtaggtttgacaattatgtgattaccatagccaaagatggtttagcagtattgtgggattgtatgacaggaaaagaaagaacaaaactaacatggaagcagccaggatcaaaatatttatataaacggtgtagatttggcgtaatagaaggactagacaagaaatgtgcactatatacaatatccaatccaataggagtagctaaaaaacaaaaatcctatctccagcaatggatacctgaggaaaacatcttaagaaggtgtatagaatttgatgaaagtttggcagctttagctgttcgtgatgatggtagatttgttgcggttggta

SEQ ID NO: 1982 - DNA, 664 bp, Diabrotica virgifera
tcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgtt

SEQ ID NO: 1983 - DNA, 793 bp, Diabrotica virgifera
tggcagaaaaatatgaggctaagcttcaagaggctctacaagaactcagagatcaatatgaaagtcaaatggccaacaaccgtggcgaaatcgagttgctttacgaacagaagattaagaacttgcaatcagctaatgacagacatgctgcctctgcctccggtgctcttgacgaattgagacaagttagaaccagaatcgatactttgaattctcgaattagcgatttagagaaccagaacgctggcttagcagctcgtgctagagatttggagaagttgttagagaatgagcgcatgcgccatgtggaagacctcgcaatgttagaaagagaattgcatagactccgagaagaaatggctaatcaacttcaagaataccaggatcttatggacattaaggtttctcttgatttagagatagctgcttatcggaaactgctcgaatctgaagaagctcgtcttaatattaccccaacaggtagtgaagttcatgaagtaactcacagtaggagccaacgcagctcgtcgcaacgtcgcactccagtcagattgggagccaaaagaaagcgaacactactcgaagaaagccaagagtcaagcatgaatgactatacggtgaacagctcctcaaaaggtgacattgaagtcgctgatgtcgatccagaaggacactatgttaagttgcacaataaaagtaatcaagaagtcgcacttggaggatggcaagtcattagacgtgttggtgaggaggaaactacattcaaatttcacaggtcactaaagcttgaagg

SEQ ID NO: 1984 - DNA, 764 bp, Diabrotica virgifera
aagaagaagctcttaacgcagttggatacgacgacatcggaggttgtagaaaacagctcgctcaaatcaaagaaatggtagagttaccactgagacatcctagtcttttcaaggctattggagttaaaccaccaagaggtatcttactttacggtccaccgggtactggtaagacactcattgcacgtgcagtagctaacgaaactggagcgttcttcttcttgattaacggtcctgagattatgagcaaattggccggtgaatccgaaagcaatcttcgtaaagctttcgaggaagccgacaagaattccccagctattattttcattgatgaattggatgccatcgctcccaagagagagaaaacacacggagaggtggaacgccgtatagtatcccaacttctaactttgatggacggtatgaagaagagttcccacgttatcgttatggccgctactaacagaccaaactcaatcgatccagctttacgtagattcggaagattcgacagggaaatcgatatcggaatacctgatgcaactggcagacttgaagttttacgtattcacaccaagaacatgaaattggccgatgatgtcgacttagaacagatcgctgcagaaactcatggtcacgtaggtgccgatttagcttcactatgttcggaagcagcccttcaacaaatcagagaaaaaatggacctcatcgacctcgaagacgaccaaattgacgcagaagtcctaaactcactggcagttacc

SEQ ID NO: 1985 - DNA, 650 bp, Diabrotica virgifera
agttcccagtctatgtgaagatctattatcatctgtggatcagcctttaaaaatcgcaaaagataaagaaactggaaaagattatcttctttgtgactataatagagatggagattcctacaggtcaccatggtccaatacatactacccgcccctagaagatggttcaatgccatctgaaaagttaagaaaactagaactagacgccaatcttgcatttgatcaatacagggaaatgtattttgaaggaggtgtatcttctgtttatttttgggacttagaccatggatttgcaggagtcattctaattaaaaagactggagatggtagtaaaaagattaaagggtgttgggattccttacatgtcgtagaagtacaagagaagagttcgggaagaaactcccattataaaatgacttcaactgctatgttatggcttcaaactaataaacagggatctggaactatgaacttgggtggaagtctgactcggcagatcgaacaagatgcagctgtaaacgatatcaaccctcacatagccaacattggaagaatggtagaagatatggaaaacaaaattcgcaatacattgaacgaaatttacttcagcaaaacgaaggacatcgtcaacagtctgcgatcagttcaac

SEQ ID NO: 1986 - DNA, 654 bp, Diabrotica virgifera
tgccaaatcagaaacgagtacatccggttccagttcggattcttctagcgacacggaagattcggaggaagaaaggcgaaacaaacaactgaagctgctagaaaaagagttgacggcaatgcaagaaaaaatgcgtaaattggtagacgagagctcgaaaaagaaaaaagaaaagaaaaaggacaaagtgaaaaagaaaccgacatcaggtgggtctctggcgaacgcctcactatcaactctaccgaacagcagcagcgcgggcttgggtaagccgggtgccggtggtcacggggctctaaacaagtcaaacaacaacaactcaatagcggcggacagcgttgacgacagcatcgccagtgttgtgtcgggggccgatctaaagatggccgagtcgcaccatccgcaaactggaacaggcgctcaccatccgccggcaggcaaatccctgaacatgcatcacaacatgacggctaacgctggcgccaacgcttccgcgcaggctaaaacacctaaaagtaaaggactccgcggcaataaacccgctgcagctaccaacgcggctcccaacaagagggtcaaagccaacaacaaagctggtgcgggtaggaagaagaacgcagcacaaccaccacctatgcagttcgattctga

SEQ ID NO: 1987 - DNA, 704 bp, Diabrotica virgifera
atgagcaaaggacatgtcatcgaccaaatccctgaattgccattggttgtcagtgacaaggtacaagaaatgagcaaaactaaacaggctgtccagttcttgaggagaatcaaggcatgggctgacattcaaaaggtttacaagagtcaacgtttccgtgctggtaagggaaaaatgcgtaataggagacgcatccaacgtaaaggaccattggttgtttactacaaagatcaaggtcttcgtcgtgctttccgtaacatcccaggcattgacctcattagcgtacagaagttaaatttgttgaaacttgctcctggtggtcatgtaggtcgctttgttatttggactgaatcagctttccaacgtttagataaattgttcggcacatggaaaacagcatcattggaaaagaagggttacaatctaccccagcctaaaatggccaacactgatctatctagattgttgaaggctgatgaaatcaaagctgtattacgtgctcctcaaaagaaggttgtacgtcgtgtacgtcgtctcaatccattgaccaacgctaaggccatgcttaagttgaatccatatgctgctgtactcaaacgtgaagccattttgaagaatcaaaagagacagttaaacagggaagaacttttggccaagaaacgtggtattaccgtgagtgccgacaacgtcgtgattagatccag

SEQ ID NO: 1988 - DNA, 738 bp, Diabrotica virgifera
ggcgttccataacatatcctatgccgaagccgaaaaatgtatggttaatatggaccagggtgaagttatcattaggccttcgagtaagggtgcggatcatttgaccattacttggaaggttacggatggaatctatcaacacattgatattaaggaacaagggaaagttaacgctttttctttaggaaaatcattatggattggaaatgaagaatttgaagatcttgatgaaataatagctaggcacgttacaccaatggcggcgcatgctagagatttactgtattttaggtattacaaagatttccaaggtggtcataaagataaggctgaggaatatctaaaagatgaaaaaaagaaaaatgcttctaaaattcattatgtagttagtgctgctaagaatatacctggtaaatttcttctttcgtaccttccacgcaacaaagttagacacgaatatgtaacagttactccagaaggctttcggtttagacaacaaatgtttgattccgtttcttcgttatttaaatggttcaaagaacatttccgggagcctccaccaggcggtgcaacaccaggtagcacgccaaggatggcttcaagcagaactggatatggaagtgccacacccgcgtatagtatgaataatgaagctattcaaagagttgctcaaaatttaccaagtcatgtagttcaagcgttatctgctgccaccaaccaaactccacattatcccca

SEQ ID NO: 1989 - DNA, 786 bp, Diabrotica virgifera
ggtggccatttcatttttgaaggaatgtggacaaaaactgacagaagtttcaagtagaggtattactgctatatttgagatgttaagaaacattttacatgaaggccagctagaaaaaagaattcagtacatgattgaagttatgtttcaaataaggaaagacggatttaaggatcatgctgctgtcgtagaagaattagatttagtagaagaggaagatcaattcactcatcttattatgttagatgatgttaaagaggctgatgcagaggatatattgaatgtgttcaaatttgatgagagttatgaagaaaatgaagataaatacaaaacccttagtaaagaaatcttaggcagtgatggtgagtctgaatcaggttccgaaggttcagaagaggaatctgataatgaaaatgaggacgaagtcaaggaccagggaacaattattgacaatactgaaacgaatttaatttctcttagaagaaccatatatttgactattcagtctagtttagattttgaagaatgtgcacataagctactgaagatggagttgaaacctggacaagaaatagaattgtgtcacatgtttcttgactgctgcgcagaacaaagaacctacgaaaagttttatggtcttttggctcaaagattttgtcaaatcaacaaagtgtatatcgagcctttccaacaaatttttaaagatacctattctaccactcacagactagatgctaacaggttaagaaacgtcagcaaattttttgcgcatttactttttacgga

SEQ ID NO: 1990 - DNA, 750 bp, Diabrotica virgifera
cacgaacttactttccaagcaatggcctatgacttactacccatagaaaatgatgtatataagtacgaagcatcggctggtgttatgaaagaagtccttctagacgaaaacgacgagctttgggtcgatctacgccaccaacacatcgcggtggtgtctcagagcgtcaccaagaatctgaagaaattcaccgactccaaacgcatgacccagagcgacaagcagtcgatgaaggatctctcaaccatgatcaaaaagatgccgcaatatcagaaagaattgtccaagtatgctacgcatcttcatctcgctgaagactgcatgaaggcctatcaggggtatatagacaagttgtgtaaagttgagcaggatttggcaatgggaactgatgccgaaggcgagaaaatcaaggatcacatgcgcaacatcgtccccatcttgctagatcccaaaatcaccaatgaatacgataagatgcgtattatagcattgtacgccatgacgaaaaacggcatcacagatgaaaatctctccaaattggctacccatgcccaaatcaaggacaaacagaccatcgccaaccttcagttacttggagtcaacgttattaatgatggaggaccaagaaaaaaacaatatacagtaccgcgcaaagaaagaattacagaacaaacgtaccaaatgtcaagatggacacctatcattaaggatataatggaggattgcatagacgacaaactggatcagaaa

SEQ ID NO: 1991 - DNA, 658 bp, Diabrotica virgifera
taacccagaacaagtgatggcaaaatttgtactgaacatatttcaactcaaactcgtcgaatacatcgatcaaagattgaattccaagttaggaacctatggctatttacaagtattatatgagttatattataagactaatcagttatctaatgatttgagcatatttaacatgggaaatgacaagaactttttatcgaagttaacgacaaatatttttaacaaatatattagtgattatatcacgatggaattaaaaggtctgaaagataggtgttctgcaaatttacaaaaatattatgaatccaaaggtcatcagaagaagcagattcagtcaggaggtttccaagaccttcgaagagaccttcaagctgttataggaactcgagcgaatattaacattgctcagatcgaaaattatggtggagaaacctttttatctgaagaattagctattacgatattacaagatacaaaacacgctttccagagatgccagttgttatccaaacccacagacagagcctcaaacgcaactcaaattttggatcgactgataaacagcttattagtagagcatgtcgactatgcagtagaattgggcttacaagctgttcctgttgtagaagggaccaaaactcctccagcgctatatttt

SEQ ID NO: 1992 - DNA, 707 bp, Diabrotica virgifera
tcttggtcggaaactaacagggatcgtagagaaaggcttcgacaactagctttagaaactatagatctacaaaaagatccctattttatgaaaaaccacttgggctcatacgagtgtaaactttgtttgacgttgcacaacaacgaaggaagttacttagcccatactcagggtaaaaaacatcaggcaaatttagctagaagagcagccaaagaggctaaggatgctcctacgcttttgcaaccagagaaacccagagtagaacctaagaagtttgtgaagattggtcgacctggttatagagtaacgaaacaaagagatgccgaaagtggacaacagagtcttctgttccagattgattatccagaaataagtgatatgattctaccccgtcaccgttttatgtcagcttatgaacaaaaaatcgaaccaccagatcgtaaatggcagtatcttctatttgcagcagaaccgtacgaaacaattgccttcaaagtaccaagcagagaagtagagaaaaccgacagcaaattttggactcattggaacaaggatactaagcaattcttcctacaatttgcatttaaaaatgacaataagagaactgttaatacagtggtccaaagacatacgattgttggtgcagcaccaccacccccaatgctacctgttccaccaccaccaagaccaccgatgttcaatcctat

SEQ ID NO: 1993 - DNA, 278 bp, Diabrotica virgifera
aacaattaccggcgaagtatacagagggaaactgatagaagccgaagataatatgaattgccaaatgactcaaattactgtaacttacagagatggaagagtcgctcaattggaaaatgtttatattagaggatcgaaaattagattcctggtattgccagatatgttgaaaaatgctcctatgttcaaaaaacaaactaaagcgggaacggcaggccgaggaaaatctgctatactgcgagcccaagctcgggggagaggtagggggcaacaacaac

SEQ ID NO: 1994 - DNA, 746 bp, Diabrotica virgifera
tcaacaagttggtgcaaatcttacagccacatctgatagagaaaccatctcctataccttagaaggaacaagaagtgccgttgaaaaggctctaccatatttagcagaagtagctacccaccaagaatttagaccttgggaagtgtcagagctctccaacagattaattttggatattttaaccagacctttacagttaagagccatcgatttgcttcacaatgctgcctaccgtagcaaaggtttaggtaactcactcttcattccaaaatcccaagtaggtaaagtttcatcagaaacgttacaacattacgtagccagcaactttgtagctggccgtgctgcagttgttggtacaggtgtaagcgagagtttgttgaatcaattcgctgctagtttgggaattgcaaatggcgaaggcagcaccaatccatctccttacaagggtggtgaactcagatcaaacaaaggtggaccacttgcttttgttgcagtaggaggagaaggagctccattgaagaacaccaaagaagctcttgcgtttgcagttctacagaaagctgtatgtgctggccctcagatcaaatatggcgtacttgataatggagtctacagcaaagctcttggtggctcatcagatgtatctgcgtgcgctgttaatgtgagctattcagacagcggtttgtttggtattttgctcgctgcacctgctggatctgtaggcaaagcagttcaatcagctgtta

SEQ ID NO: 1995 - DNA, 292 bp, Diabrotica virgifera
agcctacaagatgaggagagcccacgcaggtaactattatgaaccattaccacaagcttccaacgaaatcgaagatgaaaacgatagaatgactaatgatctgcaagaaaagattggcgtcttaaaatcgttgactatagacattggaaatgaagttaaataccaggacagaatgctcagagatgtggacgacgatctagataagactggaggcttcttgggcaccaccatgtcaagagtactgagattatcgaaaggatctcataattacctcatcctgtatttatttgtg

SEQ ID NO: 1996 - DNA, 796 bp, Diabrotica virgifera
gttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattccctttttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgac

SEQ ID NO: 1997 - DNA, 796 bp, Diabrotica virgifera
acttacgatccagaagaggacgacgacgatgatgatggcgccaagttggtgtatccaaaatctgatgagcaacgtcagagattggccactgctgttaaaaacatattgctgttcagatctctggataaagatcaaatgaacgatgtcttggatgcaatgttcgaaagagtggtcaaaaaggatgaattggtaatcaaacaaggagatgacggcgataatttttatgtaattcaaagtggaactttccatgtgtttgtcgcaccagatccatcgaaagaacccaatcatattcacacttacgaaaatagtggcagcttcggagagttggcgttgctctacaacatgccccgtgcagctacggtcaaagcaaatagcgaaggttccctttgggctatggataggcagaccttcagaagaatcgttctcaagtctgcgttcaaaaagaggaagatgtacgaagcgttgatagaaagtgttccgatgcttaaaactcttcagccttacgaacgtatgaatcttgctgatgcattggtacctagagtcttctacgatggagataggattatcaaacagggcgatgcagcggacggtatgtacttcgtagaacaaggtgaagtggccattagtgttttagacgatagcggtaaagaggtagagatcaatcgtattagtaaaggaggttactttggagagctggcattggttacacatcgtcctagagctgcttctgcttattgcgatggagaagttagatgtgcatttttggacgtggaagcatttgaacgtttgttgggtc

SEQ ID NO: 1998 - DNA, 782 bp, Diabrotica virgifera
ttatcacaccacagacaaggtttacttgctatttttaaaagcggaggtattccagcacttgtaaagttgctcagttctcctgtagaaagtgttcttgtctatgctataaccacccttcacaaccttttattacatcaagatggatcaaagatggctgttagacttgcaggtggtttgcaaaagatggttgcactactccaaagaaaccatgtcaaatttttgtcaattgtaactgattgcttacaaattttggcttatggtaaccaggagagcaagttgatcattttggcaagtcaaggacctattgaattggtcagaatcatgagatcttacgattatgagaagttgttgtggactacttctagagttctgaaagttctttcagtttgtgccagtaacaaacctgctatagttgaagcaggaggaatgcaagctttggcaatgcacttgggaaatccaagcacaagattggttcaaaattgtctatggacattgcgaaatctatcagatgctgctacaaaagttgatggtctagaaagcttattgcaatctttggtacaagtattagcatcttctgatgtcaatgtagtgacatgtgctgctggtatcctttccaatctgacttgtaacaatcagcgcaataaagtaactgtgtgccaagtgggaggggttgatgcacttgtgcgcactatagtcagtgcaggagatagagaagaaatcacggaaccagctgtttgtgcactgcgtcatttgacatccagacatgtggaatcagaaatggc

SEQ ID NO: 1999 - DNA, 673 bp, Diabrotica virgifera
aaaaacgaaggccctatcttgcatcagaatgtaaaaatttacatgcttgtgaaaaatggaggatgcagatcataagagaaattgccaagaaagtagctcaaattcaaaatgctggccttggagaatttaggataagagacttaaatgatgaaataaataaactactgagggagaagaggcattgggaggatcaaataaaggaattgggcgggcctgactatcagagagttggacccaggatgttagatcatgaaggcaaagaagtacctggaaatagggggtataaatactttggagcagctaaggaattaccaggtgttcgagaactttttgagcaggagccgcctcctcctccaaggaaaagtagagcagaactaatgaaagacattgatgcggactactatggatacatggacgacgatgacggaattttgattccattggaagttaaagctgaaaaaacagccgttcaaaatacagtagctgagtgggttagtaaaaaagaacaaaatttggagaacgcagagaaccaaacagaagaagaaagtatatatgcagttcaggagtctgacgatgaagaaagtaaggaaactgtacaacagttagtagatggatcacagcaaagatttgttgcacatgtacctgtaccatctcaacaagatatcgaacaggc

SEQ ID NO: 2000 - DNA, 511 bp, Diabrotica virgifera
acatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtggttggctaggaaactcattggagatcccaacttagaattcgtagctgcacctgccttgcttcctccagaagtccagatggatccccaatggcagcaacaaatcgaaaagga

SEQ ID NO: 2001 - DNA, 774 bp, Diabrotica virgifera
aacgatccaagttagtgcttccggaaccacaaatttcagaccaggaaatgcaccaagtggtgaagttgggcaaagcgagtgaagcagctagggaaatagttacagaaagcggtgttgaaaccactgacactttgttgaatgattatactttcaatcctcaagcggctgctacaccaaggactccggcgccccagactgataggattttgcaagaagctcagaacatgatggcgctcacacacgtagatacgcccctcaaaggcggcattaacactccgttacacaattcagatttcagcggggtcctgccccaagctcagaccgtcagcaccccgaataccgtgcttgctacgcccttcagatccagtaggagtgacggagctggcactcctggcagtagcgttggatttatgacgcctagaagtggcgctttggtgcctgtggggaagacgccggtaggaatgacgccttcggttagggataagcttagtattaatccagaggaagcaatggacgtaggaagcacaccagctgagcacagaatgtaccagatgtcgatgaaagatcaattaaaaatggggttgagcagtctaccacaaccgaaaaacgactatgaaatcgtggtgcccgaaaatgaagaccaggaagaacccgagcaagctcagtcacaaatgatcgaagatcaagctgatgtagatgcacggaaacaagaagagctcaaggcgaaagccgccagggagctggcgctacgttctcaagtcatccaacgtgatt

SEQ ID NO: 2002 - DNA, 330 bp, Diabrotica virgifera
aaatggtatgtggctcatccagacaagctcaagaaaaaaattacaagagaattaatcacaactattttagctagaaaacctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatattttggaagtgtttgtgagttagacataatcttcaactttgagaaagcctactttatattggatgagttgatgttggggggtgaagttcaggagacaagt

SEQ ID NO: 2003 - DNA, 730 bp, Diabrotica virgifera
gatgaagctagcaagtcagatttagcaaagaaggctggcaaattcacagaagaagttggtaaaactacacataaaattagtgaaacagctcaagaaattagtaaaactggagcgtttcaaagtatatctcaagctactaaggctgttaaacaagaaatagacaatactagtatagaaggtagagtatatgttagtcctaaaatactacgcaagagaacagaaacaagtgcagttgtccatcaaaaatattatgaaccaaacacagatgctacaggcgttgaactacacaaagattctaagttttatgaatcttggcaaaatttcaaagataacaatccatatgtacataaagttatggactggaaattaaaatacgatgaaagtgaaaatcctgtcatccgtgcttccagagctctaacagaaaaagttggtgatatcatgggtggtttatttcagaaaactgaactatctgaaacacttacagaaatctgtaagatagatcctgcgttcgataccaaaagatttctgaaacaatgtgagacagatattattcccaatattctcgaagccatgacgagaggagagttagaagttcttaaagattggtgccatgaaggtccatttaatctttttgctgttcctataaaagaagcctataaaaagggatacaagattgaatcaaaaattttagatatcgatcatgtggatttagtcttaggcaaagtgatgg

SEQ ID NO: 2004 - DNA, 712 bp, Diabrotica virgifera
acctggcttaaatactgtggaagaaggaccaaaacagttcacaaataatgtgagtggtttaaaacaaaaattagaagaaatcaaactcaagttaccatggatagaacgactggactgtgtaaatgcacaagcccctttagcacctgaattagcagctcaaatgttgacccacgaggaaaaaagaagtaatgagcttaaaaataataaaaagctcacacagtttactccaagtgaagacccggttttaaacgactttaaaagagaaatgatgttccacagacaagcccaggctgccattctagattctataccaaagctaaaagatatgggaatactaactaaaaggcctgacgattactttgctgaaatggcgaaaacggatgcccatatgcagaagattagggaacatcttatgaagaaacaggagcaacagaagagaagcgaacgagtcaaacaacttagacagcaacgaaaagaaggtaaaatgttacaagttcagacaaaacttcaaagacaacaagaaaagaaagatatgcttgctcaggttaaaaaagtaagaaagggaatgtccaaagatcttgacttccttgacggaaaaaataaatctgctgccaaaaaaatggcagaaaaacggaaaatgaaagacaaaaagttcggtttcggtggaaagaaaaagggaatgaaaagaaacacaagagatagtgctgcagat

SEQ ID NO: 2005 - DNA, 795 bp, Diabrotica virgifera
tgcagacaagaatcttcgaaccagcgccacctgggagcagaaaagttgtgatagctacaaatatagcagaaacgtctttgacgatagatggtatctactacgtagttgatccaggctttgtgaaacaaaaagtctataactccaaaactggaatggattcattggtagttacaccgatttcacaggctcaagcaaaacaacgagcaggtcgtgctggtagaacgggacctggtaaatgttacagactatacacagagagggcatacagggatgaaatgcttccgacgccagtacctgaaattcaacgtaccaaccttgcaacaacagtcctgcagcttaaaactatgggtatcaacgacctgcttcatttcgatttcatggacgctccgccggtggagtcgttaattatggctttggaacagttacattccttgtcagctcttgatgatgaagggttattgacacgattaggaagaaggatggcagaatttcccttggaaccaaatctttcaaagatgttgataatgtcagttgccctacaatgctcagacgaaattcttacaatagtcagcatgttatcagttcaaaatgtattttaccggccaaaggataaacaagcattggcagaccagaaaaaagcaaaattcaatcaacccgaaggtgaccacttgacgcttttggcggtatataatagttggaaaaacaataaattttctaacgcttggtgttacgagaactttgtacaaatcaggacattaaagagggctcaagatgtgaggaaacaactgctaggaa

SEQ ID NO: 2006 - DNA, 685 bp, Diabrotica virgifera
agatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaacggaaaaaaagtatatgtaggtcgctttattccacacaaagaaagagaaaaggaactgggagaaaaagccaagctgttcacaaatgtttatgttaaaaattttggtgaagattttgctgaggaacagttaaaggttatgtttgaaaagtatggtaaaattaccagctacaagataatgagtaaagaagatggtaaatcaaaaggatttggttttgtagcctttgaaagttcagaggcagcagaagcggcagttgaagctttaaatggaaaagagttggttgaaggaaaacctttgtatgttggaagagcccaaaagagagctgagcgtcaacaagaactaaaacgtcgctttgaagccttaaaaatggaaagacttaatcgctatcagggtgtaaatctctatgttaaaaatctagatgatacaatagatgatgaacgtctccgtaaagagtttactccttttggaaccataacatctgccaaagtgatgttggaagaaggtagaagc

SEQ ID NO: 2007 - DNA, 778 bp, Diabrotica virgifera
tcctactggtcaacctctagttgaactcagtacaaacactattaataaacttcttaccgctctaaacgaatgtaccgaatggggccaagtgttcatcctcgattcactttcaaattacacccctcgtgatgagcgcgaggcccaaagtatttgtgaacgtattactccgagattggcgcatgctaatgctgctgtggttttgtctgctgttaaagttttgatcaaaatgatggagattctagctggagatactgatttctgcaatactttaagcaagaaactagctcctccattggtaacgttgcttagttctgaaccagaagtgcagtacgtggcattaaggaatatcaacttaattgttcagaagaagcccgacatacttaaacatgagatgaaagtatttttcgtcaaatacaacgatccaatctacgttaaattggaaaagttggacataatgatccgtctagcatctcaagtcaacattgctcaagtcctcagtgaattaaaggagtatgctactgaagttgatgtagatttcgtcaggaaggcagttagagctattggtagatgtgccatcaaagttgaaccttcggcagaaagatgtgtggctacacttttggaccttattcaaacaaaagtcaactacgttgttcaagaagctattgttgttatcaaggatatatttagaaaatatcccaataagtatgaaagtattatcagtacactttgcgaaaatttggatactcttgatgagcccgaagctagagccagtatggta

SEQ ID NO: 2008 - DNA, 354 bp, Diabrotica virgifera
gaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatca

SEQ ID NO: 2009 - DNA, 754 bp, Diabrotica virgifera
gagtagacccaaacctcttgtagaatttgcaaataaacccattctccttcatcaaatagaagcacttgtagatgctggagttactgaagttatattagcagtatcatatcgtgctaagcaaatggaagaagagttgacagtggaagccaaaaaactgggaattaatataatattttcccatgaaacagaacctttaggtacagcgggaccaattgcattagccagggatcatctttctaaaagcactaaaccattctttgtgttaaattccgatattatttgcgacttcccatttaaagcattggctgaattccataaaaaccacggaaaggaaggtacaatagtggttactaaagtggaagaaccgtcaaaatatggtgtagtagtatatgataaagacaacagcatccaaagttttgtagaaaaacctcaagaattcatttctaataaaattaatgctggtttgtacattctaaatccaagcgtcattaataggatagaattaaaaccaacttctattgagaaagaagtatttccttacatggctgctgataaacagttgtatgcatttgaattggaaggtttttggatggatgttggtcaaccaaaagattttctgacaggaatgtgtttatatctcaaacatttaaggcagacaaatgaagacaaactttataaaggaccaggtgtcgttggcaatgtattagtagatcctactgctaaaattggaaacaattgtcaaatcgggcctaat

SEQ ID NO: 2010 - DNA, 683 bp, Diabrotica virgifera
acctcttaaaagaaggtgccagcggggcattcgcccagtataacaaagatcaactgacccccgttaaaatagaaaacgccgatcatttagtgcttattacggaatacaacgatttagggaataatagattcttcgaccccagaagtaagcagagttttacctatgatcacctgagaaaagaagccttagactaccaagtctatacccccgatagtgcttctgagccttggcgggcagccttagactccgagttcattcagtacactaggaaccattacaaagatggagtatgtagtgtggtaggccgcaaccagagcggggttgttaacttaacagcttgtatcgaagaccaccagttctctccgaagaactactggaatgggagatggagatctcagtggtccattagtctaactgatgattccactgctgaggtgagaggggtactcaaagtacaggtccattattatgaagagggtaatgtacaattagtaagtactaaagaaataaaagaaactgttcctgtttcatctgaggcacaaactgccaaagaaatcatccaagtaatagaagccgctgaggatctctatcagacggcaatttcagaaaactaccagaacatgtcagatacaaccttcaaggccctacgaagacttcttcctgtcaccaggacaaaaatggat

SEQ ID NO: 2011 - DNA, 780 bp, Diabrotica virgifera
aacaaccaagcacttcattgtgtgaaaactggatctcccactttagaaggctccgaacaacaatgttgctatgataaaaacggctttttgatgctctcttacgatcagcaatggggttctagtccgagacgttgccacaacttgggtaaaatgccttacaatgaagcgacaaaagtgcctactctctcacaatggtttaatgacatggtacccaaatatttgtgttgtctttggcaagacgagcaagctgtgggatgtgaaacactgagatttgaacggagacctacacaggattgtgtagcttaccaagcaccaggtgtagcaggagtctacggtgatccacactttgttactttcgacgatgtagaatatacgtttaatggaaagggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctggattctagatggagatataggttggatgttatagcagataatagaagactttattttgatagaccctcactaaaattccagcacttccaaggtgttactatttacactccaagctacatccttaatcaatcagaagtcatcattatgtttgacaatggagctggaatggaggttgtcgacaatcaaggattcatgagtgcaagagtatttttgccttggtcg

SEQ ID NO: 2012 - DNA, 515 bp, Diabrotica virgifera
gcggctttagttcctttttatttcacttttcactccattttccttcttgatattttgatattttgtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggc

SEQ ID NO: 2013 - DNA, 688 bp, Diabrotica virgifera
aagggaaaggatagttgcagagtgtaatgctgtaagacaagctttgcaagacttgttgactgaatatatgacaaatatgggcaataaagataaaagtgagagcctaatacgagcaatcgacaatatgggtagaaagactaaggatttaagaagacaactgagaaaagctgttgtagatcatgtatctgacagtttcttggaaaccaacgtacctcttctcgttttaataaaggcagctcaaaatggcaacgaaaaggaggtagaagaatatgcagttgtatttactgaacattccaataagttagtagaagttgctaaccttgtctgcagcatgtctaataatgaagatggtgtcaaaatggttagatatgctgctgctcagatcgacaatctgtgtcctgaagtaataaatgcagctagaattttagccgctagacctcgcagtaaagttgctcaagaaaatatggacgcattcaagcaatcatgggagaatcaagtgagacttctgactgaagcagtcgatgacattactactatcgacgactttttggctgtttctgaaaaccatattctggaagatgttaataaatgtgtacttgccttgcaagaaggtgattctgacacattggatcgcactgccagtggtataagaggaagatccaatagggtgtgcaatgtagtaacagct

SEQ ID NO: 2014 - DNA, 753 bp, Diabrotica virgifera
aactacaaaggccactacagccccaacaaccctctcctttggttttgctactcctacgactgtaccgtttggatcatcaactacaattacacctgcaacaactcctcaatttggattatcgcttccaaaggctagtgccccggccactactaccttttcacttctaggatctgccccagccactactgcagcagcacctacaggtatatcatttggtactgccactactacagcaacaacttcagctacaggtttatcatttggaactccaattggaactgctacaactacagcaacaacttcagcttcaggtttatctttcggtcttacaacagcgtcttctacaagttctgctgcacctacacttttgtcatcaacaaccacttcgacaacgtcatcagtgtctgcatctggtgctttgagtagtacaacatcagcaccgacttttgccacctcatcgttgtcttcaacaggcaccttaacattctctcaactcgaagattcgatcaacaaatggaccatggatctagaagaacaaggaaaattcttcatcaaccaggctaagcaattaaatgcatgggatactttacttatatctaatggagagaaaattttaacccttaacagtagcatcgagaaagttaagcaacaacagcaacagttagaccaagaattagacttcgtgctggcacagcaaaaggaattggaagagctgattgtaccgatagaaaaagaattgttggggatacctgt

SEQ ID NO: 2015 - DNA, 437 bp, Diabrotica virgifera
cttaggactggataacgcaggcaaaactacccttctacatatgctcaaggatgacagactggcccagcatcttcccacgttacatcccacatcagaggagctttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactat

SEQ ID NO: 2016 - DNA, 423 bp, Diabrotica virgifera
tgccgacaaaaatcaaacaataacaaatatccttacacaagttcagacattcgttaccacagctctcacttgtagagaaacaataacgtccatgttgcagttttatggaactttaaacgactatctcgacccagctggtggagcagatgaactcgaggttgaggcaaaaagacattatatattgcagttacaccctgagatcaaagacaccctacagacacatactcgaattttgcagactttactcccctttgtggaatcagaaaatatttctaaagtggttgaaatgacagctcaattggaagaggcatctgttagtcatctcagtttgtatggagagtggagagatacaatgtacaaaatggtggtagctctacaagattttactgatataatgagttcgattaaggtattgttctctca

SEQ ID NO: 2017 - DNA, 750 bp, Diabrotica virgifera
agtggcaactttatatggcaaagttgtgttagtcaatctcattgaccaaaagggagctgaaggtaacatggagaaatcctttaagaacgccatgagttcattgtcgtatccttcagcacgatacgaacctttcgacttccattctgaatgtagcaaaatgaggtgggaccgtctgaaaatcctcatagaccgtctagctctggaccaagatgaaatgggcttctttctcttattgcgggatggttccttaagctcgttacaagacggagtcttcaggacgaactgcatagattgtttggacagaaccaatgtggtccaaagtatgctagcgcacagaaatttagaaatagttttaaggaagttgaatattttacaccaaaaccagaacttggagttccagtattccttcgaggttttgtttaagaatgtttgggcagacaacgctgatattataagcacacaatactcgggaaccggagctttaaaaacggattttactagaacaggtaaaaggactaaggctggagtttttcgagacggagtcaattcgcttaccagatactacaaaaataatttaactgacgggtatcgccaggatgccatagatttgttcttaggttacggcaaaccgatatctccactaagagtagacaaatcgtggcgatatattacttacccttcggtacttttagtcgctgtatccatgtttgtagcttctgctgtgtttccttcggaatactcaaccgaatc

SEQ ID NO: 2018 - DNA, 721 bp, Diabrotica virgifera
agattccagcctcagactatggacaaagttgaagctaaggtcggttatagtattaagaaatcccttaacaatgaaacgttgtacatggacagagattctcagattaaggctattgaaaagacctttgaagactctaagaatgtcatcgagaagcattacagcaaaccaaatgtcgtagctgtggatattttgcctgtgtatccagatttcagcctttggaagtacccttgtgcccaagttatttttgattccgatccagctcctgttggcaagcaagtaccagctcagattgaagagatgtctcaggctatgatcagaggtgtgatggacgaaagtggagaacaatttgttgcctactttttgcccacagaagacactcttcagaaacgaagggatgattttgtcaaccagataccatatcaagatgatgaggaatatgagtataagatggcaagagagtacaactggaatgtaaagagcaaggcaagcaaagggtatgaagaaaactacttctttgtggcaagaccagatggaatttattacaatgaactggagaccagagtaaggctgagtaagagaagggtcaaagctggtgctccacctagtaacacaaggcttattgtcaaacacagacccatggatgctaatgagttcagaatgcagaggtaccgagagaaacagctggaaccaccaggtgaagatgatgaggaaatggaggttg

SEQ ID NO: 2019 - DNA, 759 bp, Diabrotica virgifera
aaagctaagaacgctgagaagatcaagcttttggatgaagccatagaagatgccgagaaaaatttaggtgaaatggaagttcgagaagcctacttaagaaaagcagaatactacagccgaattggtgataaagacaacgcagttagtactttcagacaaacatatgataaaactgtatcacttggtcatcgtttagatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattaagagataaagtggtcaaaggttccgaaatattggaagtactgcattcagaaccatttgtaaaagattaccttttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggagttact

SEQ ID NO: 2020 - DNA, 681 bp, Diabrotica virgifera
cagcagaggaataaagggttctcctgtcctctctgccataaagcctaccgagcgcatgctcatagggagatggttcaatgctctaattgtaaaaaatttgtacatgggacatgcgacgctgaagcagatgtagctacttaccatcaaaagaaagatcttaaccctgaatatgaatatgtatgtttacattgcaaaaacagtactgctagacaaataactgcaaaaagagcaagtattgaagactcatcggatgtaccagcttcccatgaatctctttacgatgacacctcagaattcgacctgccttctccggatgaatttgctcgtagtatgggtatgggcaaaggaaaaccgttcgccagcaaaattgctaaaaagcgcatgacctttcccgttggtggtaggccaaaaggtacaggcaaagtacctcccggtaagatgggtttcatgaaacgatctcgactatcggattttaacaggaaaaggggccataaatcaaaaatgtgcggtattttcggcgtacctggtgttggccttcaacgaccgactgccgatggaaaaagcgacgaagagcccggtgtggagaatagattggttttatgttctgccaaagataagtatacgttgacgcaagatatctgtgtcatgtgtggagcgcttggaatggaccaagaaggatgt

SEQ ID NO: 2021 - DNA, 670 bp, Diabrotica virgifera
tgtcaaggaggttttgtcaagatatgatgatgattggattgtggatgatgatggcggtggctatgtggaagatggtagagatatatttgatgatgatctcgacatggagtcaattgctcaagcctcagctaaaagcaaaggcactaaacgaaaaacaaaaaatgtatctgaaaatgctgggaaaggaaaaattcaacaaatgttatccagtttaccttcaaagaaaaaagtggaaacgaaaattgatgatgatgagatgctgtcagaaattcttggagagattgattcctcgccttccactagtggacaaaagccaaagattaacgagtattcagctttagctaaaaagttggctgctaaggattacatgaaaaatttctcccaaccttctaaaaaacgtgtcattgagaggaaatcattaccaaatgaggaagctggggaggtgacacatgggtctgtgttaaaagaagtacagtctaatgtgggaaaatccacaaagaagccccaaagaaatgtcacagaacaaactgttatcaaccctttcaaaaaagtgaaagaaactcctgcagtcaaacagccacaaactgaagcagcccaagaagtaatagaagaaactcctttagaaacctttgatgacaccttgacagaagacttcgatgatgatcccatg

SEQ ID NO: 2022 - DNA, 746 bp, Diabrotica virgifera
ccatacttcagaaccaccaatgcctagagaaagtaaatcgaagaaaaatttgcaatgggtgccatctttgccaaattccagtcatttagatgcagttcctcaagctactcctattaataggaacagagtagcatcaaaaaaggtgaggacattcccattatgttttgatgacacagatccacaagtaaacattgaaaattcttgtcagcaagaaatacttgttcctattagacttgatatggaaattgaaggacaaaaactcagagatacttttacatggaataaaaatgagagtttgatttctcccgaacaatttgcggaagtcctttgtgatgatctcgatttaaacccattgacgtttgtgcctgccatagctcaagcaatcagacagcagctggaagcttttccaaacgaaccgccaagtatactggaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaattcgtaacagccatagcatactctatccgtggtcaactctcgtggcatcagaggacttacgctttcagtgaagctccgcttccgacagttgaagttccgttcagaactcccagcgagtcagatcaatgggcgccgtttttggaaactttaacagatgccg

SEQ ID NO: 2023 - DNA, 666 bp, Diabrotica virgifera
atcagttcccaaagtggatctacagctagtggttttgcagatcatgactatccaactatcagtggagtatcacaagttatcaacaatatgacacaagttaaatgtgttaatagcattcctttaccaacggaaattgttgaccacttttcacgggttcaatgccattgcatgatgggtctcttttgtgaaatcaatagagcttggcttactgtggatagtgatatttatgtatggacttacgaacaaaatactgatctggcatactttgatggaataagtgagaccattgtttgtgttggtcttgtaaagccaaagatgggagtcttccatgcttttataaagtatcttctgatcttggcaacttctgttgatattgtggttttgggtgtaacttttactgagaagccaggtgataccacagaggaaattcagttgataccagacccagtttttagtttaccaactgatggtgccactgttactatcatcagtagtactaatgacggaagaattttttatggcacaaaggagggaaagctctttgaaatatactatcaggctgaaagtggttggtttgggcaaagatgtaaaaaggtaaacttgtctacaagtaccctatcttttctagttccttcatttttaaatgctgctcttagcgaagaagat

SEQ ID NO: 2024 - DNA, 663 bp, Diabrotica virgifera
agaagccatacgttcagtttgtactccggagattgttgttctcacacaggctagttatgtagttctatggctgtgtggattaactactattgttaacttacctttcagtgctcgcgaatcttcgataaatagattggcgccactcaaattagctcctgttttgaatttgaggcctcttactacatgtacgtcgttattggagcttttcatatcctctaccggtggccaggaagccagaaaatcttttgccagagtaaattgcagcgatgaggctttggcccattggcatatctcacttctaccttatttgaatcacgtgagacatataatttggcccataactggaggtacagttcttgccgagtggttgttaagcagtggacaacatttatggttgcaacaatacgttcgtttacttagcaactggtgtgaatggaatagttgtacaagaaacttcttgctagcttccgcctttttgtcaactggagaatataacaaagcagaagatttgtttgaaacggctgctaaaggggttttaacagatggctttttacaagaacgttgtttaaaagggaatttgcctagtccaactggagcgtatattcactattatttaaaggttattcaactatttgatcttcacaaggccaaagattccgttat

SEQ ID NO: 2025 - DNA, 720 bp, Diabrotica virgifera
gagaagctacaaatggttgcaaaaaatccatcaaaacctcattttaaccattatctttttgaaacattttcattagccataagaatcgtatgtaaggcaaatcccactgctgttacagcatttgaagatatattgtttcccattttccaaggaattctacagcaggatattcaagaatttattccttatgtatttcaaattctttctctattgatggagagtacacctcaaggtaataatctggagccctacatgcagcttttaccattcttattggctcctgtgctatgggatagacctgctaatattagtccactagtaagattattatgcgctttcgctctacaagcagccccacaaattgtagcgcaggataaagtgagcggattcctaggagtattccagaaattgattgcttcaaaaactcatgatcatgagggtttctttttgattcaaagtatgattcagcatttaccaatggaagccctagcaccttatcacaaacggatattttcccttttgtttctaagactctcttccagtaagaccacaaaatatgtaattaatctcatagttttcttttcgctgtacgttgtgaaatattcagcaaatgaactgatctcgactgttgacgatattcaagcagaaatgtttggtaaggtgcttgaaaaactatatattgctgaaatacaaaaagtttctgtagccgtcgatagaaaa

SEQ ID NO: 2026 - DNA, 505 bp, Diabrotica virgifera
cttgaacccatttcagttcgaaataacttttgaatgtatagaagaacttagagaagatttggaatggaaaatgatatatgtaggctcagctgaaagtgaagactatgatcaaactttagactcagtttttgtaggacctatacctgaaggcaaacatatgttcgtctttcaagcggatcctccaaatgtctcacgtattccagaaaatgatgctcttggtgttacagttgtactattaacgtgttcttatagaagtcaggagttcattcgtgtaggatattttattaataatgaatatactgatccagaacttaaagaaaatttacctagtcctccacaatttgataaggtaacccgaaatattctagcatccgaaccaagagttacccgctttaaaatcaactgggaagaaaccaaccccacagaaaataacacaaactctgaccaaagtggagcatcagcacccacgacatcagaagctggaccctctgctcctgtcgaagta

SEQ ID NO: 2027 - DNA, 698 bp, Diabrotica virgifera
ctcttcatcaacctgaggaggatcaacttatcttaccaaatgcccttcaacagcaacagcagcagcaacaacagcagattgcgaccagcaattcccaagtacctcctttggcaccaatgggcggattgacacctacacttggacttggcatgggccatgccatgtctgtaccacaaaccaaatatgtaactggtttcgcattgcccatgagttctatgaatgcacaaactccccaacacacaatgagccctatggtgaatttagggggttcaataactacaggagctggagtgactccaacgatggcaccttcaactccttcacctatgacgccaatgactcctcattctgctgaccctggcatcattccacagttacaaaatatagtgtccacagtaaatttaagttgcagattagacttaaagaaaatcgctctccacgccagaaacgccgagtacaacccaaaacgtttcgcagccgtcatcatgaggatacgtgaaccacgtactacagccctaatcttctcttcgggaaaaatggtgtgcacgggagccaaaagtgaagaagactcgaggttagcagcaagaaagtacgccaggataatccaaaaactcggattcccagcgaagttcctggatttcaaaattcagaatatggtgggcagttgtgacgttaaattccctataagactcgaaggg

SEQ ID NO: 2028 - DNA, 340 bp, Diabrotica virgifera
atgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaag

SEQ ID NO: 2029 - DNA, 685 bp, Diabrotica virgifera
caaggaaggagaatgggaaaagttagtgatggacacattcagaaaatatgaaaagtcgagcagggcaaaacacgaggaagaactaaaagaaaagcgagaacaagaagctcgaaaaaaagcagctgctgccaaaaaggcagaagcagaaactgtcaagcctgctcaaatcaccgaattgactgatgaagaagctgaaaggcttcaggctgagattaatgctaagaaaaacacttctgataaagctgaaagttcttcaaatggtccagaagctgcaaccacagctaaaaaagtaggagaagacgaggatgaatctgaaaaaggcaagatactgcccaactcgggaaatggatgtgatctagagaagtacaagtggacgcaaaccttaggagatattgagttaaaaattcccctcaaagtaaacttcagggtaaaacagaaagatctcgtagtaaatatgacgaagaaacacttgacgtgtggtatcaaaggtcaaccacctatcatagacgacgattttccacacgagatcaaattggaagagtcttcttgggtgatcgaagatggaaaagacctgttatttacttttgaaaagataaataaaatgaattggtggagccaaatagtcaaatccgatccagaaatcagcacaaagaagatcaatcccgaaccatccaaacttagcgat

SEQ ID NO: 2030 - DNA, 350 bp, Diabrotica virgifera
gataaaaagcatagcgaccgagaaaggtggatatgtatttaccctgcttacatcaacaacaaaaaaacattggcacagggcagaaaaatagccaaagaaagatgcgttgaaaatcccactcaccaggaaattcgtgatgttctggtcgcggctggtttgaaagtgggtgtcgaaaacaaattgtacagcagagagagaagtaaagaaatgttatatcgtggtagaataaggatacagttaaagaacgacgatggaagtttgtgtaatgacagtttccctaccagagacagcattatgtaccatttaggagacatgattcccaaactgaaaagcaggcaaaataaaagctc

SEQ ID NO: 2031 - DNA, 772 bp, Diabrotica virgifera
atcttcgactagtggaaggagaaaatgatctcgatattacacgagaaacctatgaaagagctattgctaatattcctccaacaaaaaacaaacagttttggagaagatatatttatttatggattaattatgcgatatttgaagaacttgaggctaaagattatgaaagaactcgtcaggtttataaggcttgtttagaaatactacctcacaagatatttactttttccaaaatatggttgctgtttgcacaatttgaaattcgtcagaagaacttaactgcagcaagaaaaatccttggaatgtcaattggtatgtgtcctcgagataagctttttagaggatacattgatctagagattcaactaagagaatttgacagatgcagaaaattgtacgaaaaatttcttgagttcggtccggacaattgcataacctggatgaagtttgccgaactggaaacactattgggggatatagaaagagctagaggtatattcgaattagccattaaccaagccagacttgacatgccagaattattgtggaaagcttacatcgactttgaaatatcacaagatgaaccagataacgcaaggcagatctacgaaagacttctggaaaggacctcccacgttaaggtttggctatcatatgctaaattcgaactcaacaatccaacagaagacgaattaaatgttcgtttagctagaagaatctttgaaagggctaatgaaaatctgaagagctttccagagaaagaagcaagagt

SEQ ID NO: 2032 - DNA, 779 bp, Diabrotica virgifera
gccaagccagaaagaaaaatccaattcagggagaaagtactatggactgcaatcactcttttcatctttttagtatgttgtcagattccattattcggtataatgagttcagattctgcagatcctttctactggattcgtgttattcttgcatcaaacagaggtacccttatggaacttggtatttccccaattgtaacttcaggtctgattatgcagctgttggccggtgccaaaattatcgaggttggtgacactccaaaagacagagccttattcaatggtgcccaaaaattgtttggtatggttattactgtcggtcaagccatcgtgtatgtaatgacaggcatgtatggtgatccggctgaaattggagctggagtgtgccttctcatcatcatccaactgttcgtcgccggtcttattgttttgcttcttgatgaacttctccagaaaggatatggtttaggttctggtatttccctcttcattgccacaaacatttgtgaaactattatttggaaagccttctcaccagcaacagtaaacactggaagaggaacagaatttgaaggagctgtcattgccttattccacttgttgaccaccagacaagacaaaatcagaggattacgtgaagctttctacaggcaaaatcttcccaatttgatgaacttgttggcgacagtactcgtttttgctatagtaatatacttccaaggattcagagtagatctacccatcaagagtgcaagataccgtggacaatattccagcta

SEQ ID NO: 2033 - DNA, 335 bp, Diabrotica virgifera
acatttcaagggtactagagccgaacaggacggattattaagactatcaaccacattatacgttggaaatctatctttttatacaactgaagaacagatctatgagctcttttcaaaatgtggagacataagaagagttgtaatgggtttggataaatataagaagacaccctgtgggttttgttttgtagaatactataacagagctgatgcagaaaactgtttaaggtatataaatggtactcgtttagatgataggattgtaagaacggattgggatgcaggatttatagaaggtagacaatatggtagaggaaaaacaggaggacaggtac

SEQ ID NO: 2034 - DNA, 665 bp, Diabrotica virgifera
cgtggaagaaaagcacttttgggaagcttagggcttattgctggtggtactggtgccttgctgtttgctttggaccaatcagttaaagcatctgatcttgaattgcatcctccaaagaatgtttggagtcattctggaactttcaattccttggatcatgctagtgtaagaagaggttatgaagtatacaaacaagtgtgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataatgaaaccatagaatacagtgacggaacaccagcaactgccagtcaactcgccaaagacgtcgctgtgttcctaaaatg

SEQ ID NO: 2035 - DNA, 779 bp, Diabrotica virgifera
agagaaacatactctcgggacatattgaaaaggctcatgtaagtgattttcaattcgaaaaccagagaagaacgtttacgagctatggttacgcattagacccatcgataagtaatgatggagatggacatctaaaagttgtcggttcaactgaagagggtaaaaacgtagaaagtgttaagactgtatttgaaacttcaaagataagacccttggataagaggaaaaggaaaagaaatgataatccgggtgatatagaaggatttttgggaccatggggtggttttgttgatgaacaaaaagtttctagaccaacggaggaagaacaggctgagttagatgaaataacttctaaaaagaataagaaaggtaaaccaacagaggacaaaccaattgaggaaaagtctgtattgcatatcaaagatccagtggactatcaaggaaggtcttttttgcatgctccacaagatgttggggttaatctcaaatctgatacacctccagagaaatgttttttacccaagtcccatattcatacatggactggtcactccaaaggtgttgcagccatcaggtggtttcccagaacggcacatttgttcctgtctgctagtatggattgtaggattaagatctgggaagtttataatgagagaagatgcattagaacttactatgggcatagacaagctgtgagagacatcaactttaacaattctggaaagctttttctctcagctggatatgacaggtatattaaactttgggacacagaaact

SEQ ID NO: 2036 - DNA, 664 bp, Diabrotica virgifera
ccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttccaccaccaattaaccaattctctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatctgtagctcttacacaagttgactctggagacaggtccaacttcaacaaacttttggaagtaatcaaaactaacttcaacgaccgtgttgatgaaatcaggaggcactggggtggtggtttgcttggatccaaatctgctgctcgtattg

SEQ ID NO: 2037 - DNA, 662 bp, Diabrotica virgifera
gatccagaaagtggtggaattagtgcctgcctataccacgatccccatattttacatacacttagtgctgttcaaattctctgcatctacaataaattagaggcaataaacgtagagggtgttgttaaatatatcgcaagccttcagttacccgatggtagttttacaggagataaatggggtgaagttgatactaggttctcattttgtgcagttatgacattatcgttgcttaataaaatggatgcaattgatgtaaataaagccgtggactttgttttacaatgtaaaaactttgatgggggtttcggatctaggccactttctgaaagtcatgcagggttaatgtattgctgtgttggctttttatctatcacaaataggttagatgccattgatagagacacccttgcttggtggttatgtgaaagacaactaccatctggaggtttaaatggtagaccagaaaaattacctgatgtatgttactcatggtgggtgttatcatcattaaccatgttgggcaggcttcattggattgatgcgaatgctttaaaaaactttattttggcttgtcaagacacagagactggaggatttgcagataggcccggtgatatcgcagatccttttcataccatatttggtttagcagcattgtc

SEQ ID NO: 2038 - DNA, 732 bp, Diabrotica virgifera
ggaaccttatatggctcctgctctattccctatcactctagaagccatgaagtcggaaaacgatgctgtttctctacagggtatcgaattctggtctaacgttagtgatgaagaggttgatttggccatcgaagataccgaagccactgaagcaggtcgaccacctacaagatgttcacggcactacgccaaaggtgccctacaatatatagtaccgattctgctgcaaaaattaacgaaacaggaagaactggacgacgaagacgattggaatccttgcaaagcagccggcgtttgcttaatgcttctcgccacgtgttgcgaagacgaaatcgttccacacgttctgcccttcatcaaagaaaatattaagtctgataattggcgattccgagatgcttctttgatggctttcggatctattttaggtggtttggagagtactactttgagaccgcttgttgaacaggcgatgccgaccttgatagatctgatgtacgacaatagcgttatcgtaagagacacagccgcctggaacttcggcagaatttgcgaaatcattccggaggcggccatcaacgaaaccttcctcaaaccgctattagaaagcttgatcacaggcctcaaggccgaacctcgtgttgccgccaatgtctgctgggcgttctctggattggtggaggcagcttacgaaaatgccgacgttaatgaagaaaccggtactccagatac

SEQ ID NO: 2039 - DNA, 751 bp, Diabrotica virgifera
atttgacttggtttgtgcagcgtataaagcctctaaaggacttagacattgatctacaagaacaagttgagcaggttctgctaaactgggataatggaagtgtaccgggatggccaaaagaaacagggtctgcactaacaaatgttggagcccacttggacctctctgcattttcaagttgggaagaattggcatcgttaggtttagacagactgaaatctgccttaatggcgttaggattgaaatgtggaggtactttggaagaaagagctcaaagattattctcaacaaaaggaaaaggttccttggatccttcacttatgacgaaaaataacaaaggcaaagccaacaaagaaaaggagttattgagacaaagagaacttgcaactttagaagcccaagtgtacagattagcagagtgggtctcaccgcagagagctgcgacaaaagaaaatgtgcaaagaaaacaagctcgtactgacggagaaagagacgacagcgaaaatgaagaaagcgaagatgatagtcctgatgaaggtgacgatgatgttccgtataatccaaagaatcttcctttgggatgggatggaaaacctataccgtactggctgtataaactacatggtttaaacatcagctataattgtgagatatgtggaaattacgtttataaaggcccaaaagcattccaaagacattttgcagaatggagacacgcccacggaatgagatgccttggtattcctaacac

SEQ ID NO: 2040 - DNA, 504 bp, Diabrotica virgifera
ttggaactttcaaagcgttcgacaagcacatgaatatgatattaggcgactgtgaagagtttcggaaaattaaatcaaaactgtccaaagttgaacgtgaggaaaaacgagtattaggatttgttttactgagaggagaaagcatagtttctttaacaatagaaggccctcccccaccagaagaaggtttacccagagtaccaatccctggagcagccccaggaccaggaattggtagagctggaggtagaggaatgccaccaggcatggcaggtgtacctgtaggccttcaaggacctgtaagaggagtgggaggaccatcccaacaggtcatgacaccaggaggtagaggccaagtatctgcacctccacagatgaatcaaggaccaccaaggatgggaggaccaccaccaggcatgatgggaccacctcccggtatgatgggcatggctccccaaatgggaatgggacgtggaggaccaccgccaatgggaatgagaggac

SEQ ID NO: 2041 - DNA, 743 bp, Diabrotica virgifera
aagtcacaaggggcttttaacaatttaattcgggaaatgaaggaacatgatattcaaaaatatttcaattatcttagaatgcatccttgcacatttcaaaaattatttagtctagttggaccagcattagcaaaaacatattgtgttcgtgaaccaatttcgccagaagaaagacttgctattactttaagataccttgctagtggagacagtatgatgtccatttcatatgcatttagggttgctcacaatacagtttccaaaattataaaggaagcatgcgatgcaatttgggattgtttaaaccaagaccagctgctaacaccaagtgaagaagcttggttaaatatcgctgaaggttttggagaaagatggcaactgcctcattgtgttggagcaattgatgggaagcatgtagtaatgcaggcaccttcaaaatcaggctctacattcttcaattataagggcagccacagtatagttttgttagccctctgtgatgcaagttatcgcttcacattggtggatattggagctgaaggaagacacagcgatgggggtatattcaaaaattccaatatgggaaaattaattaatacaaataatataaattttcctcaaccttcattgctgggtcaaggagatactcctttcaatttttatattgtaggtgatgaagcttttcctctaactacttcaataatgcgtccatatccaggtcactttcttcctcgagataagcg

SEQ ID NO: 2042 - DNA, 781 bp, Diabrotica virgifera
tacatgcagtttgccctaatgcatagatctccttctatctccgaagataaggccgccgaaataatcaaccatttatctcagaaagataacgagacaaaacagaaaatgcagatgatggaaccgtttgacaataaatcaataatagctcaaagactctcgttcactaatcgagaaatgaagaaagaatatgaaccaatggacaccaacgattactattcctacttgcataataacgcagagaataaaccgaatcggttttatgacggtgcttacagaccgatgccggttagcagaatctacaagaacatcagatataaggtttggtcgcctggatgtttacaaccgaatcagaaacataagatacctacggataaagaaatcatggagttgttgtatagaatgcaaataacagtcacgccgccagttatgccggatgatacaagaaagtgcatgttttgtcagggtgtttgtgatggagtagctgatggcacggcaagattacttaactttgaagttgataaatgggttcacttaaattgcggtctttggtctgacggcgtatacgaaacggtgaatggggcgttaatgaatttggagaatgctttacaaacaagcctaacgacgccctgcgtacattgcaatatgttaggtgctactataagatgcttcaaaacgagatgttccagtgtgtaccatctgaattgtgcagtaaaagacaattgtgtatttttcaagaacaaaactgtctattgcatagcgcatgtccctaagaacgaaaagg

SEQ ID NO: 2043 - DNA, 707 bp, Diabrotica undecimpunctata
tgaaagtcattccagtggaggtgaggaagctccaacgaaagatgtgcaagaaccaaagcctgggccttctcaggaacctgatgataaggaaaatgatgaagatgaacccgcagatgaggaagctgctaattcgtggctgaatgagtgttttgatgcctatgaagctggtggatatagtcccaagtttcttactccagatgaaatagagccaggaactattgttgttatagaagaagatgatctgaaaagattggaatttgcaagaattcaggtggttggtaaaggaaaaaccgtggaaaatgttataactaaggaagaattgatgttacaaaaagaagctcgtaagggcatggatgcagatgaggcacagttctctgtagagcaagctttggacagtcaagtctatctgtggtctgataaataccgtcctaggaaacccaggtattttaatagggtacacacaggatttgaatggaacaaatacaatcaaacacattatgatatggataatccccctccaaaaatcgtgcagggatataagtttaacatattctatccagatttaatcgacaaaagtagtactccagagtattatctgactccttgcccagaaaataaagaattcgccatattgagatttcatgctgggcctccatacgaagatattgccttcaagattgtcaatagagagtgggagtattcgtaca

SEQ ID NO: 2044 - DNA, 728 bp, Diabrotica undecimpunctata
tatgaagcaaccgaggaaaaattaaaagatatatttggcgaagttggacaagtactatcttttaagcttgtgtttgatcgtgaaactggaaagcccaaaggatatggtttctgtgaatacagagatcaagaaaccgccttgagtgcaatgagaaatttgaatggttatgaaatagggggaagaaatttaagagtggacaatgcttgtactgaaaaatctagaatggaaatgcaaaatcttcttaaccaacctatagtagaaaatccctatggagaggcagttcaagctgaaaaggctcctgaggctataagtaaggcagttgcatctttacctcctgaacaaatgtttgaattaatgaagcaaatgaagacaaccattcagaataatccaacagaagcaagacagatgcttttgcagaatccacagcttgcctatgctcttttacaagctcaagttgtaatgaaaattattgacgcagctactgcagttagtttacttcatcctgtaaaccaagtgccagcaacactgatgcctggagacaaaaatgttcctgttcaagtaccaattagtaatcagtacagggagcctccagcacctgtccaaccaccaagacaggaatttcagcctgttcctgctcctgttatacatccatcccagaatcaagtatttgcaggtcaagatatagatctaagatccattggtgctgtgccagatctgagattaaggcc

SEQ ID NO: 2045 - DNA, 775 bp, Diabrotica undecimpunctata
cgagagcagctaaaagatcttacaaaacaatatgataaatcagaaaatgatcttaaagctttgcagagtatgggccaaatagttggagaagtactcaaacaactcactgaagaaaaatttatagtcaaagctaccaatggtccccgttatgtggtaggatgtcgtcgtcaactagacaaagcaaagttaaaagcaggaactagagtagcattggacatgactacattaactattatgcgatatttgcctagagaagtggacccattggtgtataatatgagtcatgaagatcctggagatgttacttattccgctattggtggtttatctgaacagattagagaacttcgagaggttattgaattgcctttgttgaatccagaattgtttatgagagttggaattaccccacctaaaggttgtttattatatggtcctccaggtactggaaaaactctactagctagagctgtagcatctcagttggatgcaaatttcctcaaagtagtctccagtgctattgttgataaatatattggagaatctgcaagactgatcagggaaatgtttaactatgctaaagaccatcaaccttgcattattttcatggatgaaattgatgctattggtggtagaagattttctgaaggtacttcagctgatagagaaatccaaaggactcttatggaactgcttaaccagatggatggttttgattcattaggacaggtaaaaatgattatggcaaccaacagacccgatactctagatcctg

SEQ ID NO: 2046 - DNA, 666 bp, Diabrotica undecimpunctata
ggctatttctcatgcaggtacttgtctaggcattttagcaaatgatggaattttgttggctgctgaaaggcgtaacactaacaaattattagatgaggtttttatttcagaaaaaatatacaaactaaatgatgatatggtttgtagtgtagctggaataacatctgatgctaatgttttaacaaatgaattgagacttataggtcaaagatatttatatcagtatggtgaatctattccttgcgaacaattagtttcctggctttgtgatgtcaagcaggcatacactcagtatggaggtaaacgtccatttggtgtttcaatattatatatgggatgggataagcattatgggtaccagctgtatcagtcagatcccagtggcaactattctggttggaaagctacttgcataggcaacaacagctcagcagcaatttcaagtttaaaacaagaatataaagaaggtcaaatgactttgaaggatgcaaagacgttagcagtgaaggttctggcaaaaacactggatatggcaaaactaacttctgaaaaagtggaaatggctactcttacccgcaaaaatgataaaactatgatcaaaattttaagcggcaaggaagtggaggaactgatttcagagtatgaaaaaagtgaagctgctgtaga

SEQ ID NO: 2047 - DNA, 680 bp, Diabrotica undecimpunctata
cgaagaagacaaacagcttcaggatgaactaaatttatgtgttgagaaactccaggataatgatgaaaagagatacttgcctgctctgcaagctttatcaaatcatattcaagcctcaactacttcgatgacttctgtacctaagccgttaaaatttatgaggccccattatgacaccatgaagacagtacatgaaaaaataactgatcctgacactaaaaaagtgtgtgcagatattatatctgttttagctatgacaatgggagaaggtagagaatgtttaaaataccggcttctttctaatttggataaaattggtgaatggggacatgaatacgttaggcatttggcaggagagattgcaggagaatgggccgagactgattttatagtaaacactgaaattagagagaaactgattttacttacaaaacaaattgtgccatacaacatggcacacaacgcagaagcagaagcatgtgatttgcttatggaaattgaaaggcttgatctactagaacagtatgtggatgaaaacatttaccacagggtgtgtttatatcttaccagttgtgtaccatatgtggcagatcccgagaatactactctactacagactgctcttttactgtttagaaagttcgatcaatatccacaggcgctgagattagctatgcagt

SEQ ID NO: 2048 - DNA, 664 bp, Diabrotica undecimpunctata
ggaggtccttacgtgaatacagcatggtcatctagttcgatagaggatggacgtccaccaagccaagaggtactagtcaaagagtgcgtgaattgtggtgctagtgttacacccctttggcgtagagacggtaccgggcattatctatgtaacgcgtgcgggttataccacaaaattaatggggttcacagacctccgattaggccttcgaaaaaaccacaggcgacaggaaacagaagaaatggtgtatcatgtgcaaattgcaaaacaaataacacaactctttggcgaagaaataatcaaggggaacctgtttgcaacgcttgcggactttactttaaattacacggggttaaccgaccgatgagtatgaaaaaggatggcatccaaacacgtaagagaagaccaaaaaactctggtggaaatccaggtccatctggccaagtccggatcggcaacatctaccaatatcaacatgctccagaacttgaaatacaacaggacacctaccagttgcctataaacgtatatccttcacccactcaaggaccttacagacaatacgcagctgagaatcttcgaggcttaaatgctcagccattgcaaccaattattgccacagatgacgaacagacaagcgtcataacttctacctcacagcaag

SEQ ID NO: 2049 - DNA, 794 bp, Diabrotica undecimpunctata
ccatttgcagatgtggattctgcctttactttagcctatgcgataataatgctcaacgttgaccaacataacgaaaatgcaaaaaaacaaacgacccccatgtcggctaatgctttcaagaaaaatttgaagggcgttaacggaggtaacgattttgacgaagaaatgttagatgatatatatacaacaataaaaaacgaagaaatagttatgccagccgaacaagccgggttagttagggaaaattatttctggaagatcctgctgaggaagggacagacaaaagatggcatgtacatacatgataatagtggtacttacgattctgagcttttccagattgtgtatggacctatagtagcagctctgtcttctgtttacgagaaggctgaaaacgaaagtgtacataagaaagtcatgcaaggattcgaaagatgcgcctttatcgctgcaaatctcaatatgtcgacaaatttggatatgctcattctcggtatttgtaaatttactgtgttttacaaccaacagaaacagaacaacattgtggttcaatttggaatgaacagcaaggcgcagttggcccttaggacggtatttttcctaattcatcaacacggaaacaccatgagggatggatggaaacacttatttgatctcttgttagcactctatagcaacggactgttgtcaaaaacgtttgtagaggtagaagactttattgaaccaagtggcaaattaattctagtctacaaggaagcaccatctgcggcgaagcaggataccggtttactgag

SEQ ID NO: 2050 - DNA, 496 bp, Diabrotica undecimpunctata
gcagataggcgatttggtattcaagcccaaacagtagctacaaatttccgaaaaatctttgaaatgggaccacatttatatgtaggtcttccaggattagcaacagatactcaaacagttatggaaaaactccgtttccgaaaaaacttgtatgaacttaaggaaaatcgaaaaatatctccaaaagtatttgcgtctatgatatcaaatatgttgtatgaaaaaagatttgggccattttttgtggaacctgtagtagctggacttctacctgatacttatgaaccttttatctgtaatatggatttaattggttgtataaaccaaccttcagactttgttgttggtggaacagcctcagcacagttgtatggtatgtgtgaagcactttgggaacctaacctaggacctgaagatctttttgaaacaatctctcaagcactcattaatgcctttgacagagatgccatttctggttggggagctacagtataca

SEQ ID NO: 2051 - DNA, 773 bp, Diabrotica undecimpunctata
caaaacatctgtgctagctgtaatgatcatatgccaaggcacgtcccgatactcttacagcttcttcaccaagcggattcctttgccatcaccaacacagctaccttgggtcttctaagaggagtggcctcgataataggtcgaatgccgcacgaggagttgacgaagtccttacgggaattatgttctatgcagctcaatccgatatgtcaaatcatagaacaggatgttcatccagtgaagggggccaacacagatccggtaatgtggctcgatagacttagtgcagtgcttagatatgttaatgtacatattcccgaaggtgtggaaaacccttgtaaaccggtaattctcgaagtgtggccggtattgtctcgcacgttcgataaataccaaagtgacattaggataatggagagatgttgtcgcgctgtgcgtttcatgcttcggtgcgttgcgcaagaagtgcgagaactcttagaaagtctagttggacaaatagtgaggatctatacgttataccaacattcgtgttttctgtatgtcggtagtatacttgtggacgaatacgctatagatccgatatgcgtgccaggactactggatatgctacaagcgtttctagaacctacctttcacgtgttgcaggaggagaacgggttgaagaatcatcccgatacggtagatgacttttttaggttgtgcgcaagatttatgcagagggcacctttagcatttttaaaatgttcttccttggtccacatcttacagtg

SEQ ID NO: 2052 - DNA, 744 bp, Diabrotica undecimpunctata
caatcctccaccaccaaatataccatccagtggcggtacaatgattcaaagacctactggtgctccctattcaccaatgagaggtggaattattccgccacagcagggaaataaaaggcctgcagataataggacccaactgcaacagaaaagtaatgaatacagccatagtacaagtaagaagaagaaaaagctggcagataaaatcctgccacagaaagtcagagatttggttccagaaagtcaagcttacatggatctattagcatttgaaagaaaattggactctactataatgagaaaaagattggacatccaagaagctcttaagcgtcctatgaagcaaaaaaggaagttgagaatatttatttccaataccttctatcctgccaaggaacctcagcctgaaggacccgatggaccatgtcaggaaggcactgttgcttcttgggaattaagagtagaaggtcgtctcttagaagatccaaagaacgatccaaataaagttaaacgcaagttttcttctttctttaaatccctggttatcgaattggataaagagctgtatggaccagacaatcatttagttgaatggcatagaacactaaccacccaagaaacagatggtttccaggtaaaacgccctggtgacaagaatgtgagatgtactattttgttgcttcttgattatcaacctctgcagtttaagcttgatcctagactagctagacttttgggagttca

SEQ ID NO: 2053 - DNA, 313 bp, Diabrotica undecimpunctata
agaacccacattagatgagttagaacaaaaaatgagagaagctgaaacagaatcacatgagggtaaaaggaaaaatgaatcattgtggccaattttcaaaatccatcatcagaaatccagatatatatttgatcttttttatagaagaaaagcaattagcagggaactatatgactattgtcttgaggaaaacattgcagataaaaatttaatagcgaagtggaagaagcaaggatatgagagtctttgttgcctacgatgtattcaaacaagagacactaactttggaacaaactgtatttgtcgtgtacct

SEQ ID NO: 2054 - DNA, 702 bp, Diabrotica undecimpunctata
ggaggatgaattcagaaccatcagacaaatagtacaaaaatatcagtatgttgctatggacacagaatttcctggtgtagttgcaaggcctattggagaatttagaagttctgcagattaccaataccaaatgctgaggtgcaatgtagatttattgaggataatacagcttggactgacgtttcttgatgataacggaaaaactccaggtggtgcctatactacatggcagttcaacttcaaatttaaccttcaagaagacatgtatgcacaggatagtatagacctcctgcaaaattctggaattcagtttaagaaacatgaggatgaaggtattgaacctctcgaatttgcggaattgcttatgtcatctggtattgtcctggtggaaaatataaaatggctatccttccattctggttacgattttggctacctgataaaactgttaacggacaacaatttacctcaagacgaaacagaattcttcgatttgttaaaattatattttcctaccatatatgatgtaaagtaccttatgaaatcgtgcaaaaatcttaaaggaggattacaagaagtggcagaacagctagaacttgaaaggattggaccacaacatcaagcaggttcggattctcttctgacaggaatggcatttttcaagatgaaagagatgttcttcgaagacaccatagacgactc

SEQ ID NO: 2055 - DNA, 733 bp, Diabrotica undecimpunctata
tctggtactggtaaaacagccaccttttctatttcgattttacaagctttagatttaacaatgcgagaaacacaagttttatgtttgtctcctactagagaattggctgtacagattcaaaaagttattctagctttaggtgattttatgaatgttcaatgtcatgcttgtattggaggtacaaatcttggagaagatatcaggaaactggattatggacagcatgtggttagtggaacacctgggagagtttatgatatgatcagaagaagagctctaagaacaagatctgtaaaaatgttggttttggatgaggctgatgaaatgttaaataaaggattcaaagaacaaatttatgatgtatatagattccttcccccatcaacacaagttgtactcatttcagctacactgcctcacgaaattttggaaattacttccaaatttatgacagatcctattaggattttggtaaaacgtgatgaattgacattggaaggtataaaacagttctttgtggcagttgaaagagaagaatggaaatttgacaccctctgtgacctctatgatacattaaccattactcaggctgtcattttctgtaacacaaagaggaaggtggactggctgacagagaaaatgagggaaaacaattttacagttagttcaatgcatggagatatgccacaaaaggaacgtgacaatattatgaaagagtttagatcgggacaga

SEQ ID NO: 2056 - DNA, 768 bp, Diabrotica undecimpunctata
ggtagggaacaagcttgtaatttatcagatatcaaagttattaagcaactgggaggaacagtagaagatactgaattagtggaaggaattactttcccacaaagatctgcaaatgtgtctggaccaaaaaggattgagaaagctaaaattggttttatccagttctgtatttcacctccaaaaacagatatggatcacaatgtcattgtgtctgattatgctgctatggatagagtattaaaagaagagagagcatatattttaaatatcgtcaagcagataaagaaagctggatgtaatgtacttttggttcaaaaatcaattttgagagatgcagtttcggatcttgccttacactttttggataaaatcaagtgcatggttattaaggatattgaaagagaagatgttgaatttgtatgtaaatctttaggctgccgtcctattgcatctttagatcattttgttgctgaaaacttggttaccgctgatttagttgaagaggttggagtggcaggaaatagaatggtcaaaattacaggtgcacaaaatgcaggcaggacagtaactctactggttagaggatccaacaaattggttcttgaagaggccgatagatctcttcatgatgctctatgtgtaattcgttgccttgttcgcaagaaggcacttattgccggtggaggagcacccgagattgaggtggctcttaaactagctgccatggccaacaaactggacggcattgatgctatttgtacaagggca

SEQ ID NO: 2057 - DNA, 788 bp, Diabrotica undecimpunctata
  misc_feature (184)..(184): n is a, c, g, or t
aacacagcaatgccttagtagatgttctgccaccagaggcagattcttcaataagcatgctccaggctgatgaaaaaccagatgttcaatacagtgatattggaggcatggatatgcaaaaacaagaaataagggaagctgtagagttacctttgactcactttgaattgtataaacaaattgncagtgatattggaggcatggatatgcagaaacaagaaataagggaagctgtagagttacctttgactcactttgaattgtataaacaaattggtattgatccccccagaggtgtgttgatgtatggacctcctggatgtgggaagactatgttggccaaggctgttgctcatcatactacagctgcttttattcgtgtagtcggatcagaattcgtacagaaatatcttggtgaaggtcctcgaatggtgagagatgtgttccgtttggcaaaagaaaattctccagcaatcatctttattgatgaaattgatgcaattgcaaccaaacgatttgatgcgcagacaggtgctgatcgtgaagtccagagaattttattggaattacttaaccagatggatggttttgatcagacaacgaatgttaaggtaatcatggcaactaacagagctgatacattagatcctgcacttttgagacctggccgtctggacagaaaaatcgaatttcctttaccagatagaagacaaaaacgtttgattttcagcactatcacatctaaaatgaatttgtcagaggaggtcgacttggaggactatgtagct

SEQ ID NO: 2058 - DNA, 343 bp, Diabrotica undecimpunctata
gacttgggaatggatgaagaagaagaggaagtggttcctttaccaaatgtaaactctgctatactcaggaaagtcattcaatgggcgacttaccacaaagacgatcctccaccacctgaagatgacgataataaagaaaaaagaacagatgatatttcctcttgggatgcagacttcttgaaagtggaccaaggaacccttttcgagttgattttggctgctaactatctggatatcaagggactcttggatgtcacatgtaaaactgttgctaatatgattaaaggtaaagctcctgaagaaatcagaaagactttcaacatcaagaatgactttacagcgt

SEQ ID NO: 2059 - DNA, 696 bp, Diabrotica undecimpunctata
gattgcaagcaattaaccgaaaatcaagttaaaacactatgtgataaggctaaagaaatattgtcaaaagaatcaaatgtacaagaagtgaaatgcccagtaacagtatgtggagatgtccatggacaattccacgatctgatggaactgtttaggataggaggtaggagcccagatactaattacctgttcatgggagattatgtagatcgtggatactattctgttgagactgtcaccttactggtagcactgaaagtcaggtacaaagagagaattacaattttgagaggcaaccacgaatcaagacaaatcacacaagtttacggattttacgatgaatgtctaaggaaatacggtaacgcaaatgtttggaaattcttcaccgatctgttcgattatttgcccttaacagcactcgtcgatagtcaaattttctgcctgcacggtggattgagtcctagcattgataccttggatcacattagggcactagatcgtttacaagaggtacctcatgaaggtccaatgtgcgatcttctatggtctgacccggacgaccgcggaggctggggcatctctccccgtggagccggctacaccttcggacaggacatttcagaaacgttcaaccataccaacggtctgtctttagtatctagagcgcatcagctcgtcatggagggttacaattgg

SEQ ID NO: 2060 - DNA, 643 bp, Diabrotica undecimpunctata
ttgcaattcaagcagacaataatggaatgcaaatttttgtaaaaacactcaccggcaaaaccatcacccttgatgttgaaccgtcaaataccatcgagtatgccaaagctaaaattcaagacaaagaaggtattccaccgaatcaacaaagattaatctttgctggaaagcagttggaagacgatcgtactttctcagactacaatattcaaaaagaatctaccctacatttggtacttcgtcttaggggaggtatgcaaatttttgttaaatctttaactggaaagattgttaccctagaagtagaaccttcagatactattcaaaatgtcaaagctaaacttgatgataaaataggtgtaccaccagaacaacaaagattaatctttggtggaaatcagttggaagatggtcgtactctctcagactacaatattcaaaaagattctacattcaatttggtacttcgtcttagaggaggtatgcaaatttttgttaaatctttaactggaaagattactaccctacaagtagcaccttcagatactattcaaagtatcaaagcaaaacttgatgataaaataggtgtaccaccaagtcaacaaagaataatctttgctggaaatgagttagaagatggccg

SEQ ID NO: 2061 - DNA, 685 bp, Diabrotica undecimpunctata
ggatttgaaatgcaacccaaggtatacaaagattgtaaaatagccctgttaaacattgaattggaacttaaagctgaaagagataatgcagaagtaagagtagataatgtaaaagaatatcagaaaattgttgatgcagagtggacaattctttacaataaacttcaaaaaatttatgagtctggagctaatgttgttttgtccaaattacccataggagatgttgctactcaatactttgctgacagggatatgttctgtgctggtcgtgttcaagaagatgatatgaaacgtacgctgaaagcatgtggaggtgctgtaatgaccactgttaatgacatcaacgattctgtactcggtaaatgtgagctgtttgaagaaaaacaaataggaggagacagatttaacttctttaaaggctgtcccaatgccaaaacatgtactttaattttacgtggaggagcagaacaatttttagaagaaaccgaaagatcactacatgatgccatcatgattgttagaaggactattaaaaatgatgcagttgtagctggtggtggtgccatagagatggaattatcaaaaattttacgggatcattctcgtacaattgccggcaaagaacagcttctgattggtgcaatagctaaggcattagagatcatccccagacaattatgcgata

SEQ ID NO: 2062 - DNA, 747 bp, Diabrotica undecimpunctata
  misc_feature (84)..(84): n is a, c, g, or t
tgggtctcactagaacgtatacaattcgttggtgcttgtaatcctccaactgatcccggcaggaagcctctatcccaccgattngtggaacagaaaggtttttacagagcctcggatcaatcctgggtctcactagaacgtatacaattcgttggtgcttgtaatcctccaactgatcccggcaggaagcctctatcccaccgtttcctgcggcacgtacccgttatttatgtagattacccaggagagacatctttgaaacagatctacggtactttcaccagagctatgctaaggttggcgcctggtctgaaaggttatgccgaaccattgactaatgctatggttgaattttatttggcatctcaagatagatttactcaagatatgcaacctcattatgtatattctccaagagaaatgacgagatgggtaagaggaatttgtgaagctataaggcctcttgataatcttcatgttgaggggttggtaaggctttgggcccacgaagctctccggctattccaagacagattagtcgaagacaccgaaagacgttggaccaacgaaaacattgatgctgtagccttaaaacacttcccatcagctaactgtgagaaagctttggaaagacccattctttacagcaattggttatctaaggattatgtacctgttggaagagaacaactaagagaatatgtaaaggccagactaaaagttttctacgaagaagagcttgatgtt

SEQ ID NO: 2063 - DNA, 696 bp, Diabrotica undecimpunctata
aaagttgttttggccacaaatatagctgaaacgtctttaacaatagacaatattatatacgtaatagatcctggttttgctaaacaaaatcatttcaattcgagaacagggatggagagtttgatggtagtaccaatatctaaagcttctgcaaaccagagagctggcagagcaggcagagtagcagctggaaaatgttttagattatacactgcttggtcttataaacatgagctagaagacaatactgtacctgagatccagcgaataaatttaggaaacgctgtactcatgttgaaggcactaggaataaatgacttggtacattttgattttttggatcctcctcctcatgagactttagtgttagcattagaacaattatacgctttgggagctttaaatcatcacggagaattgaccaaattgggcagaaggatggctgagttacctgtagatccaatgatggcgaaaatgattttagcttcggaaaaatataaatgctctgaagaaatagtgaccataggagccatgttatctgtaaacggagccatattttacagaccaaaggataaaataattcacgctgatactgctcgaaaaaatttcaatcacttagcaggagatcatttaagtcttcttaatgtttataatcaatggagggattctgattactccctacaatggtgttacgaa

SEQ ID NO: 2064 - DNA, 693 bp, Diabrotica undecimpunctata
tggagaattttcgaagagcaattggtttgagaattagggaaaccaaagaagtttatgagggggaagtcagtgaattgacaccagtagaaacagagaaccctgctggaggttacggaaaaactgtaagtcatgttatcattgggctaagaactgcaaagggtagtaaacagctcaaactggatcccagtatatatgaagcactccaaaaagagaaagttgaagttggagacgtcatttatattgaagccacaagtggtgcagttaaaagacaaggaagatctgatgcctatgccaccgaatttgatttagaagctgaagaatatgtaccattaccaaaaggagatgtacataaaaagaaggaagttattcaggacgttacattacatgatctagatgccgctaatgctaaacctcaaggtggacaagacgttctgtcaatgatgggccaacttctaaaaccaaagaaaacagaaatcacagataaacttagaaaggaaatcaataaaatagtagataaatatattgatcaaggtattgcagaattagttcctggtgtactatttatcgatgaagtacacatgttggatatagaaacattcacttatctacacagagctttagaaagtgccatagctcccattgttatttttgcaacgaatagaggtcgttgtctaattagaggaacggacgatg

SEQ ID NO: 2065 - DNA, 691 bp, Diabrotica undecimpunctata
gaagggctagggatgaaaaactaatgactaatattcttcaaactcttcgtaacaatggtaacgtacttatagcagtagacacggcaggcagggttctggagttggctcacatgttggatcagctatggcgtaacaaagaatctggcctgttagcatactccttagcgttgttaaacaatgtcagttataacgttatagaatttgccaaatcccagatagaatggatgagtgataaattaatgagaagttttgaaggcgccagaaataatccctttcaatttaagcacttgcagtggtgtcacagtttagcagaattaagtaaagttcctagtccaaaggttgttcttgcaagttcacccgatttggaaagtggattctccagagaattgttcttgcagtggtgttctaattccaacaacagtattatattaacaacaagaacatcccctggtactttagctagagacttaattgataacggagcagaaagaaatatagatttaacggtagaaaggcgagtaaaactcgaaggtgtagaacttgaagaatatgaaaaacgacaacgagcgcgaggtcacaatgtagaaaaggaagatgcagattcggactctgattctgacatagaaatgtctgttatcaccaaaggtagacacgacatagttattaaacaagagggaaaaataaatgccgg

SEQ ID NO: 2066 - DNA, 659 bp, Diabrotica undecimpunctata
ttgtagtcgtcgaaactgttgactaccaacccttcgaaattggaaattttccagctccaactacccctgaagaagtcggagcccgtatcttaattcaagagagaatagaagaaggtgaagatatcgaaatgcaactagagagtgatgaggaagaatcaccagttacggaatctggtttaagtagtatgcaggacaagaccaatcggaagacacgcgacgacaccagaattcaagacatggaagaagaaagttccgatgaagagaaaggagaagacgacgaggaattagttttacctccgccaccaccgtctattcaaccaccgttaccccctattcccgataaagttgtcgtgaaaaaatatgatcccaaacaagctgtcaatgttagccgaccaacaatcggagatgattatctcgtgtcacccatcactggagagaaaatacctgcgaacaaagtgcaagaacatatgcgtattggtctgttggatccgcgttgggtagagcagcgcgacaaacaaataacggacaaaatgaaccaagaaacagtatatgctgctggtagtgccatcgatgcttcattgaaactgctcgccgagcgacgtactgatatttttggtgttggagatgaagaaacagctattggtaagaagattggcgaa

SEQ ID NO: 2067 - DNA, 687 bp, Diabrotica undecimpunctata
gtgttcttcttggttgttggcgtgctaaaggagttttagatgtttctaacagttttgcagttccctttgatgaagatgacaaagataaatctgtttggttcttggaccatgattatttagaaaatatgtatggaatgtttaaaaaagttaatgctagggaacgagtagtgggttggtaccacactggccccaaactgcatcaaaatgatattgccattaatgagttaatcagaagatattgtccaaattcagttctagttattatagatgctaaaccaaaagatttaggtttaccgactgaggcttatcaagctgtagaagaagtacatgatgatggttcacctacttctaaaacatttgagcatgttcctagtgaaattggagctgaagaggcagaagaagttggtgttgaacacttattgagagatattaaagatacaactgttggcactttgtctcagagaataacaaatcagcttttaggattaaaaggtctccattcacagttacgtgatattagggactatttagtacaagtttgtgctaaccaacttccaattaatcaccaaatcatctatcaattacaagatatatttaatcttttaccagatataaatcaggatgcatttaatacatcgttttatgttaaaaataatgatcaaatgttagttgtttatctggcagctt

SEQ ID NO: 2068 - DNA, 677 bp, Diabrotica undecimpunctata
caaatcgcggatgtgataaggacatgccttggtcctcaagctatgttaaaaatgcttatggatccaatgggaggtattgtgatgactaatgatggcaatgctattttacgtgaaattacagtacaacatccagctgctaaaagtatgattgaaattgcaagaacacaagatgaagaagttggagatggtactacctcagtaattgtcttagcaggagaaatgttagtggcagctgaacagtttttggaacaacacattcacccaacaatcataattcgccagtacagacaagcacttgaagatatgatccagttattggaaggtccattgagtataccagtcgatagaaatgataaaaatgctcttgcacaagttgttaaaggctgcattggtacaaaattcataagtaaatggtcagatttagcagtaaatattgctttagatgcagtaaacacagtattattagaagaaaatggcagaactgaagttgatatcaagaggtatgccaaagttgagaagattcctggaggatctattgaagagtctaaaattttaaaaggtgttatgcttaataaagatgtaacacatcccaaaatgaaaagatatatacagaatccgagaataatacttttggattgcgcattagaatataaaaaaggggaatctcagacaaatgt

SEQ ID NO: 2069 - DNA, 552 bp, Diabrotica undecimpunctata
aatccttatgccgacaatggagggagtgtagtagcaatagcaggtgaagactttgtaataattggtgcagatacacgtttgagtgctggattttccatttacactagagaacaaaacaaactattcccgctatcaggcactacagttttaggctgtgcaggatgttggtgtgatactctaacattaaccagaatccttaaatctcgcatgcagatgtaccaacaagagcataacaaaacaatgtctacaactgcatgtgcccaaatgttgtcaaccatgctctactacaagagattctttccttattatatatcaaacattcttgttggtttagataatgaaggaaagggctgtgtttacagctatgatccaatcggacattgtgaaaaagctacttatagagcaggtggttcggctggagctctgctccaaccccttttggacaatcagattggacaaaagaacatgcttaaaacatctggagaacctcttagtcaggagaaagctttggctacactgaaagatgtatttatttctgctgctgaaagagat

SEQ ID NO: 2070 - DNA, 665 bp, Diabrotica undecimpunctata
gctactcagtggctatgtttcctggcaatgaacgagaagacgttgaaaggggtggaaaaattatcatgcccccatcagctttggaacaattgactaggttaaatatcaactatcctatgttgtttaagcttgtgaataaaaagactcatcgcacaacacattgtggagttttagaatttgttgctgatgaaggaaaagtttatttgccactttggatgatgaacaacttagtactcactgaaggagatttggttcagatggaaagtgtttcccttccagttggcacattttcaaaattccaacctctcaatccagacttcttggacattactaatcctaaggcagtcttagaaaatggtttaagatcttttgcttgccttacaacaggagatgtcattgcagtaaagtacaatcaaaaggcttatgagttgtgtgttctagaaaccaaacctggagatgcaattagcatcattgaatgtgatatgaatgtggaatttgctgctcctgttggatacaaagaacccgaacaagtcaaaaaggaagaagaagaaatggccatagatcctgcagatttaatgccagaaccttctggatttgtagcatttagaggtgcaggaaatcgacttgatggcaaaaagcgtaaagatacttccggagctgatagt

SEQ ID NO: 2071 - DNA, 698 bp, Diabrotica undecimpunctata
aggaaaggttggtggaaaattggaagacacaacattagttaaaggtgtagttattgacaaaacaatgtcccatccacaaatgcccaaagaactaaaagatgtaaaattggctattctcacctgtccatttgaaccaccaaaaccaaagaccaaacataagttggatgtaagcagtgtggaagattataaggaactaagacagtatgaacatgataagttcaaggaaatagttggattagtaaagaaagctggagctacattagcaatttgccaatggggcttcgatgatgaagccaatcatttattgttacaacaagagttaccagctgtaagatgggttggaggtccagaaattgaacttatagccatagctactggcggtaggatagtaccccgttttgaagagcttactccagaaaaacttggttatgctggtttggtacgggaaattgcatttggcaccactaaagatagaatgttggttattgaagaatgttcaaattcacgggcagttacaattcttgttagaggaggtaaccaaatgttagtagctgaagccaagagaagtctccatgatgcattatgtgttgtcaggagtttagttcaggaaccaagagtagtgtatggtggtggagcagcagaaattgcctgcagtttggcagtcgcggctcaagcagatcaactagcttccttggaac

SEQ ID NO: 2072 - DNA, 194 bp, Diabrotica undecimpunctata
tcaaaaggagaaaagaaacgttttgaagtaaaaaagtggaatgctgtagctttgtgggcctgggacattgtagtggataactgtgccatttgccgaaatcatattatggatctatgtattgaatgccaggcgaaccaggcgtcagccaccagtgaagaatgcactgtagcttggggtgtttgtaatcatgcgtt

SEQ ID NO: 2073 - DNA, 792 bp, Diabrotica undecimpunctata
ggttggagaaaagcagtagatattgccagaaaagctcttctagacactgccaaagacaacagctctgatttagaaaagttcagagaagatctgatgaacattgccagaactacactcagctcaaagattctgtcacaacataaagaacattttgccaaactggcagtagatgctgtgttaagattgaaaggttcaggtgatttacagtctatccagctaattaagaaaactggtggtaccttggaagaatcctttttggatgaaggtttcttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtcaacaaaattcttaaacataatgctaatgtatttattaatagacagttgatttacaattatcctgaacaactatttgctgatgcaggagttatggctattgaacatgcagattttgatggaattgaaaggctagcacttgtcacaggaggagagattgtctcaacatttgaccatccagaattggtaaaactaggaacttgtaagcttattgaacaaatcatgattggagaagatatcctgctccgtttcagtggtgttgctcttggagaagcttgcacaattgtcatcagaggtgctacacaacagatcattgatgaagctgaccgatccattcatgat

SEQ ID NO: 2074 - DNA, 651 bp, Diabrotica undecimpunctata
  misc_feature (356)..(356): n is a, c, g, or t
gcatcaggtagaatatgccatggaagcagttaacctaggttcagccacagttggactaaaaagtaaaactcatgctgtacttattgcgttgaagagggcttcttcagaactgtctgcctaccaaaagaaaattatcaatatagacgatcacattggtattaccatctctggacttacagcagatgctagaattcttagtagatatatgcgaaacgaatgcttgaattataagtactctttggatacttatatgccgttaaataggctcattagtattttaggcaacaaaatgcaaacatgtacccaaagatatgaccgcaggccattcggtgtgggtcttctagtagctggttatntgcgaaacgaatgcttgaattataagtactctttggatacttatatgccgttaaataggcttattagtattttaggcaacaaaatgcaaacatgtacccaaagatatgaccgcaggccattcggtgtgggtcttctagtagctggttatgatgaatctggttcccatatctaccaaacgtgcccttctgctaatttctacgattgcaaagctatgtccattggagctcgatcccagagtgccaggacttacttagaaaaacatctcgatgaactgccatccagtgctttagaaga

SEQ ID NO: 2075 - DNA, 789 bp, Diabrotica undecimpunctata
ggactttgccaaattctacgaaacaaatggtcaaatagaagatgctcgcctcatctttgaaaaagcatcccaagtttcttacgtcaaagtagatgatttggcaacagtgtggtgtgaatgggccgaaatggaaataaggaacgagaattatgatgaagctttaagactcatgcataaagcaactgttatgcctagtcgaaaagtagcatatcatgatgacactgaaacagtccaaagtcgtctttataagtctctcaaagtttggtctatgtatgcagatttagaagaaagtttcggtacatttaagtcttgtaaagccatttacgacaaaattatagatttgaagattgcaactccgcaaattattataaattatgggatatttctagaagaaaataattactttgaagaggcattcagagcatatgaaaaaggaatatctctatttaaatggcccaatgtatacgacatatggaacacctatttgacgaaattcctaactcgttatggaggatcaaaactagaacgcgccagagatttgttcgaacaatgcttggatggatgtccacaacagtttgccaaacatctctatctgctttatgcaaaattagaagaggaacacgggatggctagacatgccatggctgtatatgaaaggtcaaccaaagctgttccagagcaagaaatgttcgatgtttttaatatctacatcaaacgagccgccgaaatttatgggattcccaaaacgaggcagatctacgaaaaggctatcgagttacttccagagga

SEQ ID NO: 2076 - DNA, 658 bp, Diabrotica undecimpunctata
ctattgtgggagctctttgtacaagcagggcctttagtcaatgtacatatgcccaaagatcgagtaacgacaatgcaccagggctatgggtttgtagaatttatgggagaggaggatgcagattatgctattaaaattatgaacatgataaaattgtatgggaagcctataagagtaaacaaagcttcagctcatcagaaaaatttggatgtaggggctaatatttttattggaaatttagacccagaagtagacgaaaagttactctacgatactttttcggcgtttggagtaatattacaaacacctaagattatgagagatcctgatactggtaactccaaagggttcgctttcatcaattttgcaagttttgaagcatcagatgcctctatcgaagccatgaatggccaatatttgtgcaatagacccatatcagtgtcatatgcattcaagaaagactccaaaggagagagacatggttctgcagctgaacgtctccttgctgctcagaatccattatcacaggctgataggcctcatcaactgtttgctgatgcacctccaataggtttgatgcccatgtcaatggccccacctcctccaccagtcataatgacaggaatgatgcccccgccacctccaacactttcaaact

SEQ ID NO: 2077 - DNA, 636 bp, Diabrotica undecimpunctata
gcacccaaacttcgttatttagatttctcagaaagacatggttacattaagggtgttgtaaaagatatcatacatgaccctggccgtggtgctccattggcagtagtacatttcagagatccctacaagttccaaaccaggaaggaattatttattgctcctgaaggaatgtatactggacaatttttgtactgtggaaaaaaagctaacctccaaattggaaatgtattgcctgtaggaactatgcctgaaggtaccattgtatgcaatttagaagaaaaaactggtgaccgtggtcggttagctcgtgcatctggaaactatgctactgtaattgcccataatcatgatacaaagaaaaccagagttaagttgccctctggagccaagaaagttattccatcaaacaatagggctatggttggtattgttgctggaggtggtcgtattgacaaaccaatcttgaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaaaagaggaacatctgctggtcgtaaagttggtctt

SEQ ID NO: 2078 - DNA, 290 bp, Diabrotica undecimpunctata
aaacagttagcaaccaaagctgctcgtaagagtgcgcctgccactggaggagttaaaaaacctcatcgttacaggccaggtaccgtagctcttcgtgaaattagacgttaccagaaaagtactgaattacttatcagaaaactacctttccaacgtcttgttcgtgaaatcgcacaagattttaaaaccgatttacgttttcagagttcggcagttatggctttacaggaagcgagtgaagcatatttggtaggtttgtttgaagataccaatttatgcgctattcacgc

SEQ ID NO: 2079 - DNA, 678 bp, Diabrotica undecimpunctata
caagatgatatgactggcgatggcactacatctacagttttagtcataggtgaactattaaaacaagccgatattttcatagctgaaggtcttcatcctagattgttaacagaaggctttgataaggctagggcaaaagcattggaactactggacaagatgaagattccaattgatgcaaacaaagaaactttgacagatatttgcaggacaagtttaagaacaaagctacatcaaaaacttgctgatgttttgacagacgtttgtgtggatgctgttctagctataaagaaagatgataaacctgttgatcttcatatggttgaattaatggaaatgcaacacaaaacagaaactgatactcagttaattaagggtttggtcctggaccatggctcacgtcatccagatatgcctaaaagtctcaacaattgctacattttaacatgtaatgtcagcatggaatatgaaaaaagtgaagtcaattcaggattcttctacaaaactgcagaagagagggagaaattagtgactgctgagcgtgaattcattgaacagagagttaagaaagtcattgaattgaaaagatcactctgtaatggaactgataagacttttgtcgttattaaccaaaaaggtattgaccccatgagtctggatatgcttgccaaagaagga

SEQ ID NO: 2080 - DNA, 651 bp, Diabrotica undecimpunctata
aacgtccaacaaccaaaatctgtcacagctgcaaaggtcattaaaaagatgaatcccgatatcaatgttgttgcacatgagaatcgtgttggacctgaaactgaaaatgtctacaatgatgatttctttgaaaagttagatggagttgctaatgcactcgataatgtagatgctaggatttatatggacagaagatgtgtttactaccgcaagcctcttctagagtctggaactctaggaactaagggaaacactcaagtggtggcgccttttctctctgaatcatatagttcttctcaagatcccccagagaaaagcattccaatctgtaccttaaagaatttccctaatgctattgagcatactctacaatgggcgagagatatgtttgaaggattatttaaacaaaatgctgaaaatgcttcgttgtatataaccgaccccgattttcttgatagaactgttaaactacctggtgtacaacctttggaggtactggaatctgtaaaggctgccttagttgatgagagacctaaagatttaaatgattgcattgcatgggcacgtaatcattggcaagaacagtattccaaccaaatcaggcagttgttgttcaacttcccacctgatcaattaaccagtacaggccag

SEQ ID NO: 2081 - DNA, 612 bp, Diabrotica undecimpunctata
tgaatgtgataaaatgttggagttattagatatgagacgtgatgttcaggaaatatatcgtaacactccccatgaaaaacaagtcatgatgttcagtgccaccttaagtaaagaaattagaccagtttgcaagaaatttatgcaagatcccatggaagtatatgttgacgatgaagctaaattaacattgcatggtctacaacaacattatgtaaaactaaaagaaaatgaaaagaataaaaagttatttgagttactagatgttttggaattcaaccaggttgttattttcgtaaaatccgtacaaaggtgtgtggcgctggcacaactactgactgaacaaaactttccagcaataggaatccacagaggaatggatcaaaaagaaagactgtcccggtatgaacaattcaaggatttccaaaagagaattctagtagccactaacttatttggacgtggtatggatatcgaaagagtgaacattgtcttcaactatgatatgcccgaggattccgacacttacctgcacagagtggcgcgagctggtcgtttcggtaccaaaggtctagccattaccttcgtatcagaagagggggatgccaaaatatt

SEQ ID NO: 2082 - DNA, 671 bp, Diabrotica undecimpunctata
tctatcattcaagggttgccgaattaaccgataaattggattcaattagaggctttttacattctcgtctacgtactgctacactcaggaatgattttgaaggtcaagctgtgcttataaattgcctgttgagaaattatttgcattattctttgtatgatcaagccgataaactagtgagtaagtgtgtatttcctgaaactgcaagtaacaatgaatgggcaagattcttgtattacttaggcagaattaaggctgcacgattagaatacagtgtagcacataaacatctcgtgcaggccatgagaaaagcaccccagaatgctgctattggtttcagacagactgttcaaaagctaacagttgtagttgaactattgttaggagatataccagaaagacaggtgtttagacaatctagtatgaggcactcccttgctccatactttcaattaacacaagcagttagaatgggaaatttgcaaagatttggtgaggtgttagagaactttggcccacaatttagacaagatcatacatttacactaattttgagactgcaccacaatgttcttaaaacagctataagatctataggattatcatactccagaatatctccccaagacatagctaagaaactggggctggattcagctgaagatgcagaa

SEQ ID NO: 2083 - DNA, 796 bp, Diabrotica undecimpunctata
gatcaatgagggaaaaccctaatcctgaaaaagatgctacgtacagtggagagaatttcgttcgttttactggtgatacgaccaatcatgctaaggctcagttatttgcttgggaagcgtatgaaaagggtgtggatgttcatcttttagctgaaccaacaaaattagaactactcaaaaaagaatatgagaaaaagaaagaagaggttaaatcgacaattcaaagcagtgtgttagataagtacggaggacaggaacatttagaggcaccacctaagagcttgttgttggctcaatcagaagtttatgtggaatattcaagatctggtaaagtcattactggggcggaaaaagaagtcattagatccaaatatgaagaagatgtgtacataaataaccacacatcagtgtggggatcgtattggagaggaggacaatgggggtacaaatgttgtcactccttcataaagaattcctattgcctaggcgaggcaggaaaaacggttaacgctcctgtaacgcaagatattccaacggatcaagacgttggtgaagcaagcagtacaaaggaagccgggatatcagatggtgaaagcgaagatagtagttccagtaattcatcagaaggtgagaaactgaaaaagaaacagagaagattaaagaaaaaggaaaagaaggcaaagaaaaaggagaagaaagctaaagaaaagttgaagaaaaaacaggaaaaagaaatggccccagaagtagatgagcaaataatgttggacgataggaaaaggccgtacaacagtat

SEQ ID NO: 2084 - DNA, 499 bp, Diabrotica undecimpunctata
tctccgtaagaagaggaagttcgaattaggacgcccagccgcaaataccaagcttggagctcgtagaattcactatgtccgtacacgaggcggtaacttgaaatatcgtgcattgaggattgaaaaaggaaatttcgcatggggcagcgaaggtactgctcgtaaaacacgtattattgatgtcgtttacaatgccagtaataacgaattggtacgtaccaaaacattggtaaaaaatgccatcgttgttattgatgcaacccctttcagacaatggtatgaaaaccactacattttacctttagggcgcaagaagggggcaaaattgacaacagaagatgaagaaattttcaataagaaacgtagtaaaaaagtacagaaaaaatatgaaactaggcaaaaaacagctaaagtagaacctgctctagaagaacaattccaaactggaagattattagcttgcttagcatcaaggccaggacaatgtggtagagctgat

SEQ ID NO: 2085 - DNA, 740 bp, Diabrotica undecimpunctata
ggatactgccgaacaagtatacatatcctccttagccctattaaaaatgttaaagcacgggcgtgctggagtacccatggaagtaatgggtcttatgttaggagaattcgtggacgactataccgttcgagtaattgatgtatttgctatgcctcagactggtaccggtgttagtgtagaagctgttgatccagtttttcaagcaaaaatgcttgacatgctaagacagactggtagaccagaaatggttgtgggatggtaccattcacatccaggttttggatgttggttgtcaggagttgatatcaacacccaacaaagttttgaggctctctcagaaagagctgtagcagtagtagttgatccaatacagtcagtgaaaggcaaagttgttattgatgcatttaggttaataaatcctaatatgatggtattgggtcaagagcctcgccaaactacctctaacttgggacatctacagaagccatcagtgcaggctttgattcatggtctaaatcggcattactactccatcagtattaattacagaaaaaatgaattggaacaaaaaatgctactaaatctccataaaaaatcctggatggatggtctaactttagcagattactcagaaaattgtagtgtcaatgaaaagactgttgctgatatgttagaactagccaagaattacaacaaggcattagaagaggaggaaaaaatgactccagaacaacttgcta

SEQ ID NO: 2086 - DNA, 650 bp, Diabrotica undecimpunctata
ccttgatgatggtggagaaagtccctgattcaacttatgaaatggtaggaggacttgacaagcaaattaaagaaatcaaagaagtaattgaacttccagttaaacatccagaactgtttgatgcacttggtattgcacaacctaagggtgtgttgttatatggacccccaggtactggaaaaactcttctggcacgtgctgtagctcatcatacagaatgtacatttattagagtatctggttcagaattggtacagaaattcataggagaaggatcccgtatggtaagagaactattcgtaatggccagagaacatgccccttcaattattttcatggatgaaattgattccattggatcttcccgtattgaatcaggatctggtggtgattctgaagtccaaagaaccatgttggaacttctaaatcaattggatggctttgaagctaccaaaaacattaaagtaattatggctaccaacagaatagatattttggatcctgctttactcagaccaggaagaattgacagaaaaattgaattccccccaccgaatgaggaagcgagattggacatcttaaagattcactccaggaaaatgaaccttacaagaggaataaatcttagaaaaatagctgagttgatgcca

SEQ ID NO: 2087 - DNA, 477 bp, Diabrotica undecimpunctata
atctggtttcgagcttcaaagcttcagctttttccaaagagggtcaattcaggagtttatgtcattcttttgcaaaaccatagtggaaagaacaataccagcttcaagacagagtgttaaagaaggagaatatttgtgtcatgtatatgtaagagctgacaacttagctggtgttatgataactgatcatgagtacccatcaagggtttctcacacactaataacaaaagtactagacgaatttgctgccagaattcccgcagctaactggcccaaccttgaggagagagatgtagcatttccacaattaaatacctacttagcaaaatatcaaaatcctagagaagcagatgctatgactaaaattcaagaagatcttgatgaaacgaaaattattttgcataataccatacaagcagttttggaacgaggcgagaaactagatgacttggtgagcaagtcggaaggtttaagcat

SEQ ID NO: 2088 - DNA, 615 bp, Diabrotica undecimpunctata
cgaaggaagattgtttcaagtagaatatgccatagaagctattaagttaggatctactgctattggaatatgtaccagtggtggagtagtgcttgctgtagaaaaacgtattacttcccccttaatggaacctactacgattgagaaaattgtagaagttgacaaacatattggatgtgccgtttcaggacttatggcagattcaaggactatgatagatagagctcgtgtggaatgtcagaatcattggtttgtctacaatgaaaatataagtgtagaatcctgtgcacagggagtatcaaatttggctattcagtttggagattctgatgaagatggtgcagccatgtctagacctttcggagtagcaattttgtttgctggtatagatgaaaaaggacctcaattgtaccacatggacccgtcaggaacattcgttcagtttgatgcgaaggcaataggatcaggatccgagggggcacagcaaagtttacaggaggcatatcatcgcagtatgaccctggaagaagctaccacaactgctttaacaattctaaaacaagttatggaagaaaagttgaattcttcaaatgttgaggttatgactatgactcc

SEQ ID NO: 2089 - DNA, 734 bp, Diabrotica undecimpunctata
ataaaggccgtcaatgtcttgaaagctcatggtaaaagcgccagagagagttttctcgtacccggttatgcattgaactgcaccgtcgccagccaagctatgcccaaaaaaattgttaacgctaaaatcgcatgtttagatttttcattgcagaaggctaaaatgaagatgggtgttcaggttttaattactgatccaaatcaactggaagcaatccgtacaagagagctcgacatcaccaaagaacgcatccaaaaaatcctctctactggtgttaatgttattcttgtgagtggtggtatcgatgatctttgcctgaaatacttcgtggaaaatggagcgatgggtgtaagaagagtaaagaaagcagacttaaaacgcattgccaaagcaaccggtgccactttcctaacctctctaagtaacatggaaggagatgagagtttcgattctagcatggtaggagaggcagcggaagttgttcaagacagaatttctgatgatgaattgataatcattaaaggaccaaaagcacgtactgcagcctcaataatcttgcgaggacccaacgatttctattgtgatgaaatggaaagatctgttcatgacgccctgtgtgttgtaaaacgtgtactcgaatcaaaaagcgtcgtagtgggtggaggcagtgtcgaagcagcgctttcgatatatttggaaaactttgccaccacactaagctccagggaacaatt

SEQ ID NO: 2090 - DNA, 668 bp, Diabrotica undecimpunctata
tcagcaaattcaacaatgacttacagtttacacttactgtttaagttttcggttttgactttgtggcataatggccccgtacccggaaacttttataactttcccggctcgcacaccagctattcaaaccctataacacatacacagtctcccgttacaacatcaacttctgtattagctattacttacgataaaggagtactgatggccggagatctggttgcttcatatggatctttagctaggtacagaaattgtccaagggttattaaagtcaatcagaatatcatattgggagccggcggagactatgctgattttcaatacgtgaagagttttattgagcaaaaaataattgatgaagaatgcattgatgatggactaaaaatgaaaccaaaatcattgtactgttggcttaccagagtaatgtaccaacggaggagtaaattggacccattttggaataatttggttataggaggaatccaggatggagtcccatttctaggaactgtagataaattaggaactgcatatacagacaaagttatctgtacaggttatggagcgcacatagccttgccccttctgagagactccttagataaaaatggggctcttaacttagctgatgccaagactctgatacacaaatgcatggaagtgtt

SEQ ID NO: 2091 - DNA, 653 bp, Diabrotica undecimpunctata
tttagaagacactcagcacctgagcattgaaagggagaataagagtaatgacaaggatgtagaagaggaaaataagcagaaacttgcagccattttagaaaaagtggaaggatgcaaggaattgttagaagtaccaggaagaaaatttttatatgaaggagatttgttagaaattgatccaacagaaaatacatctttgaaaactgttcacgtgtatttatttacagatggatttatgataacaaatagaaattccaatagtcgaggtttgatgaagtacatttatgaaataatgtacgatttaagtagtctggcagtggttaacgtgagagatttaggaaatgttaaacacgcgtttaaattgttaattttcccggacacgagagtttttcaatgttcttctaattccaacaagaaagaatggttggacaaatttgaccaagcaaagaagactagactagctcaagagcaacaaaagagagaatctatttcggaaaaatcaccctcacgatcagcttcaatagagtctccgagttataatccatttgacgaaattgaagacgatgtaggaatggtgcacccagaatggtttttggacattccagaggaacttgatgtgtgtgtagctcaaagacacttcgaagaagctcttt

SEQ ID NO: 2092 - DNA, 755 bp, Diabrotica undecimpunctata
tggattgttacccaaggatgaagatggagaggccgatattgaaattgaattggttgaagatgaagctccatttttgcaaggtcacggtagagccttacatgatcttagtcctgtaagaatagtcaaaaatccagacgggtcattagcccaagctgccatgatgcaatccgctttggctaaagaaagacgggaacagaaaatgattcagcgggaacaggaggtcgattcccagccttccggtaagaataagagttggatagatcctcttccagaggacgaatcaagaatgatgggcagaggaataggcttacaagttcaagatttaccagaatggaaaaaacatgtaataggtggcaaaaaatcatcattcggtaaaaagaccaacttaacaataatagagcaacgtcaatccttaccaatatataagctcaaagaggaattacgaaaagccgtaaccgacaatcaaattcttatagttattggtgaaactggttcaggaaaaacaacacaaataacacagtacttagctgaagctggatttacatcgagaggaaagattggttgtactcaaccaagaagagtggcagccatgtctgtagctaaaagagttgctgaagaattcggatgtcgtttgggacaagaggttggttacaccattcgtttcgaagattgtactagtcccgaaactatgataaaatacatgacagatggtatgttattaagggaatgtctcatggatctggacctcaaacaat

SEQ ID NO: 2093 - DNA, 719 bp, Diabrotica undecimpunctata
tagctggacaagaaagtgactgtcaattgtacaaactgaatcctaaactagtcgaggaagtagaaaatatcggcaataatactcatctcaggcaaagaaatacaaaaaacaaagaagttacagatgacaacaaaaatgtgacaaaagagttatattttgatgttaaggctatagaaaatgttcaaactgactttaatggcagtgaaccattatcgagggtagtaaaaattaatcatgatggtacattattagctacaggtggtacagatggagatgtacgaatatggaagtttcctagtatgcaacctttatttattcttaaggcacatacaaaagaaatagatgatatagattttagtaggtatgacaattatgtgattaccatagccaaagatggtttagcagtattgtgggattgtatgacaggaaaagaaagaacgaaactaacatggaaacagcctgaaggatcaaaatatttatataaacgttgtagatttggtgtgatagaaggactagacaagaaatgtgcactatacacaatatcaaatccaataggagtagctaaaaaacaaaaatcctatctccagcagtgggtacctgaagaaaacatgttaagaaggtgtatagaatttgatgagagtctggctgctttagctgttcgtgatgatggtagatttgttgctgttggtacaatgtttagtggatcagtgtccattctt

SEQ ID NO: 2094 - DNA, 671 bp, Diabrotica undecimpunctata
aacttataaaggccaccaggccttttttgagtttaataagcaaagcaaaagctgctaaattggtaaggtctctcgttgattattttctggatttagaagctggcattggtattgaagtacaactctgcaaagaatgtatagaatgggcaaaggaagagagaagaacttttctacgtcagtcccttgaagctaggctgattgccctttattttgacactggaatgtacagcgaagcgttacaactggaatcaaccttactgaaagagttaaaaaagttggatgataaaaatttgttagtggaagtacaactacttgaaagcaaaacatatcatgctttaagtaatttaccgaaggctagagctgcactaacttcagcacgaaccacagctaatgctatctattgccctccaaagatgcaggcagctttagatttacaatcaggagtattacatgctgcagatgagaaggatttcaaaacagcttattcttacttttatgaagcttttgaaggttttgatagtgttgaatccccaaaagccctcacagcgcttaaatacatgcttttgtcaaaaattatgatcaacagtccagaagatgtccaacaaattgttagtggtaaattggcctttaaatatgctggtcaagatatagaggctatgaaatcagttgca

SEQ ID NO: 2095 - DNA, 718 bp, Diabrotica undecimpunctata
gaccgtttggctggatatatagatcgagtaagatatttagaaggtgaaaataacagattaacgagggaaatacaaaccactcaggaaacggtaacaagggaagtttcaaacataaaatctatgtacgaccatgaattatcagatgctagaaaactattagacgaaacccaccgtgaaaaagcacgtttagaaatagatgttaaacgtcttttagaagagaatgacgaactcaagtctgagttagcgaaaaagaataaagatttggctctagctgaaaattctgccagaatatacgagacaagatgtaatgaattacagcttaaagcaaatcaagcagcttctgatgctaagaaagcaatcgcagatgctaaagaacttgaaaaagaacgtgataagctacgtaaacttcttgataaccatcgtaaacagctagaagaagaatcattggcgagggtggaagttgaaaatgccaaccaaagccttcgagaagagctatcatttaaggatcagatccatcaacaacagttgaccgaaactcgtactcgtcgtcaagtagaaattagcgaaattgatggtcgtctggcagaaaaatacgaggctaaacttcaagaggctctacaagatctcagagatcaatatgaaggtcaaatggccaacaaccgtggcgaaatcgaattgctatatgaacagaagattaaaaacttgcaatcggctaatg

SEQ ID NO: 2096 - DNA, 651 bp, Diabrotica undecimpunctata
gagagccgttgaattcaaagtcgtcgaaaccgatcctgctccgtactgtatagtggctccagatacagtcattcattgtgatggagatccaatcaagcgcgaagaggaagaagaagctcttaacgctgttggatacgacgacatcggaggttgtagaaaacagctcgctcaaatcaaagaaatggtagagttaccactgagacatcccagtctcttcaaggctattggagttaaaccacctagaggcatcttactgtacggtccaccgggtactggtaagaccctcattgcacgtgcagtagccaacgaaacaggagctttcttcttcttgattaacggtcctgaaattatgagcaaattggccggtgaatccgaaagcaatcttcgtaaagccttcgaggaagccgacaagaattccccagctattattttcattgatgaattggatgccatcgctcccaaaagagagaaaacacatggagaggttgaacgtcgtatagtatctcaacttttaactttgatggacggtatgaagaagagttcccacgttatcgttatggccgctactaacagaccaaactcaatcgatccagctttacgtagattcggaagattcgacagggaaatcgatataggaatacccgatgcaac

SEQ ID NO: 2097 - DNA, 650 bp, Diabrotica undecimpunctata
agttcccagtctatgtgaagatctactatcatctgtggatcagccattaaaaattgcaaaagataaagaaactggaaaagattatcttctttgtgattataatagagatggcgattcctacaggtcaccatggtccaatacatactacccacccctagaagatggttcaatgccatctgagaagttaagaaaactagaactagatgccaatcttgcatttgatcaatacagggaaatgtattttgaaggaggtgtatcctctgtttatttttgggatttagaccatggatttgcaggagtcattctaattaaaaagactggagatggtagtaaaaagattaaaggatgttgggattccttacatgtagtagaagtacaagagaagagttcgggaagaaactcccattataaaatgacttcaactgctatgttatggcttcaaactaataaacagggatctggaactatgaacttgggtggaagtctaactcggcagatcgaacaagatgcagctgtaaatgatatcaatccccacatagccaacattggaagaatggtagaagatatggaaaacaaaattcgcaatacattgaacgaaatttacttcagcaaaacaaaggacatcgtcaacagtctgcgatcagttcaac

SEQ ID NO: 2098 - DNA, 672 bp, Diabrotica undecimpunctata
taaagccaacaacaaagctggcgcgggtaggaagaaaaacgccgcacagccaccaccgatgcagttcgattctgaggacgaagataatgccaaaccgatgtcttacgacgaaaaacggcaattgtctttggatattaataaattaccaggtgacaaattgggtagagttgtacatataatccaatccagggaaccgtcgttgagggattccaatcctgacgaaatcgagatcgatttcgaaacgctgaaaccctcaaccttaagagaattagagagttacgttgcgtcgtgtcttcgcaaaaagccacataaaaaagtagctggcaaatctaaggacgaacaaatagcggaaaaaaagcaagagttagaaaaaagactaatagatgtaaacgataaaatcggcaactccaagaaggcccccaaaaaagatgaagccaacaaggtagatccaacgggcgcgggaggtccctcaggccgcttatcctctagctccagcagttcggactccgacagcagtagtagcagtctgtcctctagttctagcgactccagtgacagtgaagcaggtgggacggcgaaccgacaggccaaaaagaaagcgaataaaaaatcacctaatccttctctaggaagttccaccaccaccaccactacgactataaaagtaccgcc

SEQ ID NO: 2099 - DNA, 704 bp, Diabrotica undecimpunctata
atgagcaaaggacatgtcattgaccaaatccctgaattgccattggttgtcagtgacaaggtacaagaaatgagcaaaactaaacaggccgttcagttcttgagaagaatcaaagcatgggctgacattcaaaaggtttacaagagtcaacgtttccgtgctggtaagggaaaaatgcgtaataggagacgcatccaacgtaaaggaccattggttgtttactacaaagatcaaggtctccgtcgtgctttccgtaacatcccaggcattgacctcattagcgtacagaagttaaacttgttgaaacttgctcctggtggtcatgtaggtcgcttcattatttggaccgaatccgctttccaacggttagataaattgtttggcacatggaaaacaccatcattagaaaagaagggttacaatctaccccaacctaaaatggcaaatactgatctatctagattgttgaaggctgatgaaatcaaagctgtattacgtgctcctcaaaagaaggttgtacgtcgtgtacgtcgtctcaatccattgaccaacgccaaggctatgcttaaattgaatccatatgctgctgtactcaaacgtgaagccattttgaagaatcaaaagagacagttaaacagagaagaacttttggccaagaaacgtggtattaccttgagtgccgacaacgtcgtgattagatccag

SEQ ID NO: 2100 - DNA, 738 bp, Diabrotica undecimpunctata
ggcgttccataacatatcctacgccgaagccgaaaaatgcatggttaatatggatcagggtgaagttatcattaggccttcgagtaagggtgcggatcatttgaccattacttggaaagtgactgatggaatctatcaacatattgatattaaggaacaaggaaaagttaacgctttttctttaggaaaatcattatggattggaaatgaagaatttgaagatcttgatgaaataatagctagacacgttacaccaatggcagcgcatgctagagatttactgtattttagatattacaaagatttcgcgggtggtcataaagataaggctgaagaatatcttaaagatgaaaaaaagaaaaatgcttctaaaattcattatgtaattagtgctgctaagaatatacctggtaaatttcttctttcgtatcttccacgaaacaaagttagacacgaatatgtaacagttactccggaaggcttccggtttagacaacaaatgtttgattccgttggttcgttgtttaaatggttcaaagaacatttccgggagcctccgccaggtggcgcaacgccgggtagtacgccaaggctggcctcaagccgaactggatatggaactgccacacctgcgtttagtatgaataatgaagctattcaaagagttgctcaaaatttgccaagtcatgtagttcaagcgttatctgctgccaccaatcaaactccacattatcccca

SEQ ID NO: 2101 - DNA, 779 bp, Diabrotica undecimpunctata
ttaaggatcatgctgctgttgtagaagaattagatttagtagaagaagaagatcaattcactcatcttattatgttagatgatgttaaagaggctaatgcagaggatatattgaatgtgttcaaatttgatgataattatgaagaaaatgaagataaatacaaaacccttagtaaagaaatattaggcagtgatggtgaatctgaatcaggttctgaaggttcagaagaggaatctgaagatgaaaatgaggatgaagtcaaggatcaggggacaataattgacaatactgaaactaatttaatttctcttagaagaacaatatatttgactattcagtctagtttagattttgaagaatgtgcacataagctactgaagatggagttgaaacctggacaagaaatagaattgtgtcacatgtttcttgactgttgtgcagaacaaagaacctacgaaaaattttatggcttgttggctcaaagattttgtcaaatcaacaaagtgtacatcgagcctttccaacaaatttttaaagatacttattctacaactcacagactagatgccaataggttgagaaatgttagcaaattttttgcacatttactttttactgatgccattggatgggaagtactggaaatcatgaaattaaatgaagaagataccaatagttctagtaggattttcataaaaatcttgtttcaagaattggctgaatatatgggactaggaaaattaaatgcaagattaaaggatgagaccctacaggcttat

SEQ ID NO: 2102 - DNA, 791 bp, Diabrotica undecimpunctata
ttgaacctccaagacagatgtacagaggggcacatgtgttttttacagaagtatgcccggaagaactgttcaatgagctgtgcaagtcttgtgcggccagaaaaattaagactctcaaggaaatcaacattgcgttcttgccgtacgagtctcaggtgttctcattggattcaccagacacgttccaatgtagctacgatccctcgttttccgccgccagaaacgccaatatggaaagaatggcggaacaaattgcgactctctgtgcaactctaggagaatatcctcacgtcagatatagaaccgattgggaaaggaatgttgagctggctcaactaattcagcaaaaattggacgcctataaagccgatgaacctaccatgggagagggaccggaaaaggcgagatcgcagttgctaattctcgatcgaggtttcgactgtgtatctcctcttcttcacgaactcaccttccaagcaatggcctatgacttattgccaatagaaaatgatgtgtataagtacgaagcatcagctggcgttctgaaggaagtccttctggatgaaaacgacgaactttgggtcgatctacgccaccaacatatcgcagtggtgtctcaaagcgtcacgaagaatctgaagaaattcacagactcaaaacgcatgacccagagcgacaagcagtcgatgaaggatttgtccaccatgatcaaaaagatgccgcaatatcagaaggaattgtctaagtatgcgacgcatcttcatctcgctgaggactgtatgaaggcctat

SEQ ID NO: 2103 - DNA, 797 bp, Diabrotica undecimpunctata
aaagataggtgctctgcaaatttacaaaaatactatgaatccaaaggtcatcagaagaagcagattcagtcagggggttttcaagatcttcgaagagatcttcaagctgttataggaactcgagcaaacattaatattgcacagatcgaaaattatggtggggaaacttttttatctgaagaattagctattacgatattacaagatacaaaacacgcttttcaaagatgtcagttgttatccaaacccacagaaagggcctcaaacgcaactcaaattttggatcgattgataaacagcttattagtagagcatgtcgactatgcagtagaattgggcttacaagctgtgcctgttgtagaaggaaccaaaactcccccagcgctatatttttttagtgtcgtccaccacagtaataatattatacatcttgttgagaaacagttcatggatttattggttccattagttgaaaacaccccaaggaataacgattgtgtacaaaagaaaaagtttgtactggaagatatagaacggaagattaacacaggactagataggtgtctcaatgccatttcgagctgggtcaaactgtatctccaaacagaacagaaaaaatctgacttcaaacctgaatctgacgacttcgacacagtagcgtcacccgcttgtaaaaacgtcatcaattacgttaatagtattgtaaaagaaattaaagcgaacctggatggtaataatgtcacagccatattgcaagaacttggcataagattacaccgagtggtgtatgatcacat

SEQ ID NO: 2104 - DNA, 702 bp, Diabrotica undecimpunctata
ttggtcagaaactaacagggatcgcagagaaagacttcgacaacttgctttagaaactatagatttacaaaaggatccctattttatgaaaaaccatttgggatcatacgaatgtaaactctgtttgacattgcacaacaacgaaggaagttacttggcccacactcagggtaaaaaacatcaggctaatttagctaggagagcagccaaagaggctaaagatgcacctacacttttgcaaccagagaaacccagagtagaacctaagaagtttgtgaagattggtcgacctggttatagggtaacgaagcaaagggatgctgaaagtggacaacagagtcttttgttccagattgattatccagaaataagtgatatgattctacctcgtcaccgttttatgtcagcttatgaacaaaaaatcgaacccccagatcgtaaatggcagtatctcctatttgcagcagaaccttatgaaacaattgccttcaaagtaccaagcagagaagtagagaaaaccgacagcaaattttggactcattggaacaaggatactaagcaatttttcctacaatttgcatttaaaaatgacaataagagaactgttaatacagtggtccaaagacatacaattgttggtgcagcaccaccacctccaatgctgccagttccaccaccaccaagaccaccaatgttcaatcc

SEQ ID NO: 2105 - DNA, 288 bp, Diabrotica undecimpunctata
aacaattaccggcgaagtatatagaggaaaactgatagaagctgaagataatatgaattgccaaatgactcaaattactgtaacttacagagatggaagagtagctcaattggaaaatgtttatattagaggatcaaaaattagatttctagtattaccagatatgttgaaaaatgctcctatgttcaaaaaacaaactaaagcgggaacggcaggtcgaggaaaatctgctatactgcgagcccaagctcgggggagaggcagggggcaaacacaaccagtacgagg

SEQ ID NO: 2106 - DNA, 746 bp, Diabrotica undecimpunctata
tcaacaagttggtgcaaatcttacagccacatctgatagagaaaccatatcctataccttggaaggaacaagaagtgctgttgaaaaggctctaccatatctagcagaagtagctaccaaccaagaatttagaccttgggaactttcagaactgtccaacagattaattttggatattttaaccagacctttacaattaagagccattgatttgcttcacaatgctgcctaccgtagcaaagggttaggtaactcactcttcattccaaagtctcaagtgggaaaagtttcatctgaaacattacaacattatgtagctaacaactttgtagctggccgtgctgcagttgttggtacaggtataagtgagagtttgttaaatcaatttgctgctagtttggaaattccaaatggtgaaggcagcaccaatccatccccttacaaaggtggtgaactcagatcaaacaaaggtggaccacttgcttttgttgcagttggaggagaaggagctcctttgaaaaacaccaaagaagctcttgcatttgcagttctacagaaagctgtatgtgctggccctcagatcaaatatggtgtacttgataatggagtctacagcaaagctcttggtggatcatcggatgtatctgcctgcgctgttaatgtgagctattcagacagtggtttgtttggtattttgcttgctgcacctgctggatctgtaggcaaagcagttcaatcagctgtta

SEQ ID NO: 2107 - DNA, 183 bp, Diabrotica undecimpunctata
tgatctgcaagaaaagattggtgtcctaaaatcgttgactatagacattggaaacgaagttaaataccaggacagacttctcagagatgtcgatgacgatatagataagacaggaggtttcttgggcacaactatgtcaagagtactgagattatccaaaggatcccataattacctcatcct

SEQ ID NO: 2108 - DNA, 788 bp, Diabrotica undecimpunctata
gtggtcagaagattcccattttctcagctgctggtctgccacataacgatattgctgcccaaatttgtaggcaagccggtcttgtcaaaattccaggcaaatcagttttggatgatcatgaagacaactttgccattgttttcgctgctatgggtgttaacatggaaactgctagattctttaaacaagatttcgaagaaaacggttctatggaaaatgtatgtctgttcttgaacttggctaatgatccaaccattgaaagaatcatcaccccgcgtcttgctctaacagctgccgaattcttggcttaccagtgtgaaaaacacgtgttggtcattttaactgacatgtcttcatatgctgaagctttgcgtgaggtatctgccgccagagaagaagtacccggtcgtcgtggtttcccaggttacatgtacaccgatttggccaccatctacgaacgtgccggtcgtgtcgaaggccgtaacggttccatcactcaaatccccatcttgactatgcctaacgacgatattactcaccctattcctgacttgacaggttatattaccgaaggacagatctacgtcgatcgtcaattgcacaacaggcaaatctatccaccaattaacgtactgccatctctctcacgtttgatgaagtctgccatcggcgaaggtatgaccagaaaggaccactctgacgtttctaaccaattgtatgcttgctatgctattggtaaggacgtccaagccatgaaagctgtagtaggtgaagaagctctaacacca

SEQ ID NO: 2109 - DNA, 599 bp, Diabrotica undecimpunctata
ggaacaacctggagatgttattagttacgccgccgaatactttacgaggttgagggaaaccagggtaacatccagagtgtatgatgaagctgctgcctcgcaggaggaacttgtatcacctgacgaatctgtaatgtccaaagatgaagaaccttcaatccggtttgctggtaggcgtaaatcagtattcgcagaaacttacgatccagaagaagacgacgacgatgatgatggcgccaaattggtgtatccgaaatctgatgagcaacgtcagagattggccactgctgttaaaaacatattgctgttcagatctctagataaagatcaaatgaatgatgtcttggatgccatgttcgaaagagtagtcaaaaaggatgaattggtaatcaagcaaggagatgacggcgataatttttatgtaattcaaagtggaactttccatgtgtttgtcgcaccagatccatcgaaagaacccaatcacattcacacttacgaaaatagtggcagcttcggagagttggcgttgctctacaacatgccccgtgcagctacggtcaaagcgaatagcgaaggttccctttgggctatggataggc

SEQ ID NO: 2110 - DNA, 674 bp, Diabrotica undecimpunctata
accactcttcacaaccttttattacatcaagatggatctaagatggctgttagacttgcaggtggtttgcaaaagatggttgcactactccaaagaaaccatgtaaaatttttgtcaattgttactgattgcttgcaaattttggcttatggtaaccaagagagcaagttaatcattttggcaagtcaaggacctattgaattggtcagaatcatgagatcttacgattatgagaagttgttgtggactacttctagagttctgaaagttctttcagtttgtgccagtaacaaaccggctatagttgaagcaggaggaatgcaagctttggcaatgcacttgggaaatccaagtacaagattggttcaaaattgtctctggacattgagaaatctatcagatgctgctacgaaagttgatggtctagaaagcttattgcaatctttggtacaagtattagcatcttctgatgtcaatgtagtgacatgtgctgctggtattctttccaatctgacttgtaacaatcagcgcaataaagtaactgtttgtcaagtgggaggggttgatgcacttgtacgcactatagtcagtgcaggagatagagaagaaatcacagaaccagctgtttgtgcactgcgtcatttgacatccagacatgtggaatcagaaatggc

SEQ ID NO: 2111 - DNA, 650 bp, Diabrotica undecimpunctata
taagcataaaaagcgaaggccttatcttgcatcagaatgtaaaaatttacatgcttgtgaaaaatggagaatgcagataataagagaaattgcgaaaaaagtagctcaaattcaaaatgctggccttggagaatttaggataagggacttaaatgatgaaataaataaactactgagggagaagcgacattgggaggaccaaataaaggaattgggtggacccgactatcagagagttggaccgaggatgttggatcatgaaggaaaagaagtacctggaaatagagggtataaatactttggggcggctaaggaattaccaggtgttcgagaactttttgagcaggagccgcctcctcctccaaggaaaagtagagcagaactaatgaaagacatcgatgcggactactatggatacatggacgacgatgacggaattttgattccactggaagttaaagctgaaaagatagccgttcaaaatacagtagctgagtgggttagtaaaaaagaacaaaatttggagaacgcagaagaccaaacagaagaaaatatatatgcagttgaagagtctgaagatgaagatagtaaggaaactgtacaacagttagtagatggatcacagcaaagattcgtagcacatgtacctg

SEQ ID NO: 2112 - DNA, 507 bp, Diabrotica undecimpunctata
accggtaaaactacctttgtaaaaagacatatgactggtgaattcgaaaagaaatatgtagccaccttaggggtagaagttcaccctttagtttttcacacaaatagaggacaaattcgttttaatgtatgggacacagcaggccaagaaaagtttggtggtctgcgtgatggatactacatccaaggacaatgtgccataattatgtttgatgttacttctagagtcacttacaaaaatgttccaaactggcacagagatcttgttagagtttgtgaaaatatcccaattgtattgtgtggaaacaaagttgacatcaaagataggaaagttaaggcaaagagcattgtcttccatagaaagaagaatttacaatactatgacatctctgcaaaatccaattacaatttcgaaaaacccttcttgtggttggctaggaaactcattggagatccaaacttagaatttgtagctgcacctgccttgcttcctccagaagtccaaatg

SEQ ID NO: 2113 - DNA, 744 bp, Diabrotica undecimpunctata
atagcttcgctacttcacagaaagtctgcaaaacagtgtaaagcccgttggttcgaatggttagatcccagtattaaaaaaactgaatggtctagagaggaagatgaaaaactattacatttggctaaacttatgcctactcagtggagaacaattgctcccattattggaagaaccgcagcacagtgtttggaaagatatgaatatttattggatcaagcacaaaagaaagaagaaggtgaggatgcagtggatgatcccagaaagctgaaacctggagagattgacccaaatccagagacaaaacctgcaagaccagatcccaaagatatggatgaagatgaattagagatgttatctgaagctagagctagattagccaatactcaaggcaaaaaggccaagaggaaggctcgtgagaagcaattggaagaggcgagacgtttagcagctctccagaaacgcagagaactgagagctgccggaatagaagttacttctcgcagaaagaaaaaacgaggagtagactacaacgccgaaataccattcgaaaagagaccagcaattggattttatgatacatctaatgaagtattagatcctatggctcccgatttttcaaaaatgaggcaacagcacttggatggggagctaagaagtgaacaagaggagagagagcgtaaaaaagataaacagaaattaaagcagcgcaaggaaaacgacattcctcaagcgatgttacaa

SEQ ID NO: 2114 - DNA, 329 bp, Diabrotica undecimpunctata
aaatggtatgtggctcatccagacaagctcaagaaaaaaattacaagagaattaatcacaactattttagctagaaagcctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatactttggaagtgtttgtgagttggatataatcttcaactttgagaaagcctactttatattggatgaactgatgctggggggtgaagttcaggaaacaag

SEQ ID NO: 2115 - DNA, 682 bp, Diabrotica undecimpunctata
gaaattcctttattggccggctctttgaaaattttaaagatgagctggccaaaaacaaagaaatgaaagaatctctgaaaaaatttcgagaggaagctcaaaaattagaacaaagtgatgcattaaaagcagctaggcagaaatttgaaagtgtagaaaaagaagctagtaaaagtagtgaagtttttaaagaaagtttaggttctgttaaggaaaaacttaaaggagttatagatgaagctagtaagtcagatttagcaaagaaggctggcaaattcacagaagaagttggtaaaactacacataaaataagcgaaacagctcaagaaattagtaaaactggagcatttcaaagtatatctcaagctactaaggctgttaaacaagaaatagacaatactagtatagaaggtagagtatatgttagtcctaaaatactacggaagagaacagaaacaagtgcagttgtccatcaaaaatattatgaaccaaacacagatgctacaggtgttgaactacacaaagattcaaagttttatgagtcttggcaaaatttcaaagataacaatccatatgtacataaagttatggactggaaattaaaatatgatgaaagtgaaaatcctgtcatccgtgcttccagagcactcacagaaaaagttggtgatatcatgggtggttt

SEQ ID NO: 2116 - DNA, 712 bp, Diabrotica undecimpunctata
acctggcttaaatactgtggaagaaggaccaaaacacttcacaaataatgtgagtggtttaaaacaaaaattagaggaaatacaactcaagttaccatggatagaacgactcgactgcgtaaatgctcaagcccctttagcacctgaattagcagctcaaatgttgacacatgagcaaaaaagaagtaatgagcttagaaataataaaaagctcacgcagtttactccaaatgaagacccggttttaaacgactttaaaagggaaatgatgttccatagacaagctcaggctgctattctagattctataccaaagctaaaagatatgggagtactaactaaaagacccgatgattactttgctgaaatggcgaaaacagatgcccatatgcagaagattagggaacatcttatgacgaagcaggagcaacagaagagaagtgagcgagtcaaacaacttagacaacagaggaaagaaggtaaaatgttacaagttcagacaaaacttcaaagacaacaagaaaagaaagatatgcttgcccaggttaaaaaagtaaggaagggaatgtccaaagatcttgacttccttgacggaaaaaataaatcttctgccagaaaaatggcagaaaaacggaaaatgaaagataaaaagttcggttttggtggcaagaaaaagggaatgaaaaggaacacaagagatagtgctgcagat

SEQ ID NO: 2117 - DNA, 667 bp, Diabrotica undecimpunctata
agatcgagagacaggagaaacagatctaaggatagaaaatacaaaaactattctagagataaagatagaagagaaagaagcaattcacgaggcataaaacgggaaagaagtactgaaaagaagttcaaaagtgaaaaagataatcctgaatttgaagaggatcctaccccaggaaagatatataatggaaaagtatcaaatattgtaccttttggatgctttgtccagctggagggacttaaaagaaggtgggaaggcttggttcatatttcacagcttagagcagaaggcagagttactaatgtatctgaagtaacatctagaggagctagagtaaaggtcaaagtattgacagtaacaggccagaaggtatcattatctatgaaagatgtctgtcaaattactggtaaagaccttaacccacattcccatgctccaactgaaagagaagatagggatagaaatcctgacaggcctgtaaacagcagtacatctgtgttaagacttccagtaaacatagatgaaggagaagaagactcccggaaaagagtaacaagaatttcaagtcccgagagatgggaaataaaacagatgatttcatcaggatgtattgctaagagtgagttgcctgactttgatgaagaaactggattgttacccaaggatg

SEQ ID NO: 2118 - DNA, 662 bp, Diabrotica undecimpunctata
gatccttgggttatgcgtatgtaaattttcagcaacctgctgatgctgagcgtgcattggatacaatgaactttgacttgattaaaggacgtcccatcagaataatgtggtctcaacgagatccatcattgagaaaatctggtgttgggaatgtttttattaagaatttggatcgttctattgacaacaaggctatgtatgatactttctcagcttttggtaacattcttagttgtaaggtagctcaagatgaaaacggctccagtaaaggatatgggtttgtacattttgaaactgaagaagctgcaaataaatctattgaaaaggtaaatggtatgttgttaaatggaaaaaaagtatatgttggccgctttattccacgcaaagaaagagaaaaggaactgggagaaaaggccaaacttttcacaaatgtatatgttaaaaattttggtgaagatttatctgaggaagagttgcggaatatgtttgaaaaatatggtaaaattaccagctacaagataatgagtaaggatgatggtaaatctaaagggtttggctttgttgcatttgaaaatccagaggcggccgaaacagcagtagaagcattgaatggaaaagagttgatggaaggaaaacctttgtatgtaggaagagcccaaaag

SEQ ID NO: 2119 - DNA, 699 bp, Diabrotica undecimpunctata
gtaggcaaagatgtttcagctttgtttccagatgtagtaaactgcatgcagactgataatttagagctcaaaaagctagtttatttatatttaatgaactatgctaaatctcaacctgacatggctattatggcagtaaatacttttgtaaaggactgtgaagatcccaatccacttattagagcgcttgctgttagaacaatgggttgtattagagtagataaaatcactgaatatctttgtgagccactaaggaaatgtttaaaagatgaagatccttatgtaagaaaaacagcagctgtttgtgttgccaaattgtatgacatttcatctggtttggtagaggatcaaggctttttagaacagctaaaagaattgttgagtgattccaaccctatggtagttgctaatgccgttgcagctttatccgagataaatgagagcagtcctactggtcaacctctagttgaactcagtacaaacactattaacaaacttcttaccgccctaaacgaatgtaccgaatggggccaagtattcatccttgattccctttcaaattatacccctcgtgatgaacgcgaggcacaaagtatttgtgagcgtattactccgagactggctcatgcaaatgctgctgtggttttgtctgctgttaaagttttgattaaaatgatggagattctggctggagatact

SEQ ID NO: 2120 - DNA, 351 bp, Diabrotica undecimpunctata
gaagtgggagctacttcttctttggctcctaaaatcggtcctctaggtttgtctcccaaaaaagttggtgacgatattgccaaaggtactgctgattggaaaggtctaaaaatcacagttcaattgaaaatccaaaatcgtcaagctactatttctgtagttccatctgcctcttccctgattattagggctcttaaagaaccaccacgagacaggaagaagcaaaagaacattaaacacagtggtaacattacttttgatgaaatcattgctattgccaggcaaatgaggcccagatcaatggccaaacagttatctggaactgtaaaagaagttttaggaacagcccaa

SEQ ID NO: 2121 - DNA, 775 bp, Diabrotica undecimpunctata
tggaagaggaattgacagtggaagccacaaaattgggtgttagtataatattttcccatgaaacagaacctttaggtacagcaggaccaattgcattagccagggaacatctttctaaaagcactaaaccattctttgtccttaattcagatattatttgcgatttcccatttaaagcattggcagaattccataaaaaccatggaaaagaaggtacaatagtggttactaaagtggaagaaccatcaaaatatggtgtagtagtatatgacaaagacaacagcatccaaagttttgtagaaaaacctcaagaatttatttctaataaaattaatgctggtttatacattttaaatccaagtgtcattaataggatagaattaaaaccaacttctattgagaaagaagtatttccttacatggcggctgataaacagttgtatgcatttgaattggaaggtttttggatggatgttggtcaaccaaaagattttcttactggaatgtgtttatatctgaaacatttaaggcaaacaaatgaagaaaaactttataaaggaccaggtgctgttggcaatgtcttagtagatcctactgctaaaattgggaacaattgtcaaattgggcctaatgttacaataggaccaggtgttgttatagaagatggggtatgtataaaacgatctacaatacttaaagatgctacgattagctcaaattcttggttagaaagctgtattgttggatggaagtgttgtgttggaagatgggtaag

SEQ ID NO: 2122 - DNA, 680 bp, Diabrotica undecimpunctata
ttttaaaagaaggcgctagcggagcattcgctcagtataataaagatcaactgacccccgttaaaatagaaaacgccgatcatttagtgcttattacggaatacaacgatttagggaataatagattcttcgaccccagaagtaagcagagttttacctatgatcacttaagaaaagaagcattagactatcaagtctatacccccgatagcacttctgagccttggagggctgccttagactcagagttcattcagtacactaggaaccattataaagatggagtatgtagtgtggtaggccgcaaccagagcggagttattaacttaacagcttgtattgaagaccaccagttctctcctaagaactactggaatggaagatggagatctcagtggtccattagtctaactgatgattccactgctgaggttcgaggcgtactcaaagtacaggtccattattatgaagagggtaatgtacaattagtgagtactaaagaaataaaagaaactgttcctgtttcatctgaggcacaaactgctaaagaaatcatccaagtaatagaagccgccgaggatctctatcaaacggcaatttcagaaaactatcagaatatgtcagatacaaccttcaaggccctacgaagacttcttcctgtcaccaggacaaaaatggat

SEQ ID NO: 2123 - DNA, 754 bp, Diabrotica undecimpunctata
ctgtgggatgtgaaacactaagatttgaacgtagaccaacacaagattgtgtagcttaccaagcaccaggcgtcgcaggagtctatggtgatccacactttgttactttcgacgatgtagaatatacgttcaatggaaaaggggaattcgcattggtgaaatcagttacacaaacggacaatctggaaatccaaggaagattcgagcaaatggaccctaacgcttatggtgaggttagagctactcagctgacatctgtagtagctaaaggtaataacacaatagcagttgaagtcagaaggcgaccactagattctagatggagatataggttggatgttatagcagataatagaagactgtatttcgatagaccctcactaaaattccagcacttccaaggagttactatttatactccaacctacatccttaatcaatcagaagtcatcattatgtttgacaatggagctggaatggaggttgtcgataatcaaggatacatgagtgcaagagtatttttgccttggtcgtttataaataaaaccataggcctttttggaaattggagtttcaacaaagaagacgactttacacttccagatggttccagagcagcaatagtatctaacataaatgacatggaaagggtttacactgattttggttccaaatggatgttagatgatgtgttagatcctcaaaagggtagagcgttattccatagggaatttggaagaacttcagccactta

SEQ ID NO: 2124 - DNA, 189 bp, Diabrotica undecimpunctata
ctttcttttcctcagcagctggagcagcagcaggggcacctccggcagcaggtgcagcaccaccaccaactggcatggagctcaatttctcacggccttgtgcaatgagttcttcaactgacttgccactgagctcgctgatgactttctttactttttctccttcagcttcaacacctacagacccta

SEQ ID NO: 2125 - DNA, 766 bp, Diabrotica undecimpunctata
tccacaacttcgtgatgatttagcagctgctagagctgtacttaagaaacattccactatgttattaactgcatctaaggtttatgtacgtcatccagaattagcagctgccaaagcaaatagagattatgttttaaaacaagtctgtgaagctgtgaatactattaatgatgtagctcagggaagaactcctcaacctgcttctggaccatatgatggacctggagagttggctgctgctttggatgattttgatgaccacatggtaatggagcctctagcatacaatgaagttcataccagaccttcattggaagaacgtctagaaagcattataagtggtgcagcccttatggcagattccagttgtactagggatgaaagaagggaaaggatagttgcagagtgtaatgctgtaagacaagctctgcaagacttgttgactgaatatatgacaaatatgggcaataaagataaaagtgagagcctagtaagagcaatcgacaatatgggtagaaagactaaggatttaagaagacagctgagaaaagctgttgtagatcatgtatctgacagtttcttggaaaccaatgtacctctcctcgttttaataaaggcagctcaaaatggcaacgaaaaggaggtagaagaatatgcagttgtatttactgaacattccaataagttagtagaagttgctaaccttgtctgcagcatgtctaataatgaagatggcgtcaaaatggttagatatgctgctgctcag

SEQ ID NO: 2126 - DNA, 654 bp, Diabrotica undecimpunctata
tactttgccatcgaatccaatagtatcttcaactactggaattcaaagcacatttggttcaggagataataaagaccaaagtaaaccttcattgtttgcaactccctcaagtcagcctgtttcatttgggttaactacaaaagccaatacagccccaacaaccctctcctttggttttgctactcctacgactttaccgtttggatcatcaactacaattacacctgcaacaactcctcaatttggattatcgcttccaaaagctagtgctccagccactactagtttttcacttctaggatctgctccagccactactgcagcagcacctacaggtatatcatttggtactgccactactgcagcaacaacttcagttacaggtttatcatttggaactccaattgggactgctacaactgcagcaacaacttcagcttcaggtttatctttcggtcttacaaccgcttcttctacaagttctgccgcacctacacttttgtcttcaacgacaacttcgacaacatcatcagtgtctgcatctggtgctttgagtagtacaacatcagcaccgacttttgccacctcatcgttgccgtcaacaggcaccttaacattctctcaactcgaagattcgatcaacaaatggaccat

SEQ ID NO: 2127 - DNA, 433 bp, Diabrotica undecimpunctata
aggactggataatgcaggtaaaactacccttctacatatgctcaaggatgacagactggcacagcatcttcccacgttacatcccacatcagaagagctttccattggtaacatgaggtttacgacgttcgatttagggggccacgagcaagctaggagagtttggagggactattttccagcagtcgatgccatagtgttccttgttgatgccaacgacagctcaagatttgtagaaagccaggaacagctaaatgccctcctctcagatgaaactctttccaactgtccaatacttatcttaggtaataaaattgatctcccaggtgctgcttcagaggatgaactacgaactagatttggcttgtttggccaaacaacaggcaaaggcaaagtagctagaaatgatctacctggtaggcctctagaacta

SEQ ID NO: 2128 - DNA, 442 bp, Diabrotica undecimpunctata
atcccactactattgccaacaaaaatcaaacaataacaaacattcttacacaagttcagacctttgttaccacagctctcacttgtagagaaacaataacgtccatgttgcagttttatggaactttaaatgaatatcttgacccagctggtggtgcagatgaactcgaggtagaagcaaaaagacattatatattgcagttgcacccagagatcaaagacaccctacagacccatactcgaattttgcagagtttacttccatatgtagaatcagaaaacatttccaaagtggttgaaatgactgctcaattggaagaagcatctgttagtcacctcaatttgtatggagagtggagagatacaatgtacaaaatggtcgttgctcttcaagatttcactgatataatgagttcaattaaagtattgttctcccaactaga

SEQ ID NO: 2129 - DNA, 651 bp, Diabrotica undecimpunctata
attgtcgtatccttcagctcgatacgaaccgttcgatttccattctgaatgtagcaaaatgagatgggatcgtctcaaaatcctaatagaccgtctagccctggaccaagacgaaatgggcttctttctcttattacgggatggttccttaagctcgttacaagacggagtcttcagaacgaactgcatagattgtttggacagaactaacgtggtccaaagtatgctagcgcacagaaatttagaggtagttttaagaaaattgaatattttacaccaaaaccagaacttggagttccagtattccttcgaggttttgtttaagaatgtatgggcagataacgccgatattataagtacccagtactcgggaaccggggctttaaaaacagattttactagaacaggtaaaaggactaaggctggagtttttcgagatggagttaattcgcttactagatactataaaaataatttaacagacgggtatcgccaggatgccatagatttgttcttaggctatggcaaaccgatatctccactaagagtagacaaatcgtggcgatatattacgtacccttcggtacttttggtcgctgtatccatgtttgtagcttctgctgtatttccttcggaatactcaaccgaatc

SEQ ID NO: 2130 - DNA, 702 bp, Diabrotica undecimpunctata
ccgcaagactcaaaaagatctcgccatcatgccaagtcagtgtcctggttgcgaagaactgaatacatttcaacagaacagaccagattccagcctcagactatggacaaagttgaagctaaggttggttatagtattaaaaagtcccttaacaatgaaactttgtacatggacagagactctcagattaaggctattgaaaagacctttgaggattctaagaatgtcattgagaagcattacagcaaacctaatgtggtagctgtggatattttgcctgtttatccagatttcagcctttggaagtacccttgtgcccaagttatttttgattctgatccagctcctgttggcaagcaagtaccagctcagattgaagagatgtctcaagctatgatcagaggtgtgatggacgaaagtggagaacaatttgtagcctactttttgcccacagaagacactctccaaaaacgaagagatgattttgtcaaccagataccatatcaagatgatgaggaatatgaatataagatggcaagagagtacaactggaatgtaaagagcaaggcaagcaaagggtatgaagaaaattatttctttgtggcacgaccagatggaatttactacaatgaactggagaccagagtaaggctgagtaagagaagggtcaaagctggtgctccacctagtaacacaaggctt

SEQ ID NO: 2131 - DNA, 675 bp, Diabrotica undecimpunctata
gaaagatgatatggccccatggtatgaactcatttgtaaagatgctggttggaaacttgatactaatctactaagtgcattaaaagctaagaacgctgagaagatcaagcttttagatgaagccatagaagatgctgagaaaaatttaggtgaaatggaagttcgagaagcctacttaagaaaagcagaatactacagccgaattggtgataaagacaacgcagttagtactttcagacaaacatatgataaaactgtatcacttggccatcgtttagatattatttttcacttgataagaattggtttgttcttcatggaccatgatctcatcacaagaaatattgaaaaagctaaaacccttattgaagaaggaggtgattgggatagaagaaatcgtttaaaagtttatcaaggtgcatattgtatgtctgtcagagacttcaaatcagctgctaacttgtttttggacacagtaagcacttttacatcgtatgaactaatggactataaagcatttgtcagatatactgtatacacctctattattagtttgccaaggaaccaattaagagataaagtggtaaaaggttcagaaatattggaagtattgcattcggaaccatttgtaaaagattacttgttttctttatataactgtcagtatgccgaatt

SEQ ID NO: 2132 - DNA, 727 bp, Diabrotica undecimpunctata
cgcagcaacaacagaatattatacacgaacaacgtgttcaggccatcgcgagagtccagcgacaaatatccgtggatccagctcaacagtttttgtcggaacaacaaagtcccttgcaaccaagtacgcctcaggagcttagtccgtctgctacaccaacaccaagcccaagacagttcataggaatgaaatccccgacctttcctcttccttcaccagtggctcagacagcaattagacctcctacaccctctcattctccacatgatgtaagtcaggcaagcacccctgacggtaatgatcactttattcaatcaccttctactcctaaacctaattttcctactagattacctacagatcaatttatccaccaacctgcaactcctaggccccagtttggaatacaacggccgcctttacagaactttggtaatacgatgaggacagatcagcaggatattaatatcaaccggcagttacgagatcttctccagcgacaacaggtgaaaaaattggatgaactgttaccaggtaaagttcaacaacaaagagtgtggcctccaattgaacaacaagaaaatgaggcctcggcaactactggtacttcggcagttgtggctacaacagcagataccactttcaggcaaccattaccgcccagcattgtgcgacctagagtggctctctctttagctggtcgagcaggtcctggtactattagggt

SEQ ID NO: 2133 - DNA, 779 bp, Diabrotica undecimpunctata
tcagacgttgccttttgatatccacgatgccctcagtaagtacaaagcaacaaaagtacaaaaaatggactccgaaaaaggattgttgaacttttttgtaaaccaattctcttctattgatcccgatttgataataggccatgacttacagggctaccaaattaatattttagccgaaagactttcaaaactcaatacaaatattttcaataaattgggtcgcttgaaaagatcggaaaagaaaaatttggaaaaaagtctttttgctggaagattagtatgcgatataaaaatatcagctaaggaattaataaaatcacgttcatacgatttggacgccttatgccaagttgttctgaaacttaacgaaaatcaaagaatcgaattagaacccgatgatgtaccaaagatgtttaaaaccacttcagatattctgaaattggtatcgtttaccatgcaggacactatgtatatattaaaaatcatgtataatttgaatgttattccattggcgttgcagataaccaatatagctggtaatgtcatgtctaagactttgatgggtggtagatccgaacgaaatgagtttttgttgttgcacgctttttccgagaaaggctatatacctccagataaggagtataagaagaaaggagatggaaagcagagttcaaaaaagaaacctacgtatgcaggaggtttggttttggatcccaaagtcggattttacgacaatcttattctcctaatggacttcaattctctataccccagcatca

SEQ ID NO: 2134 - DNA, 746 bp, Diabrotica undecimpunctata
ccatacttcagaaccaccaatgcctagagaaagtaaatcaaagaaaaatttgcaatgggtcccatctttgccaaattccagtcatttagatgcagttcctcaagctactcctattaacaggaacagagtagcagcaaaaaaggtgaggacgttcccattatgttttgatgacacagatccacaagtgaacatcgaaaattcttgtcagcaagaagttcttgttcctattagacttgatatggaaattgaaggacaaaaactaagagatacttttacatggaataaaaatgagagtttgatttctccagaacaatttgcagaagttctttgtgatgatcttgatttaaacccattgacatttgtgcctgccatagctcaggcaatcaggcagcagttggaagcatttccatcagaaccgccaagtataattgaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaatttgtaacagccatagcatactctatccgtggtcaactctcgtggcatcagaggacttacgctttcagtgaagctccgcttcctacagttgaagttccgttcagaactcccagcgagtcagatcaatgggcgccatttttggaaactttaacagatgccg

SEQ ID NO: 2135 - DNA, 778 bp, Diabrotica undecimpunctata
ctagagctgtacatgtgtcccattatagcgacagaaatttggtactgatttcgactgttaatgataaagatgtgctttggtgcatgagttcagatatgtttccctttggtcagactttgatggaggcttatagtgttgtaaatctagatggaccagcattagctatatcagaggtgcggcatccaactcctttaccgttaccatcaaaccaagaagcgccacctctggttgtcagacaacacgcggaaccacctaagaaatatgtggtcttaacatctcacagtgttcagatttttattaaactgaggccagttgatattctcaatcagatacttagagatagtcaaggcttagacactgaagcgcttaagacgttttttacgattcaaaaagaggaccaagcttgcgcaacttgtttgattctggcttctttagaaagtgatgagaacgttgaagttgcagaatatgccacaagggctttctttttgtatggtggagaacctaaactggcgcaagccaatatatatgccggacccagtgtatttgctcctcaaataatatcaacacctgctccacaccaataccagtctcagcagtaccaaaccgctcaacacttccaatctaatatgtcacaaacactgccaactgttccaaatactaccggatatgaattcaccggtccgtttattttttcggcgaaacataatagtttatatttgtatttaagtagaatattgcgaccagtttggaacttgagaacggttgataagctttctgt

SEQ ID NO: 2136 - DNA, 656 bp, Diabrotica undecimpunctata
ttgtgcttcctacaaatcgagcaattggtcacctattattttagaaacattacctgatgccaatcaagcacctgctaatgatggagatagtgatcctagacaagtgtatttgcaacacattttccatcccggcagatttcctttgcacataataagcaaagctctttctatttacaagaggtctactattttatctgatgcccaaatatcagcctcagctttaaaacaaagaatttgtctagctgtggataatgaaatacaaaatacgttaaacggatctaatgtgaatgatgatgaatatttagaatgtgcagactggtgttggcaaaaattctattcttgctgtgtacagtaccatatcgctagcttaaaacctcttggtctaatgttattaccttctgtctctggagcagtatttttgaaaaaatcgacgttttcattccttagacctttggatcctctggaacacatgactctctgctatgaagatgtttacagagaccaattcatcaatttttccatgttagctgaagatctagacacgacagatgacgtaatgaacttgtttaaagtcatcgtatatttagaacaacaaatgagtgaatcattcgcccaggcattcgagaaagaaatttttaatctacgtgcacctgatg

SEQ ID NO: 2137 - DNA, 708 bp, Diabrotica undecimpunctata
ggaagcttttactacaacgcttctaacaaatctttttggaatactagaaaaacctgtttcagaagaaaatgagtatgttatgaaagcactgatgagaacattttctacattacaagaaagagtcctaccattcttgaacgtcgcattgccaaaattaacagaaaagctacaattggttgcaaaaaatccatcaaaacctcattttaaccattatctttttgaaacattttcattggccataagaatcgtatgtaaggcaaatcccactgctgttacagcatttgaagatatattgtttcccatttttcaaggaattctacagcaggatattcaagaatttattccttatgtatttcaaattctttctcttttgatggagagtacacctcaaggtaataatctggaaccctacatgcagcttttaccattcttgttggctcctgtgctatgggatagacctgctaatattagtccactagtaagattattatgcgctttcgctctacaagcagctccacaaattgtatcgcaggataaagtgagcggatttctaggagtattccagaaattgattgcttcaaaaactcatgatcatgagggtttctttttgattcaaagtatgattcaacatttaccaatggaagccctagcgccttatcacaaacggatattttcccttttgtttctaagactctcctccagtaagac

SEQ ID NO: 2138 - DNA, 461 bp, Diabrotica undecimpunctata
cttgaacccatttcagttcgaaataactttcgagtgtatagaagaacttagagaagatttggaatggaaaatgatatatgtaggttcagctgagagtgaagactatgatcaaactttagattcagtttttgtaggacctatacccgaaggcaaacacatgttcgtgtttcaagcggatcctccaaatgtctcacgtattccagaaaatgatgctcttggtgttacagttgtacttttaacatgttcttatagaagtcaggagttcattcgtgtagggtattttattaataatgaatatactgatccagaacttaaagaaaatttacctagtcctccacaatttgataaggtaacccgaaatattctagcatctgaacctagagtaacccgattcaaaataaattgggaagaaactaaccccacagaaaataacacaaactcagaccaaaatggagcatcag

SEQ ID NO: 2139 - DNA, 668 bp, Diabrotica undecimpunctata
cttaccaaatgcccttcaacagcaacagcagcagcaacaacagcagattgcaactagtagttcccaagtacctcctttggcaccaatgggaggcttaacacctactcttggacttggcatgggtcatgccatgtctgtaccacaaaccaaatatgtaactggttttgcattgcccatgagttcaatgaatgcacaaactcctcaacacacaatgagccctatggtcaatttagggggttctataacaacaggagcaggagtaactccaacaatggctccatcaactccatcgccaatgactccaatgacacctcattctgcagatccaggaatcattccacaattacaaaatatagtgtccacagtaaatctaagttgtagattagacttaaagaaaattgccctacatgccagaaatgctgagtacaacccaaaacgttttgcagctgtaatcatgaggatacgtgaaccacgtaccacagctctaatcttctcttccggaaaaatggtgtgcactggagccaaaagtgaagaagactcaaggttagcggcccgaaagtatgccaggataatccaaaaactcggattccctgcgaagtttttagatttcaaaattcagaatatggtcggcagttgtgacgttaaattccctataagacttgaagggc

SEQ ID NO: 2140 - DNA, 335 bp, Diabrotica undecimpunctata
gacctatgcagaccaaatgaatttcacttttgccgctggaaatcaggtttactatactgcaacttcagttaaacaggtcgatgtaccatctttctctggtagctttggtatccttcctgcccacgtacccacactggctgtgttaaaacctggagttgtcactgtttatgaagatgatggtaaagttaagaaaatctttgtttccagtggtactgtcaccataaatgatgattcatcagtacagattcttgcagaagaagcccacccagtagaaaacattgatgtcaatgcagcaagagatatccttaccaaagcccagagccagttatcatctg

SEQ ID NO: 2141 - DNA, 658 bp, Diabrotica undecimpunctata
atatcatcctcagggaccaacacagcttctggatacgtttgtaaattttttgagtagaaaaaccgactttttcattggcgccaaggaaggagaatgggaaaagttggtgatggacactttcaaaaaatacgaaaagttaagcaggtcaaagcacgaggaggaactaaaagaaaagcgtgaacaagaagctcgaaaaaaagcagctgctgccaaaaaggcagaagctgaagttgttaagcctgctcaaatcactgaattgactgatgaagaagctgaaaggattcaggctgagataaatgctaagttaaacacttctgttaacgctgaaagttcttcaaatggttcagaagctgcagctgcgactaaaaaagtagaagaagatgaggatgaatctgagaaaggcaagatactgcctaacacaggaaatggatgtgatctagagaagtacaagtggacacaaaccttaggagatattgagttaaaaattcccctcaaagtaaacttcagggtaaagcagaaggatctcgtagtaaatatgacgaagaagcacttgacgtgtggtatcaaaggccagccgcctatcatagacgacgattttccacatgaaatcaaattagaagagtcgtcttgggtgatcgaggacggaaaggacctatta

SEQ ID NO: 2142 - DNA, 350 bp, Diabrotica undecimpunctata
ataaaaagcatagcgatcgcgaaaggtggatatgtatttatcctgcttacattaacaacaaaaaaacattggcacaagggagaaaaatagccaaagaaagatgcgtggaaaatcctacccatcaggaaattcgtgatgttctggtggcggctggtttgaaagtgggtgttgaaaacaaattgtacagtagggagagaagtaaagaaatgttatatcgtggtagaataagaatacagttaaaaaatgacgatggtagtttgtgtaatgacggtttccctaccagagaaagcattatgtatcatttaggagacatgattcccaaactgaaaagcaggcaaaataaaagctca

SEQ ID NO: 2143 - DNA, 746 bp, Diabrotica undecimpunctata
atatggttgctctttgctcaatttgaaattcgtcagaagaacttaactacagcaagaaaaattcttggaatgtcaattggtatgtgccctcgagataaactttttagaggatacattgatttagagattcaattaagagagtttgacagatgcagaaaattatacgaaaaatttcttgagtttggaccagaaaattgcatcacctggatgaagtttgccgaattggaaacacttttgggagatattgatagagctagaggtatatttgaattggcgattaatcaagcaaggctcgacatgccagaattattgtggaaagcttacattgactttgaaatatcacaagatgaaccggacaatgcacggcagatatatgaaagactcttggaaagaacctcccacgttaaggtttggctatcgtatgctaaatttgaacttaacaatccaacagaagatgaattaaatgtgcgcttagctagaagaatctttgaaagggccaatgaaaatctaaagagctctccggagaaagaagcaagagtgctcctattggaaaattggagggagtttgaaaataatcatggggacgaatcgagcaaagaaaaagttaatgccaaagtaccaagaagaatcaaaaagaggcagaaagttgttgatgaggacggtgtggaacaaggatgggaagaagtatttgattacatattccccgaagacgaggctagtagacccaacttgaaacttcttgcagc

SEQ ID NO: 2144 - DNA, 654 bp, Diabrotica undecimpunctata
tcatcatccaactgttcgttgccggtctcattgttttgcttctcgatgaacttcttcagaaaggatatggtttaggttctggtatttccctcttcattgcaacaaacatttgtgaaactattatttggaaagcgttctcaccagcgacagtaaacactggaagaggaacagaatttgaaggagctgtcattgccttgttccacttattgaccacaagacaagacaaaatcagaggattacgtgaagctttctacaggcaaaatcttcccaatttgatgaaccttttggcgacagtactcgtttttgctatagtaatatacttccaaggattcagagtagatctacccatcaagagtgcaagataccgtggacaatactccagctatccaatcaaattgttctacacttcgaacatccctattattctgcaatctgcccttgtatctaatttgtatgtcatctcacagatgttggctgttaaattccaagggaacttcttaattaatctattaggagtttgggctgacgttggaggcggtggcccagctaggtcttaccccattggaggattatgttactacttatctccacctgaaagtgtaagtcacattctggaggatccaatccatgcaatgctctacatcgtcttcatgt

SEQ ID NO: 2145 - DNA, 333 bp, Diabrotica undecimpunctata
cgaccacattatacgttggaaatttatctttttatacaactgaagaacaaatctatgagctcttttcaaaatgtggggatataagaagagttgtaatgggtttagataaatataagaagacaccctgtgggttttgttttgtagagtactataatagagctgatgcagaaaactgtttaaggtatataaacggtactcgtttggatgataggatagtaagaacagattgggatgctggatttatagaaggtagacaatatggtagaggaaaaacaggaggacaggtacgtgacgaatataggactgattatgactctggaagaggagggtatg

SEQ ID NO: 2146 - DNA, 551 bp, Diabrotica undecimpunctata
aaacttatcctctgttggccagttaagttcgtattccacaacaaaagaatggactcgtggaagaaaagcacttttgggaagcttagggcttattgctggtggtactggagccttgctgtttgctttggaccaatcagttaaagcatctgatctagaattgcatcctccaaagaatgtttggagtcattctggaactttcaattccttggatcatgctagtgtaagaagaggttacgaagtatacaaacaagtatgtgctgcctgccactcaatgcgcttcattgcttaccgtaatttagttggagttacccacactgaagaggaagccaaagctgaagctgaagaacaaatgattgaagatggccctgatgacacgggtaacttcttcaaaagaccaggaaagttatctgactacttccccagtccatatcccaatgaagaagcagcccgtgctgccaataatggttcatatcctccagatttgagttatattgtatctgccagacatggaggtgaagattacatatttgcccttttaacgggctattgcg

SEQ ID NO: 2147 - DNA, 681 bp, Diabrotica undecimpunctata
acacctcctgaaaagtgttttttacccaagtctcatattcatacatggactgggcactccaaaggtgttgcagccatcagatggtttcccagaacagcacatttgttcctgtctgctagtatggattgtaggattaagatttgggaagtttataatgagagaagatgtattagaacttactatgggcatagacaagctgtgagagatattaactttaataattctggaaagcttttcctttcagctggatatgacaggtatattaaactttgggacacagaaactggacaagttgtttcaagattcactagtcgaaaaattccatactgtgttaaatttaacccagataaaaataagcagcatttatttgttgctggtacatccgacaagaaaattatctgttgggatactaggtctggtgacatcgttcaggaatatgataggcatttgggagctgtcaacagcattactttcgtagacgaaaaccgaaggtttgttactacctcagatgataagtcgttaagggtatgggaatgggatatacctgtcgacatgaaatacattgcagatcctacaatgcacagcatgccagccgtcacaccagcacctaatggaaagtggttggcgtgtcaaagtatggacaataagattgtgattttctccgccatgaatcgttttaaa

SEQ ID NO: 2148 - DNA, 664 bp, Diabrotica undecimpunctata
ccactttttgaaaagaggcctagaaattttggaattggccaggatattcagcctccccgtgatttatctcgatttgtaaaatggccaaaatacattcgtattcagagacaaaaagctgtactgcaaaagagattgaaggttccaccaccaattaaccaattttctcaaactattgacaaacaaacagccacccaattatttaaagtcttggaaaaatacaggcctgagacagcccttcaaaagaaaaataggttaaaggctaaggctgaagctaaggttgccaaaaaagaagaggcacctgctaagaaaccaaacacattgaaggctggtgccaatacagttactaagttgattgaacagaaaaaagcccaattggttgttattgcacatgatgttgacccaattgagttggttctgtttctaccagccctttgcaggaaaatgggtgtcccatactgcatagttaaaggtaaagcaagacttggacttcttgtaaggcgcaagacttgttcagctgtagctcttacacaagttgactctggagacaggtccaactttaacaaacttttggaagtaattaaaactaacttcaacgaccgtgttgatgaaatcaggaggcactggggtggtggtttgcttggatccaaatctgctgctcgtattg

SEQ ID NO: 2149 - DNA, 713 bp, Diabrotica undecimpunctata
gatccagaaagtggtggaattagtgcctgcttaaaccatgatccccatattttacatacacttagtgctgttcaaattctctgcatctacaataaattagaggcaataaatgtagagggtgttgttaaatatattgcaagccttcagttacctgatggtagttttacaggagataagtggggtgaagttgacactaggttctcattttgtgcagttgcaacattatcattgcttaataaaatggatgcaattgatgtaaataaagccatagactttgttatacaatgtaaaaactttgatggtggtttcggatctaggccactttcagaaagtcatgcagggttaatgtattgctgtgttggctttttatctattacaaataggttagatgccattgatagagatacccttgcttggtggttgtgtgaaagacaattaccatcaggtggtttaaatggcaggccagaaaaattacctgatgtatgttactcatggtgggtattatcatcattaaccatgttaggcaggctccattggattgatgccaatgctctgaaacactttattttggcttgtcaagatacagagacaggaggatttgcagataggcctggtgatattgctgatccttttcatactatatttgggttagcagccttgtcccttttgggacatgattctgtaaagaagattaatcctacttactgcatgcc

SEQ ID NO: 2150 - DNA, 696 bp, Diabrotica undecimpunctata
ggaaaatcacataagcagccacaacgataggtcgcagttcaacgatctccagagtcttttgtgcgccacccttcagtccgtactcagaaaagttactccggaagacgcgccgcacatctcagacgccataatgaccgccatgttgaccatgttcaattccaattcgtgtaagagtggaggtgttcaagaagatgctattatggccgtctcgacgctggtggaagtcctgggagaaaacttcataaaatacatggacgcgttcaaaccgttcctctacctcggattgaagaaccaccaagaataccaagtgtgcgttacagcagtaggcttaactggcgatattttcagagccctcaaactaaaagcgctaccgtactgtgatgaaataatgaccttattactagaagatctccgcgatcagtcggttcatcgtagcgtaaagccagaaattttgggcgtattcggagacatcggtcttagcatcggctccgaattcaagaagtacctcgacgtggttctgtccactttggctcaggcttcgcaggcccaagtcgatcgcaacgacttcgatatggtcgactatctcaacgagctaagagaaggagttttagaagcttatacgggcatcttacaaggtctcaaaggcgacggtcccactccacatcctgacgttttgatacttgaaccccacattcc

SEQ ID NO: 2151 - DNA, 682 bp, Diabrotica undecimpunctata
atgtcagtggaatttgacgaatttgccaaagccagggaaaatcctaacgaagatatggctaactttgtagaatttactgatgaggagggttatgggaagtatttggatttacatgaatgttatgaaaagtatataaacttaaaaggcatagaaaaggtagattacattacctacttgggtatgtttgaccaactatatgatattccaaaagaaagaaaaagcggtgaatataaaaaatatttgttatgcctaattgaatatttgacttggtttgtacagcgtataaagcctctaaaggatttagacattgatctacaagaacaagtggagcaggttctggcaatttgggatactggaagtgtcccagggtggccaaaagaaacaggatctgcactaaccaatgttggggcccacttggatctctcagcattttcaagttgggaagaattggcatcgttaggtttagacagactgaaatctgccttgatggcgttaggattaaaatgtggaggtactttggaagaaagagctcaaagattattctcaacaaaaggaaaaggttttttggatccttcacttatgacaaaaaataataaaggcaaagccaacaaagaaaaggaattattgaggcaaagagaacttgcaacattagaagcccaagtgtacagattagcagagtggg

SEQ ID NO: 2152 - DNA, 495 bp, Diabrotica undecimpunctata
ctgcaagactctcgtactttcataggaactttcaaagccttcgacaagcacatgaatatgatattaggagactgtgaagagtttcgaaaaattaaatcaaaaatgtccaaagttgaacgtgaggaaaaacgagtattaggatttgttttactgagaggagaaagcatagtttctttgacaatagaaggtcctccccctccagaagaaggtttgcccagagtaccaattcctggcgcagccccaggaccaggaattggtagagctggaggtagaggaatgccaccaggcatggcaggtgtacccgtaggcttgcaaggacctgtaagaggagtgggaggaccatcccaacaggttatgacaccaggaggtagaggccaagtatcagctcctccacaaatgaatcaaggaccaccaaggatgggaggaccaccgccaggtatgatgggacctcctcctggaatgatgggcatggccccccaaatgggaatgggacgt

SEQ ID NO: 2153 - DNA, 761 bp, Diabrotica undecimpunctata
tttggcaagtggatgttctatgggtgaattacattattcttataagattggaaggtctactgtggcaggaataattcatgaagtatgtaaagtgttatggagagaactaaaaactgtagtaatggaaatacccacagcagataaatggagagaaattgctaacgggtttgagaaacacgctaagtttcctaactgcattggcgcaatcgatgggaaacatatacggttattccaaccggcacagtctgcttcactatattataattataaacactttttctcactactactactagcattgtgtgatgcaaattattgttttacatgggttgatattggtgcatatgggaaaaatagcgactcgggagtatttcaagaatctacattgtacagaatgcttatggagaagacactgaacattcctgaaccaacggcaataacaggtgggtccattgtgccctatgtaatagtgggtgatgaagcttttgctctgatggaaaatttaatgaaaccatttggtggaaaattactcacgtacgaaaaaaaaatttttaattatcgtttaactcttgcaagacggtatatcgaatgtacatttggtatcatgtgcaacaaatggcgaatattacatcgaccgttagatgtaaatattaatttcgctgaagatattgtgaaagctatttgcgtactccacaattatgttaggcaaagagatggttctacgtttgaagagacgctttatacagcaccgctaactaatc

SEQ ID NO: 2154 - DNA, 669 bp, Diabrotica undecimpunctata
atagactgtcgccgatagtacctatgatcaaaccagtaccaattagattgaaaccagttggaggattgcttgttaaagaaactcccagtgataacaaagaaaacatcaatacagatagtcttaacgtaatgacaaagatcaaatctgaaaacaaaccgtcgataccgacgaaagattcaggacatgttaccgtgacattaacattaacttcatctgctgctgaagacataatgggtgtactaagggacttggcaaacattctacaaattccagctcctacgagttatcaaatagtggaaaggacaacaacccctcccagtcagaaactcgggctctaccggaccaagggcaaggatggtaaagagggagcgccaatagacattcaaagtattcttaatggggctaccaagttctgtaaacactgtgatgtaattattttaagcaatttgataaggagaaaggtttccgaccttcctttcttggccaaagactcagaacttttaagcgacggagaggaactattcttctgcagctcgacttgctacatgcagtttgccctaatgcatagatcaccttctatttccgaagataaggccgccgaaataatcaaccatttatctcagaaggataacgagagtaaacaaaaaatgcagatgatggaaccatttg

SEQ ID NO: 2155 - DNA, 692 bp, Diabrotica barberi
tacatcagtcagtagctggagatgttacttccgtatttaaaggtaaaaccgctgtccagttagcagctttagagaagcaaatagagggaaaaattagcggcaaagctgatggtattgatataggttactgggaatccctgttatcacaacttaaggcacacatggctagagcaagactacgagatagacatcaagaaagcttgagaagaaaacttcaagttttgaaagccgaacaagccatcattgtaacagctccaagcgaaagtcattccagtggaggcgaggaagctccaacgaaagatgtacaagaaccaaagcctggaccttctcaggaacctgatgataagcaaaatgatgaggaggaacctgcagatgaggaagcagctaattcatggctaaatgagtgttttgatgcctatgaagctggtggatatagtcccaagtttcttactccagatgaaatagagccgggaacaattgttgtgatagaagaagatgatttgaaaagattggaatttgcaagaattcaggttgttggtaaaggtaaaactgtggaaaatgttataacgaaggaagagttgatgctacaaaaagaggctcgtaaaggcatggatggagacgaggcacagttctctgtagagcaagctttggacagccaagtctatctttggtctgacaaataccgtcctagg

SEQ ID NO: 2156 - DNA, 737 bp, Diabrotica barberi
caaggcagatgcttttacagaatccgcagcttgcctatgctcttttacaagctcaagttgtaatgaaaattattgacgcagctactgcagttagtttacttcatcctgtgaaccaagtaccagcgacacttatgcctggagacaagaatgttcctgtccaagtaccagttaataatcagtacagggagcccccagcacctgttcaaccgcctgtccatccaagacaagacttccaacctgttcctcctcctgttatgcatccatctcaaaatcaagtatttccaagtcaagatatagatctgagatccattggtggtgtgccagatctaagaaacctaagacccatgggtgaccaggatatgagacaaatgccatctgctattcaaaatcccttaccacctactatcggagaaagctttattcgagatcctagagcagcacaggcgtttgcaggagatccaaggcaagcacgcatggacccacgtcaaaaacccatggtgcctcctcctcaaggccaaatgcccataccacctccaatcgcaagaccacctgtaatgccgcctcagcctcaagttcctgtgacgagagcagcacctctacctcaaccgtctccagctcctactcctgcaacggccagtccaaatgttgcaaatgccggggcttcggatcaagaaaaggccgcactcattatgcaagtattgcagctgtcagatgaacagatctctatgcttccacct

SEQ ID NO: 2157 - DNA, 659 bp, Diabrotica barberi
cgagagcagctaaaagatcttacaaaacaatatgataaatcagaaaatgatcttaaggctttacagagcatgggccaaatagttggagaagtactcaaacaactcactgaagaaaaatttatagttaaagctaccaacggtccccgttatgtggtaggatgtcgtcgtcaactggacaaggcaaagttaaaagcaggaactagagtagcattggatatgactacattaactattatgaggtatttgcctagagaagtggacccattggtgtataatatgagtcacgaagatcccggagatgttacttattctgctattggtggtttatctgaacagattagagaacttcgagaggttattgaactgcctttgttgaatccagaattgtttatgagagttggaatcactccacctaaaggttgtttgttgtatggtcctccaggtactggcaaaactctactagctagagctgtggcgtctcagttagatgcaaacttcctcaaagtcgtttccagtgctatcgttgataaatatattggagaatctgcaagactgatcagagaaatgtttaactatgctaaagaccatcaaccttgtattattttcatggatgaaattgatgctattggtggtagaagattttctgagggtacttcagc

SEQ ID NO: 2158 - DNA, 630 bp, Diabrotica barberi
ggctatttctcatgcaggtacttgcctgggcattttagcaaatgatggcattttgttggctgctgagaggcgtaacactaacaaattattagatgaggtttttatttcagaaaaaatatacaaactcaatgatgatatggtttgtagtgtggctggaattacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataagcattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgatcaaaattttaagcggcaaggaagtagaagaact

SEQ ID NO: 2159 - DNA, 769 bp, Diabrotica barberi
tgtgtaccctatgtagcagatcctgagaatactactctactgcagactgctcttttactgtttagaaagtttgatcagtatccccaggcactgagattagcaatgcagttaaatgactttggattaattgaagaaatttttgtcaactgccctgattcggacgtacaaaaacaactggcttttatgttaggacgacaacagatatatgttgaaattcctgagcatacgcctgaatacgaagatctaatcgagataatggcaaactgtcatcttaataaccacttcttgaacctagcccgcgagttggacattatggatcctaagaccccagaagatgtttacaaatcccatttagaaaatagccgtcccccattcggtggaaaccaagttgattccgccagacaaaatctagccgccagctttgttaacggttttgttaatgcagcttttggtcaagataagctcttaatggaggatgggaataaatggctttacaaaaacaaagaacatggaatgcttagtgctactgcttctttgggactaattcttttatgggatgtagacggtggtcttactcctatcgataaatacttgtactcttctgaggaccatatcaagtctggcgctttattagcttgtggcattgtaaactgcggtgtaagaaatgaatgtgatcccgcactcgcacttttgagtgattatgttcttcacaacacaaatataatgagaataggggctattgtaggtctaggtttagcgtatgttggtt

SEQ ID NO: 2160 - DNA, 688 bp, Diabrotica barberi
ctcgaacaagcagcatttaggggtcaatggggcgcaaggcgttcagtcgcccaataagccacggaataaatctagaactagcgccgagggtagagagtgcgtcaactgcggggcgacaagtactccactgtggagaagggacggcactggtcattatctatgcaatgcatgtggactttattacaagatgaatggacaaaacaggccactcatcaaacccaaaagaagactgagtttacaaagtgcggcgaggcgagcaggaacgagttgcgcgaactgtaaaaccacaactacgaccctctggaggcgcaatcagaacggggagcctgtctgtaacgcctgcggactctactataaactacacaacgttaacaggccattgacgatgaaaaaggaaggcattcaaactcgcaacagaaaactttcttcaaagagtaaaaagaaaaaatcgggtgcatcgtgtctgtctttgggcggcatgatgggtgacatgatgaagcctttagatagcaaaggtgccttcggtggaggcttcggcgcaggtatgggtggcggacatccgcatcttaacgctgctcttcatcctcaccacgctatgacacattggcatcagtatcagcatacccaagggttcgtttcaggtccacctccacccgccccaccatccgcagcttcgtatcaccatcat

SEQ ID NO: 2161 - DNA, 674 bp, Diabrotica barberi
ttcataccaacactgactggactattattttcacgcttttggaatgtgtgggagcaggggctcaaccacctaagcctgttagctcagccgaagatacagaactgaaaagtaaatctgacggtgaaacttccgataaccacgaggaagagggcaccctttcagattcagaaggaaggaagagtccgaaagataatacccagaggtcacaaagtcctgtgagtgttgtaacttcgcctgttggaactccaaatacaggtggatggattttggtaggaaacgaaggtgaaattcaacccgtcatgggccgcaccgtccctccaacccaatacggcctagcgttagagaagaaccttggaagccatgaccccagaagtatgatgaagtgctgcgaaagtcttgcgtttctagtaagagatgtcgcccatattacaccttacaattttgacgtttgtgttcattgtataaggacttttgtagaagctagcttacatggttctaatttcaaaaggttgagagattctaggtctagaaagaaaactttagataggactagaactagaaaaagtccaacaagtagtcccgatgaggaagatagtgacgacgaaaacattccaagtggttatcagcaaatatcaatacagttattagatttaatgcatactttacatacgcga

SEQ ID NO: 2162 - DNA, 638 bp, Diabrotica barberi
gcagtttagtacaaaaacctgaagtaaattctataatctataacgaaaagtgcttaaattttagtggcaaaatgtccattctagcttacaatggtggtgctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaacatgttgtatgaaaaaagatttgggccattttttgtggaacctgtagtagctggacttctacctaatacttatgaaccctttatctgtaatatggatttaattggttgtataaaccaaccttcagactttgttgttggtggaacagcctcagcacagttgtatggtatgtgtgaagcactttgggagcctaacttaggacctgaggatctttttgaaaccatctctcaagctctcatcaatgcctttgacagagatgccatttctggttggggagctacagtgtacatc

SEQ ID NO: 2163 - DNA, 731 bp, Diabrotica barberi
ggatccagtaatgtggctagatagacttagtgcggtgcttagatatgttaatgtacatattccggaaggtgtggaaaacccttgtaaaccggtaattctcgaagtgtggccggtattgtctcgcacgttcgataaattccaaagtgacattaggataatggagagatgttgtcgtgccgtgcgtttcatgctgcggtgcgtcgcgcaagaagtgcgtgaactcttagaaagcctagttggacaaatagtgaggatctatacgttataccaacattcgtgttttctctatgtcggtagtatactcgtggacgaatacgcaatagatccgatatgcgtgccaggactgctggatatgctgcaagcgtttctggaacctacctttcacgtgttgcaggaggagaacgggctgaagaatcatcctgatacagtggatgacttttttaggttgtgtgcaagatttatgcagagggcgcctttagcatttttaaaatgttcttccttggtccacatcttacagtgtgcccttttggcttcttccctggaccaccgagaagcgaatatgtctgtgatgaaattcttttacgatttgataaaccagggccagagcgggagggctgatcccgaattcaatcaacgacagatgttagttaaaagcatcctcgacgagtatggccaacaactagtctcgaatctaatccattcttgtgtcttctacctccattcctacatgc

SEQ ID NO: 2164 - DNA, 744 bp, Diabrotica barberi
caatcctccaccaccaaatataccatctagtggcggtacgatgattcaaagacctgctggtgctccctattcaccaatgagaggtggaattattccgccacagcaaggaaataaaaggcctgcagacaataggactcaaatgcaacagaaaagtaatgaatacagccatagtacaagtaagaagaagaaaaagctggcggataaaatcctgccacagaaagtcagagatttggttccagaaagtcaagcttacatggatctgctagcatttgaaagaaagctggactctactattatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcgtcttgggaattaagagtagaaggtcgtcttttagaagatccaaagaacgatccaaataaagttaaacgcaagttttcttctttctttaaatccctggttatcgaattggataaagagctgtatggaccggacaatcatttagttgaatggcacagaaccctaaccactcaagaaacagatggtttccaggtaaaacgccctggtgacaagaatgtgagatgtactattttgttgcttcttgattatcaacctctgcagtttaagcttgatcctagactagctagacttttgggagttca

SEQ ID NO: 2165 - DNA, 285 bp, Diabrotica barberi
gaacccacattagacgagttagaacaaaaaatgagagaagttgaaacacaatctcatgagggtaaaaggaaaaatgaatcattgtggccaattttcaaaatccatcatcaaaaatccagatatatatttgatcttttttatagaagaaaagcaatcagcagggaactatatgactattgtcttggtgaaaacattgcagataaaaatttaatagcgaagtggaagaagcaaggatacgagagtctttgttgcttaagatgtattcaaacgagagacaccaacttt

SEQ ID NO: 2166 - DNA, 650 bp, Diabrotica barberi
tgctatggacacagaattccctggtgtagttgcgaggcctattggagaatttagaagttctgcagattaccaataccaaatgctgaggtgcaatgtagatttattgaggataatacagcttgggctcacatttcttgatgataatggaaaaactccagggggtgcctatactacatggcagttcaacttcaaattcaaccttcaggaagacatgtatgcacaggatagtatagacctcctgcaaaattctggaattcagtttaagaaacatgaggatgaaggtattgaacctcttgaatttgcggaactgctgatgtcatctggtattgtcctggtggaaaatataaaatggctgtccttccattctggttatgattttggctatctgataaaactgttaacggacaacaacttacctcaagacgaaacagaattcttcgatttgttaaaattatattttcctaccatatatgatgtaaagtaccttatgaaatcgtgcaaaaatcttaaaggaggattacaagaagtggcagaacagctagaacttgaaaggattggaccacaacatcaagcaggttcagattctcttctgacaggaatggcatttttcaagatgaaagagatgttcttcgaagacacaatagacgact

SEQ ID NO: 2167 - DNA, 786 bp, Diabrotica barberi
tctggtactggtaaaacagctaccttttccatttcgattttacaagccttagatttgacaatgcgagaaacgcaagttttatgcttgtctcctactagagaattggctgtacagattcaaaaagttattctagctttaggtgacttcatgaatgttcaatgtcatgcttgtattggaggcacaaatcttggagaagatattagaaaacttgattatggacagcatgtcgttagtggaacacctggaagagtttatgatatgatcagaagaagagctctaagaacaagatctgtaaaaatgttggttttggatgaggctgatgaaatgttaaataaaggattcaaagaacaaatttatgatgtctacagattccttcccccatcaacacaagttgtactcatttcagctacactgcctcatgaaattttggaaattacttccaaatttatgacagatcctattaggattttggtaaaacgtgatgaattgacattggaaggtataaaacagttctttgtggctgtcgaaagggaagaatggaaattcgataccctctgtgacctctatgacacattaaccattacacaggctgttattttctgcaacacaaagaggaaggtagactggctgacagagaaaatgagggaaaacaattttacagttagttcaatgcacggagatatgccacaaaaggaacgtgacaatattatgaaagagtttagatcaggacagagtagggtcctaatcaccactgatgtttgggctagaggtatcgacgtacaacaa

SEQ ID NO: 2168 - DNA, 684 bp, Diabrotica barberi
agaaagctggatgcaatgtacttttggttcaaaaatcaattttgagggatgcagtttcagatcttgccttacactttttggataaaatcaagtgtatggttattaaggatattgaaagagaagatgtcgaatttgtatgtaaatctttaggatgccgccctattgcatctttggatcattttgttgctgaaaacttggttactgctgatttagttgaagaggttggattggcaggaaatagaatggtcaaaattacaggtgcacaaaatgcaggcaggacagtaactctgctggttagaggatccaacaaattagttcttgaagaggctgatagatctcttcatgatgctctatgtgtaattcgttgtcttgttcgcaagaaggcacttattgccggaggaggagcaccagaggttgaggtggctcttaaactagcggctatggccaacaaactggaaggcattgatgccatttgcacacgggcatatgcgaatgccttagagattataccatttaccttgtctgagaatgcaggattaaatcccatacagaccgtcactgaactaagaaacagacacgccaaaggagagacgtctgctggaataaacgttcgtaaaggagctattacagatattctcgaagaaaatgttgttcaaccacttttagttagcacttcagcattga

SEQ ID NO: 2169 - DNA, 748 bp, Diabrotica barberi
caaaacactggtatcgttggctcaactacaggttcaaattattatgttagaatcttatcaacaatcgacagagaactcttaaaaccttctgctagtgttgctcttcataaacacagcaatgccttagtagatgttctacctccagaggcagattcttcaataagcatgctccaggctgatgaaaaaccagatgttcaatacagtgacattggaggtatggatatgcagaaacaagaaatcagggaagcagtagagttacctttgactcacttcgaattgtataaacagattggtattgatccccccagaggtgtgttgatgtatggacctcctggatgcgggaagactatgttggccaaggctgttgctcatcatactacagctgcctttattcgtgtagtcggatcagaattcgtacagaaatatcttggtgaaggtccgcgaatggtgagagacgtgttccgtctagcaaaagaaaattctccagcaatcatctttattgacgaaattgatgcaatcgctaccaaacgttttgatgcccagacgggtgctgatcgtgaagtccagagaattttattggaactgcttaaccagatggatggttttgatcagacaacaaatgttaaggttatcatggcaactaacagagctgatacattagatcctgcacttctgagacctggtcgtctggacagaaaaatcgaatttcctttaccagatagaagacaaaagcgtttgattttcagca

SEQ ID NO: 2170 - DNA, 282 bp, Diabrotica barberi
aaatgctccgtcactatcaaaactatgttagaagacttaggaatggacgaggaagaagaagaagtggttcctttaccaaacgtaaattccgccatactcaggaaagtcatccaatgggcgacttaccacaaagatgatccaccaccgccagaggatgacgataacaaagaaaaaagaacagatgatatttcctcatgggacgcagacttcctgaaagtcgaccaaggaactctcttcgagttgattttggctgctaactatctggatatcaaggggctctta

SEQ ID NO: 2171 - DNA, 753 bp, Diabrotica barberi
gaatgcaagcaattaacggaaaatcaagttaaaacactatgtgataaggctaaagaaatattgtcaaaagaatcaaatgtacaagaagtgaaatgcccagtaacagtatgtggagatgtccatggacagttccacgatctgatggaactgtttaggataggaggtaggagtccagatactaattacctgttcatgggagattatgtagatcgtggatactattctgttgagactgtcaccttactggtagcactgaaagtcaggtacaaagagagaattacaattttgagaggcaaccacgaatcaagacaaatcacacaagtttacggattttacgatgaatgtctaaggaagtacggaaacgcgaatgtatggaaattcttcaccgatctgttcgattatttgcccctaacagcgctcgtcgatagtcaaattttctgtctgcacggtggattgagtcctagcatcgacaccttggatcacattagggcgctagatcgtttacaagaggtacctcatgaaggccctatgtgcgaccttctctggtcagaccctgacgaccgcgggggctggggcatctccccccgtggagccggctacaccttcggacaggacatttcagaaacgttcaaccataccaacggtctgtctttagtatctagggcacatcaactcgtcatggaaggttacaattggtgtcacgaaagaaatgtagtgaccattttcagcgcccccaattattgctaccgatgc

SEQ ID NO: 2172 - DNA, 693 bp, Diabrotica barberi
accatcagataccatcgagaatgtcaaagctaaaattcaagacaaagaaggtattccaccagatcaacagagattaatcttcgctggaaagcaattggaagatggccgcaccctctcagactacaacattcaaaaagaatctaccctccatttggtgcttcgtcttagaggagggatgcaaatttttgttaaaaccttaactggaaagaccatcacccttgaagtagaaccttcagataccattgaaaacgtcaaagccaaaattcaagacaaagaaggtattccaccagatcaacagagattaatctttgctggaaagcagttagaagatggccgtactctctcagactacaatattcaaaaagagtctaccctccatttggtacttcgtcttagaggaggtatgcagatttttgttaaaacactcactggtaagaccatcaccctcgaggttgaaccatcagataccatcgagaatgtcaaagctaaaattcaagacaaagaaggtattccaccagatcaacagagattaatcttcgctggaaagcaattggaagatggccgcaccctctcagactacaacattcaaaaagaatctaccctccacttggtgcttcgtcttagaggaggtatgcaaatctttgtaaaaacactcactggtaagaccatcacccttgaggttgaaccatcaga

SEQ ID NO: 2173 - DNA, 731 bp, Diabrotica barberi
ctatatcaaacgatggggcaactattttgaaattattggacatcgttcaccctgctgcgaaaactttggtagatattgctaagtcacaagatgcagaggtcggggacggtacgacaagtgtagtattactagcaggagagtttttaaagcaaataaagccttacgttgatgagggtgttcacccaagaataataatcaaagcagtcagaagatcgttccaaatttgcctcgagaaaataagtgaaatctctgttaaaatcaataaatcaaatgctgacgaatttagatctctattggaaaagtgtgctgcaacagcgatgagctcgaaattaattaatcaacaaagatctttcttttctaaaatggttgtagatgctgttctattactggacgatttactacctctcaatatgattggtatcaaaaaggtacaaggtggagccctagaagagtcacttttggtagccggagtagcctttaagaaaactttttcttatgctgggtttgaaatgcaacccaaggtatacaaagattgtaaaatagctctgctgaacattgaattggaacttaaagctgagagggataacgcagaagtaagagtagataatgtaaaagaatatcagaaaattgttgatgcggagtggacgatcttgtacaataaacttcaaaaaatttatgagtctggagctaatgttgttttgtccaaattacccattggagatgttgctact

SEQ ID NO: 2174 - DNA, 747 bp, Diabrotica barberi
tttttacagagcctcagaccaatcctgggttgcactagaacgtatccaatttgtcggtgcctgtaatcctccaactgatcccggcagaaagcctctatcccaccgattcttgcgacacgtacccgttatttatgtagactaccctggagagacatctttgaaacagatctacggtactttcaccagggctatgctaagattggcgcctggtctgaaaggttatgccgaaccattgactaatgctatggttgaattttatttggcatctcaagatagatttactcaagatatgcaaccacattatgtttattctccaagagaaatgaccagatgggtaagaggaatttgtgaagcaataagacctcttgataatcttgctgtggagggtttggtaaggctttgggctcatgaagctctccgtctcttccaagacagattagtcgaagacaccgaaagacggtggactaacgaaaacattgatgctgtagctttaaaacacttcccgtcagctaactgcgagaaagctttggaaagacccattctttacagcaattggttatctaaggattatgtacctgttggaagggaacaactaagagaatatgtaaaggccagactgaaagtgttctacgaggaagaacttgatgttcctttggtgctgttcgatgaggtgttggatcatgttttaaggattgaccgaatattcagacaacctcaaggtcacttactactgatcggagtttctgg

SEQ ID NO: 2175 - DNA, 695 bp, Diabrotica barberi
ggagatccagcggataaatttaggaaacgccgtactgatgttgaaggcgctaggaataaatgatttggtacattttgattttttggatccgcctcctcatgagactttggtgttagcattagaacaattatacgctttgggggctttaaatcatcacggagaattaaccaaattgggcagaagaatggccgagttaccggtggatcccatgatggcgaagatgatattagcttcggaaaaatacaaatgctctgaagaaatagtcaccataggagccatgttatcagtaaatggtgccatcttttaccgaccaaaggataaaataattcacgctgatactgctcgaaaaaatttcagtcacttagcaggagatcatctaagtcttctaaatgtttataatcaatggagggattctgattactccctacagtggtgttacgaaaatttcatacaatacagatcgatgaagcgagcccgagacgtcagggaacagctggttaacttgatgacaagagtagaaatagaaatcgtttccaacgtttctgaaaccgtggacatccgcaaggctatcacctccggttatttctaccacattgctagattttccaaaggaggaagttacaagacggtgaagcacaaccaaagtgtcaccatccaccctaacagtgcacttttcgaatcattacctaggtggg

SEQ ID NO: 2176 - DNA, 703 bp, Diabrotica barberi
ggtaaaacagcaattgcacttgcaatagcccaagagttgggaaataaagtacctttttgcccaatggtaggatctgaagtctacagttctgaaataaaaaagactgaagttcttatggagaactttcgaagagcaattggtttgaggattagggaaaccaaagaagtttatgagggggaagtcagtgaattgacaccggtagaaacagagaaccctgctggaggttacggaaaaactgtaagtcatgttatcattggtctaagaactgcaaaggggagtaaacagctcaaactggatcccagtatatatgaagcactccaaaaagagaaagttgaagtaggagacgtcatttatattgaagccacaagtggtgcagttaaaagacaaggaagatctgatgcttatgccaccgaatttgatttagaagctgaagaatatgtgccattaccaaaaggagatgtacataaaaagaaagaagttattcaggacgttacattacatgatctagatgccgctaatgctaaacctcaaggtggacaagacgttttgtcaatgatgggccaacttctaaaaccaaagaaaacagaaatcacagataaacttagaaaagaaatcaacaaaatagtagataaatatattgatcaaggtattgcagaattggttcctggtgtactatttattgatgaagtgcacatgttggata

SEQ ID NO: 2177 - DNA, 742 bp, Diabrotica barberi
ttaaatggttgtgagctcgatagactgcaaaaaccttccttacttattactgatgcgtttaatgctacttatcaacaagccagaagaagggctagagatgaaaaactaatgaccaatattcttcaaactcttcggaacaatggtaacgtacttatagcagtagacacggcaggcagggttctggagttggctcacatgttggatcagctatggcgtaacaaagaatctggcctattggcctactctttagcgtttttaaacaacgtcagttataacgttatagaatttgccaaatcccagatagaatggatgagtgataagttaatgagaagttttgaaggcgccagaaataatccctttcaatttaaacacttgcagtggtgtcacagtttagcagaattaagtaaagttcctagtccaaaggttgttctggcaagttcacccgatttggaaagtgggttctccagagagttgttcctgcagtggtgttctaattccaataacagtattatattaacaacaagaacatcccctggtactttagctagagacttaattgacaacggagcagaaagaaatatagatttaacggtagaaaggcgagtaaaactcgaaggcgtagaacttgaagaatatgaaaaacgacaacgagcgcggggtcaaaatgtagaaaaggaagatgcagattcggactctgattctgacatagaaatgtctgttatcaccaaaggtagacatgaca

SEQ ID NO: 2178 - DNA, 738 bp, Diabrotica barberi
aacagccctttatacccaaggaaacaccttcagaatttgaatttatagctgatcccccatcaatttcagctctagatttggatattgttaagcttacagctcagttcgtagctagaaatggtagagcttttctgacacaattgatgaatagagaacagagaaatctgcagtttgattttttgagacctcagcactctttatttcaatacttcaccaaattactggagcaatatacaaaggttcttattcccccaaaaagtatgcatgaaagcctgcgaaacgaggctaatagtccgaagaatgttttagagcaagtcaaatatcgtgcagaatggttaaagtatcaagagcaacaaaaagccaaggaggaggagcttttagaacgagaaagggttgcgtatgcacaaattgactggcatgagtttgtagtcgtcgaaactgttgactaccaacccttcgaaattggaaattttccggctccaactacccctgaagaagtcggagcccgtattttaattcaagagaggatagaagaaggggaagatatcgaaatgcaattagagagtgatgaggaagaaccaccagttacggaagctggtttaagtagcatgcaggacaaaaccaatcggaagacacgcgacgataccagaattcaagatatggaagaagaaagctccgatgaagaaaaagaagaggaagaggaattagctttacctccaccaccaccatctattcaac

SEQ ID NO: 2179 - DNA, 793 bp, Diabrotica barberi
ttaatcgcatgggcaaaatcggcaatcaaaagcgtgttgttggtgttcttcttggctgctggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaactgcatcaaaatgatattgccattaatgagttaatcagaaggtattgtccaaattccgttctagttatcatagacgctaaaccaaaagatttaggtttaccaactgaagcttatcaagctgtagaagaagtacacgatgatggttcacctacgtctaaaacatttgagcatgttcctagtgaaatcggagctgaggaggctgaagaagttggtgttgaacacttattgagagatattaaagacacaactgttggtactttgtcccagagaataacgaatcagcttctagggttaaaaggtctccattcacagttacgtgatattagggactatttggtgcaagtctgtggtaaccagcttccaattaatcaccaaatcatctaccaattacaagacatatttaaccttttgcccgatataaatcaggatgcatttaatacatcgttttacgtgaaaaataacgatcaaatgttagtcgtttatctagcagctttagttagatctattgtcgctctacacaatcttattaacaacaaactaacaaatagagacgcgga

SEQ ID NO: 2180 - DNA, 758 bp, Diabrotica barberi
gaacaacacattcatccgacaatcataattcgccagtacagacaagcactcgaagatatgatccagttattggaaggtccattaagtataccagtcgatagaaacgataaaaatgctcttgcccaagtcgtaaaaggctgcatcggcacaaaattcataagtaaatggtcagatttggcagtaaatattgctttagatgcagtaaatacagtattattagaagaaaatggcagaactgaagttgatattaagaggtatgccaaagtcgagaagattcctggaggatccattgaagaatctaaaattttaagaggtgttatgcttaataaagatgtaacccatcccaaaatgaaaagatatatacagaatccgagaataattcttttggattgtgcattagaatataaaaaaggggaatctcagacaaacgtagaaatttcagcagaaacagacttcaccaaactattagaactggaagaggagcatgtcaagcgtcaatgtgatgagattattgcactcaaacctgacgtcgtcttcacagaaaaaggagtgtcagatttggcccaacactttttactgaaagctggtattaccgctatcaggcgtgttcgaaaatctgataataacagaattgccagagcctgtggagccacgattgttaaccgaacagaagaattacaagaaagcgatgttggtttaggagctggactcttcgaaatcaagaaatttggtgatgagtatttctgctttgtggtcga

SEQ ID NO: 2181 - DNA, 566 bp, Diabrotica barberi
atgcaacgtcaaattaacccctatgcagataatggagggagtgtagtagcaatcgcaggtgaagactttgtaataattggtgcagatacacgtttgagtactggattttccatctataccagagaacaaaacaaacttttcccactatcaggcactacagttttgggttgcgcaggatgttggtgtgacactctaacattaaccagaatccttaaatctcgcatgcagatgtaccaacaagagcataacaaaacaatgtctacaactgcatgtgcccagatgttgtctaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggagaacctcttagtcaggagaaagctttgtctacccttaaagatgtatttatttctgctgctgaaagaga

SEQ ID NO: 2182 - DNA, 658 bp, Diabrotica barberi
gagaagacgttgaaagaggtggaaaaattattatgcccccatcagccttggaacaattgactaggttaaatatcaactatcccatgttgtttaaacttgtgaataaaaagacacatcgcacaacgcattgtggagttttagaatttgttgctgatgaaggaaaagtttatttgccactttggatgatgaacaacttggtactgactgaaggagatttggttcaaatggaaagtgtttcccttccagttggcaccttttcaaaattccaacctctcaatccagacttcttggacattactaatcctaaagcagtcttagaaaatggtttgagatcttttgcctgccttacaacaggagatgtcattgcagtaaagtacaatcaaaaggcttatgagttgtgtgttctagaaaccaaacccggagatgccattagtatcattgaatgtgacatgaatgtggaatttgctgctcctgttggatacaaagaacccgaacaagtcaaaaaggaagaagaagaaatggctatagatcctgcagatttaatgccagaaccttctggatttgtagcattcagaggtgcaggaaatcgacttgatggcaaaaagcgtaaagatacttcaggagctgatagttcagtgggcaaaccaacttatgtcag

SEQ ID NO: 2183 - DNA, 692 bp, Diabrotica barberi
ggttggtggaaaattggaagacacaacattagttaaaggtgtagttattgacaaaacaatgtcccatccacaaatgcccaaagaactaaaagatgtaaaattggctattctcacctgcccattcgaaccaccaaaaccaaagaccaaacataagttggatgtcagcagtgtggaagattataaggaactaagacagtatgaacaagaaaagttcaaagaaatagttggtttggtaaagaaagctggagctacattagcaatttgtcaatggggcttcgatgatgaagccaatcacttattgttacaacaagagttaccagctgtaagatgggttggaggtccagaaattgaacttatagcaatagctactgggggtaggatagtaccccgttttgaagagcttactcctgaaaaacttggtcatgctggtttggtacgagaaattgcatttggcaccactaaggatagaatgttggttattgaagaatgttcaaattcacgggcagttacgattcttgtcagaggaggtaatcaaatgttagtagctgaagccaagagaagtctccatgatgcattatgtgttgtcaggagtttagttcaggaaccaagggtagtgtatggtggtggagcagcagaaattgcctgcagtttggcagtcgcggctcaagcagatcaactagcttccttggaac

SEQ ID NO: 2184 - DNA, 198 bp, Diabrotica barberi; identical to SEQ ID NO: 1960

SEQ ID NO: 2185 - DNA, 774 bp, Diabrotica barberi
gatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattagtaaaacttggaacttgtaagcttattgaacaaatcatgattggagaagatatcctgctccgtttcagtggtgttgctcttggggaagcttgcacaattgtcatcagaggtgctacacaacagatcattgatgaagctgaccgttcccttcatgatgctttgtgtgtattagcagccacagtcaaagagagtcgaattgtgtatggaggaggttgcagtgaaactctaatgtccacagcggtatcaagagctgctgctaacactccaggaaaagaagctgtagcaatggaagcttttgccagagctttgttgcagttgcccacaattattgcagacaatgcaggttacgactctgcccaattggtcagtgagcttaaggcagcacataacagtggccagagcaccatgggacttaacatggaaaagggtgaattgggggatatgaaaaccttgggaatcacagaatc

SEQ ID NO: 2186 - DNA, 728 bp, Diabrotica barberi
gcatcaggtagaatatgccatggaagcagttaacctaggttcagccacagtgggactgaaaagtaaaactcatgctgtacttatcgcgttgaagagggcttcttcagaactgtctgcctaccagaagaaaattatcaacatagacgatcacattggtatcaccatctcgggacttacagctgatgctaggattcttagtagatatatgcgaaacgaatgcttgaattataagtactctttggatacttatatgccattgaataggcttatcagtattttaggtaacaaaatgcagacatgtacccaaagatatgaccgtagaccattcggtgtaggtcttctagtagctggttatgacgaatctggttctcatatctaccaaacgtgcccttctgctaatttttatgattgcaaagctatgtccattggagcccgatcccagagtgccaggacatacttagaaaaacatctggatgaattgccatccagttctttggaagaacttatcaaacatggattgagggctcttagagatactctacctccagaggttgaccttacaaccaaaaatgtctccataggctacactggaaaaggcgtgaccttcaaaatccttgaagaagaagaaactgccccctacttgtcccttattgagggtgaagaacgcagaggaggaggagctgcagctgccgcaattgaggatcttcctgcagatccattgagagatg

SEQ ID NO: 2187 - DNA, 791 bp, Diabrotica barberi
tcaaagtagacgatttggcaacagtgtggtgtgaatgggccgaaatggaaataaggaacgagaattatgatgaagctttaagactcatgcataaagcaacttttatgcctagtcgaaaagtagcatatcatgatgacactgaaacagttcaaagtcgactgtataagtctctcaaagtttggtctatgtacgcagatttagaagaaagtttcggcacctttaaatcttgtaaagctatttacgacaaaataatagatttgaaaattgcaacacctcaaattattataaactatgggatatttctagaagaaaataattattttgaagaggcattcagagcgtatgaaaaaggaatatctctatttaaatggcccaatgtatacgacatatggaacacctatttgacgaaattcctaactcgttatgggggatcaaaactagaacgtgccagagatctgttcgaacaatgcttggatggatgtccacaacagtttgccaaacatctttacctgctctacgcgaaactagaagaagaacatggaatggctagacacgctatggctgtatatgaaagatcaaccaaagctgttccagagcaagaaatgttcgacgtttttaatatatatatcaaacgagccgccgaaatctatgggattcccaaaacgagacagatctacgaaaaggctatcgaggtacttccagaggataaaactagagaaatgtgtcttagattttctgatgtggaaacaaaactaggtgaaattgatagagcccgagctatatatgctcac

SEQ ID NO: 2188 - DNA, 662 bp, Diabrotica barberi
ctattgtgggagctctttgtacaagcagggcctttagtcaatgtacatatgccaaaagatcgagtaacaaccatgcaccagggctatgggtttgtagaatttatgggagaggaggatgcagattatgctattaaaattatgaacatgataaaattgtatgggaagcctataagagtcaacaaagcttcggctcatcagaaaaatttagatgtaggagctaacatttttattggaaatttagacccagaagtagacgaaaagttactctatgatactttttcggcatttggagtaatattacaaacacctaagattatgagagatcctgatactggtaactccaaagggttcgctttcatcaattttgcaagcttcgaagcatcagatgcctccatcgaagccatgaatggccaatatttgtgcaatagacccatatcagtatcttatgctttcaagaaagactcaaaaggagagagacatggatctgcagctgagcgtcttcttgctgctcagaatccattatcacaggctgataggcctcatcaactgtttgctgatgcacctccaataggtttgatgcccatgtccatggccccacctcctccaccagtcataatgacaggaatgatgcccccaccgcctccaacactatcaaacttgcc

SEQ ID NO: 2189 - DNA, 637 bp, Diabrotica barberi
agcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaacctccaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgatacaaagaaaaccagagttaagttgccttctggagccaagaaagttattccatcaaacaacagggccatggttggtatcgttgctggaggtggtcgtattgacaaaccaatcttgaaagcaggtcgtgcttatcacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagttggtctt

SEQ ID NO: 2190 - DNA, 292 bp, Diabrotica barberi
cagttagcaactaaagctgctcgcaagagtgcacctgctactggaggagttaaaaaacctcatcgttataggccaggtaccgtagcgcttcgtgaaattagacgttaccagaaaagtactgagctgcttatcagaaaactacctttccaacgtcttgtccgtgaaatagctcaagattttaagacagatttacgttttcagagttcggcagttatggctttacaggaagcgagtgaagcatatttggtaggtttattcgaagataccaacctatgcgctattcatgctaaga

SEQ ID NO: 2191 - DNA, 680 bp, Diabrotica barberi
tacatagcagaaggtctccaccctagattgttaacagatggctttgataaggctaggacaaaagcgttggaagtactggagaaaatgaagattccagttgaggctaacaaagaaactttgacagatatttgcaggacgagtttaagaacaaagttgcatcaaaaactggctgatgttttgacagacgtttgtgtggatgctgttctagctataaagaaagatgacaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaagatcactctgtaatggaactgataagacttttgttattattaaccaaaaaggtattgaccccatgagcctggatatgcttgccaaagaaggaataatagctctcagaagagctaagagacgtaacatggagcgtctatcattggcttgtggtggagtagctatgaacag

SEQ ID NO: 2192 - DNA, 798 bp, Diabrotica barberi
agagaacaaatcgcagaagtggttatgcaagtcaatgttccagaattcatccctaaatctggcgtaaagatagcagttacggattctcaaatggctatgaatggtaataatgtggatttggatcgcgtttcccaaattaaagaagaactaccctcagtagcagaactaggtggactacgtcttactcctttagaatttgaaaaggacgatgacaccaatttccacatggactttatagttgctgcttcaaatcttcgtgcagctaattacaaaatacctcccgctgatagacataaatcaaaacttattgctggtaagattattcccgccatagcaacaacaacctcagtagtcgctggaatggtttgcttggaactttacaaactcaccagaagttacacatccctaactccattcaaaaataattttattaacctcgctctgcctttcttcagttgctcagaaccaatcgcagcccaacaaatggaatactgtggtaacaaatggacactatgggaccgcttcgatgttcagggagaaatgacgcttagtgaatttttggaatacttcaaggaaaaacacggtcttgaaattactaacctcgctctgcctttcttcagttgctcagaaccaatcgcagcccaacaaatggaatactgtggtaacaaatggacactatgggaccgcttcgacgttcagggagaaatgacgcttagtgaatttttggaatacttcaaggaaaaacacggtcttgaaattacgatgttgtcccagggcgtttgcatgctgtattcgttc

SEQ ID NO: 2193 - DNA, 653 bp, Diabrotica barberi
ctcaagctgttattggcatggatattctgtgccaagctaaatccggtatggggaaaactgctgtttttgtattagctacactccaagtaatagatcctacagaaaatgttgtatatgttctcgtcatgtgccataccagagagttagccttccagataagcaaagagtatgaacgtttcagtaaatatatgcccaatattaaagtaggggtcttctttggtggcttgcctatccagaaagatgaggagacgttgaaaaataattgtccgcatattgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccctaagtaaagaaattagaccagtttgcaagaaatttatgcaagatcccatggaagtatatgttgatgacgaagctaaattaacattgcatggtctacagcaacattatgtaaaactaaaagaaaacgaaaagaataaaaagttatttgaattactagatgttttggagttcaaccaggttgtcattttcgta

SEQ ID NO: 2194 - DNA, 656 bp, Diabrotica barberi
ccaacactagaaggaagcttaatggactggtgttgagaagtctcattactcaaatatatcctgtagctgaacgtgatgccctcattagtttcgtcgaggaagcttctggagaactcgacgccacccagtcaagagcaaggtcagctgttaagtcacccgttcccgaggtagatacatatataaatcttttaatactagtacgtttaatcgacaccaataagttagttgaagcagagcgatgttcccaagctctcatgaataaaataactaaccaaaacagacgtactatagatcatattgctgccaagtgttatttctatcactccagggttgctgaattaaccaacaaattggattcaattagaggctttttacattctcgtctacgtaccgctacactcagaaatgacttcgaaggccaagctgtgcttataaactgtctgttgagaaattatttgcattattcattgtatgatcaagccgacaaactagtgagtaaatgtgtatttcctgaaactgcaagtaacaatgaatgggcaaggttcttatactacttgggcagaattaaggcggcaagattagaatacagtgtagcgcataaacatcttgtgcaggccttgagaaaagcaccccagaatgctgctattggtttcaga

SEQ ID NO: 2195 - DNA, 778 bp, Diabrotica barberi
gagtactcaaacatcgacgaatggtacaaacggggtgttgacacttcaaaaatagttactaaatatcgtaaaggtgcgtgtgaaaattgtggagctatgactcataaaaagaaagattgtatggaaagacctcgcaaagttggagccaaattttccggagcaaatattgcaccagatgaatttgcccagaaaaacttagcgttgagctttgatggaaaaagagatcgatggagtgggtatgacccatctgagcataaagcagtaatagaagagttccagaaagttgaggaagctaaaagacaactgaaggctgacaagttaaatgcaaacgaatcttctgacgatgaagaaaaagatgaggacaaatatgtagatgaagttgatatgcctggtactaaagtagacagcaaacagagaattactgtaagaaatttgaggataagagaagacaccgccaaatatttgagaaatcttgatttaggttctgcttattatgatcccaagacaagatctatgagggaaaaccctaatcctgaaaaagatgctacgtacagtggagagaatttcgttcgttttactggtgataccaccaatcatgctaaggctcagttatttgcttgggaagcatatgaaaagggtgtggatgttcatctcttagctgaaccaacaaaactagaactgctcaaaaaagaatatgagaaaaagaaagaagaggttaaatcaacaattcaaagcagcgttctagataaatatggtgggcaggaacatttagaagcac

SEQ ID NO: 2196 - DNA, 590 bp, Diabrotica barberi
gcctcctgtggattttagtttattcgttcagaatgggtattagtagagaccattggcataaacgaaggtccacaggaggcaagaggaagcctctccgtaagaagaggaagttcgaattaggacgtccagccgcaaataccaagcttggagcacgtagaattcactatgtccgtacacgaggaggtaacttgaagtaccgcgcattgaggattgaaaaaggaaatttcgcatggggcagcgaaggtactgctcgtcaaacacgtattattgatgtcgtttacaatgccagtaataacgaattggtacgtaccaaaacattggtaaagaatgccatcgttgttattgacgcaacccctttcagacaatggtatgaaagccactatattttacctttaggacgcaagaagggggcaaaattgacagcagacgacgaagaaattttcaataagaaacgtagcaaaaaagtacagaaaaaatatgaaactaggcaaaaaacagctaaagtagaacctgcgttagaagaacaattctcaactggaaggttattagcttgcttagcgtcaaggccaggacaatgtggtagagctgat

SEQ ID NO: 2197 - DNA, 735 bp, Diabrotica barberi
ggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgccccagactggtaccggtgtcagtgtagaagctgttgatccagtttttcaagcaaaaatgcttgacatgttaagacagactggtaggccagaaatggttgtggggtggtatcattcccatccaggtttcggatgttggttgtctggagtggatatcaatacccaacaaagttttgaggctctctcggaaagagctgtagcagtagtagttgatccaatacagtcagtgaaaggcaaagtcgttattgatgcctttaggttaataaatccgaatatgatggtattgggccaagaacctcgacaaactacatccaacttaggacatctacagaaaccatcagtccaggctttgattcatggtctaaatcggcattactactctatcagtattaattacagaaaaaacgaattggaacaaaaaatgctactaaatctccataaaaaatcctggatggatggtctaactttagcagattactctgaaaattgtagtgtgaatgaaaagactgttgctgatatgttagaactagccaagaattacaacaaggcattagaagaggaggagaaaatgactccagaacagct

SEQ ID NO: 2198 - DNA, 783 bp, Diabrotica barberi
gcaagctcagagaaatgaactcaatgccaaagttcgtatgttgagagaagaattgatgttacttcaagagcaaggaagttatgttggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaattcttccaaataaggttgatcctttagtttccttgatgatggtggagaaagtccctgattcaacttatgaaatggtaggaggacttgacaagcaaattaaagaaatcaaagaagtaattgaacttccagttaaacatccagaactgtttgatgcccttggtattgcacaacctaagggtgtgttgttatatggaccaccaggtactggaaaaactcttctggcacgtgctgtagctcaccatacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgagtcaggatctggtggtgattctgaagtccaaagaaccatgttggaacttctcaatcaattggatggttttgaagctaccaaaaacatcaaagtaattatggctaccaacagaattgatattttggatcccgctttact

SEQ ID NO: 2199 - DNA, 488 bp, Diabrotica barberi
acctggttgaaatcagcttttgaacttcaaagcttcagttttttccaaagagggtcaatacaggagttcatgtcattcttttgcaaaaccatagtggaaagaacaataccagcctcaaggcagagtgttaaagaaggagaatatttgtgtcatgtatatgtaagagctgataacttagctggcgttatcataactgaccatgaatacccatcaagggtatctcacactctaataacaaaaatactagatgaattcggtgccaaaattcctgcagctaactggcccaaccttgaagagagagatgtagcatttccacaattaaatacctacttagcgaaatatcaaaatcctagagaagcagatgctattactaaaattcaagaagatcttgatgaaacgaagattattttgcataataccatacaagcagttttggaacgaggcgagaaactagacgacttggtgagcaagtcggaaggtttaagcat

SEQ ID NO: 2200 - DNA, 463 bp, Diabrotica barberi
catattggatgtgccgtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctagaccttttggagtagcaattttgtttgctggtatagatgaaaaaggacctcagttgtaccatatggatccatcaggaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttcc

SEQ ID NO: 2201 - DNA, 652 bp, Diabrotica barberi
atgttattcttgcgagtggtggtatcgatgatctttgcttgaaatacttcgttgaaaatggagcgatgggtgtaagaagagtaaagaaagctgacttaaaacgcattgccaaagcaactggtgccactttcctaacttctcttagtaacatggagggagatgaaagttttgattctagcatggtaggagaggcagcggaagttgttcaagaaagaatttctgatgatgaattgataattattaaaggaccaaaagcacgtacagcagcctctatcatcttgcgaggacccaacgatttctattgtgatgaaatggaaagatctgttcacgacgcgttgtccgttgtaaaacgcgtactcgaatcgaaaagcgtcgtagtcggtggcggcagtgttgaagcagcactttcgatatatttggaaaacttcgccaccacgctaagctccagagaacaattggctatcgccgaattcgccaggagcttactggttattcctaaaacgttggcagttaatgcagcgcaggacgctacagatttagtagctaagttgagggcataccataattccagtcaaacgaaaaaggatcatgcgcatttgaaatatgtaggattagatctcatggaaggtaccgttcgagataaccgaaaagc

SEQ ID NO: 2202 - DNA, 756 bp, Diabrotica barberi
tcccgttacaacatcaacttctgtattagctattacttacgataaaggagtattgatagccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgacgatggactaaaaatgaaaccaaaatcattgtactgctggcttacaagagtaatgtaccaacgcaggagtaaattagaccccttttggaataatttggttataggaggaatccaggatggagtcccgttccttggaactgtagataaattgggaactgcatatacagacaaagttatctgtacaggttatggagcccacatagccttgcctcttctgagagactcgttagataaaaatggagctcttaacttggctgatgccaaaactctgattcacaaatgcatggaagtgttgttctacagagatgccagaagttttcccaaatatcagcttggtgttattgataaggatgatggcgtcacgatccagggaaccatagataaattgggaactgcatatacagacaaagttatctgtacaggttatggagcccacatagccttgcctcttctgagagactctttagataaaaatggagctcttaacttggctgatgccaaaactctgattcacaaatgcatggaagtgtt

SEQ ID NO: 2203 - DNA, 725 bp, Diabrotica barberi
aagagtggttggacaagtttgaccaagcaaagaagactagattagcccaagagcaacataagagggagtcaatttcggaaaaatcaccctctcgatcagcttcgatagagtctcctagttataacccttttgacgaagttgaagacgatgtaggaatggtgcacccagaatggtttttggacattccagaggaacttgatgtgtgtgtagctcaaagacacttcgaagaggctctttcattgttgcaaaaagctaaggaatatattagccaaatgacggctggtaatgagaaacacgatcatgtgttcctcgatattcaaagaaaggttgaacaacgacaaaatagtcttaccgaagttttaatgaaagaactggaagttaatcctgataaatctttgcaaggtggattgagggctgctagaagagcagtaaggttattaaatcaattaggaagagaaaaccaatcatgtaacttattcctgaaattgtgtagcagtatgttgaggacacagtgtaagcgtgtaaaaagagaaggatccaccacaacatacatacgaaatttggcgagtgtagttttcactaacatgtgtcatatgtcggatgagtttctaagggcctttcccgactcaccaacttgtgcttcagcttatgttgtttgggccagcaacgaattgcttctttttactggacattttataaaacaagtatttatgccccagacttcg

SEQ ID NO: 2204 - DNA, 744 bp, Diabrotica barberi
gtggttctaggagcaaaagaaataaagaaagaagtaggtctaggaataggagaagcagatcaagggatagaagaagtagatcgagagacaggagaaacagatctaaggatcgaaaatacaaaaattattctagagataaagataggagagaaagaagcaattcgagggatataaaacgggatagaagtactgagaagaagttcaaaagtgaaaaagataatccagagttcgaagatgatcctaacccaggaaaaatatataatggaaaagtatcaaatattgtaccttttggatgctttgtccagctggagggacttaaaaggagatgggaaggcttggttcatatttcacagcttagagcagaaggcagagttactaatgtatctgaagtaacatctagaggagctagagtaaaggtgaaagtattgacagtaacaggtcagaaggtgtcattatctatgaaagatgtctgtcagattactggtaaagaccttaacccacattcccacgctccgactgaaagagaagatagagatagaaatcctgacaggcctgtaaacagcagtacatctgtattgagactgccagtaaatatagatgaaggagaagaagactctcggaaacgagtaacaaggatttcaagtcccgagagatgggaaataaaacagatgatttcatcaggatgtattgctaagagtgagttgcccgattttgatgaagaaactggattgttacccaaggatg

SEQ ID NO: 2205 - DNA, 701 bp, Diabrotica barberi
ttctcttttggtagctggacaagaaagtgagtgtcaattgtacaaactgaatcctaaactagtcgaggaagtggaaaatatcggtaataatactcatctcaggcaacggaatacaaaaaacaaagaagttacagatgacaacaagaatgtgacaaaagagttatattttgatgttaacgcaatagaaaatgttcaaactgactttaatgggagtgaaccgttatcaagggtagtaaaaattaatcacgacggtacattattagctacaggtggcactgatggagatgtacgaatatggaagttccctagtatgcaacctttatttattcttaaggcacacacaaaagaaatagatgatatagattttagtaggtatgacaattatgtgattaccatagccaaagatggtttagcagtattgtgggattgtatgacaggaaaagaaagaacaaaactgacatggaaacagcctgaaggatcaaaatatttatataaacgttgtagatttggtgtaatagaaggactagacaagaaatgtgcactatacacaatatccaatccaataggagtagctaaaaaacaaaaatcctacctccagcagtggatacccgaggaaaacatgttaagaaggtgtatagaatttgatgagagtttggctgctttagctgttcgtgatgatggtagatttgttgcggttggta

SEQ ID NO: 2206 - DNA, 664 bp, Diabrotica barberi
tcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaacttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttacgaagcttttgaaggttttgatagtgttgaatccccaaaagccctcacagcccttaagtacatgcttttgtcaaaaatcatgataaacagtcccgaagacgtccaacaaatcgttagtggtaaattagcctttaaatatgctggtcaagatatagaggctatgaaatcagttgcacaggctgcacacaaaagatcactagcagatttccaacaagcagtaaaacagtttaaacacgaattagaagatgatgttattgttagagcacatttaggaacgtt

SEQ ID NO: 2207 - DNA, 793 bp, Diabrotica barberi
tggcagaaaaatatgaggctaagcttcaagaggctctacaagaactcagagatcaatatgaaagtcaaatggccaacaaccgtggcgaaatcgagttgctttacgaacagaagattaagaacttgcaatccgctaatgacagacattctgcctctgcttccggtgctcttgacgaattgagacaagttagaaccagaatcgatactttgaattctcgaattagcgatttagagaaccaaaacgctggcttagcagctcgtgctagagatttggagaagttgttagagaacgagcgcatgcgccatgtggaagacctcgcaatgttagaaagagaattacatagactccgagaagaaatggctaaccaacttcaagaataccaggatcttatggacattaaggtttctcttgatttggagatagctgcttatcggaaactgctcgaatctgaagaagctcgtctgaatattaccccaacgggtagtgaagttcatgaagtaactcacagtaggagccaacgcagctcgtcgcaacgtcgcactccagtcagattgggagccaaaagaaagcgaacactactcgaagaaagccaagagtcgagcatgaatgactattcggtgaacagctcctcaaaaggtgacattgaagtcgcagatgtcgatccagaaggacactatgttaagttgcacaacaaaagtaatcaagaagtcgctcttggaggatggcaagtcattagacgtgtcggtgaggaggaaaccacattcaaatttcacaggtcactaaagcttgaagg

SEQ ID NO: 2208 - DNA, 702 bp, Diabrotica barberi
agattcggaagattcgacagggaaatcgatatcggaatacctgatgcaactggcagacttgaagttttacgtattcacaccaagaacatgaaattagccgatgatgtcgacttggaacagatcgctgcagaaactcatggtcacgtaggtgccgatttagcttcactgtgttccgaagcagcccttcaacaaatcagagaaaaaatggacctcatcgacctcgaagacgaccaaattgacgcagaagtcctaaactcactggcagttaccatggagaacttccgttacgccatgacgaagagcagcccaagtgctttacgtgagaccatagtagaagtaccaaatgtcacttgggacgatatcggtggcttggctaatgtcaagaaagagttgcaagaattggtgcaatatcctgtcgaacatccagataagttccttaagttcggtatgcaaccgtccagaggagtgttgttctatgggccgcctggttgcggtaaaacgttattagctaaggctattgcgaatgaatgccaagccaactttatctcagttaaaggaccagagttgcttactatgtggtttggtgaatcagaagcaaacgtcagagatatcttcgacaaggctagatctgcggcaccttgtgttctattcttcgacgaattagattcaattgccaaatcgcgtggtggaaatgtaggtgat

SEQ ID NO: 2209 - DNA, 651 bp, Diabrotica barberi
gttcccagtctatgtgaagatctactatcatctgtggatcagcctttaaaaattgcaaaagataaagaaactggaaaagattatcttctttgtgactataatagagatggagattcctacaggtcaccatggtccaatacatactacccgcccctagaagatggttcaatgccatctgaaaaattaagaaaactagaactagacgccaatcttgcatttgatcaatacagggaaatgtattttgaaggaggtgtatcttctgtttatttttgggacttagaccatggatttgcaggagtcattctaattaaaaagactggagatggtagtaaaaagattaaaggatgttgggattccttacatgtagtagaagtgcaagagaagagttcaggaagaaactcccattataaaatgacttcaactgctatgttatggcttcaaactaataaacagggatctggaactatgaacttgggtggaagtctaactcggcagatcgaacaagatgcagctgtaaacgatatcaaccctcacatagccaacattggaagaatggtagaagatatggaaaacaaaattcgcaatacattgaacgaaatttacttcagcaaaacgaaggacatcgtcaacagtctacgatcagttcaacca

SEQ ID NO: 2210 - DNA, 721 bp, Diabrotica barberi
catgactaccacgacatcataaagaaacccatggattttagcactgtaaaaaataaaatggaaaaccgagagtatcgcactcctcaagactttgccgccgacgttagactgatttttagtaattgttacaagtacaacccttctgaccacgatgtggttgctatggcgaggaagttgcaggatgtgtttgaagtgaaatatgcaaagattcccgacgaacctgtcaatagggtaggagcccctgccgttaataatatacctgccaaatcagaaacgagtacatccggttccagctctgattcttctagcgacacggaagattcggaggaagaaaggcgaaacaagcaactgaagctgctagaaaaagagttgacggcgatgcaagaaaagatgcgtaaattggtagacgagagctcgaaaaagaaaaaagaaaagaaaaaggacaaagtgaaaaagaaaccggcatcaggtgggtctatggcgaacgcctcactatcaactctaccgaacagcagcagcgcgggcttgggtaagccgggtgccggtggtcacggggctctaaacaagtcaaacaacaacaactcaatagcggcggacagcgttgacgacagcatcgccagtgttgtgtcgggggccgatctaaagatggccgagtcgcaccatccgcaaactggaaccggcgctcaccatccgccggcaggcaaatccctgaacatgcatc

SEQ ID NO: 2211 - DNA, 704 bp, Diabrotica barberi
atgagcaaaggacatgtcatcgaccaaatccctgaattaccattggttgtcagtgacaaggtacaagaaatgagcaaaactaaacaggctgtccagttcttgaggagaatcaaggcatgggctgacattcaaaaggtttacaagagtcaacgtttccgtgctggtaagggaaaaatgcgtaataggaggcgcatccaacgtaaaggaccattggttgtttactacaaagatcaaggtcttcgtcgtgctttccgtaacatcccaggcatcgacctcattagcgtacagaagttaaacttgttgaaacttgctcctggtggtcatgtaggtcgctttgttatttggaccgaatcagctttccaacggttagataaattgttcggcacatggaaaacagcatcattggaaaagaagggttacaatctaccccaacctaagatggccaacactgatctatctagattgttgaaggctgatgaaatcaaagctgtattacgtgctcctcaaaagaaggttgtacgtcgtgtacgtcgtctcaatccattgaccaacgctaaggccatgcttaaattgaatccatatgctgctgtactcaaacgtgaagccattttgaagaatcaaaagagacagttaaacagggaagaacttttggccaagaaacgtggtattaccttgagtgccgacaacgtcgtgattagatccag

SEQ ID NO: 2212 - DNA, 746 bp, Diabrotica barberi
gaaggaaattcaagcgactgcggcgttttgaagatgaggaaagtgaaggagaagaagaacatgatcctgaacaagatagggaacaaattgctatggatatattttcagatgatgacgatgaaagacgatcagaacggagtcacagacctgccgtcgaacaagagacttatggtgtaggcgaggaagaagaggaaggggagtactcggatgccgatgattttatagttgacgatgacggtagaccgatagctgaaaagaagaagaagaaaaaaccaatatttactgatgccgctctccaagaggctcaagaaaccttcggtgtcgattttgattatgatgaatttagtaaatacgatgaagatgattacgaagatgaagaggaggaggatgacgaatacgaggaagatgatgtagagaaaaggaaacggcctaaaaagacttcaaagaaaaaaccgacgaagaaatccatttttgaagtgtatgaacctagtgaacttaaaagaggtttctttaccgatctcgataatgaaatccgtaacaccgatattcccgaaagaatgcaacttcgtgatgttccaatcaccgctgttccggatgactcaactgaacttgatgatgaagcagaatggatttacaggcaagcgttttgtaacagaactgtttccaatgtggattctcatttatcatcagaggcaagagagaaattgaagaagactcatcatgccatcggaaagatcagaaaagca

SEQ ID NO: 2213 - DNA, 759 bp, Diabrotica barberi
agtggcacatgaaattttggctttggagatacttacgttgttggtggagactcctacagacgattctgtggaagtggccatttcatttttgaaggaatgtggacaaaaactgacagaagtttcaagtagaggtattactgctatatttgagatgttaagaaacattttacatgaaggccagctagaaaaaagaattcagtacatgattgaagttatgttccaaataaggaaagacggatttaaggatcatgctgctgttgtagaagaattagatttagtagaagaagaagatcaattcactcatcttattatgttagatgatgttaaagaggctgatgcagaggatatattgaatgtgttcaaatttgatgagagttatgaagaaaatgaagataaatacaaaacccttagtaaagaaatcttaggcagtgatggtgagtctgaatcaggttctgaaggttcagaagaggaatctgatgatgaaaatgaggaggaagtcaaggaccagggaacaattattgacaatactgaaacgaatttaatttctcttagaagaaccatatatttgactattcagtctagtttagattttgaagaatgtgcacataagctactgaagatggagttgaaacctggacaagaaatagaattgtgtcacatgtttcttgactgctgcgcagaacaaagaacctacgaaaagttttatggtcttttggctcaaagattttgtcaaatcaacaaagtgtacatcgagccttt

SEQ ID NO: 2214 - DNA, 743 bp, Diabrotica barberi
tagcattcattccgactgagtcacaggtgttctcgttggattcaccagacacgttccaatgtagctacgatccctcattttccgctgctagaaacgccaacatggaaagaatggcagaacaaattgcgacactctgtgcgactctaggggaataccctcacgtcagatatagaactgattgggaaagaaatgttgagctggctcaactaattcagcagaaattggacgcctataaagccgacgaacctaccatgggagaggggccggaaaaggcgagatcacaattaattatcctcgaccgaggtttcgactgtgtatctccccttcttcacgaacttactttccaagcaatggcctatgacttactacccatagaaaatgatgtatataagtacgaagcatcggctggtgttatgaaggaagtccttctggacgaaaacgacgagctttgggtcgatctacgccaccaacacatcgcggtggtctctcagagcgtcaccaagaatctgaagaaattcaccgactccaaacgcatgacccagagcgacaaacagtcgatgaaggatctctccaccatgatcaaaaagatgccgcaatatcagaaggaattgtccaagtatgctacgcatcttcatctcgctgaagactgcatgaaggcctatcaggggtatatagacaagttgtgtaaagttgagcaggatttggcaatgggaactgatgccgaaggcgagaaaatcaaggat

SEQ ID NO: 2215 - DNA, 721 bp, Diabrotica barberi
agtcaaatgggatgtctgtcgagtaaggacgtatttgctaactttttaactctttgtaaatacaatcatgaaataattgtcaaggtttttaataatccggaacaagtgatggcaaaatttgtactgaacatatttcaactcaaactcgtcgaatacatcgatcagagattaaactctaagttaggaacctatggctatttacaagtattatatgaattatattacaagactaatcagttatctaatgatttgagcatatttaacatgggaaatgacaagaactttttatcgaagttaacgacaaatatttttaacaaatatattagtgactatatcacgatggaattaaaaggtctgaaagataggtgttctgcaaatttacaaaaatattatgaatccaaaggtcatcaaaagaagcagattcagtcaggaggtttccaagatcttcgaagagaccttcaagctgttataggaactcgagcaaatattaacattgcccagatcgaaaattatggtggagaaacttttttatctgaagaattagctattacgatattgcaagacacaaagcacgcttttcaaagatgccagttgttatccaaacccacagacagagcatcaaacgcaactcaaattttggatagactgataaacagcttattagtagaacatgtcgactatgcagtagaattgggcttgcaagctgttcctgttgtagaag

SEQ ID NO: 2216 - DNA, 707 bp, Diabrotica barberi
tcttggtcggaaactaacagggatcgtagagaaaggctccgacaactagctttagaaactatagatctacaaaaagatccctattttatgaaaaaccacttgggctcatacgagtgtaaactttgtttgacgttgcacaacaacgaaggaagttacttagcccatactcaaggtaaaaaacatcaggctaatttagctaggagagcagccaaagaggctaaggatgctcctacgcttttgcaaccagagaaacccagagtagaacctaagaagtttgtgaagattggtaggcctggttatagagtaacgaagcaaagagatgccgaaagtggacaacagagtcttctgttccagattgattatccagaaataagtgatatgattctgccccgtcaccgttttatgtcagcttatgaacaaaaaatcgaaccaccagatcgtaaatggcagtatcttctatttgcagcagaaccgtatgaaacaattgccttcaaagtaccaagccgagaagtagagaaaaccgacagcaaattttggactcattggaacaaggatactaagcaattcttcctacaatttgcatttaaaaatgacaataagagaactgttaacacagtggtccaaagacatacaattgttggtgcagcaccaccacccccaatgctacctgttccaccaccaccaagaccaccgatgttcaatcctat

SEQ ID NO: 2217 - DNA, 278 bp, Diabrotica barberi
aacaattaccggcgaagtatacagagggaaactgatagaagccgaagataatatgaattgccaaatgactcaaattactgtaacttacagagatggaagggtcgctcaattggaaaatgtttatattagaggatcgaaaattagatttctggtattgccagatatgttgaaaaatgctcctatgttcaaaaaacaaactaaagcgggaacggcaggccgaggaaaatctgctatactgcgagcccaagctcgggggagaggtagggggcaacaacaac

SEQ ID NO: 2218 - DNA, 746 bp, Diabrotica barberi
tcaacaagttggtgcaaatcttacagccacatctgatagagaaaccatttcctataccttagaaggaacgagaagtgctgttgaaaaggctctaccatatttagcagaagtagctacccaccaagaatttagaccttgggaagtgtcagaactatctaacagattaattttggatattttaaccagacctttacagttaagagccatcgatttgcttcacaatgctgcctaccgtagcaaaggtttaggtaactcactcttcattccaaaatcccaagtaggtaaagtttcatcagaaacgttacaacattacgtagccagcaactttgtagctggccgtgctgcagttgttggtacaggtgtaagcgagagtttgttgaatcaattcgctgctagtttgggaattggaaatggcgaaggcagcaccaatccatctccttacaagggtggtgaactcagatcaaacaaaggtggtccacttgcttttgttgcagtagggggagaaggagctccattgaagaacaccaaagaagctcttgcgtttgcagttctacagaaagctgtatgtgccggccctcagatcaaatatggcgtacttgatcatggagtctacagcaaagctcttggtggctcatcagatgtatctgcgtgcgctgttaatgtgagctattcagacagcggtttgtttggtattttgctcgctgcacctgctggatctgtaggcaaagcagttcaatcagctgtta

SEQ ID NO: 2219 - DNA, 194 bp, Diabrotica barberi
atctgcaagaaaagattggcgtcttaaaatcgttgactatagacattggaaacgaagttaaataccaggacagaatgctcagagatgtggacgacgatctagataagactggaggcttcttgggcaccaccatgtcaagagtactgagattatctaaaggatctcataattacctcatcctgtatttatttgtg

SEQ ID NO: 2220 - DNA, 704 bp, Diabrotica barberi
ggctctggaaaacctattgacaaaggtcccccaattctggctgaagactacctagatatccaaggacaacccatcaacccatggtcccgtatctaccccgaagaaatgatccaaactggtatcactgccatcgatgtgatgaactccattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgtttgctgctatgggtgttaacatggaaactgctagattcttcaaacaagatttcgaagaaaatggttctatggaaaacgtatgtctgttcttgaacttggctaacgatccaaccatcgaaagaatcattaccccacgtcttgctctaacagccgctgaattcttggcttaccagtgcgaaaaacatgtgttggtcattttaactgacatgtcttcatacgctgaagctttgcgtgaggtatctgctgccagagaagaagtacccggtcgtcgtggtttcccaggttacatgtacaccgatttggccaccatctacgagcgtgccggtcgtgtcgaaggccgtaacggttccatcacacaaatccccatcttgactatgcctaacgacgatattactcaccctattcccga

SEQ ID NO: 2221 - DNA, 204 bp, Diabrotica barberi
tttactggaacaacctggagatgttattagttacgccgccgaatattttacgcgcttgagggaaacccgggtgacatccagagtgtatgatgaagctgctgcctcgcaggaggaattggtatcacctgacgaatccgtaatgtccaaagatgaagaaccttcaatccggtttgctggtaggcgtaaatcagtgttcgcagaaac

SEQ ID NO: 2222 - DNA, 782 bp, Diabrotica barberi
ttatcacaccacagacaaggtttacttgctatttttaaaagcggaggtattccagcacttgtaaagttgctcagttctcctgtagaaagtgttcttgtctatgctataaccactcttcacaacctgttattacatcaagatggatctaagatggctgttagacttgcaggtggtttgcaaaagatggttgcactactccaaagaaatcatgtcaaatttttgtcaattgtaactgattgcttacaaattttggcttatggtaaccaggagagcaagttaataattttggcaagtcaaggacccattgaattggtccgaatcatgagatcttacgattatgagaagttgttgtggactacttctagagttctgaaagttctttcagtttgtgccagtaacaaacctgctatagttgaagcaggaggaatgcaagctttggcaatgcacttgggaaatccaagcacaagattggttcaaaattgtctttggacattgagaaatctttcagatgctgctacaaaagttgatggtctagaaagcttattgcaatctttggtacaagtattagcatcttctgatgtcaatgtagtgacatgtgctgctggtattctttccaatctgacttgtaacaatcagcgcaataaagtaactgtgtgccaagtgggaggggttgatgcacttgtgcgcactatagtcagtgcaggagatagagaagaaatcacggaaccagctgtttgtgcactgcgtcatttgacatccagacatgtggaatcagaaatggc

SEQ ID NO: 2223 - DNA, 655 bp, Diabrotica barberi
taagcacaaaaagcgaagaccttaccttgcatcagaatgtaaaaatttacatgcttgtgaaaaatggagaatgcagataataagagaaattgccaagaaagtagctcaaattcaaaatgctggacttggagaatttaggataagagacttaaatgatgaaataaataaactactgagggagaaacggcattgggaggatcaaataaaggaattaggtgggcctgactatcagagagttggtccacggatgttggatcatgaagggaaagaagtacctggaaatagggggtataaatactttggggcggctaaggaattaccaggtgttcgagaactttttgagcaggagccgcctcctcctccaaggaaaagtagagcagaactaatgaaagacattgatgcggactactatggatacatggacgacgatgacggaattttgattccattggaagttaaagctgaaaaaacagccgttcaaaatgcagtagctgagtgggttagtaaaaaagaacaaaatttggagaacgcagagaaccaaacagaagaagaaagtatatatgcagttcaggagtctgacgatgaagaaagtaaagaaactgtacaacagttagtggatggatcacagcaaagatttgttgcacatgtacctgta

SEQ ID NO: 2224 - DNA, 511 bp, Diabrotica barberi
acatgactggtgaattcgaaaagaaatatgtagccaccttaggagtagaagttcaccctttagttttccacacaaatagaggacaaattcgttttaatgtatgggacacagcaggccaagaaaagtttggtggtctgcgtgatggatactacatccaaggacaatgtgccataattatgttcgacgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccacaggaagaagaatttacaatactatgacatctctgcaaaatccaactacaacttcgaaaaacccttcttgtggttggctaggaaactcattggagatcccaacttagaattcgtagctgcacctgccttgcttcctccagaagtccagatggatccccaatggcagcaacaaatcgaaaagga

SEQ ID NO: 2225 - DNA, 795 bp, Diabrotica barberi
atctaccgagacctcaagaagtgaacatgaccgtccttcgaccatcccacgagagctattccttatccgatctgcagcgagccgaagagctcatcaaacgcgagatggtgactatgttacatttcgataaccttaagaatccggttccgacgcagagtaagaggtccaatatgtcgcaggctcatcaattggcctttttggagcagcatccgtatgagtcgttcaggaaagaagatttagaggcggccaaggggatattgaagagggaaatggaggtggttaggaatggtatgaatcacggggagttgcctatcgaagtctacactcaggtgtgggaagaatgcttaagccaagttctgttcctcccgaaccaaacgagatacactcgagccaacttagctagtaaaaaagacagactggaatcggcggaaaaaaggctcgaacagaacagatctcacatggcgaaagaagccaaacgagctgccaaaatggagaaaaaattgaagattttaacaggcgggtaccagtccagagcgcaggtgttgatcaaacaattacaagattgttatgagaacctagattcgactaatttagaattgaatacgttcaagtttctgcaagaacaagaaaaatctgctctaccaagaagaatacagtctctcactgaagacgtcagtcgacaaacagaacgagaacgaggcttgcaaaagaaatacggcgatcttcaagcagaaataaaatacttacaagaatcatacctgagtcagcttcaaaaagaacagagaaaggaagctg

SEQ ID NO: 2226 - DNA, 330 bp, Diabrotica barberi
aaatggtatgtggctcatccagacaaactcaagaaaaaaattacaagagaattaatcacaaccattttagctagaaaacctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatattttggaagtgtttgtgagttagatataatcttcaactttgagaaagcctactttatattggatgagctgatgctagggggtgaagttcaggagacaagt

SEQ ID NO: 2227 - DNA, 779 bp, Diabrotica barberi
ttcgagaggaagctcaaaaattagaacaaagtgatgcactaaaagcagctagacagaaatttgaaagtgtagaaaaagaagctagtaaaggtagcgaagtttttaaagaaagtttaggttctgttaaggaaaggcttaaaggagttatagatgaagctagtaagtcagatttagcaaagaaggctggcaaattcacagaagaagttggtaaaactacacataaaattagtgaaacagctcaagaaattagtaaaactggagcgtttcaaagtatatctcaagctactaaggctgttaaacaagaaatagacaatactagtatagaaggtagagtatatgttagtcctaaaatactacggaagagaacagaaacaagtgcagttgtccatcaaaaatattatgaaccaaacacagatgctacaggtgttgaactacacaaagattctaagttttatgaatcttggcaaaatttcaaagataacaatccatatgtacataaagttatggactggaaattaaaatacgatgaaagtgaaaatcctgtcatccgtgcttccagagctctaacagaaaaagttggtgatatcatgggtggtttatttcagaaaacggaactatctgaaacacttacagaaatctgtaagatagatcctgcgtttgataccaaaagatttctgaaacaatgtgagacagatattattcccaatattcttgaagccatgacgagaggagagttagaagttcttaaagattggtgtcatgaaggcccattcaatctt

SEQ ID NO: 2228 - DNA, 712 bp, Diabrotica barberi
acctggcttaaatactgtggaagaaggaccaaaacagttcacaaataatgtgagtggtttaaaacaaaaattagaagaaataaaactgaagttaccatggatagaacgactggactgtgtaaatgcacaagcccctttagcacctgaattagcagctcaaatgttgacccacgaggaaaaaagaagtaatgagcttaaaaataataaaaagctcacacagtttactccaagtgaagacccggttttaaacgactttaaaagagaaatgatgttccacagacaagcccaggctgccattctagattctataccaaagctaaaagatatgggaatactaactaaaaggcctgacgattactttgcagaaatggcgaaaacggatgcccatatgcagaagattagggaacatcttatgacgaaacaggagcaacagaagagaagtgaacgagtcaaacaacttagacagcaacgaaaagaaggtaaaatgttacaagttcagacaaaacttcaaagacaacaagaaaagaaagatatgcttgctcaggttaaaaaagtaagaaagggaatgtccaaagatcttgacttccttgacggaaaaaataaatctgctgccaaaaaaatggcagaaaaacggaaaatgaaagacaaaaagttcggtttcggtggcaagaaaaagggaatgaaaaggaacacaagagatagtgctgcagat

SEQ ID NO: 2229 - DNA, 658 bp, Diabrotica barberi
gctccagtaaaggatatgggtttgtacattttgaaactgaagaagctgcaaataaatctattgaaaaggtaaatggtatgttgttaaatggaaaaaaagtatatgttggccgctttattccacgcaaagaaagagaaaaggaactgggagaaaaggccaaacttttcacaaatgtatatgttaaaaattttggtgaagatttatctgaggaagagttgcggaatatgtttgaaaaatatggtaaaattaccagctacaagataatgagtaaagatgatggtaaatctaaaggctttggctttgttgcatttgaaaatccagaggcagctgaaacagcagtagaagcattgaatggaaaagagttgatggaaggaaaacctttgtatgtaggaagagcccaaaagaaagctgagcgccagcaagaactaaaacgtcgatttgaagcccttaaaatggaaagacttaatcgttatcagggtgtaaatctctatgttaaaaacttggatgatactatagacgacgaacgtctccgtaaagaattctctccgttcggaaccataacttctgccaaagtaatgatggaagaaggtagaagcaagggttttggtttcgtctgcttttcctccccggaagaagctacaaaagcagtaacggagat

SEQ ID NO: 2230 - DNA, 669 bp, Diabrotica barberi
ggatctgctgaagacactagtagcgctccagaaccaaccgttattcctaatcaagagagtcttatcggtgacttgctatcaatggatcttaatgctccagctcctgcggctgcacaagcagctgtaccagccagtaatgtagatctcttaggtggaggattggattctttgttggatattggtaccactcccgcacctcccacttctacgggacttcttggtgacatttttggaataccaactgctccaaccatgtatacaccacccaaaactatatggttaccggctgaaaaaggtaaaggattggaaatacatggagcgttttcaagaagagctgggcagatgtcaatggatttgacattcaccaataaagccatgcaggcgatgtctgccttcgctattcagttcaacaaaaacagcttcggtatagttcccggctcaccactcaccgtgcctgcgcttcagcccggacagagcttggaatacaatttagcgttggccactactggaccagtacaacgtatggatccactcactactctccaagtggcaatcaaaaacaacgtcgatatcttctattacgcctgccaaattcccattcagattctgttcaccgaagacggcactttggataagagggtgttccttactacttggagagacattccg

SEQ ID NO: 2231 - DNA, 354 bp, Diabrotica barberi
gaagttggagctacctcttctttggctcctaaaattggtcctctaggtttgtctcccaaaaaagttggtgacgatattgccaaaggtactgctgattggaaaggtcttaaaatcacagtacaattgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaataattgctattgccagacagatgaggcccaggtcgatggccaaacagttatccggaactgtaaaagaggttttaggaacagcccaatca

SEQ ID NO: 2232 - DNA, 692 bp, Diabrotica barberi
cacttgtagatgctggagttactgaagttatattagcagtatcatatcgtgctaagcaaatggaagaagagttgacagtggaagccaaaaaattgggaattaatataatattttcccatgaaacagaacctttaggtacagcgggaccaattgcattagccagggatcatctttctaaaagcactaaaccattctttgtgttaaattccgatattatttgcgacttcccatttaaagccttggccgaattccataaaaaccacggaaaggaaggtacaatagtggttactaaagtggaagaaccgtcaaaatatggtgtagtagtttatgataaagacaacagcatccaaagttttgtagaaaaacctcaagaattcatttctaataaaattaatgctggtttgtacattctaaatccaagtgtcattaacaggatagaattaaaaccaacttctattgagaaagaagtatttccttacatggctgctgataaacagttgtatgcatttgaattggaaggtttttggatggatgttggtcaaccaaaagattttctgacaggaatgtgtttatatctcaaacatttaaggcagacaaatgaagacaaactttataaaggaccaggtgtcgttggcaatgtattagtagatcctactgctaaaattggaaacaattgtcaaatcgggcctaat

SEQ ID NO: 2233 - DNA, 685 bp, Diabrotica barberi
acctcttaaaagaaggtgccagcggggcattcgcccagtataacaaagatcaactgacccccgttaaaatagaaaacgccgatcatttagtgcttattacggaatacaacgatttagggaataatagattcttcgaccccaggagtaagcagagttttacctacgatcacctgagaaaagaagccttagactaccaagtctatacccccgatagcgcttctgagccttggcgggcagccttagactcagagttcattcagtacactaggaaccattacaaagatggagtatgtagtgtggtaggccgcaaccagagcggggttgttaacttaacggcatgtatcgaagaccatcagttctctccgaagaactactggaatgggagagaagaccaccagttctctccgaagaactactggaatgggagatggagatcgcagtggtccattagtctaactgatgattccactgctgaggtgagaggtgtactcaaagtacaggtccattattatgaagagggtaatgtacaattagtaagtactaaagaaataaaagaaactgttcctgtttcatctgaggcacaaactgctaaagaaatcatccaagtaatagaagccgctgaggatctctatcagacggcaatttcagaaaactaccagaacatgtcagatacaaccttcaaggc

SEQ ID NO: 2234 - DNA, 699 bp, Diabrotica barberi
ggtatctggaattcagcgatccacctccaaattatgactatccattagtatttccaattaaagaatggcccaaaaagaatgatcctgcctttattggtattttcttcagcagatgcagaatcggtaatctgcgtgatggagacattgaccaaagaacacccggggtctattttagaatggaaagagatttaagaacgaggcaagacagaatgggtgtagaaattagagaaagacttaagtgggacatcagaacaggagtcattggatcagaaacattcgatcctaagcacgccgttattgtcacttggaaaaacgtttctttcactggaggattcgctaatgctaaatacaagacaaacaccttccaaatggttcttgcaactgacgaagtcttcacttacgcgatgttcaactacctcaacttggactggacctcccacactgaagcgggtggtgattcccaaaacggagaaggtggtgtcagtgcctatgttggttttaacgctggaaacggtaccagaagctacgaatacaatccttacagtcaagcttccgtcattcgagatctcactgcagttggatttggaaatggttttaagggaagacatattttccgtatagacgaagacattttgcttggatcatgcaacaaagatatagatggtgccaaccttcccctgaaattcgctcctgaaagtg

SEQ ID NO: 2235 - DNA, 338 bp, Diabrotica barberi
ataagtaagcagccacgtaacgcatttttaagtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggc

SEQ ID NO: 2236 - DNA, 688 bp, Diabrotica barberi
aagggaaaggatagttgcagagtgtaatgctgtaagacaagctttgcaagacttgttgactgaatatatgacaaatatgggcaataaagataaaagtgagagcctagtacgagcaatcgacaatatgggtagaaagactaaggatttaagaagacaactgaggaaagctgttgtagatcatgtatctgacagtttcttggaaaccaacgtacctcttctcgttttaataaaggcagctcaaaatggcaacgaaaaggaggtagaagaatatgcagttgtatttactgaacattccaataagttagtagaagttgctaaccttgtctgcagcatgtctaataatgaagatggtgtcaaaatggttagatatgctgctgctcaaatcgacaatctgtgtcctgaagtaataaatgcagctagaattttagccgctagacctcgcagtaaagttgctcaagaaaatatggacgcattcaagcaatcatgggagaatcaagtgagacttctgactgaagcagtcgatgacattactactatcgacgactttttggctgtttctgaaaaccatattctggaagatgttaataaatgtgtacttgccttgcaagaaggtgattctgacacattggatcgcactgccagtggtataagaggaagatctaatagggtgtgcaatgtagtaacagct

SEQ ID NO: 2237 - DNA, 726 bp, Diabrotica barberi
aactacaaaggccactacagccccaacaaccctctcctttggttttgctactcctacgactgtaccgtttggatcatcaactacaattacacctgcaacaactcctcaatttggattatcgcttccaaaggctagtgctccggccactactactttttcacttctaggatctgccccagccactactgcagcagcacctacaggtatatcatttggtactgccactactacagcaacaacttcagctacaggtttatcatttggaactccaattggaactgctacaactacagcaacaacttcagcttcaggtttatctttcggtcttacaacagcgtcttctacaagttctgctgcacctacacttttgtcatcaacaaccacttcgacaacgtcatcagtgtctgcatctggtgctttgagtagtacaacatcagcaccgacttttgccacctcatcgttgtcttcaacaggcgccttaacattctctcaactcgaagattcgatcaacaaatggaccatggatctagaagaacaaggaaaattcttcatcaaccaggctaagcaattaaatgcatgggatactttacttatatccaatggagagaaaattttaacccttaacagtagcatcgagaaagtcaagcaacaacagcaacagttagaccaagaattagacttcgtgctggcacagcaaaaggaattggaagagctgattgtaccgat

SEQ ID NO: 2238 - DNA, 436 bp, Diabrotica barberi
cttaggactggataacgcaggcaaaactacccttctacatatgctcaaggatgacagactggcccaacatcttcccacgttacatcccacatcagaggagctttccattggtaacatgaggtttacgacgttcgatttggggggccacgagcaggctaggagagtgtggagggactactttccagcagtggatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaacgatctacctggtaggcctctagaacta

SEQ ID NO: 2239 - DNA, 423 bp, Diabrotica barberi
aggtgtttccttcaggagatcccagtaccattgccgacaaaaatcaaacaataacaaatatccttacacaagttcagacattcgttaccacagctctcacttgtagagaaacaataacttccatgttgcagttttatggaactttaaacgactatctcgacccagctggtggagcagatgaactggaggttgaggcaaaaagacattatatattgcagttacaccctgagatcaaagacaccctacagacacatactcgaattttgcagactttacttcccttcgttgaatcggaaaacatttctaaagtggttgaaatgacagctcaattggaagaggcatctgttagtcatctcagtttgtatggagagtggagagatacaatgtacaaaatggtggtagctctacaagatttcactgata

SEQ ID NO: 2240 - DNA, 750 bp, Diabrotica barberi
agtggcaactttatatggcaaagttgtgttagtcaatctcattgaccaaaagggagctgaaggtaacatggagaaatcctttaagaacgccatgaattcattgtcgtatccttcagcacgatacgaacctttcgacttccattctgaatgtagcaaaatgaggtgggaccgtctgaaaatcctcatagaccgtctagctctggaccaagatgaaatgggcttctttctcttattgcgggatggttccttaagctcgttacaagatggcgtcttcaggacgaactgcatagattgtttggacagaaccaatgtggtccaaagtatgctagcgcacagaaatttagaaatagttttaagaaagttgaatattttacaccaaaaccagaacttggagttccagtattccttcgaggttttgtttaagaatgtttgggcagacaacgcggatattataagtacacaatactcgggaaccggggctttaaaaacggattttactagaacaggtaaaaggactaaggctggagtttttcgagacggagtcaattcgcttactagatactacaaaaataatttaactgacgggtatcgccaggatgccatagatttgttcttagggtatggtaaaccgatatctccactaagagtagacaaatcgtggcgatatattacttacccttcagtgcttttagtcgctgtatccatgtttgtagcttctgctgtatttccttcggaatactcaaccgaatc

SEQ ID NO: 2241 - DNA, 721 bp, Diabrotica barberi
agattccagcctcagactatggacaaagttgaagctaaggtcggttatagtattaagaaatctcttaacaatgaaacattgtacatggacagagattctcagattaaggctattgaaaagacctttgaagactccaagaatgtcatcgagaagcattacagcaaaccaaatgtcgtagctgtggatattttgcctgtgtatccagatttcagcctttggaagtacccttgtgcccaagttatttttgattccgatccagctcctgttggcaagcaagtaccagctcagattgaagagatgtcgcaggctatgatcagaggtgtgatggacgaaagtggagaacaatttgttgcctactttttgcccacagaagatactcttcagaaacgaagggatgattttgtcaaccagataccatatcaagatgatgaggaatatgagtataagatggcaagagagtacaactggaatgtaaagagcaaggcaagcaaagggtatgaagaaaactacttctttgtggcaagaccagatggaatttattacaatgaactggagaccagagtaaggctgagtaagagaagggtcaaagctggtgctccacctagtaacacaaggcttattgtcaaacacagacccatggatgctaatgagttcagaatgcagaggtaccgagagaaacagctggaaccaccaggtgaagatgatgaggaaatggaggttg

SEQ ID NO: 2242 - DNA, 707 bp, Diabrotica barberi
ctacagccgaattggtgataaagacaacgcagttagtactttcagacaaacatatgataaaactgtatcacttggtcatcgtttagatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattacgagataaagtggtaaaaggttccgaaatattggaagtactgcattcagaaccatttgtaaaagattacttgttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggggttactgttgaatacattgataaagaactgtccacatttatagcagcaggaagattgcattgta

SEQ ID NO: 2243 - DNA, 727 bp, Diabrotica barberi
cgcagcaacaacagaatattatacacgagcaacgtgttcaggccatcgcaagagtccaacgatcaatatcggtggatccagctcaacagtttctgtcggaccaacaaagtcccttgcaaccaagtacgcctcaggagcttagcccgtctgctacaccaacaccaagcccaagacagttcataggaatgaaatccccgaccttccctcttccttcaccagtgcctcagacagcaatcagacctcctacaccctcccattctccacatgatgtaagtcaggcaagcacctctgacggtaatgatcactttattcagtcaccttctactcctaaacctagttttcctaatagattacctacagatcaatttatccatcaacctgcaactcctaggccccagtttggaatacaacggccaactttacagaactttggtaatacgatgaggacagaccagcaagatattaatatcaaccgacagttgagagatcttctacagcgacaacaagtcaaaaagttggatgaaatgttaccaggtaaagttcaacaacaaagagtgtggcctccaattgaacaacaagaaaatgaggcctcagcaactactggtacttcggcagttgtggctacaacagcagataccactttcagacaaccgttaccgcccagtattgtacgacctagagtggctctctctttagctggtcgagcaggacctggtactattagggt

SEQ ID NO: 2244 - DNA, 220 bp, Diabrotica barberi
tgcatcaacaggaaaacttgtggccatgaaattgtgatggcgtcttgcttgacgcataaaaaatatgccgtagatatgcagcctccagatcccccgtttcagcaacatttctgtgtcattgcttctcccggtgaccagacgttgcccttcgacatccacgatgctctcagtaagtacaaagcaaccaaagtacaaaaaatggactcagaaaaaggattgc

SEQ ID NO: 2245 - DNA, 746 bp, Diabrotica barberi
ccatacttcagaaccaccaatgcctagggaaagtaaatcgaagaaaaatttgcaatgggtgccatctttgccaaattccagtcatttagatgcagttcctcaagccactcctattaataggaacagagtagcatcaaaaaaggtgaggacattcccattatgttttgatgacacagatccacaagtaaacattgaaaattcttgtcagcaagaaatacttgttcctattagacttgatatggaaattgaaggacaaaaactgagagatacttttacatggaataaaaatgagagtttgatttctccagaacaatttgcggaagtcctttgtgatgatctcgatttaaacccattgacgtttgtgcctgccatagctcaagcaatcagacagcagctggaagcttttccaaacgaaccgccaagtatactggaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaattcgtaacagccatagcatactctatccgtggtcaactctcgtggcatcagaggacttacgctttcagtgaagctccgcttccgacagttgaagttccgttcagaactcccagcgagtcagatcaatgggcgccgtttttggaaactttaacagatgccg

SEQ ID NO: 2246 - DNA, 666 bp, Diabrotica barberi
atcagttcccaaagtggatctacagctagtggttttgcagatcatgactatccaactatcagtggagtatcacaagttatcaacaatatgacacaagttaaatgtgttaatagcattcctttaccaacggaaattgttgaccacttttcacgggttcaatgccattgcatgatgggcctcttttgtgaaatcaatagagcttggcttactgtggatagtgatatttatgtatggacttacgaacaaaatactgatctggcatactttgatggaataagtgagaccattgtttgtgttggtcttgtaaagccaaagatgggagtcttccatgcttttataaagtatcttctgatcttggcaacttctgttgatattgtggttttgggtgtaacttttactgagaagccaggtgataccacagaggaaattcagttgataccagacccagtttttagtttaccaactgatggtgccactgttactatcatcagtagtactaatgacggaagaattttttatggcacaaaggagggaaagctctttgaaatatactaccaggctgaaagtggttggtttgggcaaagatgtaaaaaggtaaacttgtctacaagtaccctatcttttctagttccttcatttttaaatgctgctcttagcgaagaagat

SEQ ID NO: 2247 - DNA, 799 bp, Diabrotica barberi
aaggccaaagattccgttataagcattgcaaatactgctctgagcattgtagacccagaagatcctttagcggctactttatattccatcaagttcaaacaccacttggcattaaaacactacgaactcgccttcgattcattgaatgcgaatccagatgcggaacggaaaaaagacaatctgagagatttggttaaaacactgttggatgaaaagaaattggatactttattgaacttcacgtacggtagcatggatgagttctttacaaatatactgttgagcagagctagagcaaacgatgcagttaacaacattttctacgacttcttgtattcttatcaaattaaaagaggacctctgtcacacagactagctgcatcagtaatgtacgagcaggctttcagattaaatcatattaacagcgttgaagcactggaaaaacaagtaaaatgttacttggcagccaaaaacgttctacatctgtgtcaaccagaacacgcttgggtagtgagaccagctgatccagatgaagaagatgacgtaataactattcagcctttggcaggatcaaacgaagaaatgaaagtatttagattgagaaaacaacttgaagtggtaaatattgaaactgttgagaaagaacttattttcgcaagtgcaaagttaaaattggcaagatttagctcgagcctatcaccggttaatataacaactcctgtggaattagtaacattattaaatactgctggtttattcaaaactgccttagacatttgcacgacgtttgaattgtcat

SEQ ID NO: 2248 - DNA, 711 bp, Diabrotica barberi
ggctaccataaatttggcacaaacccatagcaacgacgtgaatgcattaaaagttatatacagttcattggtgttaatttgtaaagtattttattccttaaattttcaagatcttccagaattttttgaagataacattcagatttggatgtcaaatttccatacgttattaacggcagatgtcaaatgtcttcaaaatactgatagcgaagaggctggtattatggaacaattgagatcccaagtatgcgacaatatagctctgtatgcacaaaaatatgatgaggaatttcagcagttcttgccacaatttgttactgacgtttggagtcttttagtatcaactggtcttgaacctaaatatgatctgttagtttcaaatgctctccagttcctgtcatcggttgcagaaagagttcagtatagacatttatttgaagataacaatgttttgagcagcatctgcgaaaaagtcattatacccaatatggaatttagagtttcagatgaggagttatttgaagataatcctgaagaatatacacgtagagacattgaaggttctgatattgatactaggcgaagagctgcttgtgatctcgtaaatactctcagccagaactttgaacaaagaattatagacatatttggtcaatatttacaagtgatgcttggaaaatatgtggaaaataccaagcagtattggagaag

SEQ ID NO: 2249 - DNA, 505 bp, Diabrotica barberi
cttgaacccatttcagttcgaaataacttttgagtgtatagaagaacttagagaagatttggaatggaaaatgatatatgtaggctcagctgaaagtgaagactatgatcaaactttagactcagtttttgtaggacctatacctgaaggcaaacacatgttcgtctttcaagcggatcctccaaatgtctcacgtattccagaaaatgatgctctcggtgttacagttgtactattaacgtgttcttatagaagtcaggagttcattcgtgtaggatattttattaataatgaatatactgatccggaacttaaagaaaatctacctagtcctccacaatttgataaggtaacccgaaatattctagcatccgaaccaagagttacccgcttcaaaatcaactgggaagaaaccaaccccacagaaaatatcacaaattcagaccaaagtggagcatcagcacccacgacatcagaagctggaccctctgctcctgtcgaagta

SEQ ID NO: 2250 - DNA, 681 bp, Diabrotica barberi
tgtctgtaccacaaaccaaatatgtaactggtttcgcattgcccatgagttctatgaatgcacaaactccccaacacacaatgagccctatggtgaacttagggggttcaataactacaggagctggagtgactccaacgatggcaccttcaactccttcacctatgacgccaatgactcctcattctgctgatcctggcatcattccacagttacaaaatatagtgtccacagtaaatctaagttgcagattagacttaaagaaaatcgctctccacgccagaaacgccgagtacaacccaaaacgtttcgcagccgtcatcatgaggatacgtgaaccacgtactacagccctaatcttctcttcgggaaaaatggtgtgcacgggagccaaaagtgaagaagactcgaggttagcagcccgaaagtacgccaggataatccaaaaactcggattcccagcgaagttcctggatttcaaaattcagaatatggtcggaagttgtgacgtcaaattccctattagactcgaagggcttgtgctaacccatagctctttcagcagttacgaaccagagttgttccctggactcatttaccgtatggtaaaacctagaatcgtacttttgatcttcgtgtctggcaaagtggtgttgacgggtgcgaaagtaagacaggaaa

SEQ ID NO: 2251 - DNA, 251 bp, Diabrotica barberi
tatgccgaccaaatgaacttcacatttgcagctggaaatcaggtttactatactgcaacctcagttaaacaggtagatgtaccatctttctctggtagctttggtatccttcccgcccatgtacccacactggctgtgctaaaacctggagtagtcactgtttacgaagatagtggtaatgttaagaaaatctttgtttccagtggtactgtcaccattaacgatgattcatcagttcagattcttgctga

SEQ ID NO: 2252 - DNA, 693 bp, Diabrotica barberi
caaggaaggagaatgggaaaagttagtgatggacacattcagaaaatatgaaaagtcgagcagggcaaaacacgaggaggaacttaaagaaaagcgagaacaagaagctcgaaaaaaagcagctgctgccaaaaaggcagaagcagaaactgtcaaacctgctcaaatcaccgaattgactgatgaagaagctgaaaggcttcaggctgagattaatgctaagaaaaacacttctgataaggctgaaagttcttcaaatggttcagaagctgcaactacagctaaaaaagtaggagaagacgaggatgaatctgaaaaaggcaagatactgcccaactcgggaaatggatgtgatctagagaagtacaagtggacgcaaaccttaggagatattgagttaaaaattcccctcaaagtaaacttcagggtaaaacagaaagatctcgtagtaaatatgacgaagaaacatttgacgtgtggtatcaaaggtcaaccacctatcatagacgacgattttccacacgaaatcaaattagaagagtcttcttgggtgatcgaagatggaaaggacctattatttacttttgaaaagataaataaaatgaattggtggagccaaatagtcaaatccgatccagaaatcagcacaaagaagatcaatcctgaaccatccaaacttagtgatctcgacgg

SEQ ID NO: 2253 - DNA, 332 bp, Diabrotica barberi
cgcgaaaggtggatatgtatttaccccgcttacatcaacaacaaaaaaacattggcacagggcagaaaaatagccaaagaaagatgcgttgaaaatcccactcaccaggaaattcgtgatgttttggtcgcggctggcttgaaagtgggtgtcgaaaacaaattgtacagcagagagagaagtaaggaaatgttatatcgtggtagaataaggatacagttaaagaatgacgatggtagtttgtgtaatgacagtttccctaccagagacagcattatgtaccatttaggagacatgattcccaaactgaaaagcaggcaaaataaaagctc

SEQ ID NO: 2254 - DNA, 650 bp, Diabrotica barberi
gatatgggagagagcacttgatgttgaccataggaatattaccatttggttgaaatataccgaaatggaaatgagaagtagacaggttaaccatgctaggaatctatgggacagagccacagttagaagtagacaggttaatcatgctagaaatctatgggacagagccacagttcttttgccacgagttaatcagttttggtacaaatatacttatatggaagaaatgttagaaaatgtaccaggtgccagagcagtttttgaacgatggatggactggcaacctgacgaacaagcctggcaaacctatattaactttgaactccgctataaagagattgatagagccagacaaatatatgaaagatttgtcataacacatcccgaagttaaacactggataaaatacgcccgttttgaggaaaaccatggtttcatacactcatctagacagatatacgagagagcagtacaattctatggtgacgatcatttagatgagaaatctaggcagatatacgagagagcagtacaattctatggtgacgatcatttagacgagaaactctacattgcgtttgccaagtttgaagaaaaccaaaaggagcatgatagggcgagagttatatacaagtatgctctcgatcaca

SEQ ID NO: 2255 - DNA, 721 bp, Diabrotica barberi
atcgtgtacgtaatgacaggcatgtatggtgatcccgctgaaattggagctggagtgtgccttctcatcatcatccaactgttcgtcgccggtctcatcgtattgcttctcgatgaacttctccagaaaggatatggtttaggttctggtatttccctcttcattgcaacaaacatttgtgaaactattatttggaaagccttctcaccagcaacagtaaacactggaagaggaacagaatttgaaggagctgtcattgccttattccacttattgaccaccagacaagacaaaatcagaggattacgtgaagctttctacaggcaaaatcttcccaatttgatgaacctcttggccacagtactcgtttttgctatagtaatatacttccaaggattcagagtagatctacccatcaagagtgcaagataccgtggacaatattccagctatccaatcaaattgttctacacttcgaacatccctattattctacaatctgctcttgtatctaacttgtacgtcatctcacagatgttggctgttaaattccaagggaacttcttaattaatctattgggagtttgggctgacgttggaggcggtggcccagcgaggtcttaccccattggtggattatgttactacttatctccacctgaaagtgtaagtcacattctagaagatccaatccacgcaatgctctacatcgtcttcatgt

SEQ ID NO: 2256 - DNA, 335 bp, Diabrotica barberi; identical to SEQ ID NO: 2033

SEQ ID NO: 2257 - DNA, 665 bp, Diabrotica barberi
cgtggaagaaaagcacttttgggaagcttagggcttattgctggtggtactggtgccttgctgtttgctttggatcaatcagttaaagcatctgatcttgaattgcatcctccaaagaatgtttggagtcattctggaactttcaattccttggatcatgctagtgtaagaagaggttatgaagtatacaaacaagtatgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactatttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataacgaaaccatagaatacagtgacggaacaccagcaactgccagtcaactcgccaaagacgtcgctgtgttcctaaaatg

SEQ ID NO: 2258 - DNA, 779 bp, Diabrotica barberi
agagaaacatactctcgggacatattgaaacggctcatgtaagtgattttcaatttgaaaaccagagaagaacttttacaagctatggttatgcgttagacccatcgataagtaatgatggagatggacatctaaaagttgttggttcaactgaagaaggtaaagacgtagaaagtgttaagactgtatttgaaacttcaaagataagacccttggataagaggaaaaggaagagaaatgataatccgggtgatatagaaggatttttgggaccatggggtggttttgttgatgaacaaaaagtatctagaccaacggaggaagaacaggctgagttagatgaaataacttctaaaaagaataagaaaggtaaaccaacagaggacaaaccaattgaggaaaagtctgtattgcatatcaaagatccagtggactatcaaggaaggtcttttttgcatgctccacaagatgttggggttaatctcaaatctgatacacctccagagaaatgttttttacccaagtcccatattcatacatggactggtcactccaaaggtgttgcagccatcaggtggtttcccagaacggcacatttgttcctgtctgctagtatggattgtaggattaagatttgggaagtttataatgagagaagatgcattagaacttactatgggcatagacaagctgtgagagacattaactttaacaattctggaaagctttttctctcagctggatatgacaggtatattaaactttgggacacagaaact

SEQ ID NO: 2259 - DNA, 664 bp, Diabrotica barberi
ccactttttgaaaagaggcctagaaattttggaattggccaggatattcagcctccccgtgatttatctcgatttgtaaaatggccaaaatacatccgtattcaaagacaaaaggctgtacttcaaaagagattgaaggttccaccaccaattaatcaattctctcaaaccattgacaaacaaacagccacccaattatttaaagtcttggaaaaatacaggcctgagacagctcttcagaagaaaaataggttaaaggctaaggctgaagctaaggttgccaagaaagaggaggcgcctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatccgtagctcttacacaagttgactctggagacaggtccaacttcaacaaacttttggaagtaatcaaaactaacttcaacgaccgtgttgatgaaatcaggaggcactggggtggtggtttgcttggatccaaatctgctgctcgtattg

SEQ ID NO: 2260 - DNA, 680 bp, Diabrotica barberi
atccagaaagtggtggaatcagtgcctgcctataccacgatccccatattttacatacacttagtgctgttcaaattctctgcatctacaataaattagaggcaataaacgtagagggtgttgttaaatatatcgcaagccttcagttacctgatggtagctttacaggagataaatggggtgaagttgatactaggttctcattttgtgcagttatgacattatcgttgcttaataaaatggatgcaattgatgtaaataaagccgtggactttgttttacaatgtaaaaactttgatgggggtttcggatctaggccactttctgaaagtcatgcggggttaatgtattgctgtgttggctttttatctatcacaaataggttagatgccattgatagagacacccttgcttggtggttgtgtgaaagacaactaccatctggaggtttaaatggtagaccagaaaaattacctgatgtatgttactcatggtgggtgttatcatcattaaccatgttgggcaggcttcattggattgatgcgaatgctttgaaaaactttattttggcttgtcaagacacagagactggaggatttgcagataggcccggtgatatcgcagatccttttcatactatatttgggttagcagccttgtcccttttgggacatgattct

SEQ ID NO: 2261 - DNA, 693 bp, Diabrotica barberi
gaaaccggtactccagatacttacgtcttgtcacaatacttcgagttcataatacaaagactgcttgaaacaacggatcgacccgatggcgcccaacacaatttacgacctgcagcctacgaagccctcatggaaatggtgaaaaactcacccaaagattgctatgtcaccgtgcaaaagactacaatggtcattttggacagattacatcaggtcttacagatggaaactcacataagcagccacaacgatagatcgcagttcaacgatctccagagtcttttgtgcgccactcttcagtccgtactcagaaaagttaccccagaagacgcgccaagatcgcagttcaacgatctccagagtcttttgtgtgccactcttcagtccgtactcagaaaagttaccccagaagacgcgccacacatctcagacgccataatgaccgccatgttgaccatgttcaattcgaattcatgtaagagtggaggcgttcaagaagatgctattatggctgtctcgacgctggtcgaagttttgggagaaaacttcataaaatacatggacgccttcaaaccgttcctctacctcggattgaagaaccatcaagaataccaagtgtgcgttacagcagtgggcttgaccggcgacatcttcagagctctcaaactgaaagcgctaccatactgtgatgaa

SEQ ID NO: 2262 - DNA, 784 bp, Diabrotica barberi
tagaaggcatccaaacgaaatcagtgttcccatgtcagtggaatttgatgagtttgccaaagccagggaaaatcctaacgaggatatggctaactttgtagaatttacagatgaggagggctacgggaagtatttggatttacatgaatgttatgaaaagtatataaacttaaaaggcatagaaaaggttgattacattacctatttgggtatgtttgaccaactgtacgatattccgaaggagagaaaaagcggtgaatataaaaaatatttgttatgcctaattgaatatttgacttggtttgtgcagcgtataaagcctctaaaggacttagacattgatctacaagaacaagttgagcaggttctgataaactgggataatggaagtgtaccgggatggccaaaagaaacagggtctgcactaacaaatgttggagcccacttggacctctctgcattttcaagttgggaagaattggcatcgttaggtttagacagactgaaatctgccttaatggcgttaggattgaaatgtgggggtactttagaagaaagagctcaaagattattctcaacaaaaggaaaaggttccttggatccttcacttatgacgaaaaataacaaaggcaaagccaacaaagaaaaggagttattgagacaaagagaacttgcaactttagaagcccaagtgtacagactagcagagtgggtctcaccgcagagagctgcaacaaaagaaaatgtgcaaaggaaacaagctcgtactgacggagaaagagac

SEQ ID NO: 2263 - DNA, 504 bp, Diabrotica barberi
ttggaactttcaaagcgttcgacaagcacatgaatatgatattaggcgactgtgaagagtttcggaaaattaaatcaaaattgtccaaagttgaacgtgaggaaaaacgagtattaggatttgttttactgagaggagaaagcatagtttctttaacaatagaaggccctcccccaccagaagaaggtttacccagagtaccaatccctggagcagccccaggaccaggaattggtagagctggaggtagaggaatgccacccggcatggcaggtgtacctgtaggtcttcaaggacctgtaagaggagtgggaggaccatcccaacaggtcatgacaccaggaggtagaggccaagtatctgcacctccacagatgaatcaaggaccaccaaggatgggaggaccaccaccaggtatgatgggacctccacccggtatgatgggcatggctccccaaatgggaatgggacgtggaggaccaccgccaatgggaatgagaggac

SEQ ID NO: 2264 - DNA, 760 bp, Diabrotica barberi
acagctttcggttaggattttcaaccgttgcaactatcgtggatgaaacatctgaagctatatggaaccggttacaaccgatttatatgccagagccaacagaagaaatatgggaaaaatcaatcctaggcttcaaaaatgtatggcagttccccaattgtttaggaagcatagatggcaaacacgtgaccatcagatgtccccagaagagtggatcaaattacttttcctatttaaaaaaattttccatagttcttatggcaattgttgacccagaatataaatttatttgtatagatgtaggtggttatggtaaaaatagtgacggtggtatttttgagacatcggctatgggcagaaaatttgcaaatgaaactatgaatataccacccaacagaccattagctaatgaaaatgaagagattccatgtgtattaattggcgatgaagcttttacactaagcccttacttaatgaggccgtttccttatagacaggcacgaaatgacaacagaaaagagagatttaattatcatctatgcagagcccgacgcgtagtggaaaatgcctttggaatattggcacataaatggcgtctattttttagaccactagaagttaaagttcaaacagctacaaaacttgtgaaggcagcatgcgtattgcacaatttgctgcgcacaaaaaacactgacgagcaatctttgcatttacaagaaaactgcaatattcctttaccagtagttgataatctggcggt

SEQ ID NO: 2265 - DNA, 792 bp, Diabrotica barberi
ctccaactaaaccggaagaaaaaatggcaaaccaagacagtatgatgttacaaaagatgaaaaaggagcctcacttaagcaaagtttctatccttaaaagaaaagttggagctggaagtggcaaaatcggctctcttgttagtacagattacaatgatatggacgatagctcatccacgcctcctataactcctccattagctactacaagtcgaggaggcataccaaaaacattgcccaaaaagattttggagaatcaaagcagcaaggattccgttattgtcatgcacagcccagaggacaaacaacttgatatgatggattttgacgatgacaccaatactgttttatcagcggaagtctctctaagttctgcagctcaaaatgacgaagatatgttggaaatggagacactatcacaacaagatttagctgaaggattatctagtcccttggaacccgatcaaatagcagatgaatatttactatttcctgggaatatggtagttgacatgtctgcaggggaacatttttccgaaaaagaggaggaagaagaaaccgtagatgaagaatttaacgatgaaaacatgcatatcatgattcgtagtcctacaaccagtgactatgaatacattatgcaaagtaagggtaagaaatataacgtaggtgtccacgatgaaaacgatgaaatgccagaatctccagatcaggaagacttggctgtaccgtcacctgaagtttcagacttgttgacaaattacgatgaaaatgatgtcttaatgggcgatcaaa

SEQ ID NO: 2266 - DNA, 680 bp, Phyllotreta armoraciae
agctgaacagaagaagaaggaaaaggagcttctcaaagctacggaaacagccgaggagaagagattgagaagattgatgaagaaagaggcgaaggaaagaaggcgaaaagaaaaaatgggctgggacaacgaatacttacattacacgaacagcgacaatccattcggagacggaaatttactgaccacattcgtttggaacaaaaaactgtccaaagaaggcatcaaagacgtcggccatgaagaaattgaagcgataaacagattaaaacaagaagagaataaaagggaactggaaaaagtcaagaagcgaagattagagagagaattagagaggcaaagaagagaggaagaaacgcaaatgatgcaaagaactaaagaagcagcccaattcgaggaatgggaaaggcaagaagataaattccacctggaacaagctcgattgagatctcacataagaatacaagacggacgagctaagccgattgatctactagcaaagtacataagcgctgaagaagaagtcgatgctgttgaaatgcacgaaccgtatacttacctcaatggtttgcaaatcaaagacctagaagacttagtcgaagacatcaaagtctacaaagaactagaaagggggaaaaacctagattactggaacgatataacagtcatagtcgaagacg

SEQ ID NO: 2267 - DNA, 668 bp, Phyllotreta armoraciae
aatcaagtacctgcgactttgctgccgggcgataaaaatgtggccgtgcaagtaccgattagcaatcagtatcgggaacctccggttccagtgcaagcccctcgacaggagtaccagccggtaccggcgcctgcagtacatcccaatcatgtgcaacagcccgtttttacaggtcaagatgttgatttgcgatcgatgggtaacgtgactgatccgagaatcaggccgatgatcgtcgatcaggatatgagacaaatgccaaatgtcatccagaatcctctaccgcctactataagcgaaagtctcgccaaagcgggagattcgaaacttgataatttttcgagggatcctcgaagtgtcaccggtggtttcccatcagatccaaggcaagctaggatggacccgcgacaaaaaaatataataccgccgacgagccagcaagtaccttcatcggtgaatcccaaaataatggcgaatcaagccggccctgccgccatcagaccggcccaaaacgtcaccgtgcaagctcaatctgcgggtgttgtgcccgctgcatcggctgcagctgcaccggccaatgtgatgagtccaggaataggaggagctggggctacagatcaagaaaaagccgccctgattatgcaagtcctccaattatccgatgagca

SEQ ID NO: 2268 - DNA, 652 bp, Phyllotreta armoraciae
tgtcacttattccgccataggtgggctttccgagcagataagggagttacgagaagtcattgaattgcctcttatgaatcccgaattgttcatgcgagtgggaattacaccaccaaaaggttgtctgttgtatgggcctcctggaactggtaaaaccctgttagctagagccgtagcttctcaactggacgcaaactttttaaaagtcgtatcgagtgctatcgtagacaaatacatcggtgaatctgctaggcttattagggaaatgtttaactatgccaaagaccatcagccgtgcatcatcttcatggatgaaatcgacgctatcggtggtcgtaggttttcagaaggtacatcggcagatagagaaatccaaaggactcttatggagttgctgaatcaaatggacggattcgattcgttaggacaagtaaaaatgattatggcgacaaataggcctgatactttggatcctgctctgctccgtcctggtcgtttggacaggaaaatcgagattcctctgccgaacgaacaagctcgtcttgaaattttgaagattcacgcacttcctattgctaaacacggggaaattgattatgaagctattgttaaattgtcagacaccttcaatggggccgatttaagaaatgtg

SEQ ID NO: 2269 - DNA, 675 bp, Phyllotreta armoraciae
atcaagtggagtatgccatggaggccatatcccatgctggaacatgtctaggcatcctggcaaacgacggaatccttcttgccgcagaaagacgtaacaccaacaagctgctggacgaagtttttatttctgagaaaatatacaaacttaacgatgatatggtttgcagtgtggcaggaattacctcggatgctaatgttctaactaatgaattgcgtttgattgggcaacggtacttgtatcagtatggtgaatcaattccctgcgaacaattagtttcgtggttgtgcgatgttaaacaagcttatactcaatacggaggaaaaaggccttttggtgtatcgatcttgtacatgggctgggataagcattatggttatcaattgtaccagtccgatccgagtggaaattattccggttggaaagcaacttgcataggaaataacagttctgctgccatttcgagtttgaaacaggaatacaaagaaggcaatatgactttgaaagatgcaaaaagtttggctgtaaaagttctggcaaaaacgttagatatggctaaattgacgtcggaaaaagtggaaatggctacgctgacacgaagaaatgataaaaccatcataaatatattaaataacaaagaagtggaagaacttatttccgagtacgaaaaatccg

SEQ ID NO: 2270 - DNA, 664 bp, Phyllotreta armoraciae
actaccacgattatgcagacgttaatggaaaaatcagaaactgaactgaaagatacatacgctagatttttgcccttaggtcttggcttgtgtatgttgggcaaacaggagggtgtcgattccataattgccgcgctggaagttataccggagccttttaaatcaatggcaactacgatggtcgacatttgcgcttacgctggcaccggcaacgtacttaaagttcaacatttacttcacatttgctctgagcattacgatggtgacagctcagacaagagttctaaagataaggacaaaaaagatgcttcagagaaggagaaagatctttcatcgagacaagcagtggccgtactcggcatagctttgatcagtatgggtgaagacatcggtagtgaaatggccttccgaacctttgggcatttgttgcgctactgcgagccagtaatcagaagagcagtaccattagctctaggactcatttcagtatcaaatcctaaattgagcatactcgatactttgagtaaattctcgcacgacagtgatgctgaagtagcccataatgccatatttgctatgggcttagttggagcgggtacgaataatgcaagattggccgcgatgctcaggcaattggcgcagtatcacgctaaagatccaaaca

SEQ ID NO: 2271 - DNA, 748 bp, Phyllotreta armoraciae
gcgtgatccgaagaaattttatcactccggccggcacaatagttgaaaccaacgaagagcaaccgccggaaccaacgatagaagaagtcgtcaaaacgacatcgtcgaatccaagtcccgccgaacagaaaacggaacccgcagaaatagtcacctacgctgcggaggtcctgccgcaggagcagagagagcaattcgctgacgccaaatcttacgccgtggaaatgcctgccgaaaattttcaaaatcagagctatacgcaggacattagttacgtgaatatagaaggaactgttgtgccagttacaatatcggaaatagaacatcctggggactacgccaatctacaaaccgctcaatacaataacggctatacggacggtacacaatatttaaccaatcatcaataccaaaatttgtatatagatagaagtacagttgataattctccttctgctacagttttataccgtggcgatgatccaaatttgggagcttccagattccaaggaaactacgacatatccagttctcaatcgcaagtgaaccttcttcccgcttccggagaagcctactatccatcaacgtctaactggacgccaaccagcagcgggtcttaccaacaacaatacccgtcgggaaacgtccttcaagctgattcgactcaagctttcgcaggtccttacataaacgctacctggtcgtcgaattcgatggaggacggacggcaatctagtcaagagaccgg

SEQ ID NO: 2272 - DNA, 720 bp, Phyllotreta armoraciae
ccttggataatttgctgcagttgtggagggtgcccgggttccacgccgagctctatgtaaactatgattgcgacatgtactgtgctaatttgtacgaggagctcaccgagctgctggccgaacggtccatttctaccgttgtgggagtttatcatgcgcatttgctgtcgctcgacgggcttttgattataatcgatgggatagggaagagattcgatgaagcgaaagatcgatcagataccgatgagattagcagttatacaggagagaatacgaggattaaaggttgtgttaaagttcccgataagaaggttttggctgcgaagaaggcgatcaaaaaatggttgccgcaaggtacggagtatttcaatcagaagccgaagaaaggtatacagttcctgcaagagcacggcgttttaaagcaggaactcgacgtggaggagattgctagattcttgcgggagaatcctgcgttgaacaaagctatgatcggagagtatattagcaatcgggggaatttgaagatactagaggctttcgtgagcacattcgatttcaccggaatacgaatcgacgaagcgcttagagcgtttctggagacatttcgattaccaggtgaagctcccacaatttcgctgatcctggaacatttcgccgagcactggcacaaaagcaacggagaacccttcgctgacgtagattctgcttttaccttagcgt

SEQ ID NO: 2273 - DNA, 470 bp, Phyllotreta armoraciae
caaacagtagccacgaatttcgagaaagtcttcgaaatgggcccgcacctgttcgtaggcctccccggcctcgccaccgacacgcaaacggtcatggagaagctcaggttccgcaagaacctgtacgaattgaaagagaaccggcggatctcgcccaaggtgttcgcagccatgatatcgaacatgctgtacgagaagaggttcgggccgtttttcgttgaaccggtcgtggccggtctagcgcccgatacctttgagccttacatatgcaatatggatttgatcggttgccttaacgagcccagcgatttcgtcgtgggcggtacggcctctgcgcaattgtacggaatgtgcgagtccttgtgggagcccaatctcgcgcccgatgatctattcgaaactatatcgcaggctttgataaacgctttcgatagggacgccatatccggttggggagctaccgtttatat

SEQ ID NO: 2274 - DNA, 740 bp, Phyllotreta armoraciae
tgcaaaccggtaataatggagatatggccgatattatctcgcgcattcgacacataccacagcgacgtccggataatggaaaggtgttgtcgctcggtgcgtttcatgttgcgttgcgtagctcgacaactccaagatttgctgccttctttggtcggccaaatcgtgcacatttaccgtctctacggacattcttgttgtttgtacgtcggcagcattttagtggacgaatacgccggagatgcgacttgcgttcaaggtcttctcgacatgttaaatgcctttttggaaccgacgtttcgtttgttgcaagaagaaaatggcttgaagaaccatccggatactgtggatgacttctttaggttgtgcgcccggttcgtccagagggcgccgaaggcgtttctaagcggaggggcccatctggcgcccattatgcaatgctcccttctcgctgccaccttagatcacaaggaggctaacgtgtctgtcatgaaatttttctacgatttaataaatcagggactgagcggcagaggggaacccgacttcgacgagagaaaagccttggttaggagcctgctaaacgaatacggccaacaactcgtgtctaatttaattcactcttgcgtattttacctgcattcatacatgttaagcgaagtgggtgacgtttttgtgcaattgttagatttcgatagacagataacgagtgaatggttagcgaacggtttggaattatt

SEQ ID NO: 2275 - DNA, 747 bp, Phyllotreta armoraciae
agattccacgattatgcgaaagagattggatattcaagaagctttaaagcgtccgatgaaacagaaacgaaaattaagaatcttcatttcaaacactttctatccggcgaaggagccccaacccgaaggccccgatggcccttgccaagaaggcacggtagcctcttgggaacttagagtggaaggaaggctcttggaagactcgaagaacgatccgaacaaagtaaaacgcaaattctcctcgtttttcaagtcgctggtcatcgagctcgacaaagaactctacggccccgacaaccacttagtcgaatggcacagaaccttgaccacccaagaaaccgacggtttccaagtgaaaagacccggcgacaagaacgtgaggtgtacaattctactgctcctcgactaccaaccgctgcagttcaagctcgatccgagactagcccggttactcggggtacacacgcaaaccagaccggtgattatatcagccttgtggcagtacattaaaacgcaccggctgcaagacggtcacgagcgcgagtacatcatttgcgacaagtatctagagcagattttcaactgtactcgtatgaagtttgcagaaattccccaacgattgaaccccctgctgcatccgcccgatccgatcgtaataaatcacgttatatcagtcgaaggcggtgctgaaagcaaacagacagcttgctatgatatagatgtggaagtggacgatacccttaagac

SEQ ID NO: 2276 - DNA, 663 bp, Phyllotreta armoraciae
cgtttgggctcacaatttagaagacgaatttcgaactataaggcaaatagtgcagaaataccaatatgtcgcaatggacaccgaatttcccggggttgtggctagacccataggagaatttcgaagttcagccgattaccaataccaaatgttaaggtgcaacgtagacttactgaggattattcaactaggtttaacgttcttagacgataatggcaaaacgccgggaggagtttatactacctggcaattcaattttaaatttaaccttcaagaagacatgtacgcacaagatagcatcgatttactgcaaaactcagggatccaatttaagaagcacgaagatgaaggtatcgagccattagaatttgccgaactactaatgtcctctggaatcgtgctcatggaaaatattaaatggttatcgtttcattccggctacgattttggctatttaataaagttactaaccgacaacaatctcccacaagacgaaaccgaatttttcgatctattaaaattgtattttcctacgatatacgacgttaagtatttaatgaaatcgtgtaaaaatttaaaaggtggtcttcaagaagttgcagaacaactagaattggaaaggattgggcctcaacatcaagccggatctgactcacttctgac

SEQ ID NO: 2277 - DNA, 731 bp, Phyllotreta armoraciae
tgacaatgagagaaacccaggtgttgtgtttatccccgactagagaattggctgtacaaattcaaaaagttatactagctctaggcgatttcatgaatgtacaatgtcacgcttgtatcgggggtacgaatcttggagaagacatcaggaagttagattacggacagcatgttgttagcggtacacccggaagagtttatgatatgattcgtagaagagctttgaggactagatcggtgaaaatgctggtcctagatgaagccgacgaaatgttgaacaaaggcttcaaagaacaaatctatgatgtgtacagatttcttcctccgtccactcaagtcgttttaatttctgctacgttaccccacgaaatccttgaaataacatccaaattcatgaccgatcccatcaggattctagtaaaacgtgatgaactgacgctggagggaatcaaacagtttttcgtcgccgtggagagggaagaatggaaattcgacactctatgcgatctgtacgacaccctaaccatcacgcaagccgtaattttctgcaacaccaaaagaaaggtcgattggttgactgaaaagatgcgagaaaacaacttcaccgtgagctccatgcacggagacatgccccagaaggagcgcgacaacattatgaaagaattcagatcgggccaaagcagagttttgatcactactgacgtatgggccagaggtatcgacgtacaacaa

SEQ ID NO: 2278 - DNA, 655 bp, Phyllotreta armoraciae
tactgtggaagataccgagttgatcgagggtatcgttttctcgcagaaatctgccaacgtatctggcccgaagaaaatcgaaaaagccaagattggtttcatccaattctgcatttcccctcctaaaaccgatatggaccacaacgtgatcgtatctgattacgctgcgatggatcgagttttgaaggaagaacgagcttatatcttgaatattgttaaacagattaagaaagccggttgtaacgtacttctggttcagaaatcgattctccgagatgctgtatccgatctggcccttcactttttggataaaataaagtgcatggtcatcaaggatgtcgaacgagaagacgttgaatttgtgtgcaaatcgttgggttgtagaccgatcgcatctctcgatcatttcaccgcagagaatttagtaacagccgatttggtcgaagaagttggactaggcggtaaccgaatggtgaaaatcacgggtattcaaaatgcggggcgtactgtcaccctgctcgtaagaggctcgaataaactagtattagaagaggccgaaaggtctctgcatgacgctctttgtgtcattcggtgtcttgttcgcaagaaggcgttgatcgcaggtggcggagcacccgaaattgaagttgctctc

SEQ ID NO: 2279 - DNA, 692 bp, Phyllotreta armoraciae
gaaattacagcagacgttggagtttttggaagttcaggaagaatacatcaaagacgagcagaggaatttgaaaaaggagtacttgcacgcccaagaagaagtcaaacgtattcagtcagtacccttggttatcgggcaattcttagaagcagttgatcagaataccggcattgttggatcaactacaggttctaattattacgttcgcattctctctacaatcgatagggaattattgaagccctcagctagtgtagccctacacaagcacagcaatgctctggtggatgtgttaccccccgaagcagattcctcgattagcatgcttcaggccgatgagaaaccagatgtacaatacagcgatatcggaggtatggatatgcaaaagcaggagatacgagaggctgtagaacttccgttgacccacttcgagctgtacaaacaaatcggtatagaccctccgagaggtgtgttgatgtacggtccgcccggttgcggcaagaccatgttagccaaagctgtagctcatcacaccacagccgcttttattcgagtggtcggttcggaattcgtgcagaagtacctgggcgaagggcccaggatggtgagagacgtgttccgtttggccaaggagaattcccctgccatcatattcatcgacgaaatcgatgctatagccactaaacggttcg

SEQ ID NO: 2280 - DNA, 340 bp, Phyllotreta armoraciae
cggtgaccataaaaaccatgttggaggacctcggcatggacgaggaagaggaagaggtagtaccgttgcccaacgtaaactcagcaattctacggaaggtcatccaatgggccacctaccacaaggacgacccgccgccgcctgaagacgacgacaacaaggagaagagaacggacgacatatcctcgtgggacgcggatttcctgaaagtcgaccaagggaccctgtttgagctgatcctggccgcaaactatctcgatatcaaagggctgctcgatgtaacttgcaagactgtagccaacatgataaaaggcaaagcaccggaggagatacggaaaac

SEQ ID NO: 2281 - DNA, 687 bp, Phyllotreta armoraciae
tgtgtgataaggcgaaagaaatactgtccaaagaatcaaatgtgcaggaggtaaaatgccctgtcaccgtttgcggagatgtacatggacaatttcacgatctgatggaattatttaggataggcggccgaagtccagatacgaattacctttttatgggtgactatgtcgatcgtggatattattccgtcgagactgttactcttttggtggctttgaaagtcaggtataaagaaagaattacaattctgagaggaaaccacgaatcgagacaaatcactcaagtatatggattctacgacgagtgcctacggaaatacggaaacgcgaacgtttggaaattcttcaccgatttgttcgattatctgccgcttacagcgctcgtcgatagtcaaatattctgtttgcacggaggtctcagtcccagcatcgacaccttggaccatattagagcgctagatcgtttacaagaggtacctcatgaaggtccgatgtgcgatcttctctggtcggatcccgacgatcgcggaggttggggcatttctcctcgcggtgccggttatactttcggacaggatatatcggaaacgttcaaccacagcaacggtttgacattggtctctcgagcccatcagctcgtcatggaggggtacaattggtgccacgacagaaacgtcgtgactatct

SEQ ID NO: 2282 - DNA, 740 bp, Phyllotreta armoraciae
gtaagcaattggaagatggccgtactctttccgactacaacatccagaaggaatctactcttcacttggttttgagacttcgtggtggtatgcagatcttcgtaaaaactcttaccggcaagaccattactcttgaagtcgaaccatcagacaccattgagaacgtcaaagccaagattcaggacaaggaaggtatcccaccagaccagcagagattgatcttcgctggaaaacaacttgaggatggccgtactctttctgactacaacattcagaaagaatctactcttcacttggttttgagacttcgtggtggaatgcagatcttcgtgaaaactctcaccggtaagaccatcactcttgaagtcgagccatcagacacaattgagaatgttaaggctaaaattcaggacaaagaaggtatcccaccagaccagcagagattgatcttcgctggaaaacaactagaagatggccgtactctttctgactataacatccaaaaggaatctactcttcacttggttttgagacttcgtggtggaatgcaaatcttcgtaaaaactcttaccggcaagaccattactcttgaagtcgaaccatcagacaccattgagaatgtcaaagctaaaattcaggacaaggaaggtatcccaccagaccagcagagattgatcttcgccggaaaacaactagaagatggccgtactctttctgattacaacatccagaaggaatcc

SEQ ID NO: 2283 - DNA, 718 bp, Phyllotreta armoraciae
gaagcaactgaagtcctacatcgaagaaggcgtgcacccgaggatcatcatcaaagccgtacgaaaggcaacgcagatttgcttggagaaaatcaactccctggccgttaaaatcgacaaaacgaacgccgatgactacagatcgctgttggagaagtgcgccgcgacggcgatgagctcgaaattgatcaacaaacagaaatcgttcttctccaaaatggtggtcgatgctgtcttactgctcgatgaacttctaccgttgaacatgatcggcatcaagaaggtgcaaggcggtggtttggaggagtccatgttagtcgccggagtggcctttaagaaaaccttctcgtatgccgggttcgaaatgcagcccaagatttacaaagactgcaagatcgctctgttgaatatagaattagagctgaaagctgagagagacaacgccgagatccgtctgagcagcgtcaaggagtaccagaaagttgtcgatgccgagtggaacattttgtacaacaaactccagaaaatttacgaatccggagccaacgttgttctgtcgaaattacctatcggcgacgttgctacgcaatacttcgccgacagagacatgttctgcgctggaagggtccaagaagaagatatgaagaggaccttgaaagcatgcggtggctccgtaatgaccacagtcaacgatttaaaagacgatgtgctaggtaac

SEQ ID NO: 2284 - DNA, 752 bp, Phyllotreta armoraciae
aaagatgatgacaacgtccagcctcccgaaggggaagaagaaaaagaacccgttacatactatattagcaatgaagtgcactattcaaattcaaaaatgtccagtttggtgtgcatcaagagaggtccggtgatagaagcagataaaagtattcgagctcaggttcgtttgatgaacttcagcgaggggtcgccatatgaaattctgcatgattatgtcagcagaacggttgccccttacttcaaatcttacgtaaaagagtctggtagagctgatcgtgatggtgataaaatggcgcctgcagttgaaaaaacaatcgctgaattggaaatgggactgctgcatttacaacaaaatatagatattccggaaattacgcttcaagtgcacccgtacgttgccagtcttataaagcaatgcgccgatgaaggaaggaagccgaaagtcgccgattttagtgacaaagtggacgactcgaactttcttaaccaacttcaacatggagttaatcgttggatcaaagaaattcaaaaagtaacaaaattagacagagacccctcttctggcacagctcttcaagaaattagcttttggctcaatctggaaagggcccttcaccgcatccaagaaaaacgcgaaagcatggaagtcgctctaacattagacattctgaagcacggtaaacgttttcacgccacagtgtctttcgataccgatacaggcttaaaacaagccatagctacagttaacga

SEQ ID NO: 2285 - DNA, 698 bp, Phyllotreta armoraciae
gacgatgagtacttgttcgaggaggaaatattaacggagagggaaaagaaggaacgccagcataaaaaggaattattgcaactagcccaggaacatgaaaaggcacgggaactcgaacgaatacaacgctatcacatgccgagggacttgggtaaggactcgacggcagattacatcgaagtggacgagctcgagaaagtaccgcaatccgaacagaagaaatgggaaaaagaccaaatggcctcagctgtcttcaaatttggtgctaaagatgtcaagaaaaccgacgattacgaactgttactggaagatcaaatcgatttcatacaagctctgcaaatgccgggatccaccgagaagaaagtctcgcaactatccgatgtacaaaagaagaaactaaccatcgaggaaacaaagaaaagcctgccgatttatccattcaaagatgatttaatacaagccgttaaagagtaccaagtgttgattataaaaggtgaaaccggttcgggaaaaaccacgcaaataccccagtatctccacgaagctggtttcacagctgacggtaagaaaatcggttgtacacagcctcggagagtcgctgccatgtcggtagcagccagagtagcccaagaaatggacgtaaagctaggcaacgaagtcggttacgctatcagattcgaagattgcacttccgaaag

SEQ ID NO: 2286 - DNA, 731 bp, Phyllotreta armoraciae
ggaagtgggagatgtcatttacatcgaagccaccagtggggctgttaaaagacaaggaagatctgatgcttacgctacagaattcgatttggaagccgaagaatatgtgccgcttcctaagggagatgtgcacaagaagaaggaagttgtacaggatgttactttacacgatttggacgctgctaatgcaaaaccacagggtggtcaagacgtgttgtccatgatggggcaactgttaaaaccaaagaaaactgaaattacagacaaactcagaaaagaaataaacaaaatcgttgacaaatacattgatcaaggcattgcggaattggtaccaggagtattattcattgacgaagttcatatgttggatatagaaacgttcacttatctccatagagctttggaaagcgctatagcccctattgttatttttgctactaatagaggtcgttgtctcattagaggaaccgatgatgtattttctccacatggaattccattagatcttctagatagactgctgattatacgcaaaattccttacaacaaatccgaaatggagcaaattattaaattgcgagctgttacagaaggtttggaaattgagcaggaagcaatctcgagtttgggagaagtcgggacaaaagccaccctgagatatgcagttcagcttttaacgccgtcgtttttaactgctaaaattaacggaaggggtaacattctcaaaagcg

SEQ ID NO: 2287 - DNA, 775 bp, Phyllotreta armoraciae
cgaaggagcaagaaacaatcccttccagttcaaatatttgcagctatgccacagtttaggggagttgagcaaagtgcccagtccgaaggtggtactggctagttcgcctgatttggagagcggattttccagggaactgtttttacagtggtgttctaatccaaataacagtattatattaactacaaggacctcgcctgggactttagccagggatttaattgacaacggaggaggaagaaacatagacttgatagtagagcgaagggttaaattagaaggacaagagcttgatgattatgaaagtcgtcaacggtctaaatatgacaaattagaagatgaggaagccgattccgattcagattccgatattgaaatgttagtcacaactaaaggcaaacatgacattgttatcaaacaagaaggcaaaatatccacaggattttttaaagtgacaaaaaaaatgtacccgatgtatcctttcaaggaagataaaataaaatccgatgaatatggcgaaataataaaagcagaagattacaaactagctgaaatttcagccgaagccgaagataataaagaaaacatagtgattaaaaaagaggaagaggaaataagtaaatattattcatttataaacgatctaatagttacgcatgaatcatttttagctgaaattaccgagcaaccgaccaaatgtataattcttcaaagaaccgttcaagtgagttgtcaagttcagtacatcgatttcgaaggtagatcagacggagaa

SEQ ID NO: 2288 - DNA, 743 bp, Phyllotreta armoraciae
tggtaaaacttcgagttcgtcttcgctcattcaaccgcctttgccgcccatacccgataaagtgctcgttaaaaaatacgatcctaaacaagctgtcaaagtgtccagaccgacagtaggcgacgattatctagtatcaccaatcacaggcgagaagataccggccagcaaagtacaagagcacatgcgcataggcctcttggacccaagatgggtcgaacaacgtgacaaacaaatgtccgataagatgaatcaagacacggtatatgctgcaggaagcgccatcgacgcttcgttgaaattactagccgaaagacgtacggacatttttggtgtgggagacgaagaaacggcaattggtaagaaaataggcgaagaggacgtgagaaaagacgaaaaagtgacgtgggacggtcacaccagcagcgtggaggcggcgacgagggcggctcgcgccaatatcaccttagaagagcaaatacatcagatacataaggtaaaaggtcttctacctgacgaggagaaggagaagatcggtccgaagaatattggttcgaagaaaattaacatacaaagtgttattactaccaaaccgcctaatccgtcttcacagcaacccaaacaacaggtttctatgattcaaacgggcgcacagccaatcatgccggttccaacgcaacctacgatgctcgcgccccaaccgtctattatgatgatgcccgcccctcctatgcctaacattc

SEQ ID NO: 2289 - DNA, 672 bp, Phyllotreta armoraciae
agtggaccatttcaatcgaatggggaaaatcggcaatcaaaagcgcgttgtcggtgttctactcggttgctggagggctaaaggagtcttagatgtgtccaacagttttgcagtccctttcgatgaggacgacaaagataaatctgtatggtttttggaccacgactacttggaaaacatgtacggcatgtttaagaaagtcaatgctagagaacgcgtcgttggttggtaccacacgggccctaaattacaccagaatgatatcgctattaacgaattaattcgaagatactgtcccaattccgtgctggtgattatagatgcgaaacctaaagatttggggcttcctaccgaagcttaccaagcggtagaagaagtccacgatgatggctctcccacgtcaaaaacatttgaacatgtcccgagcgaaataggcgcagaagaagctgaagaagtcggagtggaacatttactgagagatatcaaagacactacagtgggaactttgtctcagaggatcactaatcagttattaggccttaaagggttgcatttgcaattgagagatattagagactatttgatgcaagtgtgcgataacaaactgcccatcaatcatcagatcatctatcaattgcaagatattttcaatttgttgcccgatataaacca

SEQ ID NO: 2290 - DNA, 742 bp, Phyllotreta armoraciae
agatcgaaacgacaaaaacgccgtagccgaagtggttaaaggttgcataggaacgaaattcttgagcaaatggtcggatttggccgtaaatatcgctttagatgcggtgaataccgtcctattagaagagaatggtcgaacggaggtggatatcaagagatatgccaaagtcgaaaagattcctggtggttctgtggaggaatccaaaattttgagaggcgtaatgttgaacaaagacgttacccatcctaaaatgaagcgacacattaagaatccgagaatcatccttttggattgcgctttggaatacaagaaaggagaatctcaaaccaacgttgaaattagtaccgaaactgattttaccaaacttcttgaattggaagaagatcatgtgaaacgccaatgcgacgagattatcgccctcaagccggacgtagtgttcacagaaaagggagtatccgatatagcccagcatttcctgctcaaggccggcatcactgccatcaggcgtgtcagaaagtctgacaacaaccgaatcgctagagcttgtggagccgtcattgtaaacagaaccgaggaactccaggagtccgacgtgggcaccggagctggtgtatttgaaatcaaaaaaatcggcgacgagtacttctgttttgtcgacgaatgcaaagatccaaaggcctgtacaatcctcctccgaggagccagcaaggatattctgaacgaaatcgagaggaatctg

SEQ ID NO: 2291 - DNA, 558 bp, Phyllotreta armoraciae
cgttgaacgccagattaatccgtacgctgacaatggaggaagtgtcgtagcaattgcaggaaaagatttcgtggttattggtgcagatactcgtcttagttccggcttttccatttacactagaaaccaaaacaagctgtttcctctttccgaaacgactgttttaggatgttcaggttgttggtgcgatactttaacgttgactcgtattttaaagtctcgtatgcaaatgtaccatcaagagcataacaagaacatgtctacaacagcggctgctcaaatgttgtcgaccatgttgtactacaagcgatttttcccttattacatatcgaacattctcgttggattagataatgagggaaaaggttgcgtctacagctacgatcccgttgggcattgtgaaaaagccacatacagagcaggtggttctgcgggggctttgcttcagcctttgttggacaatcaaattgggcaaaaaaatctgcagaagccttcgcaagaagatcttactcaggaaaaggccatttctacactgaaagatgttttcatatccgctgc

SEQ ID NO: 2292 - DNA, 681 bp, Phyllotreta armoraciae
tcgaacgtggaggaaaaataatcatgccaccttcagcactggaacagctcactcgattaaacatcaactaccccatgttatttaaactagttaataagaagacgagccgcacgactcattgcggcgtgttggagttcgtagcggacgaaggaaaagtctaccttccattatggatgatgcacaatttagtactatccgaaggcgatttggttcaaatggaaagcgtctcgctgccggtgggcactttctcgaaattccaaccgttgaatccggatttcctcgacataaccaatccgaaagccgtgctggagaattgcctgcggtctttcgcttgtctgaccaccggcgatgtcatagcggtgaggtataatcaaaaggcgtacgaattgtgcgtgttggaaaccaaaccgggaaacgccatcagcataatcgaatgcgacatgaacgttgaattcgccgctccggttggctacaaggagcccgaacatgcgaaaaaagaagaagaaatgtcggtggatcccgctgatttgatgcccgaaccgtcgggattcgtcgcatttcggggggccggtaaccgattggacgggaaaaaacgcaaggattcttcctccagcgatgctccttcgtccaaaccggcctacgtccggggaattcccgattacgattatcaaataggcacgc

SEQ ID NO: 2293 - DNA, 727 bp, Phyllotreta armoraciae
gaaataggggacggaactaccggtgtagtagtattagcaggggctcttctggaacaagctggcgctcttctggaccgcggaatccatccgataagaatagccgatggtttcgaattggcatgccaaacagctgtggatcatctagagaaaatcgccgaactgtttccagtgtccgctgaaaacaccgagccccttattaaagtcgcgatgactacattaggttcgaagataattaacaaatgtcacaggcaaatggccgaaatcgccgtaaatggcgtgttagcagtagctgatctcgaacaaaaggatgtcaactttgaactcattaaagtagaaggaaaggttggagggaaattggaagacaccacattagtgaaaggtgtcgttatagataaaacaatgtctcatcctcaaatgccgaaggagctaaagaatgttaaattggccatcctcacctgcccgtttgaaccccccaaacccaagaccaagcataagttggatgtcaccagcgtagaagactacaaagaactaagattgtacgagcaagagaaattcaaggaaattgttggcttggtaaaaaaagcaggagctaccttggctatttgccaatggggattcgacgatgaagccaaccatttgctgttgcagcaggagttacctgctattagatgggttggaggtcctgagatagagctaatagccattgcgaccggaggaagaatagttc

SEQ ID NO: 2294 - DNA, 208 bp, Phyllotreta armoraciae
gtgaaaaagtggaatgctgtagcactttgggcttgggatattgttgttgataactgtgctatatgccgaaaccacataatggacttgtgcatcgagtgccaggcaaatcaggcctctgcaactagtgaagaatgcactgtagcttggggagtatgcaaccacgcttttcactttcactgtatttcaagatggttaaaaactaggcagg

SEQ ID NO: 2295 - DNA, 800 bp, Phyllotreta armoraciae
accttgagctcgaaaattctatcgcaacacaaagagcatttcgcgaagctcgccgtcgacgcggtgctgagattaaaggggtccggcgacttacaagccatccaattgatcaaaaaaaccggcgggaccctgcaggaatccttcctcgacgaaggttttctgctcgacaagagacccggcgtgcaccagcccaagcgagtcgagaacgccaaaatcctgatcgccaacactccgatggacaccgataaaatcaaagtgtttggctcgcacatcaaagtcgattcgatggccaaaatcgccgagctggaatcggccgaaaaggataaaatgaaagacaaggtcaacaaaatcctcaagcacaacgccaacgtcttcatcaaccggcaactcatttacaactatcccgaacagttgttcgccgacgccggagtgatggccattgagcacgccgatttcgatggtatcgaaagactggcgctggtcaccggaggagaaatagtctcaactttcgatcaccccgagctggtgaaacttggtacttgcgacctcatcgagcaagtgatgataggagaagacactctcctgcgtttcagcggtgtggccttaggagaagcttgcacgatagtcatccgaggagccacccagcagatcatagatgaagctgatcgatccctgcacgatgccctttgcgtgttagccgcaactgtaaaagagagcaggatcgtgttcggaggcggttgcagcgagactttaatggctactgctgtggctagagcgtctgttaacacagctggtaagga

SEQ ID NO: 2296 - DNA, 671 bp, Phyllotreta armoraciae
aaggacgtcttcatcaagtcgaatatgcaatggaagcggttaatcttggttcggcaacagtaggactaaaaagcaacagtcatgctgttagaatagcattgaaaagagcttcatctgaattatctgcttaccaaaagaagataattcaaatcgatgatcacattggcattactatatctggtcttacagctgatgcaagaattttaagcagatatatgagaaacgaatgtttgaattacaagtactccttagacgcttacatgcctttgaatagattaattaatattttaggtatcaaaatgcagcattgtacgcaaagatacgatcgtagaccgtttggtgtaggtctcttgctagccggttacgatgacaacggcgcccatatttaccaaacatgtacgtctgctaatttctacaattgcaaggccatgtcgatcggagctcgatctcaaagcgctagaacttatttggaaaagaaactcgacgagttaccttcgagttctttagaagatttgatcaaacacggtttgagagctctcagagatactcttccaccggaagtcgatttgaatacgaagaacgtctccataggatacgtcggtaaagggattacctttaaaattttggaagaagaagaaactgctccttatcttgctttaatcgagggtgaa

SEQ ID NO: 2297 - DNA, 728 bp, Phyllotreta armoraciae
gttacggtggcagtaaattggaacgagcgcgtgatctattcgagcagtgcttggacggttgtccctcgcaattcgccaaacatctctatttattatacgctaagttggaagaggagcacggaatggccaggcatgcaatggccgtgtacgaaagggccactaaagccgtaccggaaaacgagatgttcgacatttttaacatatacataaaaagagccgctgaaatatatggcataccgaaaacgaggcaaatctacgagaaggccattgaagtccttccggaggataaaaccagggaaatgtgcttgagattcgccgacatggaaacgaaattaggtgaaatcgatcgagccagggccatttacgcgcattgcagccaaatctgcgatccccgagtcacggccgagttctggcaaatttggaaggagttcgaagttcgacacggtaacgaggacacgatgagggaaatgttgaggattaaacgcagcgttcaggcggtgtacaacactcaggtgaatatgatgtcagctcagatgttgagctcggcgggcagctcgagcggcaccatagcagacttagcgcctggggttaaagacggaatgaggcttttggaggcaaaagcggccgagatggcgggctcggcggcggcgcagaaatccaacataatgttcgttagaggggaaactcaaggggacaataaagacaaagtggtcaatcccgatgaaatt

SEQ ID NO: 2298 - DNA, 705 bp, Phyllotreta armoraciae
atgtacacatgcccaaagatcgcgtcaccatgatgcaccagggctacggttttgtcgaattcatgggcgaagaggacgccgattacgctataaagataatgaatatgataaaattgtatgggaaacctataagagtcaacaaagcttctgctcatcaaaagaatttggacgtaggagcgaacattttcatagggaacttggacccggaggtcgacgagaaactcttgtacgataccttttcggccttcggtgtaatattacaaacgcccaagataatgagagatcctgagactggaaattccaaaggctttgcgtttataaactttgccagcttcgaagcttccgacgcttccatcgaggccatgaacggccagtatctttgcaatcgaccgatatctgtgtcctatgcattcaaaaaggattccaagggcgagagacacggttcggcggccgagcgattgttagccgcccagaatccgctatcgcaggccgacaggcctcatcagttgttcgcagatgctccaccaataggaatgatgccgatgagtatggcgccgccccctccgcctctaatcaccggcatgatgccccctccaccaccaacgccgggcggcatgccacctccccctccgccagtccctccaccgagctccttccccgcgggtataccgccgccgcccttaccgccttctcagccacctttac

SEQ ID NO: 2299 - DNA, 658 bp, Phyllotreta armoraciae
taaaaggaggaaaggagcacccaagctccgttatttagatttctccgaaaggcatggctacatcaagggtgtagtgaaagacatcatccacgaccccggtcgcggcgcccccttggctttagttcacttcagggacccttacaagttccaaactaggaaggaaatattcattgctcccgagggaatgtacacaggacaatttttgtactgtggaaagaaagctaacctccaaattggaaatgtgttgcctgtaggaactatgcccgagggtacaattgtctgtaatttggaagaaaaaactggtgaccgtggccgattggctcgagcatctggtaactacgcaaccgtgattgcccacaatcacgatacaaagaaaactagagttaaattgccatcgggagctaaaaaagttatcccaagcaacaacagagctatggttggtattgttgccggaggtggtcgtatcgacaagcccatcctgaaagccggtcgtgcctaccacaagtacaaggtgaagcgtaactgctggccgaaggtgcgtggtgttgccatgaaccccgtcgagcatcctcacggaggtggtaaccaccagcacattggtaaagcttccaccgtcaagaggggaacttccgctggtcgcaaggtcggtcttattgct

SEQ ID NO: 2300 - DNA, 264 bp, Phyllotreta armoraciae
gaaaacagttagctgccaaagccgctcgaaagtctgcaccttcaactggtggtgttaagaagcctcaccgataccgccctggtactgttgcccttagagaaatcagacggtatcagaaatctaccgaactacttatccgaaaacttccatttcaacgattggttcgagagatcgcccaagactttaagactgatctaagatttcaatcatcagctgttatggcactccaggaatctgctgaagcttacctagtcgggttgtttg

SEQ ID NO: 2301 - DNA, 795 bp, Phyllotreta armoraciae
atggttgagctcatggaaatgcagcacaaaacggagaccgacacccaactggtcaaaggtttagtgcttgatcacggcggtcgtcaccccgatatgccgaagagcttgaagaattgttacatcctcacctgtaacgtcagcatggagtacgaaaagagtgaagtcaattcaggtttcttctacaaaaccgctgaagagagggagaaattggtgttggccgaaagagattttatcgaacagcgagttaagaaagtggtcgagttgaagaaggctctttgcaaagacacaaacaagacgtttgttgtcataaaccaaaaaggtattgaccccatgagcttggacatgctcgccaaagaggggatcattgctctccgaagggctaagaggcgtaacatggaacgtttggcgttagcttgtggtggaacggctgtgaacagtttcgacgatttacaagaatctcaccttggttatgccgggcatgtttacgaacacgtcctgggcgaaaacaaatatacctttgtagaagaatgcaaagtgcctcaatctgtaacgattttaatgaaaggacccaacaagcacactttgttacagatcaaagacgctgttagagatggcttgagagctattaataacgccatcgaagacaaagcccttattccgggtggtggtgctttggaagtggcagtaaacaaggaattactggcgtacaaggacgaaataaagggaaaagctcgcttgggcgtagccgcttacgctgaagctctgttggttattccgaaaactctggctgtaaac

SEQ ID NO: 2302 - DNA, 692 bp, Phyllotreta armoraciae
aggattacgacgattgtctggcctgggcgcgtctacattgggaggaccaatacgccaatcagataaagcaactgttgtttaatttcccgccggatcaactcaccagcaccggccagctgttctggtctggaccgaagaggtgtcccgaaccgctcgtattcgatatcaatgaagatttgcacgtggattacgtaatagctgcggctaatttgaaagctcaagtttacggcatccctacgaatagaaacagatgttatgccaaacaagtagtcaccagcattgaggtacctccgtttgtgcccaaatcgggcgtgaaaatcgccgtgacggattcccaaatggccatgaacggtaacaacgtcgacttggatcgtatcaatcaaatcaaacaggagctaccctcgatggaagagctcaacggcctgacgctcacaccactggaattcgaaaaggatgacgacagtaatttccatatggacttcatcgtcgcggcctcgaacttgagagccgccaactacaagattccactggccgatcgacacaaatctaaactcatagctggtaaaattataccggctatagcgactactacgtcagtggtagctggtctggtttgtttggaattgtacaaactggccaggagtatcaagagtttaacgccgtttaaaaacggtttcgtaaatctggccttg

SEQ ID NO: 2303 - DNA, 786 bp, Phyllotreta armoraciae
atgggtaaaacagcggtatttgtactagccaccctacaacagctagaacccaccgaaaatgtcgtttacgtactcgtaatgtgccatacgcgcgaattggccttccaaatcagcaaggaatacgaacgtttcagcaagtacatgtccaacatcaaagtcggcgtgttcttcggaggcttgcccatccaaaaagacgaagaagtattaaaaaacagctgtccgcacatcgtcgtcggaacgcccggtcgaatcttggctctcgtcagatcgaagaaactcaatctcaagcacataaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaagcgaaattgacgttacacggtctacaacaacattatgttaagcttaaagagaacgaaaagaataaaaaattatttgagttacttgatgtattggagtttaatcaggtggtgatatttgtaaaatcggtgcaaagatgcgtagcattagcacaacttttgacggaacaaaattttcccgcgattggaatacaccgaggaatggagcaaaaggaacgattatccagatacgaacaattcaaagatttccaaaagagaatattagtggccactaatctctttggtcgtggtatggatatcgag

SEQ ID NO: 2304 - DNA, 700 bp, Phyllotreta armoraciae
gcttgacactacccaaactaaagctagaccggccaccaagtcgcccgtagcagaaatcgatacctacatcaacttgctctgcttagtgcatttaatcgacaccaacaaattagtagaagccgaacgctgttcgcaaatcctcatgaacaagatcaccagtcaaaacagacgaacattggacctaatcgcagcgaaatgttacttttattactccagagtagcagagctcaccgacaagctggactcgatcaggagattcctgcactcccgtcttcgcacggccacgctcaggaacgatttcgaaggacaagccgtactaatcaactgtttattaaggaactacttacactattccctgtatgatcaagcagataagttggttaataaatgcgtgtttcctgagactgccagcaacaacgaatgggcgagatttttgtactacttggggaggatcaaagcggctcggttggagtacagcgtggcgcataagcatctaatacaagcgatgcgtaaagcgcctcagaatactgcgatcggttttcggcaaactgttcagaagctgacggtcgtagtcgaattgctgttgggggatataccggagagacaaatattccggcaggcgagcatgcggcattctcttgcgccctatttccagctcacgcaggccgtgagaatgggaaacttgcataggtttggagag

SEQ ID NO: 2305 - DNA, 729 bp, Phyllotreta armoraciae
cggcaattaaaatccgacaaattgaacgcaaacgaagagtccgaagacgaagaaaaagacgaggataaatacgtcgatgaagtggacatgcccggcacgaaagtcgacagtaaacaaagaataacggtcaggaatttgcgtatacgagaagatacggctaaatacttgagaaatttggatccgaactcggcgtactatgaccccaaaaccagatcgatgagggaagatccgaaccccgggaacgacgctacataccatggggaaaatttcgttcgcttttccggcgacactacaaatcacgccagagcgcagctgttcgcttgggaagcacacggtaaaggagtggacgttcatttactagcagaacccacgaaattggaattactgaagaaagaatacgagaaaaagaaggatgaggtgaagtcgaatattcagggtacagttttagagaaatacggaggtgaggaatatcttgaagcgccaccaaagagtttgttgttggctcaaactgaaaactacgttgaatattcgagatcgggtaagattattaaaggagcagaaaaagaagttattaaatcaaagtacgaggaagatgtttatattaataatcatacgtcagtatggggctcttactggcgcggaggacaatggggttatcgatgttgtcattcctttattaagaattcttattgtttgggcgaagcaggaaaatcagtaaacgctcaacct

SEQ ID NO: 2306 - DNA, 477 bp, Phyllotreta armoraciae
ggctaacacgaaactaggaaccagaaggatccattatgttcgtacaaggggaggcaacttgaagtaccgtgccctaagattagacaccggaaacttttcttggggtagcgaaggaactgcccgtcaaacacgtattatcgatgtcgtttacaacgctagtaataacgaattggttcgtaccaagacgttggtaaagaatgctattgttgttattgacgccaccccattcagacaatggtacgaaagtcactacatcttaccattgggacgcaagaagggtgccaaaatgacgcctgaggaggaggagattttcaataaaaaacgtagcaaaaaagtacagaagaagtacgaaactaggcaaaaaaccgctaaagtagaacctgcgatcgaagaacagttccacactggaagattgttggcatgcctagcatcaagacccggacaatgcggcagggccgatggttatgtcctcgaagg

SEQ ID NO: 2307 - DNA, 727 bp, Phyllotreta armoraciae
actgaaaatgctcaaacacggcagggccggcgtgcccatggaagtcatgggactcatgttaggtgaattcgtcgacgattacacggtgagagtgatagacgtgtttgctatgccccaaacgggcacaggagtgagcgtagaagccgtagatccggtttttcaagcgaaaatgttggatatgttaaggcagaccggcaggcccgaaatggttgtcggttggtaccattcccatccgggtttcggctgttggttgtccggcgtcgatatcaacactcaacagagctttgaggccctttctgagcgagccgtggccgtagtcgtggatcccattcaatcggtcaaaggaaaagttgtcatcgatgcctttaggttaatcaatcccaacatgatggtgttgggtcaggaaccccgtcagacgacttcgaatttgggtcatttgcagaagccttccgtacaagcgctgatacacggtttaaatcgccattactactctataagcattaattataggaagaacgagttggagcaaaagatgctgctgaatttgcacaagaaatcctggatggacgggctcactttggccgattactcggagaattgcagtgtgaacgagaaaaccgtagccgatatgctggaattggctaaaaattacaacaaagctttggaggaagaggagaaaatgacgcctgaacaactggctatcaagaatgttggtaaacaggatccc

SEQ ID NO: 2308 - DNA, 760 bp, Phyllotreta armoraciae
tggtcaaacccatggataagaagaaagtacttgtgaaagtccatccagagggaaaatttgttgttgatattgacaaaaatatcgacattaatgacgttacaccaaattgtagagtcgctcttcgaaatgaatcgtacactttgcataagattttaccgaataaggtggatcctttagtatccctcatgatggttgaaaaagttccagattccacttacgaaatggtcggtggtttggacaagcaaatcaaagagatcaaagaggtgattgaattgcccgtaaaacatcccgagctctttgatgcattgggtattgctcagcccaagggtgtgttgttgtatggaccgccaggaactggtaaaactcttttggctagagccgtagctcaccacactgaatgtacgtttattagagtatctggatcagagttggtacaaaaattcatcggggaaggttccaggatggtaagggagctgttcgtaatggctagggagcacgccccttcaatcattttcatggatgaaatcgattcaattggatcctctcgtatcgaatcaggttctggtggtgattccgaagttcaaagaactatgttggagttgctgaatcaactcgatggatttgaagctacgaagaacattaaagtgataatggctacaaacagaatcgacattttggatcccgctttgctgaggccaggtagaattgacaggaaaatcgagttccctccaccgaacgaggaagcccgattggatattct

SEQ ID NO: 2309 - DNA, 450 bp, Phyllotreta armoraciae
gtctgctttcgatttgcaaagcttcagtttcttccaaagagggtctatacaggaattcatgtcattcttttgtaagactattgtggaaaggactataccatcatcgagacaatccgtcaaagaaggagaatatatgtgccatgtttatgtaagacatgataacttagctggtgttgtgatatcagatcacgaatatccgtctagggtgtcgcatacgctgattacgaaaattttggacgaatttgccgctaaaatacctgctgttaattggcctaccttgcaagagaaggatgtaacgtttccgctgctaaatacataccttgccaaataccaaaaccccaaggaagccgatgcaatgactaaaatacaagaggaccttgacgaaaccaagattattctgcataatacgattcaagctgtcctggaaagaggcgaaaaattggatgactt

SEQ ID NO: 2310 - DNA, 604 bp, Phyllotreta armoraciae
tggaatatgccattgaagctattaaattgggatccacagctatcggaatatgcaccagcgaaggggtcgtgctagcagtcgaaaagcgtattacttctccattaatggagcctacaacgattgaaaagatcgtagaagtagataaacacatcggctgtgctgtttcggggctcatggcagattcacgcacaatgatcgatagggcaagagtagaatgccaaaatcattggtttgtttacaatgaaaacatcactatcgaatcatgtgctcagggagtatcgaacttagctattcaattcggagattcggacgatgatggtgctgctatgtcgaggccatttggtgtggccattttgtttgctggcatagacgaaaaagggcctcaactttaccacatggatccttcaggtacatttgttcagttcgatgcgaaagctataggatctggttcagagggcgcacagcaaagcttacaagaagtatatcaccgtagcatgactttagaggaagctaccacagcagcattgactattctcaagcaggttatggaggagaaattgaactcgtccaatgtagaagtcatgacaatgacgccaaaggatat

SEQ ID NO: 2311 - DNA, 745 bp, Phyllotreta armoraciae
caattagttgggctatccgacgatttgggaaagctggatggtttcgtggagcaggttactcggaaggtggctcagtacctcggcgaggttcttgaagaccagagggacaagttgcaggagaatttgcaggcgaacaacaccgatttgccaagttatttaaccagattccaatgggacatcgccaaataccccatcaagcaatcgctccgcaacatcgctgatataatcagcaagcaagttggacaaatcgatgccgatcttaagaccaagtcctcagcgtacaataatttaaaagggagtcttcaaaatttggagaaaaagcaaacagggagtttgctaacccgtaacttggcagatctggtcaagaaggagcactttattttagattctgagtacttgcaaacgttgctcgtcatcgttcccaaatctcagtttaatgagtggaacgccacttacgaaaaaatcacggacatgatcgtccctcgatcgtcggagcttatcattcaggaccacgactacggcttgttcaccgtgtcgctctttaagaaagtcgtcgaggagtttaagctgcacgccagagagaagaagtttatcgtgcgagatttcacgtacaacgaggaggaattggcggccggcaaaaacgaaatcaccaagctcgttaccgataagaagaagcaatacggtccgttagtgagatggttgaaagtgaacttcagcgaatgcttttgtgcttggatacacgtta

SEQ ID NO: 2312 - DNA, 717 bp, Phyllotreta armoraciae
gccgatacatacaagaccatttgactataccagtagaggaattgggcaaggaatccatcgtaaacgtcgccaagacttcgatgagctccaaaattatcggagctgatgctgatttcttttcgcaaatggtagtcgacgccgcgacagccgtgaaagtaacggactccaaaggcaactcgatgtatcccataaaggcggtgaacgtgttgaaagcgcacggcaaaagcgcccgggagagtttcctggtggccggctacgccttgaactgcacggtcgccagccaggccatgcccaagaagattttaaacgccaaaatcgcctgtctggatttctcattgcaaaaggccaaaatgaagatgggcgtgcaagttctgattacggaccccaatcaattggaaggcgtgcgcgccagagagctggacatcaccaaggagcgcatccagaagatcctggctaccggcgtgaacgtggtgcttctgtccggcggcatcgacgacgtctgtttgaagtacttcgtggagcgcggcgccatggccgtgcggcgcgtcaaaaaggccgatttgaaacgcatcgccaaggctacgggcgccgctttcgtcacgtcgttgagcaacatggagggcgaggagaccttcgacgccgccatggtgggcgaggccgcagaggtcgtacaggagaggatatccgatgacgaattgatcgttatcaaaggaccga

SEQ ID NO: 2313 - DNA, 639 bp, Phyllotreta armoraciae
ggaaccgaatggaaacctataacaaacccaataactcatactcaatctcctgtaactacttcaacttctattgtgtctataacgtacgataaaggagtactaatagccggagacttgctggcctcttacgggtctttagctagatacaaaaattgccctagggtaatcgaaatcaatccgaatatcatcctaggagcaggaggagattacgctgattttcaatatgttaaaagctttatcgagcagaaaataatcgatgaagattgcctagatgatggtttgaaaatgaaaccgaaatctctttattgctggctgactaggattatgtaccaacggagaagtaaactcgacccgttctggaacaacttagttgtcggagggatacaggatggtgtaccattcctaggaacagtcgataaacttggtacagcttacacagataaagtaatttgtaccggttacggggctcatatagcccttcctgtcctgcgagatgccctcgataagaaaccaaatttaaatttaaacgaagccaagcagcttattaaaaagtgtatggaagttttgttctacagggatgcgaggagttacccgaaatatcagttggggatgatcgatgcggatgaaggtgtgaagatt

SEQ ID NO: 2314 - DNA, 665 bp, Phyllotreta armoraciae
gcagaacaatttaacggaggtgttgatgaaggaattagaagtaaacccggataaatcgctgcagggcggtttgagagcggctcgcagggctgtgagattgctgaatcaattaggaagggaaacacaatcttgtacgctgttcctaaagttgtgcagcagcatgctaaggactcagtgcaaacgagttaaaagagaaggctctactaccacttacataaagcatctttcgagcgtggttttcaccaatatgtgtcacatgtctgatgaatttctgagagctttccccgactctccagcctgcgcctcagcgtatgtggtttgggcgagcaatgaactgctgcaatttactacccattttattaagcaggttttcatgcctcagacttccttatcaacggtgaccgaatgcatagttttagtgagacaacagtgtgaaaggctgtacgtttacggattagacctttgttatcaattagacggtgctttgagatcttccctgatgaaagcattgaaagacgctcgagataaactaatcgactcgataaagttgcgagttctagatgataaatggatacctattaatttgcacagcaaatcggctttaagtcgttgcgtgcaagagtattcccaaatgggactcactaacgttggaagttacgtttctg

SEQ ID NO: 2315 - DNA, 789 bp, Phyllotreta armoraciae
gaagacggtgaagctgatattgaaattgaattggttgaagatgagccaccatttttacaaggtcacggtagagctgttcacgatctaagccccgtaagaatagtaaaaaatccagatggttcgctagcccaagccgctatgatgcaatcggctttggcaaaggaaagacgcgaacagaaaatgctgcaaagagaacaagaagtggattcgcagccttctggaaagaacaaaaactggatcgatccccttccagaagaggaatctaaatcgatggcaagaggaataggtcttcaaagtcaagatttgcccgaatggaaaaaacacgttatcggcggtaaaaagtcatcttttggtaaaaaaactaacttaacgatcgtcgagcaaaggcagtctcttcctatttacaagctcaaagaagagttacgaaaagccgtaacagaaaatcaaatattgatcgttattggtgaaaccggctccggaaaaacaacacaaatcacccagtatttagctgaggccgggttcacagccagagggaaaattggatgcacgcagcccagaagagttgctgcaatgtcggtggctaaaagagtggccgaggagtttggatgcagattgggccaagaagttggttacaccattagattcgaagattgcaccagtcccgaaacgatgatcaaatacatgacagacgggatgttgctacgtgaatgccttatggatttggatcttaaaaattactctgtaataatgttggacgaagctcacgaacgtacgattcacactgacgta

SEQ ID NO: 2316 - DNA, 786 bp, Phyllotreta armoraciae
atgacggtcacaaattctcagccaaagaagttacaagacacgaaactggaggaaacgtagtcatgaattgttgtgtgtttagtgataggaaaaattcatttttagtagctggtcaagaaaactactctcaactttataaagtcaatacgaaattaatcgagcatgaacaagtagaaacagttggagacactgcaagcgttcggcacagaaataccaagtccaaagaacacgtagataataataaaaacattaaaaaggagctggtttttgacctgaatcctttagatagcatacaaaccgattttaagggttctgaacccctatgtagagtagttagaattaatcactcgggaaagatattagctactggaggaactgacggcgatgtaagactttggaaattccctatgatgcagcccttgtccattctaaaaggacatacaaaggaaatagacgatatagatttcagtaaatttgataacctcatcataactttggcaaaagacggtttggctattttgtgggacgcccaaacgggaaaattgaaatcaaaattgacatggaaaactccagagggatcgaaatatttgtacaagaggtgcagatttggcgttatcgaagaccaaaaaaataagtgcatgctgtacatgatagcgaatgcgactaattcgaagcaaacatcgtttcttcaacaatggatacctgaggagaatactttaaaaaagttctcggaattcaatgaaaccctatcggcacttgcggtgagagacgatggacgatttgtag

SEQ ID NO: 2317 - DNA, 662 bp, Phyllotreta armoraciae
aagcaatttacccaaagcacgagccgctctaacatccgctagaacgaccgcgaacgctatctattgccctccgaagatgcaggccgccctagacctgcagtcaggcgtgctacacgcagccgacgaaaaggatttcaagactgcttactcctacttttacgaagccttcgaaggtttcgacagcgtcgagtctcccaaagctctaactgctctcaagtacatgcttctgtccaaaattatgattaatagtcctgaagatgtacagcaaattgttagtggaaaattagccataaagtatgccggtaaagatattgatgccatgaaagcagtcgcacaagcagcccacaaaagatctcttgcagattttcaacttgccgtaaaacaattcaaacatgagctggaagatgacgttatcgtaagagcacatttaggaaccctctacgacaatatgttagaacaaaacttatgcaggatcattgaaccttactcacgtgtccaagtagaatatatagccaagacgattaagcttcctgtgttacaagtagagaagaaactatcgcagatgattttagatgccaagtttcatggaattttagaccagggtgatggtgtcctgatagtgtttgaagaaacgccggtagacaaaacctacgaaatggctc

SEQ ID NO: 2318 - DNA, 681 bp, Phyllotreta armoraciae
ttggagaaattgctcgagaacgagcgcattcgtcacgccgaagatctggcgttggtcgagagggaattgcacaggctgcgagaggaaatggcccaacaacttcaggaataccaggacctcatggatatcaaagtatcgctcgatttggaaatcgcagcttaccgtaaacttctcgaagcagaagaagctcgattgaacatcacaccgacaggcatggaacacgaggtgcaccataggagttcttctcaacgtcggacgccggtgagaatgggggccaaaaggaaacgagccctgctcgaggagactcaggagtcgagcttgtcggattacagcgtgaacagttcatctaaaggggacatcgaagtggccacagtcgatccggacggtcagtttgtgagattgcacaacaaaagtaaccaagaggtgccgctcagcggatggcaagtcataaggcgggcgggtgatgaggagactttctacaaattccacaggactgttaaagtagaaggaaatggtacagtaaccatttggagttcggatttaaataaagatcacgaaccccctagtaacctggttatgaaaggccaaaaatgggttactggagacaacatgattacgatagtattgaacaacaatggagaagaagtagcgtcatctgaaagggtaagaaggcagatttca

SEQ ID NO: 2319 - DNA, 745 bp, Phyllotreta armoraciae
gatcaaatagatgcggaggttctcaattcgttggccgtgaccatggagaacttccgttacgctatgacgaagagcagtccgagcgctctgcgcgaaacggtggtagaagtaccgaacgtcacgtgggaggatatcggcggtttggctaacgtcaagaaggagttgcaggagttggtgcaatatccggtcgagcatcctgataagttcctcaagtttggaatgcagccgtccaggggagtgctgttttacgggccgcccggttgcggtaagaccctattggcaaaggccatcgctaacgaatgtcaggccaacttcatatcggtcaaaggaccggaattgttaacgatgtggttcggtgaatctgaagctaatgttagggacattttcgataaggccagatcagcagctccttgtgtacttttcttcgatgagttagattcaatcgctaagtcgagaggcggaaatgtaggagatgccggcggtgccgccgatagggtgattaatcaaattttaactgaaatggatggtatgggagcgaaaaagaacgttttcatcattggtgctacaaatagaccagatatcattgatcccgctatattacgtcccggtcgtttggatcagttgatctacatcccattgccagacgaaaagtctagagaagcaatctttaaagccaacttaaggaaatcacctgtagctaaagacgtagatcttacttatattgccaaagttacacacggctttt

SEQ ID NO: 2320 - DNA, 650 bp, Phyllotreta armoraciae
atttagtgccaagtctttgcgaggatcttctttcgtctgtagatcaaccattaaaaatcgctaaggacaaggattcgggcaaggattttctattatgtgattacaatagggacggggattcttacaggtcaccatggtcgaatacctattaccctccattagaagacggctcgatgccctccgagaggctaagaaaattagaattagacgccaatttagcgttcgatcaatatagagaaatgtatttcgaaggtggcgtatcttctgtttatttttgggacttagatcacggtttcgcaggagtaattttaattaaaaaaactggagatggtagtagaaaaattaaaggttgttgggattccctgcacgtagtggaggtgcaagagaagagttctggaaggaattcccactacaaaatgacctccaccgctatgctgtggctgcaaaccaataaacaaggctcgggaaccatgaatttgggcggtagcttaacccggcagatcgagcacgatgcagcagtaaatgacatcaaccctcacatcgcgaacatcggtcgaatggtggaagacatggaaaacaaaattcggaacactttaaacgaaatctactttagcaaaaccaaggacatagtcaatagcttgagatcggtg

SEQ ID NO: 2321 - DNA, 792 bp, Phyllotreta armoraciae
ttcaccaattgctacgtgtacaaccagcccggcgaggacgtagtcgtcatggcccaaacattagaaaaagtatttttaaccaaagtggccgacatgcctaaacaagaatttgtcgttgaaattccaatgaaaggcaagaaagggcgagttagcgtcggcggtgggagcaccccatcttccagcggaccggtgccggcagctgtacccggaggtgtcagaggcaggccgcccgcgaccgtttcttccaccagtaccacaccaattgccaccactactggttcgtccggtctaccgttgggcacacaagcgcctgcgacgttgccgggaagcactgccacgacgacgatagcgccggccaacaacaacaacagctctctgacgccgcagcagctcggcacgcccgtcagctcgatgcacggaacccccggagcgcctctatccaattccctcgatcccacaggagtgttgcccggaaacgtcatgccgccggcgcaaccagccaaggtaaaaaaaggcgtgaagagaaaggccgacacaacgacgccggcgacggcctacgattatccgacggtattagaatcgaaatcggcgaagatttcgactcgcagagaatcgggcaggcagataaagaaaccggcgcggcgggaaatcgaccttcatgtacctcaaccggcgatccacaaacccaacgataagttgacggaatcgcttaaagcttgcaatgaaattcttatggaattgttctccaagaaacattcgaattacgcatggcctttctatcaaccggtcgat

SEQ ID NO: 2322 - DNA, 762 bp, Phyllotreta armoraciae
caatttcgttcatcagcaggtctcaatgaaccatcgccagccctacagcgtcagcgacaaagctggtcaccaaacctccgcggagtcctggggaacaggtcgtgccgtagcccgtatacctcgtgtacgcggtggcggtacccaccgatcgggtcagggagccttcggtaacatgtgtcgcgggggtcgcatgttcgcgcccaccaagccgtggcgccgttggcacagacgcgtcaacatcaaccagcgtcgctacgccctggcgtcggccgtcgccgccagcggcgtgcccgctttggtcatgagcaaggggcacgtggtcgatcagatacccgagttgccgttggtcgtcagcgataaggtgcaggagatgcacaagaccaaggaggccgtgcagtttttgagaaggatcaaagcatgggctgacatccagaaggtttacaagagccaacggttgcgtgccggtaaaggaaaaatgcgtaacaggagacgtatccaacgtaaaggaccactcatcgtttactacaaagatcaaggtcttcgtcaagctttccgtaacatccctggcattgacctcattagtgtccaaaagttgaacttgctaaaactggctcctggtggtcacgtaggtcgatttgtcatctggaccgaatcggcattccaacgtttagacaaattattcggtacatggaagaacccatcgaccgaaaagaagggttacaatttaccccaacccaagatgtccaacaccgatttgtctag

SEQ ID NO: 2323 - DNA, 722 bp, Phyllotreta armoraciae
cgaggaagaggaagaagatgatgaagagaaaattagagaagaattaaaagatcttatcgacgataatccgattgaagaaagtgatgctgaatccgatacttcaggtcgtgaaaaaagaaaaaaatcagacgatgaagacctcgatgatcgattggaagacgaagattacgatctgttggaagaaaatttgggtcataaagtagaaagaaggaaattcaaacgtttgcgtcggttcgatgatgaagaaagcgaaggagaagaagaacatgatcccgagcaagatcgtgaacaaatcgccatggacatattttccgacgatgaaaaagacgatcgtcagaaaaaggatgaagaacgaaggtcagaacgaagtcaaagaccggtcgttgagcaagaatctttcggagtgggcgaagaggaagaagaaggcgattattcagatgctgatgattttattgtagacgatgatggtagacctttaatcgagaaaaagaggaagaagaaaccgattttcactgacgccgcgctgcaagaggcccaagaaacattcggcgttgatttcgactacgacgagttcaccaaatatgaccaagacgagtatgaagacgaggaggatgaagaagaagacgaatacgaagaagatgacaacgaacgaagaaaacatccgaagaaagcggcgcggaagaagttgaccaaaaagtccatttttgaagtgtatgagccga

SEQ ID NO: 2324 - DNA, 689 bp, Phyllotreta armoraciae
taaagatgccgggaaaatcatcgataatactgaaacaaatctaatagcccttagaaggacaatatatttgactatacaatctagtttggatttcgaggaatgtgctcataagcttttgaaaatggagttaaaacccggccaagaaatcgaattatgccatatgtttttagattgttgtgccgaacaaagaacatacgaaaaattctacggacttctagctcaaaggttttgccaaataaacaaaatatacatcgagccctttcagcaaatattcaaagacacctacgctactacccatcggttggacaccaatagattgaggaacgtcagcaaatttttcgctcacttgctcttcacggacgccataggctgggaggtgttcgagattatgaagctgaatgaagaagacactaacagctcgagcaggatttttattaaaatcttgtttcaagaattagcagagtacatgggcctaggaaagttgaataccagattgaaggatgaaacacttcagcagcattttgcagggctgtttcctagagacaatccgaaaaataccaggttttccattaatttcttcacgtccattggtttaggaggtctaacagacgaacttcgggagcatttaaaaaacgtccctaaaattatggaaactaaaacggcctctgtgaaggaagaaagtggcagta

SEQ ID NO: 2325 - DNA, 773 bp, Phyllotreta armoraciae
tgaactgacgtttcaagctatggcctacgacttgcttccaatcgaaaatgacgtgtacaaatacgaagcttccgctggggtgcagaaggaggtcctcttggatgaaaacgacgagctgtgggtggaattgcgccatcaacacatcgccgtggtttctcaaagcgttaccaagaatttgaaaaagttcaccgattcaaagcgcatgacccagagtgataaacaatccatgaaggatttgtccactatgattaaaaagatgccgcagtatcagaaagaattgtcgaaatacgctactcacttacatctcgccgaagactgcatgaaggcctaccaagggtatatcgacaagttatgcaaagttgagcaggatttggcaatgggaactgacgccgaaggggagaaaattaaagatcacatgcgcaacatcgttccgattcttttagacaccaaaataacaaacgagtacgataagatgcgcatcatagccttgtacgctatgactaaaaatggaataaccgaggaaaatctttcaaaactaggacaacatgcatcaattaaagacaaacaaactatcgctaatctacagctcctgggagttaatgtcattaatgatggtggtcccagaaaaaagcagtacaccgtaccgcgcaaagagcgaattacggaacaaacttaccagatgtcgagatggactcctgttattaaagacatcatggaggattgcatcgaggacaaattggatcagaaacattttccctatctaagtggaaggg

SEQ ID NO: 2326 - DNA, 705 bp, Phyllotreta armoraciae
ctatggagctgaagtgtctcaaagacagatgttcaactaacttacaaaaatattacgactcaaaaaatcatcaaaagaaacagattcaatctgggggctttcaagatcttagaagagatttacaagcagtgataggtacaagggcaaatattaacatagcacaaatagaaaattatggcggtgaaactttcttatcagaggaattggctatcatgattcttcaggatactaaacaagcttttcaacgttgcttattgttatcaaaaggcagtgaaaaagcttctaatgccactcaaattttggatagacttattaatagtttgctaatagaacatgtagactatgcagttgaattgggtctacaagctgtacccgttgtcgaaggcgttaaaaatccccctgttttgtatttttttaatgtcgtccatcaaagcaataatataacccatctcgtcgagaaacagttcatggatttggtggtcccattagtagaaaatactccaaaatacagcgattgcgtccagaagaaaaaatttgttttggaggatatagaaagaaaaattaatacaggattggataggtgcttgagtgccatattaaattgggtgaagttgtatttacaatctgaacaaaagaaatcagattttaagccagagtctgatgattttgatacagtggcctcatcagcttgcaagaacgtactta

SEQ ID NO: 2327 - DNA, 653 bp, Phyllotreta armoraciae
tagaaaccatcgatctgcagaaggacccctattttatgaaaaaccacctgggctcctacgaatgtaagctttgcctaacattacacaacaacgaaggaagttacttggcgcacacgcagggcaaaaagcaccaggccaatttggctcggagggcagccaaggaggccaaagatgccccctcgttgctccagcccgagaagcccagagtggagcccaagaaattcgtgaaaatcggtagacccggttatcgggtaactaaacagagggatcccgaaaccggccaacagagtttactcttccaaatcgattatccagaaataagcgacttggttttgcctcgacaccgtttcatgtctgcgtacgagcaaaaaatcgaaccgcccgaccgtaaatggcaatacttactcttcgcagccgaaccctacgaaaccatagcctttaaagtacccagcagagaagtcgaaaaaaccgatactaaattttggactcattggaacagagacaccaagcaattttttctgcaattcgctttcaagaacgagaacaaacgatccgttaactccgttgttcaaaggcattcgatcgtcggtggagttccaccgcctcccatgctgccggtaccgccgccgcccaggcctcctatgtttaatccc

SEQ ID NO: 2328 - DNA, 253 bp, Phyllotreta armoraciae
taacctgcgaaaccataaccggcgaagtttacaggggtaaactcatagaagccgaggataatatgaattgccaaatgacccagataactgtaacgtacagagacggacgagtggcacaattagaaaacgtttacattagaggttccaaaataaggttcttgatattaccggatatgttgaagaatgctccgatgtttaaaaagcaaaccaaagctggcactgcaggtagagggaagtctgcaattctacgagc

SEQ ID NO: 2329 - DNA, 654 bp, Phyllotreta armoraciae
caagtcggagccaatttaacggccacatccgacagagaaactatctgttacacgttggaaggtacccccgaagctgtggaatgcgctataccattcttaaccgaagtagccacccaacaagaatttagaccttgggaagtttccgaattgtccagtagattgcagttggatatcgccactagaccattgcagttgagagctatcgatttgctgcacaacgctgcttttagaggacgcggcttgggtaattctttgtttattccgaaaactcaaattggcaaaatatcgtccgaaactctacaacattacgttagctcgaacttcttgagcggacgtatggcagtcgttggttcggggatcagccaaaaggaattgacgtcttttgctaattccttaaaagtagaaaacggcgaaggcaataacgccccttctccttacgtaggcggtgaattaagatcgaacaaaggtggtcaactggcctttattgctgtagcaggagagggcgctgctctcaaaaaccacaaggaagctttagcttttgctgtacttcaaggagcccttggaggaggcccccaagttaaatacggagtttctgataatggaatcttccgaaaggctcttggaaataaccctagcgttagttcagtagccata

SEQ ID NO: 2330 - DNA, 199 bp, Phyllotreta armoraciae
ggtcttcatcctctctctctaatcatcggacggctgaagagctggaatctcagaacgatgaagccatcgatgggctaagtgcaaaagttaaaatgctaaaggagattacagttgggattggaaatgaagtgaaagaatcgtctaagcttatcactggaatcaatgattctttttcagaagctagtgggatcttaagtgg

SEQ ID NO: 2331 - DNA, 729 bp, Phyllotreta armoraciae
cgttggtaatcctcgaagatgtcaaatttccgaaattcaacgaaatcgtccagctcaaactggccgatggcagcttgcgatccggtcaagtattggaagtgagcggctcaaaagccgtagtacaagtgtttgaaggtacttcgggaatcgacgccaaaaacaccatgtgcgaatttaccggcgatattctcagaacgcccgtgtcagaagacatgttgggtagagtgtttaacggctcaggaaaacccatcgacaaagggcctccgattttggctgaggactacttggacatccaaggtcaaccgatcaatccttggtcgcgtatctacccggaggaaatgatccaaaccggtatctccgctatcgatgtgatgaactcgatcgctcgtggtcagaagattcccatcttctcggcggccggtctgcctcacaacgaaatcgccgcgcaaatttgtagacaagccggtcttgtcaaagtgcccggcaagtccgctttggacgatcacgaagacaacttcgccatcgtgttcgccgctatgggagtcaacatggaaactgctcgtttcttcaaacaagatttcgaagagaacggttcgatggagaacgtatgtctgttcttgaatttggccaacgatcctaccattgagagaatcatcacgcctcgtttggctctgaccgcagccgaatttttggcctatcaatgcgagaaacacgtgttggtcatattga

SEQ ID NO: 2332 - DNA, 763 bp, Phyllotreta armoraciae
ggccatcaaaaacatcaacaccatcatcgccccggagctgatcaaggccggcttcgaggagacacaacagaagaaaatcgacgagttcatgatcaagctggacggcaccgagaacaagtccaaattgggcgccaacgccatcctcggcgtttccttggccatttgcaaagccggagcggccaggaaaaacgtgccgttgtacaaacatatcgcagatttggccggtaacaaggatatcatcctaccagtacccgcttttaacgttatcaacggtggttcccacgctggaaacaaactggccatgcaagagttcatgattctccctactggcgccacaaccttcaccgaagccatgcgaatgggttccgaaatataccatcacctgaagaaggtaatccacgccaagttcggcttggacgcgacggccgtcggcgacgagggcggttttgccccgaacatcctcaacaacaaagaaggtctcgagctcatcaaagtggccatccaaaacgccggctacaccggcaaaatcgacatcggcatggacgtggccgcttcggaattcttcaaagaaggtaaatacgatttggacttcaagaaccccaacagcgacaaatcgaaatggatatcctccgacgaactagaagctttataccaggagttcatcaaagagtacccgatcgtttccatcgaagaccccttcgatcaggacgattgggccgcctggagcaagctcaccggcaacaccaaaatccaaatcgtaggc

SEQ ID NO: 2333 - DNA, 676 bp, Phyllotreta armoraciae
gaaaatggcggttagattggccgggggattgcagaaaatggtggcgttgctccagagaaaccacgtcaaattcttggctattctcaccgactgtttgcaaatcttggcttacggcaatcaagagagcaagctcatcatactcgcctctcaaggccctatcgaattggtcagaataatgagatcgtacgattacgagaagcttttgtggactacatcgagagtattgaaagtgttgtcggtgtgttccagcaataaaccggctattgtagaagctggcggtatgcaagccctcgccatgcatttgggcaaccccagcactcggttggttcaaaactgcctttggaccctcagaaatctatcggacgcggctactaaagtcgacggattggagagtttgttgcaatcattagttcaagtgctgcaatcgtctgacgtgaacgtggtgacttgcgccgccggtatcctgtcgaatttaacgtgcaacaatcaacgcaacaaagtgacggtgtgccaagtgggcggcgtggacgccctggtgcgtaccatcgtcagcgcgggcgatcgcgaggagatcaccgagccggcggtgtgcgccctacgccaccttacatcgaggcacgtcgagtccgagatggcgcagaacgccgttcggctgaactacggcatacaagtgatc

SEQ ID NO: 2334 - DNA, 689 bp, Phyllotreta armoraciae
cgaaatcgacaagcacaaaaaacgccggccctatttggcgtccgaatgcaagagcctgtacgcctgcgagaaatggcgcatgcagataatcagggaaatagcgaaaaaagtggcccaaatccagaacgccgggctgggcgagttccggatacgcgatctgaacgacgaaatcaacaaactcctgcgcgagaaacgccactgggaggaccaaatcaaggagttaggaggcccagattaccagcgagtcggcccgaggatgctggatcacgaaggcaaagaagtacccggcaacaggggctacaagtacttcggagccgccaaggaactaccaggcgttcgagagctgttcgaacaggaaccgccgcctccgcctaggaagagccgggccgagctgatgaaggacatcgatgccgattactacggctacatggacgacgacgacgggatattaataccgctcgaagtcaaagctgaaaaaatcgccgttcaaaacgccgtatcggaatgggtgagcaacaaggaaaagaacctggactcgagcaaggtaatcgaagagagcatttacgcggtggaggactccgacgaagaggatgccgttcaacagttcgatggctcgcaacagcgattcgttgctcacgtacccgtaccgtcacaacaggacatcgaacaggctttgttgaggagaagaa

SEQ ID NO: 2335 - DNA, 510 bp, Phyllotreta armoraciae
aaaaccactttcgtcaaacgccacatgaccggcgagttcgagaaaaagtacgtagccaccctgggtgtcgaagtccatcccttagtgttcacgacaaaccgaggcaaaatctgctttaacgtgtgggacacggcgggccaggagaagttcgggggcctcagagacggttattacattcagggacagtgtgccattatcatgttcgatgtcacgtccagggttacatacaaaaacgttcccaactggcacagggatatcgtcagggtgtgcgaaaacataccgatcgtactatgtggaaacaaggtcgacatcaaggataggaaggttaaggctaaaagtatcgtgttccataggaagaagaaccttcagtattatgacatatctgccaagtcgaactacaacttcgagaagcccttcttgtggttggcgcgaaaacttattggcgatcccaacttagatttcgtcgctgaatcggcccttctccctccggaagttcaaatggatccccag

SEQ ID NO: 2336 - DNA, 724 bp, Phyllotreta armoraciae
cgtgatgaaatacggcaaaaatcaatggtccagaatagcatctctgcttcacaggaagtctgcgaaacaatgtaaagcccggtggttcgaatggctagaccctagcattaaaaaaaccgaatggtccagggaagaagatgaaaagttgctgcatttagctaaactaatgcccactcaatggagaactattgcgcctataataggcaggaccgcagcccaatgtctagaaagatacgaatatttactggatcaagcgcaaaaaaaggaagaaggcgaggacgccgtggatgatccgaggaagttaaaacccggagaaattgatcccaatccagaaactaaaccggcaagacccgatcctaaagatatggacgaagacgaattagaaatgctttccgaagctagagccagactggccaatacccaaggcaaaaaagccaaacgtaaagctcgcgaaaagcaattggaggaagctcgccgtttggcagccttgcagaagcgacgagaactgagagcagccggtattgaagtcacttcgaggcgcaagaagaaacgcggtgtagattacaacgcggaaattccattcgaaaaacaaccagccatcggtttctacgacacttccaacgaagccctagacttgatggccccagatttttccaaaatgagacaacaacatctagacggtgaactcagaagcgaaagagaggagagagaacggaaaaaggac

SEQ ID NO: 2337 - DNA, 330 bp, Phyllotreta armoraciae
atgtggctcatccagataagctgaagaaaaaaattactagggaattaattactaccattcttgccagaaaaccaaaaatgtgcagtttcttagaatggagggatttgaaaatcgtttacaaaaggtatgctagcttgtatttttgctgcgcgatagaacagtgcgacaatgaactgttaactttggaaatcattcatcgttacgttgaacttttggataagtacttcggaagcgtatgcgaattggacataatttttaacttcgaaaaggcctatttcattctggacgagctgatgcttggtggcgaggtgcaggaaaccagtaagaaga

SEQ ID NO: 2338 - DNA, 700 bp, Phyllotreta armoraciae
gaaagctggtaaattcaccgaagaagtgggaaaaactactcacaaaatcagcgaaaccgcacaagaaatcagcaagaccggagcgtttcaaagcatatcggaggccaccaaagcggttaaacaagaaatcgacaacaccagcatggaaggtcgagtgtacgtgagccctaaaaagctgcgaaaacgaaccgaaaccagcgcggtagtccaacaaaagtactacgaaccgaacacagacgcaaccggcgtagagctacacaaagactccaaattctacgagtcctggcaaaacttcaaaaacaacaacccgtacgtgcacaaagtcatggactggaaactcaaattcgacgaaagcgaaaaccccatcattcgagcctcccgagcgctcaccgagaaagtcggcgacataatgggaggcctctttcaaaaaaccgaactctccgaaaccctcacggaaatctgtaaaatcgaccccgctttcgatacgaaacgattcctgaaacagtgcgaaaccgacatcatcccgaacgtgctcgaagccatgacgagaggagacctcgaagtcctgaaggactggtgtcacgaaggacccttcaatttgttcgccgtgcccatcaaggaagcctacaagaaaggctacagaatcgagtcgaaaatcctggacgtagaccacgtggatttggtgatgggtaaagtgatg

SEQ ID NO: 2339 - DNA, 654 bp, Phyllotreta armoraciae
agatggtaagctgaaacctggattaaataaaatcgaagaagcccctaaacaattcgtgaacaacataagcggcttaaatcagaaaatcgaagaattcaaattgaaactgccatggatcgaacggctggattgtacgaatgcccaagcccccttggcgcccgagttagcggcagaaatgttggttcacgaggaaaagaggagtaatcaactgagaaacaacaaaaaacttccccaatttcaacccgcccaagatcccgttctgaacgatttcaaacgagaactcatattccaccggcaagcacaagctacaattctagaggcaattccgaaaatcaaagaattagggatacttactaaaaggccagatgattattttgctgaaatggccaaatcggatgagcacatgcacaagatcagagagaacctgaagcaaaagcaggagcaacagaagcggattgaacgggtgaagcaattgaggcagcaaaggaaagagggaaaatcgctgcaggtgcagatgaaattgcaacgctccaaagagaagaaagaaatgatggatcaagtgaagaaggcaagaaaaaacttcgactttttggatgataaaaataagcccatgggaaggaaggctgcagaaaaacggaagatgaaggacaagaa

SEQ ID NO: 2340 - DNA, 661 bp, Phyllotreta armoraciae
gatccatcgataacaaggctatgtacgatactttctctgccttcggtaacattctcagctgcaaagtggctcaagacgagagcggagtcagcaagggatacggttttgtccacttcgaaaccgaagaagctgccaataaatccattgaaaaggtaaatggtatgctgttgaacggcaaaaaggtctacgttggtcgattcatcccacgcaaagaaagggaaaaggaattgggcgaaaaagccaagctcttcacaaacgtttacgttaaaaatttcggagaggacttgtccgaggaacagctgcgaacgatgttcgagaaatacggcaagataactagctacaaaataatgagcaaggacgatggaaaatcgaaaggattcggattcgtcgctttcgagagccccgaggcagccgaaacagctgtcgaggccctcaacggcaaagaaatattggaaggcaaacctttgtacgtcggcagagcccagaagaaggccgagcgtcaacaggaattgaagcggcgcttcgaagctctgaaaatggaaaggctgaaccgttaccaaggcgtaaatctctacgtgaaaaacttggatgataccatagacgacgagcgccttcgcaaggaattttcaccgttcggcaccatcacttcggccaaagtaat

SEQ ID NO: 2341 - DNA, 766 bp, Phyllotreta armoraciae
ttgttgaattgagcaccaacacgataaacaagcttctaacagctctaaacgaatgcaccgaatggggccaagttttcatactcgattccctgtcgaactacaccccacgagacgaaagagaagcccaaagtatatgcgaaaggatcactccacgtttagcccacgctaacgctgccgtagtactatcagccgttaaagtattgatcaaaatgatggagattttggcaggagataccgaattctgcaacacgctcagcaaaaaattagcgcctcctttggtaactctgctgagttcagaacccgaggtgcagtatgttgcattgagaaacatcaatttgatcgtacaaaagaagcccgacatattgaaacacgaaatgaaggtgttcttcgtgaaatacaatgacccgatttacgtgaaactggagaagctcgacataatgattcgattggcttctcaagtcaacatcgctcaagttctcagcgaactcaaagaatacgcgaccgaagtcgatgttgactttgtgaggaaagccgtgagagccatcggtcggtgtgccatcaaagtggagccttccgcagaaagatgcgtagccacgctgttggatttgattcaaactaaagttaattacgtcgtacaagaggccatcgtagtcatcaaagacatatttagaaaatatccgaataaatacgaaagtattatcagcaccttgtgcgaaaatttggatactctggatgagccagaagccagagctagtatggtgtggat

SEQ ID NO: 2342 - DNA, 363 bp, Phyllotreta armoraciae
gaggagaagtaggagctacatcatccttggctccgaaaatcggtccccttggtttgtctcccaaaaaaattggtgacgatattgccaaaggtacagctgactggaaaggtttaaaaattacggtccaattgaaaattcaaaaccgtcaagccaccatctccgtcgtaccatcggctgcttccttaattattaaggctttgaaagaacctcctcgtgacagaaagaagcagaaaaacattaaacacagtggaaatattacatttgatgaagtgatttccattgccaagcaaatgaggcatagatcaatggccaagagccttgctggaactgttaaggaagtgctgggtacagctcaatctgtag

SEQ ID NO: 2343 - DNA, 712 bp, Phyllotreta armoraciae
tatcatatcgtgccaagcaaatggaggaagaacttacagttgaagcggctaaactgggcatttctatagtattttcgcatgagactgagcctttaggcaccgcaggaccaatagcattagctaaagaacacttatcgaaaagtacaaaaccgttttttgtattgaattccgatataatatgcgacttcccgtttagggagctagagaagttccacgaaggccacggaaaggaaggaactatagtcgttacaaaggtcgaagaaccatccaagtacggcgttgtagtttacgatcaaaacaactgcatcgagagtttcgttgagaaaccgcaggaattcatttcgaataaaatcaacgccggcctgtacattctaaatcccagcgtgatcaacaggattgaactccgaccgacttccattgaaaaggaagtgtttccttacatggcatctgacaagcagctttatgctttcgagctgaaagggttttggatggacgttgggcaacccaaagacttcctgactggaatgtgcttgtatttaaaccatttgcgggaaactaatagccagaagctgtacaaaggacccggtgtagtcgggaacgtgctggtcgatccgacagcaaaaattggcagcaattgccaaattggacccaacgttacaatcggaccaggtgttgtaatagaagatggggtttgtataaaacgctcgacgat

SEQ ID NO: 2344 - DNA, 694 bp, Phyllotreta armoraciae
gaataacgacgaccttctgaaagaaggcgtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgtcgatacgacggcggagccctggcgggccgctctagataacgagtttatacaatatacgagaaaccattataaagacggcgtttgtagcgtgttcggtcgcagtcaaaacggtgcgatcacccttactgcttgcatcgaagaccaccaatttcagcccaagaacttttggaacggtcgatggagatcccaatggtccgttagcctaaccgatgaatctactgcagaagtacggggcgtcctgaaagtgcaagtccattattacgaagaaggaaacgttcaactggtgagtactaaggaaatcaaggagtcgattccggtttctaacgaagcgcaaacggctaaggaaatcatccacgtaatagagaacgctgagaatctgtatcaaactgcgatttctgagaattaccagacgatgtcggacacgacgtttaaggctctgcgaagactcctgcccgtcaccaggacaaaaatggat

SEQ ID NO: 2345 - DNA, 783 bp, Phyllotreta armoraciae
atcccttactccattaccgaaaacaggttagctgaaatcaggaaaaactttatgtacccgtacttcgataaagggggcaacgtggacaacgagggggattaccagaaggaaatccaatcctccacgccccaagtccacaagaatctgaacttccaagtgccttttttcggattcaggtataattacacgagagtttccatcaatggttatttggaattcagcgatccaccttccaacttaaattatccactggtctttcccataaaggactggcctaagcaaaacgatccttcgtttattggtattttctacagtaaatgtaaaatcggtaatcttcgtgacgaagacgtggacaaaaggaaacccggcgtgtacttcagaatggaacgagacctcagggacaggcaagacaggatgggagttgaaataagggagagattgaaatgggatataagagaaggagtgatcggttcggataccttcgatccaaaacacgctataatcgtgacgtggaaaaacgtgtcatttaatggaggatatgcaaacgcagtttatcaaaccaacacattccaaatggtactcgctaccgacgaggtattcacttacgcaatattcaactatctaaatttggcgtggaccagtcacacggaagccggtggagacaccagaacaggcgaaggcggtgtaccggcgtttgtcggattcaacgccggtaatggtacgagaagcttccagtacgcgccctacagtcaagcgtctgtcattcgagatttggtatcgacc

SEQ ID NO: 2346 - DNA, 210 bp, Phyllotreta armoraciae
aaaaatccttggctccgtaggagttgaagccgaagctgaaaaggtcaagaaagtcttaggcgaactcaacggcaaatccatcgaagagctcattactaaaggtcgcgagaaattgagttccatgccagtaggtggtgcagcccctgtagctgctgctgcagttgccgctgctcctgctgccgcagaagaaaagaaagaagccaagaagga

SEQ ID NO: 2347 - DNA, 708 bp, Phyllotreta armoraciae
aacagagctgacgaagatttggatcccgaagacgtcgaactcgatgaaaactatctgattgagaccaggagtaaatcgagtgctcatactggagaacatggcgttgatgaatatcctgatatcagtggaatcacaaccgctagggaagccatgggtaagatgcccgaagaggataagcaaaaaatattgcagcaagtggagtttttcaagaacgagaagctcaagttcgataacgaagtcgctaaatgggacgatactggcaacgacatcatcgttttggctaaacacatgtgcatgatcatgatggaaatgacagattttaccaggggaaaaggccctctgaaaactaccatggacgtcataaatgcggccaagaaaatttcagaagcaggtactaaattggacaagctaaccagacagattgccgaacagtgtccggaaagttcaacgaagaaagacttactcgcctatttacagcgtatcgctctctactgccatcagatgaatattacttctaaggtcaaagcagacgtccagaatatcagtggagaattgattgtgtctggtcttgacagtgctacatcattgatacaagcagccaaaaatttgatgaacgctgtcgttctgacggtgaaagcttcatacgttgcatctactaagtatcctagaccaggaactgtagcttctccgattgttgtgtggaagatg

SEQ ID NO: 2348 - DNA, 645 bp, Phyllotreta armoraciae
agcagcactactacaatagccagtgtccccgctttaggtttatcgactactgtttcttccgctgcttcaacaactccatcgacttcattaggtacaacaacagcagctcctccagcttattcaacatcgacacttccttcttctggttcgttaactttcagccaactagaagattctatcaacaaatggactattgatttggaagagcaaggcaaatttttcattaatcaagcgaaacagcttaatgcttgggattcgctacttatttcgaatggcgaaaagattctcaatctgaatggtagtatcgagagagttaagcagcagcaacagcaattggaccaagaactcgatttcgtcttggcgcaacagaaggaattagaagagttgataacaccactagaaaaagaattgttggaaattcctgtaacggacatagatcgaaatcaaatgtatcaattttcggaaataatcgattctcaattgaagcaaatgtccgatgatttgaaggaaattatcgagcatattaatgaatctaataaaagcgaagaaatttcaaatccgttgacgcaaattagccgcataatgaatgctcacatgaattcactccagtggttagacagaaatacggcacaaattgtttctcat

SEQ ID NO: 2349 - DNA, 455 bp, Phyllotreta armoraciae
tttaggactggataacgctggtaaaacgaccttattacacatgcttaaagacgacagactggcccagcacttgcccacattgcatccgacctccgaggaactgtccatcggaaacatgagattcactacgttcgatttaggagggcattcgcaagctagaagagtgtggaaggattacttccccgccgtagacgctatcgtatttcttattgatgctaacgacagatcgagattcgtcgagagcaagcaagaattagatgccttgttaacggacgaaaccctagccaattgccccgtgctgattttaggcaataaaatcgatttaccggacgccgcctctgaggatgagttacgaaacgtttactcgctgtacgggcagacgaccggtaaaggtaaagtggctcgatcggatttgcccggacgaccgctcgagcttttcatgtgctccattctga

SEQ ID NO: 2350 - DNA, 575 bp, Phyllotreta armoraciae
actaatattaacgagcaatttcgataaaaaatcgaaacgaaccgatacagccagcctttcagtcatggacccgatcgccgtgctggaaaaacgcatcgaggcgctcgagctgcaggtgttccctttgggtgactacaatcaaatatcgaacaagacgctgaccataacgaatctgctggtggagacgcaaacgatgataaattcggctttaacttgtcgcgaatccatcacgtcgatgctgcaacacctggtggtgatcaacgactacctgaaccccgtcagcgaggcggacgagctggaggtcgaagcgaaaaggcagtatttactcgaattgtatcccgaattgaaggatacgatacagacggtgagcacgttggaatcgctgttgccttttatcgattcaattaatatatccaaagtggtggagttctcggggaagctggaggaggtggccgtgagcaatctcaagttgtacggggaatgcagggatatcacgaagaaggtgctggtcgcgttacagcaatataacgacatatccaattccattaaattgttattttcgcaattggatacgg

SEQ ID NO: 2351 - DNA, 780 bp, Phyllotreta armoraciae
aaggatttctgcgggttaataggtataatccaactgttagcttgtccctacttagtagtagcagttcaaagagaattagtcggttatatagcaggttgcgctatctggcgcctcgccaaagctgaattaataccatacaggagctccgcacacttgactcctgaaaagcaagcagacaacgatgtctatttgtccatggtgtattccgtactatccactccatttctatacttttcctacgactacgatcttacgcattccttgcaacgcttgcacggcataagccccgatttttggaagcaatcgttgtttgagcgagccgatcaaaggtttgtttggaatggaaacctattgtattcgttcaaaggattttcgatacacagattttgcctgcctctcatgcacggattcatttccataaatttctgcgtagtgaacgggcacagtttaaactggtcaattgttagtagaagaagcattcaacgagccggcaccagattacacagaagaggtttagataaagaaggaaacgtggctaatttcgttgaaaccgagcagatagtcgaatatcaaggcgatcgggcgagtttcgtgcaaatacgaggcagcattcccctgttttggcaacaagatcccgacctgagatacaaaccaccgcctactatactcgatgtcgatccacaagatcagcactcgatgtgtctaaagcacatgaacgatttaatgactttctacggaaaggtcgtttgcgtgaatctagtcgatcaaaaaggagcagaa

SEQ ID NO: 2352 - DNA, 730 bp, Phyllotreta armoraciae
tcgcaaataaaggctatcgaaaaaacgttcgaagataccaaaacgaccattgataagcattacagcaagccgaacgtagtccccgtggatgtcctgccagtttatccagatttcagtttgtggaaatatccttgtgcgcaggttattttcgattctgatccagctcccgtgggaaaacaagtacccgctcaaatcgaagagatgtctcaagccatgatcagaggtgtaatggatgaaagtggtgagcagttcgtagcctacttccttcccaccgaagagactctccaaaagcgcagggaagacgtcgcgaaccaagtccaataccaagatgaagaggaatacgaatacaaaatggccagagagtacaactggaacgttaagagcaaggcaagcaaaggctacgaggagaattacttcttcgtcgtacgatcgagcggtatttactacaacgaattagaaaccagagttaggttaagcaagcgaaggcagaaagtaggccagcccccgagcaacactcggctcatcgttaaacacaggcctatggatgctaatgaatttagaatgcaacggtacagggaaaagcagctggaacctacaggcgaggatgacgaagagatggaaatcgacgagccccaagacgaggaaaacgtgctcgagccggacaacgaaagccgcgacaaagaaaccgagagcgacaacgaaaagaaacgatccagagcttcctcagtat

SEQ ID NO: 2353 - DNA, 790 bp, Phyllotreta armoraciae
actcctttgcaaagaggtaggctggaagttggactcggccttgctgaaggccctcaaggccaagaatgccgaaaaggtcaagctcctggacgaagccatcgaggacgcggagaaaaacttgggagagatggaggtgcgggaggcttatttgcgtaaagcggagttttacagcaggatcggcgacaaagaaaacgccgtgagtaccttcaggcaaacttacgataaaacagtgtctttgggccaccgtttggacatcatatttcacttaattagaataggcttgttctttatggaccatgacctcatcaccaggaatatcgacaaagcgaagagcctaatcgaagaaggaggcgattgggacaggagaaaccgattgaaagtctaccaaggtgcttattgtatgtcggtgagagacttcaaaaccgccgctaacctatttttggacactgtgagcacattcacgtcttacgagctcatggactacaaggcgttcgtgagatacaccgtctacacttccataatcagcctgccgagaaaccaactaagagataaagtaataaaaggctcggagatactagaggtcctccactctgagccgttcgttaaagactacctgttttcgttgtacaactgccagtacgcggagtttttctcgaatttggccgaggtcgagacgattctgaggaaagactacttcctgaatcctcattaccggtattacgttagggaaatgaagatttcggcttacacgcagctgctggagtcctatcgatctctcacgttgcagtat

SEQ ID NO: 2354 - DNA, 762 bp, Phyllotreta armoraciae
acgatttggatgacagttcaacgacgcctccggtaaccccaccgttggcctcgaccagcaggggtatggtgtcgaagaagaagaatctcgagcttcaagcgcaaaaagaatccgtgatcgtcatgcacagtccggacgataacaaacagctcgaaataatggattacgacgacgacaacaatactgttctgtcttcagaagtttctttgagttcagcagctcgaaacgacgacgacttggtggaaatcgaaacgatatcgcaagacctcgccgaagggctatccagcccgttggaatccgatcaaatcggagacgaattcctgttgtttccaggcaatatggtggtggatatgtcaggcgaggggcattactcggagaaagaggaagaagaaaccgaggaattcaccgatcagaacatgcacatcgtgatacgcagcccgacgaccagcgacgacgagttcatcatgccgtgcaaagtcaagcagtacaacgaggacgagcaggaggacaatcccgaatcgccggatcaagaggaattcggcgaatcctccgacatgttgaccggttacgataacgaagaaaccgatattatcctctccgatcaaactaccagcgttcccgaagactcgatatccactaaagaggacttcgaggagctcatcgacgaggggtcacggaaaaacaacatcagcaaacaggaggtgaccgcgaaacacattcaggatttccacaggtacaccgaattgttcgattacggcaaac

SEQ ID NO: 2355 - DNA, 784 bp, Phyllotreta armoraciae
tctgttgaaattacggctgatgttccattcgtaaaagtcgaagggaaaaatgtgtttaggttcttttggtgggatgcttacgtggatccactatatcaacaaggaactgttttcctgtttggtaaaacatactgcgaaacttccaagaaatatgaaagttgctgtgtgcctgtaaagaacatagaacgaacaatatttgttttacctagaccttttgaactagatgagaacggaaagcccacagaaaaaccggtcacgtttaaaacagttcacgatgaatttaacaatcaggttttaaagcgaatgggcattacatctttcaaatcgagattgatcacgaaaaaattcgcattcgatccaagcgtaccagtcgaatccgaatacttagaagtcagatatcctgcttcatttccacggattttttgcaatgatgacgaggaccaaaaagacgatttaagtgacttcgatgatcccagctataaaactttttcaaagatattcggcataaaaacgagtttcttggaatcgctttttctcgaacgtaaaatcaaaggcccctgttggatcgacatatctgaccccgaacccgcaactaatccgatgagcttttgcaaattcgaagtaaactgtcttaaacctaccaacttgaaaatcacccaattcgagaaacctgttcctcctcctccgcttgtagttgccactataaacatgagaaatttcatcaatcgaggatcgtcctatcacgaaatcgtcatgatttcttgtttggtgcaaaatcgatacg

SEQ ID NO: 2356 - DNA, 678 bp, Phyllotreta armoraciae
tgtatgatttgggcggtaaaatgattgatagtattctaaaagaaaaagttcaatctggtgatgttataaccattgataaagctacaggaaaaattacgagattgggcagatcttttgctagagctagagattatgatgctactggccaacaaacgagattcgttcaatgtccggaaggtgaattgcaaaaacgcaaagaagttgtccacacagtgactttgcacgaaattgatgtaattaacagtcgcactcacgggttcttggcactcttttcgggtgatacgggagaaattaaatcagaagtaagagagcagattaatggcaaagtagccgaatggcgtgaagaaggcaaggctgaaatcataccaggcgtactctttattgatgaggttcacatgttggatatagaatgcttctcctttttaaacagagctttagaaaatgaaatgtctccaatcgtcataatggccaccaatagaggaatcacgaaaattcgaggtacaacttacaaatctcctcacggcataccattggacttgctggatcgaacaattattgttcctactcagccatatgacgaaaaggaattgaaagaaatattaaacattcgatgcgaagaagaggactgtcaaatgtctgataatgctttagtggttttaacgaggatctgtaaggaga

SEQ ID NO: 2357 - DNA, 768 bp, Phyllotreta armoraciae
tcttcgactcttcagaggatccctatacaaaaagtaccctggaatgttcaggaggtctataaccaatgaagaaagaaggaggttgattgaactcggtttgagccagcacgttctagcgagtagcgtatcactgcttagagcagaagaagttgaagatataattgaaggaaatgatgaaaagtataaagctgtatctgtacacacttctgaacctcctatgccaagagaaggaaaatccaagaaaaacatgcagtgggtaccttcattacccaattccagtcatttagatgccgttccgcaagctacacccattaacaggaacagagtagctgctaaaaaggtgagaacatttccactatgttttgatgataccgatccccaattaaacatagaaaacgcttgtcaacaagaattgctagttcctattagactggatatggaaatcgaagggcagaagctcagagatacatttacttggaataaaaatgagagtttaataacgcctgaacaatttgctgaagtcctctgcgacgatcttgatttaaatcccttaacttttgtaccagcgattgctcaagcaattagacaacaactcgaagcattcccgacagaacctcccagtattatagaggaaacctgcgatcaaagagtcattattaagttaaacattcacgtgggaaatacttctttagtcgatcaagttgaatgggacatgagtgaaaaacagaataatcccgaagaatttgcgttgaaactttgcgcagaatt

SEQ ID NO: 2358 - DNA, 417 bp, Phyllotreta armoraciae
cttacactacgggcgaatttccagaggaatacataccgacagtatttgaacattatggacaagaaattacggtcgatggtacacattacaatatgactttatgggacactgcaggtcaagaagattatgaaagactaaggcctctatcttatcccaatacaaactgttttctagtttgtttttctgtggacaaaaatctagcctcctacgacaacgtatggttgaaatgggtaccagaagttcggcattttaacccaaacgtgccgattatattagtagcgaccaaaactgatctaagagacgatccgagcctggcttgttactcgaccgaggaaggcaagaagttgaaaagaaaagtcagggcgcaatgctacatggaatgctcggcattgaggtaccaaggactcgaggaaattt

SEQ ID NO: 2359 - DNA, 788 bp, Phyllotreta armoraciae
atgcagcattttcaaaagctgtcgaaatattaaaaatgacacggacaattcaaaacaacgatgaaaaggaggagatgatccaatcggctctgcagatttgcaaatcaatcggccccactattaatataactgatatatgcaaggaattcgctaatctcaaagcgtataaagctgttacggaattgtgtgcgcatttcggcaagaaaatcgatccggataaaatagcagaaagttactataacgcggaagacaacagtggtgaccaagaagggtacaattattatcaaagaaggttggaaatttatcgtcatattttaaatatgttggatcaattatacaacgaacaaaatcaaacgcaagtcgttagtagagatccagcatactcagttaatcagaccatattactggatggtgtggaacagtctcaagtaggatatgtgatgaagcaagtaataaaagacgttatggaaacgcccgatgaaattatgcacttcgccctttacgattggctagtattcaagaacatgactggagatttgataaacatccaaaatccgtctttggaaacgtatttgaaacgaacatccacccagaaccccaacaacatcgaggccatgaatttgttatggaaatactatgaaagttgtaacaaccacgcggccgctgccaaaattttgaacaacctcgcctcaaggactggcataaacgttcctttgaaagagagactgtcttacctggcgagagctatcatgtgcatgcgaagcgataaaataggttatgcgccgtat

SEQ ID NO: 2360 - DNA, 792 bp, Phyllotreta armoraciae
tcttaggcacctcgttagtagcccaaagttttcgacaacaagctgaaatcagatttcaaatttgccgcaatttgttgctcctatgcaacttcttggtgatggacaggacgttgaacgggggcgttttggaaggggttcgatcggtctgtatgccggatattgtcgttttaacccaagccagtttcgtcgtgctctggctaagcggcttgacgatgttcgaaagtgactcgattcgggattcttcaatgagcacgctgaatccgttaaaattaacgcccgtttacaatctgttgccgttcactcgttgcacgtctttattggaagtgtttatatcttcatcgggcgttcaagatgccaggaaatcgttcgctagagtctcttgcaaagacgaagccttggctcgttggcattggtctctgttgccctacgtgaatcacatcaggcatcttatttggcccataagcgggtgtacggtgttcgaggaatggctcttatcgagtggccagcacgtgtggctgcagcagtatgttcggttactcagcaattggtgcgaatggaacgtttgtacacgaaacttcttattggcctcgtcgtttctgacttccggcgaattttacaaggccgaagagctcttcgaaaccgcgtcgaaaggcgtttttaccgacacgtttttgaaaaacagaatcaaaagtgtcgatgaaaataatattagaaccactattcattattatttaaaggtgatccaattattcgagttgtgtaacgctagaagtcatgtgattaatgtggcca

SEQ ID NO: 2361 - DNA, 686 bp, Phyllotreta armoraciae
tgctctccgttgatgttaaagcgctacaaagccaagaagacagcgaagctggtgtattagaacagctgaaatcacaagtgtgcgataacgtagctttatatgcccaaaagtacgatgaagaattccagccgtacttgcctcagttcgttacggacgtttggagcttactagtcgctacaaatttacagcccaaatacgatttgttggtttcgaacgccctgcaattcctttcgtctgtggccgaacgttcgcagtacaggaacctcttcgaggacgataacgtactgagcagcatatgcgagaaagttattataccaaacatggaattcagaacttccgatgaggaattgttcgaagacaacccggaagagtacacgagaagggacatcgaaggctccgatatcgacacgcgcagacgagccgcctgcgatttggtcaacacattgagtcagaacttcgagcagagaatcatagaaatattcgggcgttatttacaagtgatgctggcgaagtacgcggagaatccgaagcagtattggcgcagcaaagacgccgccttgtacttagtaacgtctctagttagcaggggctctactcagaagcacggggtcacgcaaaccagccagttggtggacattacgcagttctgtcggcagcacattttgcccgaattagaacgacctgat

SEQ ID NO: 2362 - DNA, 450 bp, Phyllotreta armoraciae
cgagtgcatagaggaattgaaagaagatttagaatggaagatgatttacgtaggttccgctgaaaccgaagaacacgatcaaatcttagactctgtgtttgtaggacctattccagaaggtaaacacatgttcgtctttcaggccgatcctccgaacgtctcccgtatacctgaaaatgatgccattggtgtaacagttgttctgctcacttgctcctacaagagtcaagaatttattcgtgtaggttactttataaataacgaatacagcgatccggaaatgagggaaaatttgcccagcccacctcagttcgataaggtaattagaaatatattggcgtcagagccaagggtgacgaggtttaaaatcaattgggaagaatcaagtggcactcaggaaaacggaaccacaattgccgaagcacccgctaaccaaacaaccgaaacttc

SEQ ID NO: 2363 - DNA, 657 bp, Phyllotreta armoraciae
cagcaacaacaaagtctacctactactaactcacaagtgcctcctctagctccaatgggaggttctactccaacacttggtctaggtttaggccatgctatgtccatgccacatacgaagtatgtaactggattttcactgcctatcagttctatgactcctcaaacaccacaacatacaatgatgagtcctatggtaaatgtaggtggaactggtaccactagttccggtgtaacgcctacgttaggtccctctacaccttcaccaatgactcctatgacaccacactcggcagatcctggaatcgttccacaattacaaaacatcgtctcaacagtaaacttgagctgtaaattagatttaaagaaaattgccttgcatgcgagaaatgccgaatataatcctaaacgttttgctgctgtgattatgagaatacgagagccgagaacgacagctttgatattttcgtcgggtaaaatggtgtgtacgggtgcgaaaagtgaggaagactcgaggctagctgcgagaaagtatgctcgaattatacaaaaattgggattccctgcgaaatttttggatttcaaaatacagaatatggtgggaagttgtgatgttaaatttccaatacgattggaaggattggttctgactcacagt

SEQ ID NO: 2364 - DNA, 425 bp, Phyllotreta armoraciae
aagtcccttttcaaagctcataaaatggctgcaattcgttccatgtctcgcctgttattctccagatcattacaaactactgtaaaaaggggttacgctgatcaaatgagcttcacttttgctgctggaaatcaggtcttctatgacgcaaaatctataaaacaagtggatgttccttctttctccggtagcttcggtatcctcccagctcatgttcccactcttgctgttctgaaacctggagtagttactgtttacgaagacggcggtgcagtcaagaaaatttttgtatccagtggtacggtcactgttaatgacgattcatcagttcaaatcttagctgaagaggcccacccagtagaaaatttagatgttagtgcggccagagatcttcttaacaaagcacaaagtcaattgtcatcggc

SEQ ID NO: 2365 - DNA, 693 bp, Phyllotreta armoraciae
cttttgtgaacttcctgagcagaaaaacggactttttcacgggcggaaaggaaggagaatgggaaaagctagtattgaatacgttcaagaaatacgagaagtcgagcagggaacaacacgctgccgaattgaaagagaaactcgagcaggaagcgcgtaggaaggcgaaaaaagaggccgaatcggccaaacaggctcaaataaccgaattaacggacgaacaagcggagaaactacaagccgaactcaacgctaaaaagtccccctcatcggcagccccttcgaatagctcaaatactccttcgacttcgaagatcgaagaagacgaagacgagtccgagaagggtaaattattaccgaacaaaggaaacggctgcgatttagaaaaatacaattggacacagacgcttagtgatatagagctgcgcgtgccgctcgaatgcgatttcagagtaaagcaaaaggatctcacggtgaacataactaaaaagcacctcacctgcggcctgaaaggccgtccgcccatcatcgacgacgatttccagcacgagatcaagctggaagagtccaattgggtcatcgaggacgggaaatcgctgctcttcgccatagagaaggtgaacaaaatgaattggtggagcaaaatcgtcaagtccgatccggagattagcaccaagaaaatcaatccggagc

SEQ ID NO: 2366 - DNA, 336 bp, Phyllotreta armoraciae
gcgatagagaaaggtggatttgcgtttatccagcgtacattaattgcaaaaaaaccatagcccaaggcaggaaattaaacaaagaaaaatgcgtggagaaccccactcatcaagagatcagagacgttttggtcgcagcaggtttgaaggttggcgtagaaaataaattgtacagcagggaacgaagcaaagaattgttgtatcgaggacgaattagagttcaattgaaaaacgacgatggtacactgtgcaatccaaattttgctaccagagatagcataatgctccatttgggagacatgattcctaaattaaaaagtagacaaaacaagggca

SEQ ID NO: 2367 - DNA, 776 bp, Phyllotreta armoraciae
aacaagcttggcaaacttacattaatttcgaactgagatacaaagaaattgatagagccaggcaaatatacgaaagatttgttataacgcatccggaagtaaaacattggattaaatatgcccgtttcgaagaaaatcatggttttattcattctgctagacagatttatgaaagagctgtacagttttatggagacgatcatttggacgaaaagctttacatagctttcgccaaattcgaagaaaaccaaaaagagcacgatagagcgagagttatctacaagtatgctctagaacacattccaaaggatgaaacgaaggaactgtataaggcttataccatccatgaaaagaaatatggagacagaagcggtatcgaggaagttataatgtctaaaagaaaactgcaatacgaacaagaaatactccaaaatcccaccaattatgatgcttggttcgattatctcagattggtagaaggtgaagcagatttggaaacaacccgagaaacctacgagagagccatcgcaaacatacctccatcaaaaaacaaacaatactggagaagatacatttatttatggatcaattatgctttattcgaagaacttgatgcaaaagattatgaacgaactagacaggtttataaagcttgcctggaaatcctgccgcacaaaacattcacattttccaaaatttggctgctctatgcgcagttcgaagtgcgacagaaaaatttaaaagcagcccgtaaaattctaggcatgtccatagga

SEQ ID NO: 2368 - DNA, 682 bp, Phyllotreta armoraciae
gacgatcatatggaaggctttctcgccggctactgtcaatactggaagaggaaccgaattcgaaggagctgttatcgccttgttccacttgctcaccaccagacaggataagattagaggattacgagaggctttctaccgtcagaatcttcctaatttgatgaacctcctagcaacagttttagtgtttgctatagtaatatacttccaaggttttagagtcgatttgcccattaagagtgccagataccgtggccagcattcgagctatcccatcaaacttttctacacttctaacattccgatcattttgcaatctgctttggtatccaacttgtatgttatatcccagatgttggccgttaaatttcaaggcaacttcttcatcaatctcttaggggtgtgggctgacgttggaggcggcggcccggctaggtcttacccaatcggcggtttgtgctattacttgtctccgcccgaaagcgtaagccacattttggaagatcccgtccacgctgttatgtacattattttcatgttgggttcttgcgctttcttctcgaaaacgtggatcgaagtatccggcagttcggctaaggacgttgccaaacaacttaaagagcaacagatggtgatgaggggtcacagagaccattctatgatacacgaactcaaccgatac

SEQ ID NO: 2369 - DNA, 342 bp, Phyllotreta armoraciae
gcaggacaagttattaaggctttctacgacgttgtatgtaggaaacctatcattttacaccacagaagaacaaatttatgaattattttctaaatgcggcgacattagacgaatcgtgatgggtctggacaagtataagaaaacaccttgtgggttttgtttcatcgagtattacactcgcaatgatgcggagaattgtttaaggtatattaacggtaccagattggacgatagaatagtacgtacagactgggatgcgggttttatagaaggcagacaatacggaaggggaaaaaccggtgggcaggtaagggatgaatacagaactgattttgactccgg

SEQ ID NO: 2370 - DNA, 665 bp, Phyllotreta armoraciae
aatttaaccaccatcggtcagatcggctcttattcgacggccaaagaatggactagaggtaaaaaagcactgttaggaacattagggatgttagcaggcggcacgggtgccgtattaattgctctcgaccaatccgttaaagcatcggaactagaactgcacccgccgaagaacatctggagccacagcggaatattcagctcgttggaccacgctagcgtccgaaggggtttcgaagtgtacaaacaagtctgcgccgcctgccactcgttgcgtttcgtagcctaccgtaacctagtaggagtatcccacacggagctcgaagcgaaggccgaagccgaggaacagatgatccaagacgggccgaacgatgtaggagaaatgtttatgcgtcccggcaagttatcggactacatccccagcccgtaccccaacgaggaggctgcccgtgcggccaacaatggcgcttacccgcccgatttgagctacattacagctgcgagacacggagccgaagattatatattcgcgcttttgacgggttactgcgaggctccggcaggtgtggtgctcagagaagggcaatattacaatccgtatttccccggaggtgccatttcgatggctcaggctttgtataacgagacgattgaatacggagatgg

SEQ ID NO: 2371 - DNA, 698 bp, Phyllotreta armoraciae
tcatcttctgttatcagccggaatggactgtcgtattaaaatttgggaggtctacaatgaaagacggtgcataaggacctactatgggcatcgacaagctgttagggacatcaatttcaataattccggaaagcattttctttctgccggttacgacaggtatatcaaactgtgggatacggaaacaggtcaggttttgtctcgcttcaccagcagaaaaataccctattgcgttaaatttaaccctgataagaacaaacaacatttgtttgtggccggtacatcggataagaagataatttgttgggatacgaggtcaggggatatcgtgcaggagtacgataggcatttgggtgctgtcaatagtattacatttgtggatgaaaatcgacgattcgtgaccacatcagacgataaatcgttgagagtatgggaatgggacattcccgttgatatgaaatacattgctgatcctacaatgcacagtatgccttcagtaactccagcaccaaacggtaaatggttagcttgtcaaagtatggacaacaaagtggtcatattctcttccatgaatagatttaagattaatcgtaaaaagacgttcagcggtcatatggtggccggttatgcatgctccttggacttttcgcccgacatgagttacctaacatctggagatgccgatggtaaagtttaca

SEQ ID NO: 2372 - DNA, 655 bp, Phyllotreta armoraciae
caaccccttattcgaaaagcgacccaggaatttcggaataggccaagacatccaacccccgagggacttgtcgaggttcgtgaaatggcccaaatacatccgtatccaaaggcagaaagccgtcttgcagaaacgcttgaaagttccgccgccgatcaaccagttctcccaaaccatcgacaaacaaacggccactcaattattcaaagtattggagaaataccgaccggaaaccgccttgcagaaaaagaaccgactgaaggccaaagccgaagctaaagtggccaagaaggaagaggccccgactaaaagacccaacactttgagagccggtactaacacagttaccaaattggtcgaacagaaaaaagcccaattagtcgtcatcgcacacgacgtagaccctattgaattggtactcttccttcccgcgctttgcagaaaaatgggagtcccctactgcatagtcaaaggtaaagccaggctagggttgctcgttaggcgtaaaacttgcgcgactgtcgctcttacgcaagtcgattccggagacaggtccaacttcaacaaactcttggaggttatcaagaccaacttcaacgaccgtgccgatgaaatcaggagacactggggaggcggtatcctcggttcgaaatca

SEQ ID NO: 2373 - DNA, 697 bp, Phyllotreta armoraciae
cttttcgaaaagcacatcgacttcataaaggaatacggtcaaaaggaaaacaactttgaatatgcaatgaccgactatttgaggatatccggcatgtattggggcctcacggctctcgagttgatgaatgcctcgcctccgcacactatagaagagatttcagattacatcaaacattgtcaagaccccgaaagcggtggaataagctcttgcctgaaccacgaccctcacatactccacaccttgagcgccgtccagatactgtgcatgtacgacaatttaaaagccatcgacgtggagggcgtcgtgaaatacgtgaaaaacctacaattacctgatggtagcttcacgggagacaaatggggcgaagtagacacgagattctcattctgcgccgtcgccaccctgtcgctcttgaacagaatggacgctattgacgttaataaagcagtcgatttcgtagcttcgtgtaaaaacttcgacggaggcttcggctcgaggcctctttccgaaagccacgccggtttaatatactgctgcttaggatttttgtctgttaccaatagattggatattgtggatcgagacatgctggcttggtggctgtgcgaacgacaactaccttcgggcggtttgaacgggcgtccggagaagctgcccgacgtctgctactcctggtgggtgctttcttctctaa

SEQ ID NO: 2374 - DNA, 668 bp, Phyllotreta armoraciae
accaaggctaacttcgatttgaccaccgaaagaaattacattatggaggttgtttgcgaagctacacaatcgccggtgtcgcaaattaaggtggccgctttgcaatgtttagtgaaaataatgtcgctgtattatcaacacatggagccctacatggctcccgctttgtttcccataacgttagaggccatgaaatccgagaacgatgccgtcgccctgcaaggtatagaattttggtcaaacgtaagcgacgaagaagtcgatttggccatcgaagatacggaagctgccgaagctggaagaccccctacgagagtatcgaggcattatgcgaaaggtgctctgcagtacataataccgattattcttcaaaaactaacgaaacaagaggaattggacgacgaggacgattggaatcccagtaaagcggccggcgtttgcctcatgcttcttgccacttgctgcgaagacgaaatcgttccgcatgtgctgccttttattaaagaaaatatcaagtcagacaattggcgtttccgagacgcttccttgatggcattcggttctattctgggcggattggaaccaaacactctgagaccgctcgttgaacaagcaatgccgactttgattgaattaatgtacgacaacagcgtcattgtgagagatac

SEQ ID NO: 2375 - DNA, 775 bp, Phyllotreta armoraciae
catcgaataccttacgtggttcgtgcaacgcatcaggcctctgatggatctcgatagcgatttacaggaacaagtcgatcaggcgatgggtaattgggataacggaacggtgcccgggtggccgaaagaaacaggctcggctttggccaacgtgggcgcccatttggacctatcggccttctccagttgggaggaattggcttcgttgggcttggatcgtttaaaatcagccctcatggcgctaggattgaaatgcggaggaacgttagaggagcgagcccaaaggttgttctcgacgaaaggcaaaggttctctggacccttcgctcatgacgaagaacagcaagaaccgagtgacgaaggagaaggaagcgctcaggcaaagagaactggccacgttagaagcgcaaatttacagattggccgatctggtgtcagcccaacgagcagccaccaaagagaacgtgcagaggaaacaagcccgtacagacggcgaacgggacgacagcgagaacgaagaaagcgaagaagagagccccgacgaggccgacgacgacgtgccctacaaccccaagaacctcccgctcggttgggacggtaaacccattccgtattggctgtacaaattgcacgggttgaatataagctacaattgcgagatatgcggtaactacgtgtacaaaggccccaaggcttttcaaaggcattttgccgaatggagacacgcgcacggaatgcggtgtttgggcataccgaatacggctcatttcgctaat

SEQ ID NO: 2376 - DNA, 562 bp, Phyllotreta armoraciae
gtttatcggcaccttcaaagctttcgacaagcatatgaacatgatactcggcgactgcgaagaattccgaaaaattaaacccaaaaactctaaagtcgaacgagaagaaaaacgggtattaggatttgtattgctgagaggcgagagcatagtctcgctgaccgtagaagggcctccaccaccagaagagggacttcccagagtacccattcccggagcagcccaagggccaggtataggaagagcagcaggtaggggaatgccacccggcatggctggagttccagtaggtctccaaggtcccgtgagaggagtcggaggaccgtcccagcaagtaatgacacctacaggtagaggacaggtctcagcgccgccacaaatgaaccaagcgcctccaaggatgggtggccctccgcctggcatgatggggcctccgcccggcatgatgggcatgccgccccaaatgggcatgggccgtggagggccccctccgatgggcatgaggggtcccccgcccggtatgatgagaggcgggccgcccggaccgccgagaccttattaa

SEQ ID NO: 2377 - DNA, 270 bp, Phyllotreta armoraciae
acctgcgaatagtgactctatgttcttcaattataaacaatatttttcaatggtgctttttgcaatggttgatagcaattatttatttacatttgtcgacattggctcatatagaaaatctagtgactctggaattttcaaaaatttcgcactatatgaaaaaatgttaaatggtacactgaacatacccacagcaacgcccatcgaaggagatttggtagaatatccatttgtaatcgtaggagatgaagcctttcccctatctgaaaa

SEQ ID NO: 2378 - DNA, 762 bp, Phyllotreta armoraciae; identical to SEQ ID NO: 2354

SEQ ID NO: 2379 - DNA, 721 bp, Phyllotreta nemorum
aagaagaagtcgatgctgttgaaatgcacgaaccatatacttacctcaacggtttgcaaatcaaagacctagaagacttagtcgaggacatcaaagtctacaaagaactagaaaggggaaaaaacctagactactggaacgatataaccgtaatagttgaagacgagcttcaaaagcttagaaaaatagaaaaacaaaacgatttcgacttgggattgaaccgaagggaagggatacatcaatcagtcgctaccgatgtaacttcagtatttaaaggcaaaacagccgcacaattagctgcgctagaaaaacaaatcgggagtaaaattagcagcaaagccgatggaatagacataggctactgggaatctctactgtcccaactcaaagcccacatggcaagggccagactacgggacaggcatcaagatagcttgagaaggaaactgcaggttctaaaagccgaacaagccatcacaggagtaggtaaaactcacagcgaaactcattcaaccgataacgaagaaaccactatggaacctaaaccaggcacgtcccaggattccttggaaacgatggaagaaagcaacgaaaaaagcgaagacgctgcccatgcgtggctaagcgaatgcttttcggcataccaagcaggcgggtacagccccaagtttttaactccggacgataccgagcccggcacgattgtagtctcggaggaaga

SEQ ID NO: 2380 - DNA, 651 bp, Phyllotreta nemorum
gcgaagtaggccaagtattatccttcaagctggtctttgaccgcgaaacgggcaagcccaaaggctatgggttctgcgaataccgagaccaagagaccgccctcagcgccatgaggaatttgaacggttacgaaataggcggcaggaatttacgcgtcgacaacgcctgtacggaaaagtcccgcatggaaatgcaaaacctcctcaaccagccgcccatcgagaatccctacggagaacctattcaagccgaaaaggcgcccgaggccatcagtaaagccgtggcttcgctgcctcccgagcagatgtttgaactcatgaagcaaatgaaaactaccatacaaaataatcccacagaggctagacaaatgttattgcagaatccccagttggcttacgctctattacaagctcaagtcgtcatgaagataatcgatcctcacacggctgccagcctactacaccctgtcaatcaagtaccggccactctgctgccgggcgataagaacgtgaccgtacaagtaccgatcggcaaccagtaccgggaacctccggctccggtacaagcacctcgacaggaataccagccggtaccgccgcccgccgtccatccaaatcacgttcaacaacccgtttttaccggtcaagatg

SEQ ID NO: 2381 - DNA, 661 bp, Phyllotreta nemorum
gaagcaactgacagaagagaaattcattgtaaaggcgacaaacggtccccgttatgtagttggctgccgtcgtcagttggataaggccaagttaaaggccggcacaagagtagctctcgacatgaccaccttaaccataatgcggtacttaccgagagaagtcgatcctttagtgtacaacatgagccacgaagatcccggagatgtcacttattccgccataggtggactttccgagcagattagggaactacgagaagtcatcgaattgcctctcatgaatcctgaattgtttatgcgagtgggcattacaccaccgaaaggttgtcttctctacgggcctcctggaactggtaaaactctgctagccagagccgtagcttctcaattggacgcgaactttttaaaggtcgtatcgagtgctattgtagataaatacataggtgaatctgctaggcttattagagagatgtttaactacgccaaagaccatcagccttgcatcatttttatggatgaaatagatgctataggtggtcgtaggttttccgagggtacatcggctgacagagaaattcaaaggacacttatggagctgctgaatcaaatggacggatttgactcgttaggacaagtaaaaatgattatggcgaccaatagg

SEQ ID NO: 2382 - DNA, 654 bp, Phyllotreta nemorum
gtatcaagtcgagtatgccatggaggccatatcccatgcaggaacgtgtctaggcatcctggcaaacgacggaatccttcttgccgcagaaaggcgtaacaccaacaagcttctggacgaagtttttatttctgagaaaatatacaaacttaatgatgatatggtttgcagtgtggcaggaattacctctgacgctaatgttctaactaacgaattgcgtttgatcgggcaaaggtacttgtatcagtatggggaatcgattccctgcgaacaattagtttcgtggttgtgcgatgtaaaacaagcttatactcagtacggaggaaaaaggccttttggtgtatcgatcttgtacatgggctgggataagcattatgggtatcaattgtaccaatccgatcccagtggaaattattccggttggaaagcgacttgcataggaaacaacagttctgctgccatttcgagtttgaaacaggaatacaaggaaggcgatatgatgttgaaggatgcgaaaagtttggctgtaaaagttctggcaaaaacgttagatatggctaaattgacgtctgaaaaagtggaaatggctacgctgacacgtagaaatgataaaaccatcataaatatattgaatagcaaagaagtggaagaact

SEQ ID NO: 2383 - DNA, 733 bp, Phyllotreta nemorum
tacttcacatttgctccgaacattacgatggcgacagctcagacaagagttctaaggataaggacaaaaaagacgcttcagagaaggagaaagatctttcctcgagacaagcagtggccgtgctgggtatagctttgatcagcatgggtgaagacattggtagcgaaatggcctaccgtaccttcgggcatttgctgcgctactgcgaacccgtaattagaagagcggtaccgttagctttaggactcatttcagtatcgaatcctaagttgagcatactcgatactttgagtaaattctcgcacgacagtgatgctgaagtagcccataacgccatatttgccatgggtttagtcggagctggtacgaataacgcaagattggccgcgatgttgaggcaattggcgcagtatcacgctaaagatcctaacaacctatttatggttcgtattgctcaaggtcttacgcatttaggtaaaggaacattgacgctgagtccttatcacagcgaccgtcagctcatgagccctgtagcagtagcaggattaatggctacccttgttggatttttggatgttaaaaatattattttgggaagatcgcattatctcctatacactctagcagcggctatgcaacctaggatgcttgtgacatttgatgaagatttgaatccattgccggtgcctgtgagagtgggattggctgtagatgtagttggtcaagctggtaa

SEQ ID NO: 2384 - DNA, 654 bp, Phyllotreta nemorum
acataaacgtccttcaagctgattcgactcaagctttcgcaggtccttacataaacgcgacctggtcgtcgaattcgatggaggacggacggcaatctagtcaagaggtactagtgaaagagtgcgttaattgtggtgctagcgttacaccactttggcgtagagacggtacggggcattatctatgtaacgcgtgtggtttataccacaaaattaatggggtgcacagaccgccgactaagccaaccaaaaaaccacaggcgaccggaaatagaagaaacggcgtaacgtgcgcaaattgcaaaactaacaacactacactttggagaagaaacaaccaaggcgagccagtctgtaacgcttgcgggctttactataaattacataatgttaacaggccgatcagtatgaaaaaagaaggtatccaaacgcgcaaaagaaggcccaaaaactcttcggttggaaaccctgccagtgctgcaggtcaagtaagaatggggcttccctcttatcaatatcaagatattgaagtacagcaggatcagtaccaattaccagtgagcgtttattctcaaagaccacaagtatcttatcgacattacggggcagaaaatattggaactataaatgcacaaccactgcagccaattatta

SEQ ID NO: 2385 - DNA, 710 bp, Phyllotreta nemorum
aaagtgagctatgagcacaaggagatcgccttggataatctgctgcagctgtggagggtgccggggttccacgcggagctctacgtgaactacgattgcgacatgtactgcgcgaatttgtacgaggagcttacggagctgctggccgaacgggctgtttctaatgtgggagtgtatcactctcatttgctgtcgcttgatgggcttttgattataattgacgggatagggaagagatttgacgaagcgaaggatcgatcagataccgatgagattagcagttatactggggaaaatacgagagttaaaggttgtgttagagctcctgataagaaggttttggctgccaagaaagggattaaaaaatggttgccccaaggtacggagtatttcaatcagaagccgaagaaaggtatacagttcctgcaggagcacggcgttttgaagcaggagctggacgtcgaggagatcgccagatttctgagggagaatcctgcgttgaacaaggcgatgatcggggagtatatcagcaatcgagggaatttgaagatactggaggcttttgtgggcacgttcgatttcacagggatacggatcgacgaggcgctcagagcgtttttggagacgtttcgattgcctggtgaggctccgacgatttcgctgatccttgaacatttcgccgagcattggcataaaagcaacggagaacc

SEQ ID NO: 2386 - DNA, 525 bp, Phyllotreta nemorum
gtcgattttggcgtacaacgggggcgcgatggtggccatgaagggcgagaactgcgtagccatagcggccgaccgccggttcggcatacaggcccaaaccgtcgccaccaacttcgagaaagtcttcgaaatgggcccccacctcttcgtcggcctccccggcctcgccaccgacacccaaacggtcatggagaagctcaggttccgcaagaacctgtacgagttgaaagagaaccgccggatctcccccaaggtgttcgcggccatgatatcgaacatgttgtacgagaagaggttcgggccgtttttcgtggaacccgtggtggccgggctggcgcccgacacgttcgagccttacatatgcaacatggatttgatcggttgtattaacgagcccagcgatttcgtcgtgggcggcacggcgtccgctcagctgtacggaatgtgcgagtcgctgtgggagcccaatctcgcgccggaggacctgttcgaaaccatatcgcaggctttgattaacgctttcga

SEQ ID NO: 2387 - DNA, 756 bp, Phyllotreta nemorum
tgctcgaaaaaggagatgaatttaaagattttaggatgaaagtctccgatctaataaaggacgtcgtctttatagtaggtagcagcagttgcttcagacaaatgtttatcaatttgcaaacccctggtgtaacgtgggatgccagcgaagccgctctctttgtgatgcaggctgtagccaaaaacgttctacccacggaaaacgaagttgttcctaaagtcgtcgaagcaatactgaacatacccagcagcgcacacgtcgctgtgaagtacacatctgttcttctactgggcgaactggccgaatggatagaaaaacacccggacgctttggatcccgtcctgaatttcctagtttgctgcctccggagcggcgccgaaggaggaggcgtcgccacggcggcggcggcggcgctgcagaacgtgtgcacttgctgtggggctcacatgggcaggcacgttcccattctgttacagttacttcaacagtcggattcgttcggtatcggcaacacggcgatcataggattattgaagggcgtcgcgtcggtggtgagctgcggcattggcagcggcgccgaaacggcttccgccgtacgggaattgtgctccttgcaattgtcgccgctgtgcagtttgatcgaaaacggcgttcgacccgttaagggaactctaacggatccggtgctgtggttggatcgattgagttcagttttgagatacgtcaatgtcaatgtagttgaaggggaaatccatc

SEQ ID NO: 2388 - DNA, 784 bp, Phyllotreta nemorum
cgatgaagcagaaacgaaaactgcgaatttttatttccaacactttctacccggcgaaagagccccaacccgagggccccgacggcccttgccaagaaggcacggtagcctcctgggagctcagagtcgaaggcaggctgctcgaagactccaagaacgatccgaacaaagtcaaacgcaaattctcctcgttcttcaagtccctcgtcatcgagctcgacaaagaactctacggccccgacaaccacttggtcgaatggcaccgaacgctgaccacccaagaaaccgacggtttccaagtcaaaagacccggcgacaagaacgtgaggtgcaccatcctgctgctcctcgactaccagccgctgcagttcaagctcgacccgagactggcccgattactcggggtacacacccaaaccagaccggtcattatttcggccttgtggcagtacatcaagactcacaggctgcaagatggccacgagcgcgagtacatcatctgcgacaaatacctcgagcagatcttcaactgtactcgaatgaagttcgccgaaatcccccaacggttgaaccccctgctgcacccgcccgatcccatcgtcataaatcacgttatatcggtcgaaggcggcgctgagagcaagcaaacggcctgctacgatatcgacgtcgaagtggacgatactctgaagacccagatgaataatttcctgttgagcacggccagccagcaggagattcagggattggacgcgaagattcacgagactgtcgacacgataaa

SEQ ID NO: 2389 - DNA, 685 bp, Phyllotreta nemorum
aagttcagccgattaccaataccaaatgttaaggtgcaacgtagacttactgagaattattcaactaggtttaacgttcttagacgataatggcaaaacaccgggaggagtttataccacctggcaattcaattttaaattcaaccttcaagaagacatgtacgcacaagatagcattgatttgctgcagaattccgggatccaattcaagaagcacgaagatgaaggtatcgaaccgctagaatttgccgaattactaatgtcctctggaatcgttcttatggaaaatatcaaatggttatcgttccattccggctacgatttcggctatttaattaagttactaaccgacaacaatctcccgcaagacgaaaccgaattcttcgatctgttgaaattgtactttcctaccatatacgacgtaaagtatttaatgaaatcgtgtaaaaatttaaaaggtggtcttcaagaggtggcggaacaactggaattggaaaggatcgggcctcaacatcaagctggatctgactcgcttttgaccttcgatctattgaaattgtactttcctaccatatacgacgtaaagtatttaatgaaatcgtgtaaaaatttaaaaggtggtcttcaagaggtagcggaacaactggaattggaaaggatcgggcctcaacatcaagctggatct

SEQ ID NO: 2390 - DNA, 678 bp, Phyllotreta nemorum
ttacggacagcatgttgttagcggtacacccggaagagtttacgatatgattcgtagaagagctttgaggactagatcggtgaaaatgctggtcctggatgaagccgatgaaatgttaaataaagggtttaaagaacaaatctacgatgtgtacagattccttccaccctccactcaagtggttttaatatcagctaccttaccccacgaaattctggaaataacatccaaattcatgaccgatcccatcaggatcctagtaaaacgtgatgaactgacgctggagggaatcaagcagtttttcgtcgccgtggaaagggaagaatggaaattcgacacgctctgcgacctctacgacaccctgaccatcacgcaagccgtcattttctgcaacacgaagagaaaggtcgattggctgaccgaaaagatgcgagaaaacaacttcaccgtgagctccatgcacggggacatgccccagaaggagcgcgacaacatcatgaaagagttcaggtcgggccaaagcagagttttgatcaccaccgacgtttgggccaggggtatcgacgtacagcaggtttctttggttatcaattacgatttgccgaacaatcgtgaattgtatatccatcgaatcggtcggtccggtcgattcggcaggaagggtgtcgctatcaattt

SEQ ID NO: 2391 - DNA, 678 bp, Phyllotreta nemorum
tactgtggaagataccgagttgattgagggtatcgtgttctcgcagaaatcagccaatgtatcaggccccaagaaaatcgaaaaagccaagattggtttcatccaattctgcatttctcccccgaaaaccgatatggaccacaatgtcatagtatccgattacgctgcgatggatcgagtcctgaaggaagagcgagcgtatatcttgaacattgttaaacaaatcaagaaagccggttgtaacgtactactggttcagaaatcgattctcagagatgccgtatccgacctggcactccactttttggataaaataaagtgcatggtcatcaaggatgtcgagcgagaagacgtcgagtttgtgtgcaaatcgttgggttgcagaccgatcgcttccctcgatcatttcaccgccgaaaatctagtaacagccgatttggtcgaagaagtcggggtgggcggtaaccgaatggtcaaaatcacaggtattcaaaacgctgggcgtactgtgaccctgctcgtaagaggctcgaataaactagtattagaggaggccgagaggtccctgcatgacgctctttgcgtcattcggtgtcttgttcgcaagaaggcgcttatcgcaggcggcggggcacccgagattgaagttgctctcaagctggctgctatggctaataa

SEQ ID NO: 2392 - DNA, 779 bp, Phyllotreta nemorum
atcagtaccgttggttatcggtcaattcctggaagcagttgatcagaataccggcattgttggatcaactacaggctctaattactacgttcgcattctctccaccatcgacagggagttgttgaaaccgtccgctagcgtagccctacacaagcacagcaatgccctggtggacgtgttaccccccgaagcggactcctctatcagcatgcttcaggccgatgagaaaccggacgtgcagtacagcgatatcggaggtatggatatgcaaaagcaggaaatccgagaggccgtggaacttccgctgacccacttcgagctgtacaaacaaataggcatagacccgccgagaggcgtgctgatgtacggcccgcccggttgcggcaagaccatgttagccaaagccgtggctcatcacaccactgccgccttcattcgagtggtcggttcggagttcgtgcagaagtacctgggcgaggggcctcgtatggtgagagacgtgttccgcttggccaaggaaaactcgccggccatcatattcatcgacgaaatcgacgccatagcgacgaagcggttcgacgcccaaacgggggcggaccgcgaggtgcagcggatcctgctggagttgctgaaccaaatggacgggttcgatcagaccaccaacgtgaaggtgatcatggcgacgaatcgggccgatacgttggatcccgcgctgctgaggccgggtcgtttggataggaagatcgagtttccgttgcccgatagaagacagaaacggt

SEQ ID NO: 2393 - DNA, 367 bp, Phyllotreta nemorum
cggtgaccataaaaaccatgctggaggacctcggcatggacgaggaagaggaagaggtcgtgccgttgcccaacgtaaactcagccatcctacgtaaagtgatccagtgggccacctaccacaaagacgacccgccgccgcccgaagacgacgacaacaaggagaagcgaacggacgacatatcctcgtgggacgcggatttcctcaaggtcgaccaaggcaccctgttcgagctgatcctggccgcgaactatctcgacatcaaaggcctgctggatgtgacctgcaagaccgtggccaacatgattaagggcaaagcgccggaggagatacggaaaacgttcaatatcaaaaacgatttcacgcc

SEQ ID NO: 2394 - DNA, 727 bp, Phyllotreta nemorum
tgtgtgataaggcgaaagaaatactgtccaaagaatcaaatgtgcaggaggttaaatgtcccgtcaccgtctgcggagatgttcacggacaatttcacgatctgatggaattatttaggataggcggtcgaagtccagatacgaattaccttttcatgggcgattacgtcgatcgtggatattattcggtcgagactgttactctgttggtggctctgaaagtcaggtataaagaaagaatcacgattttgagaggcaaccacgaatcgaggcaaatcactcaagtatacggtttctacgacgagtgcctgcggaaatacggcaacgccaacgtttggaaattcttcaccgatctgttcgactacctgcctctgacggcgctcgtcgacagccaaatattctgtttgcacggcggcctcagtcccagcatcgacaccttggaccacattcgagccctagatcgtttacaagaggtacctcatgaaggtccgatgtgcgatcttctgtggtcggatcccgacgatcgcggaggctggggcatttctcctcgcggcgccggttatacgtttggacaggatatatcggaaacgttcaaccacagcaacggtctgacgttggtctcgcgcgcccatcagttggtcatggaggggtacaattggtgtcacgacagaaacgtggtgacgatcttcagtgctcccaattactgctatagatgtggcaatcaggc

SEQ ID NO: 2395 - DNA, 703 bp, Phyllotreta nemorum
tattgagaacgtgaaagccaaaatccaagacaaagagggtattcccccagatcagcaacgtcttatctttgccggaaagcagctagaagatggacgaaccttgtccgactacaatattcagaaagaatctactctacacttggtacttcgtctcagaggaggaatgcaaatattcgtgaaaactctcactggtaaaactattactcttgaagttgaaccatctgataccattgagaacgtgaaggccaaaattcaagacaaagagggtattcccccagatcagcaacgtcttatctttgctggaaagcaactggaagatggaagaaccttatctgactacaatattcaaaaagaatctactctacatttggtacttcgtctcagaggaggaatgcaaatattcgtgaaaactctcactggtaaaactattactctcgaagttgaaccatctgatactattgagaacgtgaaggccaaaatccaagataaagagggaatcccaccagatcagcagcgtctcatctttgccggaaagcaactggaagatggaagaaccttatctgactacaatattcagaaagaatctactctacacttggtacttcgtctcagaggaggaatgcaaatattcgtaaaaactctcactggtaaaactatcaccctcgaagttgaaccatccgatactattgaaaacgtgaaggcc

SEQ ID NO: 2396 - DNA, 792 bp, Phyllotreta nemorum
cgttcaagaaaaccttctcgtacgccggcttcgaaatgcagcccaagatctacaaagactgcaagatcgccctgctgaacatcgagctggaactgaaagccgaacgggacaacgccgagatccggctgagcagcgtcaaggagtaccagaaagtcgtcgacgccgagtggaacatcctctacaacaaactccagaaaatccacgaatccggagcgaacgtcgtcctatccaaactccccatcggcgacgtcgccacgcagtacttcgccgacagggacatgttctgcgccggacgggtccaagaagaagatatgaagcgaaccctcaaggcctgcggcggctccataatgaccacagccaacgatttgaaagacgaggtgctgggccgctgccagctcttcgaagagaaacaaatcggaggcgaacggtacaacttcttcaaaggctgtcccaacgccaagacctgcaccataatcctgcgaggaggcgccgagcagtttctggaggaaaccgagcggtccctgcacgacgccatcatgatcgtacgcagaacgatcaagaacgactcggtagtagcgggcggaggggcgatagaaatggagctgtcgaagttactcagggactattcccgtactattgctggtaaagagcagctcctgataggagccatggctaaggcgctggaaataatccctaggcagctgtgcgacaacgccgggttcgatgctactaatatattgaacaagttgaggcagaagcatgctcagggtaattcttggtatggggttgatg

SEQ ID NO: 2397 - DNA, 768 bp, Phyllotreta nemorum
gaaggggacgaatacactactctaatgacacagtgcaaagagggagcccaaagagaaggattaatgttggattcgaacgatgaactgtacaaatggttcacacagcaagttatgcgaaatttgcatgtagtttttacgatgaatccatcaacagatgggttaaaggacagggctgctacatctcctgctttattcaacagatgtgttttgaattggtttggagattggtcagatggagctcttttccaggtgggaaaagaatttacgaaccgtttggatctcgacaaacaaagttggaaatgtccagatttcttccctgcttcttgcaaccacatttccgctacgcccaatcacagggaagccgtcattaacgcctgcgtttacgtccaccagacgcttcacaaagccaacggcagattggtaaagagaggaagtcgcaccatggccatcacccccaggcactacttggatttcatacaccatctcgtcaaattgtacaatgaaaaacggtccgatttggaggagcaacagctccatctcaacgtcggtttgaacaaaatcgccgaaaccgtagaacaggtggaagagatgcaaaagagtttggctgtgaaatcgcaagaattgcaagcgaaaaacgacgccgccaacgccaagctcagacaaatggtgaaagatcagcaagaagccgaaaagaagaaggttcaaagtcaggaaatccaacagcagctcgctcagcaaactgtgcacatcaagcagaagaaatccgaa

SEQ ID NO: 2398 - DNA, 707 bp, Phyllotreta nemorum
atcacttcaattccaggaccggaatggagagtctgatggtggtgcccatatcgaaagcttcggccaaccagcgagccgggagggctgggagggtggcggccgggaagtgcttcaggctgtacacggcctggtcctataagcacgagttggaggaagcgaccgttccggagatacagaggatcaatttggggaatgcagtgttgatgttgaaggcgttggggatcaacgatttggtgcacttcgattttctggacccgcctccgcacgaaacgctcgtgttggctctggagcagctgtacgctttgggggctctgaatcatcacggggaattgactaaattggggaggaggatggctgagttgccggtggatcccatgatggctaaaatgatattggcgtccgaaaaatacaagtgttctgaagaaatagtcacgataggcgccatgttgtcggtgaacggggccatattttacagaccgaaagacaagattatccacgcagacacagccaggaagaatttcaatcacctggctggcgatcacttgagccttctgaacgtttacaatcaatggagagactccgattactcgctgcaatggtgctacgaaaattttatccaacacaggtcgatgaaacgagccagagacgtcagagagcaactagtcaatctaatgaccagagtagaaatcgaaatagtgtcgggaatc

SEQ ID NO: 2399 - DNA, 758 bp, Phyllotreta nemorum
gaaaaccgaagtgctaatggaaaatttcagacgagccattggccttagaattagagaaacgaaggaagtctacgaaggagaagtcagcgaactgacacctgtcgaaacagaaaatccagcaggaggttacggtaaaactgttagtcacgttgtaatcggtttgcggacagccaagggcagcaagcagctgaaactagatcccagcatttacgaagccctgcaaaaggagaaagtggaagtgggagatgtcatttacatagaagccaccagtggggctgttaaaagacagggaagatctgatgcgtacgctacagaattcgatctagaagccgaagaatatgtgccgcttcccaagggagatgtgcacaagaaaaaggaagttgtacaggatgttactttgcatgatttggatgctgctaatgcaaaaccacagggtggtcaagacgtgttgtccatgatggggcaactgttaaaaccaaagaaaaccgaaatcacagacaaactcagaaaagaaataaataaaatcgtggacaaatacattgatcaaggtattgcggaattggtaccaggagtattattcattgacgaagttcacatgttggatatagaaacgtttacataccttcatagagctttggaaagcgctatagcccctattgttatttttgctactaatagaggtcgttgtcttattagaggaacagatgatgtattttctccgcatggaattccattagatcttctggatagactgctga

SEQ ID NO: 2400 - DNA, 677 bp, Phyllotreta nemorum
ctatcatttgggggctctaccatacgcagtgggtaaattaggcttaaattgtccaatatacgccactataccagtgtacaaaatgggtcagatgtttatgtacgatctctaccagtctcagtacaatatgaaggaattttgtattttttctcttgatgatgtcgatgccactttcgaaaaggttgttcagctaaaatataaccaaacggtccctttaaaaggtaaaggatacggcataactgttacacctctaccagccggtcatatgatcggaggaaccatatggaagataatgaaagtaggcgaggaagatattgtatactgcaacgattttaaccataaaaaagaaaggcacttgaacggttgcgaactgaagaaacttcaacgaccatcattacttataaccgatgcctttaatgcaacatatcaacaggccagacgacggacgagagatgaaaaattaatgacaaatattctccagactttacgaaaccacgggaacgtcctcatagccgtagacactgctggaagagtactggaattggctcacatgttggatcaactgtggagaaacaaggaatcggggctcttggcttactctttggcttttttgaacaacgtcagttacaatgtagtcgaatttgccaaatcgcaaatagaatggatgagcgataacc

SEQ ID NO: 2401 - DNA, 652 bp, Phyllotreta nemorum
agaagatgatccttcgaacgctgatgatggtttgagctccatgcaggataagacgaaacgcaaaggaggcgatgataataggctgcaggacatggaagaagacacttctgatgaagataatgatgatgaagttggtaaaacttcgacttcgtcttcgctcattcaaccgcctttgccgcccatacccgataaagtgctcgttaaaaaatacgatcccaaacaagctgtcaaagtatccagacccacagtaggcgacgattatttagtatcgccaatcacaggcgagaagataccggccagcaaagtacaggagcacatgcgcatcggcctactagacccgagatgggtcgaacaaagagacaaacaaatgtccgataaaatgaatcaagacacggtatacgcagccggcagcgccatcgacgcctcgctgaagctgctggccgaacgacgtacggacatattcggcgtgggcgacgaggagacggccatcggcaagaaaatcggcgaagaggacgtgcgaaaggacgagaaggtcacgtgggacgggcacacgagcagcgtcgaggcggcgacgagggccgcccgcgccaacatcaccttggaagagcaaatacatcagattcataaggtgaaaggccttttacctgatgag

SEQ ID NO: 2402 - DNA, 741 bp, Phyllotreta nemorum
aaaggagtcttggatgtgtccaacagttttgcagtccctttcgatgaggacgacaaggataaatctgtatggtttttggaccacgactacttggaaaacatgtacggcatgtttaagaaagtgaatgctagagaacgcgtcgtcggttggtaccacacgggccctaaattgcatcaaaatgatattgcgattaacgaattgattcgaagatactgcccgaattccgtgctggtgattattgacgctaaacctaaagatttggggcttcccactgaagcctaccaagcggtagaagaagtccacgatgatggctctcccacgtccaaaacatttgaacacgtcccgagcgaaatcggcgccgaagaagctgaagaggtcggcgtggagcatttactgagagatatcaaagatactacagtgggaactttatcccagaggatcaccaatcagttattaggccttaaagggctgcatttgcaattgagagatataagagactatttgatgcaagtgtgcgataataaattgcccattaatcatcagatcatctatcagttgcaggatattttcaatttgttgcccgatataaaccaagatgcgttcaacaattcgttttatgttaaaaataacgatcaaatgcttgtagtttatttagcggctctcgttcgatctatcgtcgcactgcacaacctaatcaacaacaaactcaccaacagagacgcggaggaaggtaaaaaggaa

SEQ ID NO: 2403 - DNA, 774 bp, Phyllotreta nemorum
agaaatagccagaacccaagacgaagaggtgggagatggaaccacttctgtaatagtattagctggagaaatgttggccgctgccgaacagttccttgaacagcaaattcaccccacgatcatcatccgacaatacaggcaggccctggaagatatggtgcagtttctggaaggtcctttgagcgtgcccttggaccgaaacgacaaaaacgccatagctgaagtggttaaaggttgcattggaacgaagttcttgagcaaatggtcggatttggccgtcaatatcgctttggatgcggtgaataccgtcttattggaagaaaacggtcgaacggaggtggatatcaagagatacgccaaagtcgaaaagattcctggtggttcggtggaggactccaagattttgagaggcgtaatgttgaacaaagacgttacccatcccaaaatgaagcgacacattaagaatccgagaatcatccttttggattgcgctttggagtacaagaaaggagaatctcaaaccaacgttgaaattagtaccgaaaccgatttcaccaaactcctcgaattggaagaagagcacgtcaagcgccaatgcgaagagattatcgccctcaagccggacgttgtgttcaccgaaaagggagtatccgatatagcccagcacttcctgctcaaggccggcatcactgccatcaggcgtgtcagaaaatccgacaacaaccgaatcgctagagcttgcggcgccgtcatcgtaaacagaaccgaggaact

SEQ ID NO: 2404 - DNA, 552 bp, Phyllotreta nemorum
acgccagattaatccttacgctgataatggagggagcgtcgtagcgattgcaggaaaagatttcgtggttattggcgccgatacgcgtcttagttccggcttttccatatacactagaaaccagaacaagctgttccctctttctgaaacgactgttttaggatgttcaggttgttggtgcgatactttaacgctgactcgtattttaaagtctcgcatgcaaatgtactatcaagagcataacaagaacatgtctacgacagcggctgctcaaatgttgtcgaccatgctgtattacaagcgatttttcccttattacatatcgaacattctcgttggattggataatgagggaagaggttgcgtctacagctacgatcccgttgggcattgcgagaaagccacctacagagcaggtggttctgcaggggctttgcttcagcccttattggacaatcaaattggacaaaaaaatctgcagaagccttcgcaggaagatcttactcaggaaaaggccatttctacgctgaaagatgttttcatatccgctgc

SEQ ID NO: 2405 - DNA, 706 bp, Phyllotreta nemorum
aaaataatcatgccgccttcggcgctggaacagctcactagattaaacatcaactaccccatgttatttaagcttgttaacaagaagacgagccgtacgactcattgtggtgttttggagttcgtagccgacgaaggaaaagtctacttaccattatggatgatgcacaatttggtgctgaccgagggagatttagttcaaatggaaagcgtatcgttgccggtcggcacgttctcgaaattccagccgttaaacccggacttcctcgacatcaccaacccgaaagccgtgctggagaattgcctgcggtcctttgcttgtctgaccaccggcgacgtgatagccgtcaggtacaatcaaaaggcgtacgaattgtgcgtgttggaaaccaagccgggcaacgccatcagcataatcgaatgcgacatgaacgttgaattcgcggccccggttggctataaagagcccgagcaggctaaaaaagaagaagaaatgtcggtggatcccgccgacttgatgccggagccgtcggggttcgtggcttttagaggggctgggaaccgattggacgggaagaaacggaaggattcgtcttcgagcgacgctccttcggctaagccggcttacgttcgggggatacccgattacgattatcaaataggcacgctggactttatcaggcgtacgatagcgaagcctaaggaaa

SEQ ID NO: 2406 - DNA, 766 bp, Phyllotreta nemorum
ctagagaaaatcgctgagctgtttccagtttctgctgaaaacaccgagccccttattaaagtcgcgatgactacactaggttcgaaaataattaacaaatgtcacaggcaaatggccgaaattgccgtcaatggcgtattagctgtagcggatctcgaacaaaaggatgtcaactttgaactcattaaagttgaaggaaaggttggtggtaaattggaagacacgacattagtgaaaggtgtcgttatagataaaacaatgtctcatcctcaaatgccgaaggagctaaaggatgttaaattggccatcctcacctgcccgtttgaacctcccaaacccaagaccaagcataagttggatgtcaccagcgtagaagactacagagaactgagattgtacgaacaagaaaaattcaaggaaattgttcgcctggtcaaaaaatcgggagctaccttggctatttgccaatggggattcgatgacgaagctaaccatttgctgttgcaggaggagttacctgctataagatgggttggaggacctgagatagagctgatagctatcgcgaccggaggaagaatagttccacgattcgaggaacttagccctgaaaaacttggttcggccggtttggtgcgtgagatatcctttggaaccaccaaagataagatgatggtgattgaagattgctcgaattcccgtgccgttaccattcttgtcagaggtggtaatcaaatgttggttgatgaagccaagaggagtttac

SEQ ID NO: 2407 - DNA, 208 bp, Phyllotreta nemorum
gtgaaaaagtggaatgctgtagcactttgggcctgggatatcgttgttgataactgcgctatatgccgaaaccacataatggatttgtgcattgagtgccaggcaaatcaggcctctgcaactagcgaggaatgcactgtagcttggggagtttgcaaccacgcttttcactttcactgtatttcaagatggttaaaaactaggcagg

SEQ ID NO: 2408 - DNA, 657 bp, Phyllotreta nemorum
accttgagctcgaaaattctatcccagcacaaagagcacttcgccaagctcgccgtcgacgccgtgctgcgattaaagggatccggcgacttgcaagccatccagctgatcaaaaaaaccggcgggtgcctgcaagattccttcctcgacgaaggcttcctgctcgacaaaaaacccggagtacaccagcccaagcgagtcgagaacgctaaaatcctaatcgccaacactccgatggacacggataaaatcaaagtgttcggctcgcacatcaaagtcgactcgatggccaaaatcgccgaactggagtcagccgagaaagacaaaatgaaagacaaggtcaacaagatcctccagcacaaagccaacgtcttcatcaaccggcaactcatctacaactaccccgagcagttgttcgccgacgccggcgtaatggccatagagcacgccgacttcgacggtatcgaaagactggcgctggtcaccggaggagaaatagtctcaacattcgatcaccccgagctggtgaaacttggaacttgcgacttgatcgagcaagtcatgatcggagaagacactctgctgcgtttcagcggagtggccttaggagaagcctgcacgatagtcattcgaggagccacccagcagattatagac

SEQ ID NO: 2409 - DNA, 667 bp, Phyllotreta nemorum
acgtcttcatcaagtcgaatatgcaatggaagcggttaatctcggttcggcaacggtaggactaaaaagcaacagtcatgctgttataatagcattgaaaagagcttcatccgaattatccgcttaccaaaagaagatcattcaaatcgacgatcacatcggcattactatatctggtctgacagcagacgcaagaattttaagcagatatatgagaaacgaatgtttaaattacaagtactccttggacgcttacatgccattgaatagattaataaacatattaggtatcaaaatgcagcattgtacgcaaagatacgatcgtagaccgttcggtgtaggtctattggtagccggttacgatgacaacggagcccacatttaccaaacatgtccgtctgctaatttctacaattgcaaggccatgtcgatcggagctcgatctcaaagcgctcgaacttatttggagaagaaactcgacgaattaaatttgtgttctttagaggatttgattaaacacggtttgagagctctcagagatactcttcctcctgaagtcgatttgaatacgaagaacgtctccataggatatgtcggtaaagggattacctttaaaattttggaagaagaagaaactgctccttatcttgctttaatcgagggtgaa

SEQ ID NO: 2410 - DNA, 751 bp, Phyllotreta nemorum
ttaccgggttcgtacaaattgtggtacaattatctacggaccagaaggaatcaaatcaaaagcaaatgcatcaccgatccgggtttcgaagaggtaaacaacgccttcgagcgttcgctggtattcatgcacaagatgcctcgtatttggatggactactgcacgttcctcaccgatcaatgtaaaataacgagaactcgaaaggttttcgaccgggcccttcgagccttacccgtaactcagcataacaggatatggcctttgtatttgaaattcgtgcagaaacatgatatatcagaaacggccgttcgagttttcagaaggtatatgaaattgtgtcccgaaaacgccgaagaatacatcgattacctaacgaaagcagaacgattagacgaagccgctataataacagctaaaatagtaaacgacgataatttcgtgtcccaacagggcaaatcgaaacaccaactgtggaacgagctgtgcgagctgatttcgaaaaacccggaaaaagttcgctcgctaaacgtcgacgcgatcataagaggcggcctgcgaaggtacaccgaccaattgggccacctgtggaactctttggccaattattacgttcgcagcggcttattcgaacgggctagagacatttacgaagaggccatccaaaccgttacgaccgtcagagatttcacccaagtattcgatgcgtacgcgcaattcgaagaattaagtctgagcaaacgaatggaagaag

SEQ ID NO: 2411 - DNA, 657 bp, Phyllotreta nemorum
ggcggtttagacgataaagtatcggaatccctgctatgggagctgttcgtacaagccggaccattggtgaacgtacacatgcccaaagatcgcgtcaccatgatgcaccagggctacggttttgtggaattcatgggcgaagaggacgcagattatgctataaaaataatgaatatgataaaattgtacggaaaacccataagagtcaacaaagcttccgctcatcaaaagaacttggacgtcggagccaacatttttatagggaacttggacccggaggtcgatgagaaactcttgtacgatacgttttcagccttcggtgtaatattacaaacgcccaagataatgagagatccagagactgggaattccaaagggttcgcgtttatcaacttcgccagcttcgaagcctccgatgcttcaatcgaggccatgaatggccagtacctctgcaatcgaccgatatctgtttcctacgcattcaagaaggactcgaagggcgagagacacggttcggccgccgagcgattgttagccgcccagaacccgctatcgcaggccgacaggccccatcagctgttcgcagacgctccaccgataggaatgatgccgatgagcatggcgccgcccccaccgcctctaatcaccggcatgatg

SEQ ID NO: 2412 - DNA, 658 bp, Phyllotreta nemorum
taaaaggaggaaaggagcacccaagctccgttatttggatttctccgaaaggcatggctacatcaagggtgtagtgaaagacatcatccacgaccccggtcgcggcgcccccttggctctagttcacttcagggacccttacaagttccaaactagaaaggagatattcattgcccccgagggaatgtacacagggcaatttttgtactgtggaaagaaagctaacctccaaattggaaatgtgttgcctgtaggaactatgcctgaaggtacaattgtctgtaatttggaagaaaaaactggtgaccgtggccgattggctcgagcatctggtaactacgcaaccgtgattgcccacaatcacgatacaaagaaaactagagttaaattgccatcaggagctaagaaagttatcccaagcaacaacagagctatggttggtatcgttgccggtggtggtcgtatcgacaagcccatcctgaaagccggtcgtgcctaccacaaatacaaggtgaagcgtaactgctggccgaaggtgcgtggtgttgccatgaaccccgtcgagcatcctcacggaggtggtaaccatcaacacattggtaaagcctccaccgtcaagagaggaacgtccgctggtcgcaaggtcggtcttattgct

SEQ ID NO: 2413 - DNA, 267 bp, Phyllotreta nemorum
aaacaattagccacgaaagcggcccgaaaaagtgctccggcaacgggaggagtaaagaaacctcatcgttacaggcccggtacggtagctcttcgagaaattagacgttaccaaaaaagtaccgaactcctgattagaaaattacccttccaacgtttagtgagagaaattgcccaagattttaaaaccgatttgcgttttcagagttcggctgttatggcgttgcaagaggctagtgaagcctatttggtcggtctttttgaagat

SEQ ID NO: 2414 - DNA, 773 bp, Phyllotreta nemorum
gccgttaatataactgcagccaaaggtatttctgaagtgatgaaaaccaacttgggaccgaagggaaccatgaaaatgttggtgtccggtgccggtgacattaaaataaccaaagacggcaacgttctcttgcacgagatgcaaatccaacatcccacggcttcgttaatagccagagcttcgacggctcaagatgatatgactggtgacggaaccacatctaccgttttagttatcggggaactcctgaaacaagccgacatatacatcgcagaaggcttacaccccagaacactcacagaaggtttcgacaaagcgagagcaaaggccctagaaattttggagaagctgaaagtacccatcgaaatcaacaaagaatcgttgactgatgtttgtcgaacaagcttaagaacaaaattgcaccaaaatttggctgacctcctcactgatgtgtgcgtcgaggccattctcgccatcaaacagtccgacaaaccagtcgacttgcacatggtggagctcatggaaatgcagcacaaaaccgagaccgacactcagctggtcaaaggattggtgctcgatcacggcgctcgtcaccccgacatgccgaagagcttgaagaattgttacatcctcacctgtaacgtcagcatggagtacgaaaagagcgaagtcaattcgggcttcttctacaaaaccgccgaagagagggagaaactggtgttggccgaaagagacttcattgaacagcgagttaagaaagtcgtcgagttgaa

SEQ ID NO: 2415 - DNA, 771 bp, Phyllotreta nemorum
aaatagtactcgagccgaacagctccgtataagcgagataacgcataataacgatatcgctttgattgtagccgatacgaaaggtttattcgcccaggtgttctgcgacttcggcaaggccttctccgtggtggacgtgaacggggaaccccccgtctccaccatgatagccgatatatcgaacgatacggagagcgtggtcacctgcatagacgatacgagacacggcatggaggagggcgattacgtcaccttctcggagatcctgggcatgaccgagctgaacaactgcaagcccatcaagatcaaggtgctggggccgtacacgttcagcattggcgacaccaccaagttctccaagtacgtacgaggcggtatcgtaacgcaggtcaaaatgcctaaggaggtgcattttaagccgctgaaggaggccttgcagaatcccgaattcgtggtgaccgacttcgccaagttcgatcacccgattcagctgcacctcgccttctccactctccacaagttcgtggagaagaccgggcggttgccgaaggcctggaataaagacgacgcctcggagtttatcgctctggcgaagtcgttggctgtaaacggttctacggataccgaggtcaatactgatattctcaatattttctctaaatgttgctcgggtgatctaaatcctattaatgctactattgggggtatcgtggcgcaggaagtcatgaaagcctgttcggggaagttctaccccatttaccagtggttgta

SEQ ID NO: 2416 - DNA, 671 bp, Phyllotreta nemorum
ggggttaaaggaacatacgtctcgatacacagttccggttttcgggatttccttctaaaaccagaaatcctccgagctattgcagactgcggtttcgaacacccttcagaagtacaacacgaatgtattcctcaagcggtaattggcatggacatcctttgccaagcgaaaagtggtatgggtaaaacggcggtgtttgtactagccacgctacaacagctagaacccaccgaaaacgtcgtttacgtgctcgtcatgtgccacacgcgcgaattggccttccaaatcagcaaagaatacgaacgtttcagcaagtacatgtccaacatcaaggttggcgtgttcttcggaggcctgcccattcaaaaagacgaagaagtattaaaaaacagctgtccgcacattgtagtcggaacgcccggtcgcatcctggctctcgtcagatcgaagaaactcaatctcaagcacattaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaagcgaaatt

SEQ ID NO: 2417 - DNA, 678 bp, Phyllotreta nemorum
atcaagccgataagttggttaataaatgcgtgtttccggagactgccagcaacaacgaatgggcgagattcctgtactacttgggcaggatcaaagcggcccgattggagtacagcgtggctcataaacatctcatacaagcgatgcgtaaagcgccccagaacaccgccatcgggttccggcagaccgtccagaagctaacagttgttgtggaattgctgttgggggacattccggagaggcagatattccggcaggcgagcatgcggcattctctggccccctatttccagctgacgcaggcggtgcgaatggggaacttgcagaggttcggagaggtgttggagaatttcgggccgcaatttaggctggatcatacgtttactttgatcctgcggcttcggcataatgttatcaaaacggctattagatcgatcggtctgtcgtactccagaatatccccgcaggatatagccaagaaactggggcttgactcagcagaggatgcggagttcatcgtagcgaaggccattcgtgatggtgtaatcgaagctattttagatccccaaggaggttatatgaggagtaaagagagcactgatatctactgcactaaagagccccaactagcttttcatcagaggatatccttctgtttggatttgcacaatcagagtg

SEQ ID NO: 2418 - DNA, 729 bp, Phyllotreta nemorum
cggcaattaaaatccgacaaattaaatgcaaatgaagagtctgatgatgaagagaaagacgaggataaatacgtcgatgaagtggacatgcccggcacgaaagtagacagcaaacaaagaataacagtcaggaatttgcgtatacgagaagatacggctaaatacttgagaaatttggatcccaactcggcttactacgaccccaaaaccaggtcgatgagggaggatcccaatcccggaaacgacgctacataccatggggagaatttcgttcgcttttccggcgacacgacgaatcacgccagggcgcagctgttcgcttgggaagcacacggcaaaggggtggacgttcatctgctagcggaacccacgaaattggaattgctgaagaaagaatacgagaaaaagaaggatgaggtcaagtcgaatattcagggtactgttttggagaaatacggaggtgaggaatacctcgaagcgccaccgaagagtttgttgttggctcaaaccgaaaactacgttgaatattcgagatcgggtaaggtgatcaaaggagctgaaaaagaagttatcagatcaaaatacgaggaagatgtttatattaataatcacacgtcagtgtggggttcttattggagcgctggacaatggggttacaagtgctgtcattcttttatcaagaattcttattgtttgggagaagctggaaaatcagtaaacgctcaacct

SEQ ID NO: 2419 - DNA, 413 bp, Phyllotreta nemorum
taccgtgccctaagattagacaccggaaacttttcttggggtagcgaaggtactgcccgtcaaacacgtattatcgatgtcgtttacaacgctagtaataacgaattggtccgtaccaagacgttggtaaagaatgctattgttgtcattgacgccaccccgttcaggcaatggtacgaaaatcactacatcttaccattgggacgcaagaagggtgccaaaatgacgcctgaagaggaggagattttcaataaaaagcgtagcaaaaaagtacagaagaagtacgagactaggcaaaaaaccgctaaagtagaacccgcgatcgaagaacagttccacaccggaagattgttggcatgccttgcatctaggcccggacaatgcggcagggccgatggttatgtcctcgaagg

SEQ ID NO: 2420 - DNA, 652 bp, Phyllotreta nemorum
ctgctgaaaatgctcaaacacggcagggccggcgtgcccatggaagtcatggggctcatgttaggtgaattcgtggacgattacacggtgagggtcatagacgtgttcgcaatgccccagacgggtacgggtgtgagcgtagaagccgtagatccggtgttccaggcgaaaatgttggatatgctgagacagacgggcaggccggaaatggtggtcggctggtaccattcccatccgggtttcggctgttggttgtccggagtcgatatcaacactcagcagagcttcgaggccctctcggagcgggccgtggccgtcgtcgtggatccgattcaatcggtcaaaggaaaagttgtcatcgacgcctttaggttaatcaatccgaacatgatggtgttgggtcaggaaccccgtcagactacctccaatttgggacatttacagaaaccatccgtacaggctctgattcacggcctgaaccgccattactactccataagcataaattataggaagaacgagttggagcaaaagatgctgctgaatttgcataaaaaatcgtggatggacgggctcacgttggccgactattcggagaattgcagcgtaaacgagaagaccgtagccgatatgctggaattggcaaagaatt

SEQ ID NO: 2421 - DNA, 678 bp, Phyllotreta nemorum
cgacattaacgacgttacaccaaattgtagagtcgctcttcgaaatgaatcgtacactttgcataagattttaccgaataaggtggatcctttagtatcactcatgatggtcgaaaaagtaccagattccacttacgaaatggtcggtggtttggacaagcaaatcaaagagatcaaagaagtaattgaattgccagtgaaacatcccgagctctttgatgcgttaggtattgctcagcccaagggtgtgttattgtacgggcctccaggaactggaaaaactctcctggctagagccgtagctcaccacaccgaatgtacgtttattagagtatctggatcggaattggtgcaaaagttcattggtgaaggctccaggatggttagagagctgttcgtaatggccagggagcatgccccttcgatcatcttcatggatgaaatagattctattggatcctcccgtatcgaatcaggttctggtggtgattcggaagttcaaagaacaatgctggagttgctgaatcaactcgacggattcgaagccactaagaacattaaagtcataatggctactaacagaatcgacattttggatcccgctttgctaaggcccggtagaatcgacaggaagatcgagttcccgccaccgaacgaggaagcccgattggatatctt

SEQ ID NO: 2422 - DNA, 467 bp, Phyllotreta nemorum
tgctttcgatttgcaaagtttcagttttttccaaagaggatccgtacaggaattcatgtctttcttttgtaagactattgtagaaaggactataccatcatcgagacaatctgtcaaagaaggagaatacatgtgtcatgtttatgtaagacatgataacttagctggtgttgtgatatcagatcacgaatatccctctagggtgtcacatacgctcattacgaaaattttggacgaattcgccgcaaaaatacccgctgccaattggtctaccttgcaagagaaggatgtaacgtttccacagctaaacacataccttgccaaataccaaaaccccaaggaggccgatgcaatgactaaaattcaggaggatcttgacgaaaccaagataattctgcataatacgattcaggctgtcctggagagaggcgaaaaattggatgacttggtaaacaaatcagagggct

SEQ ID NO: 2423 - DNA, 582 bp, Phyllotreta nemorum
tggaatatgccattgaagctattaaactgggatccacagctatcggaatatgcaccagcgaaggggtcgtgctggcggtcgaaaagcgtattacttctccattaatggagcccacgaccatcgagaagatcgtagaagtagataaacacatcggctgtgctgtttcggggctcatggcagattcacgtacaatgatcgatagggcaagagtagagtgccaaaatcattggtttgtatacaatgaaaacattactatcgaatcgtgtgctcagggagtatcgaacctagctattcaattcggagattcggatgatgatggtgctgctatgtcgaggccatttggcgtggccattttgtttgctggcatagacgaaaaagggcctcaactttaccacatggacccctcaggtacatttgttcagttcgatgcgaaagccataggatccggttcggagggcgcacagcaaagcttacaagaagtgtaccatcgcagcatgactttagaggaagctaccacagcggcgttgactattctcaagcaggtcatggaggagaaattgaactcgtccaatgtagaagtca

SEQ ID NO: 2424 - DNA, 708 bp, Phyllotreta nemorum
gatttgaaggttgggactcttgaccaattggttgggctatccgacgatttgggaaagctggatggtttcgtggagcaggttacccggaaggtggctcagtacctgggtgaggttctcgaagaccagagggacaagttgcaggagaatttgcaggcgaacaacaccgatttgccaagttatttaaccagattcacatgggacatcgccaaatatcccatcaagcaatcgctgcgcaacatcgccgatataatcagcaagcaagtcgggcaaatcgatgccgatcttaagaccaagtcgtcagcgtacaataacttaaaggggagtcttcaaaatttggagaaaaaacaaacagggagtttgctaacccgtaacttggcagatctggtcaagaaggagcacttcattttagattctgagtacttgcaaacgttgctcgtcatcgttcccaaagctcagtttaatgagtggaacgccacttacgaaaaaatcacggacatgatcgtccctcgatcgtcgcagctgatcattcaggaccacgattacggcctgttcaccgtgtcgctcttcaagaaggtcgtcgaggagttcaagctgcacgccagagagaagaagttcatcgtgcgagatttcacgtacaacgaggaggaattggcggccggcaaaaacgaaatcaccaagctcgttaccgacaagaagaagcaatacggt

SEQ ID NO: 2425 - DNA, 750 bp, Phyllotreta nemorum
tgtctggatttctcattgcaaaaggccaaaatgaagatgggcgtccaagtgctgataacggaccccaatcaactggaaggcgtgcgcgccagggagctggacatcaccaaggagcgcatccagaagatcctggctactggagtgaacgtggtgcttctgtcgggcggcatcgacgatctctgtttgaagtacttcgtcgagcgcggcgccatggccgtgcggcgagtcaagaaggccgatttgaaacgcatagccaaggctaccggagcggccttcgtcacgtcgctgagcaacatggagggcgaggagaccttcgatgcctccatggtgggcgaagccgccgaggtcgtgcaggacaggatatccgacgacgaattgatcgtcatcaaaggacctaaagctcgtacagcggcttcgataatcctgcgaggtccgaacgatttctactgcgacgagatggagcgttcggtgcacgacgccctgtcggtggtgaagcgcgtgctggaatcgaagagcgtcgtggccggcggcggtagcgtcgaggcggcgttgtcgatctacctggagaatttcgctacgacgttgagttcgcgcgaacagctggccatcgccgagttcgccaaaagcctgttggtcataccgaagacgttggctgtgaacgcggcgcaggacgccaccgacctcgtggccaaattgagagcctatcagaactccagccagaccaagaaggatcacgctcatctgaagtac

SEQ ID NO: 2426 - DNA, 623 bp, Phyllotreta nemorum
cgcaacgaatccaataactcatactcagtctcctgtgaccacttcaacttcaattgtatccataacgtacgacaaaggagtgctgatagccggagacttgctggcctcttacgggtctctagccaggtacaaaaattgccccagggtgatcgaaattaatcctaatatcatcctgggagccgggggagattacgccgattttcaatacgtgaaaagctttatcgagcagaaaataatcgatgaagattgtttagatgacggtttgaaaatgaaaccgaaatctctttactgctggctgactaggattatgtaccaacgaagaagtaaactcgacccgttctggaacaatttagtagtcggaggaatacaggatggcgtgcctttcttaggaactgtagataaactcggtacagcttacactgataaagtaatttgtacgggttatggggcccatatagctcttccggtgttgcgagatgcgctcgataagaagccgaatttgaatctgaacgaagccaagcagcttattaaaaagtgcatggaagttttgttctacagagacgcgaggagctacccgaagtaccagttggggatgatcgatgcggatgaaggggtgaagatcg

SEQ ID NO: 2427 - DNA, 797 bp, Phyllotreta nemorum
cctagcagtcgtaaacgtaagagatctggggaacgtcaagcacgcctttaagcttctcattttccccgataccagagtttttcaatgctcctccaactcgaacaaaaaagagtggctggacaagttcgatcaggccaagaaaaccaagctggcccaagaacagcaaaaaagggaatccgtatcggagaaatcgcccactcgcgtctcattcgaatcgcccagctacaatcctttcgatgaagcagaagaagaaaccggcgcgtcgcatccggaatggttcgtggagattcccgaagagctggacgtttgcgtggcccaaaggcatttcgaagacgccatttctctgctgcaaaaagccaaggaatatttggctcgaacgtcttccacgtccggtgataagcgggacaccgtctttacggatatccagagaaaagtggagcaaagacagaacaatttaacggaggtgttgatgaaggaattggaagtgaatccggataaatcgctgcagggcgggctgagggccgctcgcagggctgtgagattgctgaatcaattaggaagggaaacacaatcttgtacgctgtttttgaaattatgcagcagtatgctgaggacgcaatgcaaacgagtcaaaagagaaggttctacgaccacttacataaagcatctttcgagcgtggtttttaccaatatgtgtcacatgtctgatgaatttctaagagcttttcccgattctccggcctgcgcgtcagcgtatgtggtttgggcgagcaatgagctattgcaatttaccaccc

SEQ ID NO: 2428 - DNA, 712 bp, Phyllotreta nemorum
cagattaggtcaagaggtcggttacactattagattcgaagattgcaccagtcccgaaacgatgatcaaatacatgacagacggtatgttgctacgtgaatgcctcatggatttggatcttaaacagtactctgtaataatgttggacgaagctcacgaacgtacaattcacactgatgtactattcggactcctgaagcaagctgtcatgaagcgagacgaactgaaattgatcgtaacttctgctaccttagacgccgtcaagttctcgcagtatttcttcaaagccccgatattcacgattcccggcaggacgtttccggtcgaagtattgtacaccaaggagccggagaccgattatttagacgctagcttaataacagtcatgcaaatacatctcagggaacccccgggcgatattttgctgtttctgacgggtcaagaagaaatcgatactgcttgcgaaatattatacgaaagaatgaaaagtttgggtcccgacgtacccgaattaatcattcttcctgtgtactctgctttaccgtccgaaatgcagactagaatattcgaaccggctcctcctggcagtaggaaagttgtgatagctacgaacatcgcagaaacttcactaacaatcgatggaatatattatgtagtagatcctggattcgtcaagcaaaaagtttataattccaagactggaatggattca

SEQ ID NO: 2429 - DNA, 718 bp, Phyllotreta nemorum
ggccaagaaaactactctcaactttacaaaatcaatacgaaattagtcgagcatgaagaagtagaaacaatcggagacactgcaagcgttcggcatagaaacaccaagcccaaagaacacgtagataataataaaaacattaaaaaggagctggtttttgacctgaatcctttagattgcatacaaaccgattttaaggggtccgaacccctatgtagagtacttagaattaatcactcgggaaagatattagctactggaggaactgacggcgatgtaagactttggaaattccctatgatgcagccattgtccattttaaaggggcatacaaaggaaatagacgatatagatttcagtaaatacgataacctcatcatcactctagcaaaagacggtttggctattctgtgggacgcccaaacgggaaaaatgaaatcaaaactgacatggaaaactccagagggatcaaagtatatgtacaagaggtgcagatttggcgttatcgaagatcaaaaaaacaagtgcatgctatacatgatagcgaacgcgactaattcgaagcaagcatcgtttcttcaacagtggatacctgaggaaaatactttaaaaaagttttctgaattcaatgaaaccctatcggcacttgcagtgagagatgacggacgatttgttgctgtcgggacaatgttcagcggctccgtttccattcacattg

SEQ ID NO: 2430 - DNA, 741 bp, Phyllotreta nemorum
tgtacaccgatgctttacaactggaatccaccttgttaaaagagctgaagaaactggacgacaaaaatctgctggtcgaagtacagctgctcgaaagcaaaacatatcacgccctaagcaatttacccaaagcacgagccgccctaacgtccgctagaacgaccgctaatgctatctattgccctccgaagatgcaggcagccctagacctgcagtctggcgtactacatgcagccgacgaaaaggatttcaagaccgcttactcctacttttacgaagccttcgagggcttcgacagcgtcgagtctcccaaagctctaactgctcttaagtacatgcttttgtccaaaattatgattaatagtcctgaagatgtacagcaaattgttagtggaaaattagccataaagtatgcaggtaaagatatcgaggccatgaaagcagtcgcacaagcagcccacaaaagatctcttgcagattttcaacttgccgtaaaacaattcaagcacgagctggaggatgacgttatcgtaagagcacatttaggaaccctctacgacaatatgttggaacaaaacttgtgcaggatcattgaaccttactcgcgtgtccaagtagaatatatagcaaagacgattaagcttcctgtgttacaagtagagaagaaactatcgcagatgattttagatgccaagtttcatggaattctagaccagggtgatggtgtcctgatagtgtttg

SEQ ID NO: 2431 - DNA, 673 bp, Phyllotreta nemorum
atacgaatccaggtgtaacgagtaccagctcaagtccaaccaagcttctgcagacgccaagaaggccatcgccgatgccaaggagttggaaaaggaaagggacaagctgaagaagctcctcgatgctgctcgtaaacaactggaagaggaatctctggccagagtagaggtcgagaatcacaatcagagcttaagggaagagctaacctttaaagatcagatccatcaacaagagctcacagagacccgcactcgccggcaggtcgagatcagcgaaatcgacggccgtctggcgcagaaatacgaggccaagctgcaagaggccctgcaggatctgcgcgaccagtacgaatcgcaaatggccaacaaccgacaggagatcgaattgctgtacgagcagaaaatcaaaaacctccaagcggccgccgacaggcaccagtcgaccgcctccggcgcgctcgacgaactgagacaggttcgctcgaggatcgacaccttctcgtcgaagatcgacgacctggagaaccagaaccgcggtctggcagctagaaatagggatttggagaaattgctcgagaatgagcgcattcgtcacgccgaagatctggcgttggtcgagagggaattgcacaggctgcgggaggagatggcccagcaacttcaggaataccag

SEQ ID NO: 2432 - DNA, 767 bp, Phyllotreta nemorum
ctgagaatccacaccaagaacatgaagttggccgacgacgtcgatttggagcaaatcgcggccgagactcacggtcacgtgggcgccgatttggcctcgctctgttcggaagcggcgctacaacaaatcagagaaaagatggacctgatcgatctcgaagacgatcaaatcgacgccgaggtcctcaattcgttggccgtgaccatggagaacttccgttacgccatgacgaagagcagcccgagcgctctgcgcgaaacggtggtcgaagtacccaacgtcacgtgggacgatatcggcggtctggccaacgtcaagaaggaattgcaggagttggtgcaatatccggtcgagcatcccgataagttcctcaagttcggcatgcagccgtccaggggagtgctgttttacgggccgcccggttgcggtaagaccctgttggcaaaggccatcgccaacgaatgtcaggccaacttcatatccgtcaaagggccggagttgttgacgatgtggttcggtgaatctgaagctaatgttagagacattttcgataaggccagatcagcagctccttgtgtacttttcttcgacgagttggattcgatcgctaagtctagaggtggaaatgtgggagatgccggcggtgcagccgatagggtgattaatcaaattttaactgaaatggatggtatgggagcgaaaaagaacgttttcatcattggtgctacaaatagaccagatatcattgatccggctatattacgtcc

SEQ ID NO: 2433 - DNA, 650 bp, Phyllotreta nemorum
atttagtgccaagtctttgcgaggatcttctttcatccgtagatcaaccgttaaaaatcgctaaagacaaggattcgggcaaggattttcttttatgtgattacaatagggacggagattcttacaggtcaccatggtcgaatacttactaccccccattagaagacggttcgatgccctccgagaggttaaggaaattagaattagacgccaatttagcgttcgatcaatatagagaaatgtatttcgaaggtggcgtatcttctgtttatttttgggacttggatcacggttttgcaggagtaattttaattaaaaaaaccggagatggtagtaggaaaataaaaggttgctgggattccctgcacgtagtggaggtgcaagagaagagttcgggaagaaattcccactacaaaatgacctccaccgccatgctgtggctgcaaaccaataaacaaggctcggggaccatgaatttgggcggtagcttaacccggcagatcgagcaagatgcagcggtaaatgatatcaacccccacatcgccaacatcggtcgaatggtggaagacatggagaacaaaattcggaatacgttgaacgaaatctactttagcaaaaccaaggacatagtcaatagcttgagatcggtg

SEQ ID NO: 2434 - DNA, 733 bp, Phyllotreta nemorum
ctttctatcaaccggtcgatgcggaactactgggcctgcacgactaccacgacatcatcaagcgacccatggactttggcacggtcaaagagaaaatggacaacagagagtaccgcacgccgcaggactttgccgccgacgttagactgatttttagtaattgttacaagtacaatccctctgaccacgatgtggtcgccatggcgcggaagctccaggacgtgttcgaagtcaaatttgcgaagatccccgatgagcctgtgaaccggataggaggagttgtaaataatttgcctataaaatccgaatcgagtagttccggttcgagttcggattcgtccagcgaatcggaggattcggaggaggaaaggcgtaacaaacaattgaaagtgctggagaaagagttgacggcgttgcaagagaagatgcgcaagctggtcgaggagagttcgcgccggaaaaaggagaaaaagaaaaacaaaatgaaaaagaaaccgagcggcgcgggggcgctgacggcggcgggcgcgctgccgaacagcagcagcggtctcggtttgcgcggcaacaaacccgccgccgcttcgaacgccgcccccaagcgggcgaaggcgaacaacaagaccggcgccggcaggaagaagaacgccgcccagccgcccccgatgccgttcgactcggaggacgaggacaacgccaagccgatgtcctacgacgagaaacgacaactttc

SEQ ID NO: 2435 - DNA, 661 bp, Phyllotreta nemorum
caatttcgttcatcagcaggtctcaatgaaccatcgccagccctacagcgtcagcgacaaagccggtcaccaaacctcggccgagtcctggggaaccggtcgcgccgtggcccgtataccgcgtgtacgcggcggcggtacccaccgatcgggccagggagccttcggcaacatgtgtcgcggcggtcgcatgttcgcgcccaccaagccgtggcgccgctggcacagacgcgtcaacgtcaaccagcgtcgctacgcgctggcgtcggccgtcgccgccagcggcgtgcccgccctggtcatgagcaagggccacgtggtcgatcagatacccgagctgccgttggtcgtcagcgataaggtgcaggagatgcgcaagaccaaggaggccgtgcagttcctgaggaggatcaaggcttgggctgacatccaaaaggtttacaagagccagcggttccgtgctggtaaaggaaaaatgcgtaacaggagacgtatccaacgtaaaggacctctaatcgtttactacaaagatcaaggtcttcgtcaagctttccgtaacatccctggcatcgacctcatcagtgtccaaaagttgaacttgctgaaactggctcccggtggtcacgtaggtcggttcatcatctggactgaatctgctttc

SEQ ID NO: 2436 - DNA, 722 bp, Phyllotreta nemorum
tcgagcaagaatcttttggagtgggcgaagaggaagaagaaggcgattactcagacgccgatgattttatcgtagacgatgacggcagacctttaatcgagaaaaagaggaaaaagaaaccgattttcaccgacgccgcgctgcaagaggcccaagaaacatttggcgttgatttcgattacgatgagttcagcaaatacgaccaagacgagtatgaagacgaggaggacgaagaagaagacgaatacgaagaagatgacaacgaacgaaggaaacatccaaagaaagcggcgcgaaagaagctgacgaaaaagtccattttcgaagtgtacgagccgagcgaactgaaaaggggctttttcaccgatctcgataatgaagttcgtaacaccgatataccggaacgaatgcaacttcgtgacgttcccattacccccgtcacggacgattcgaccgagctggaagacgaggcggagtggatttacagacaagcgttctgtaacaaggcaatatccaatgttgatgcccacctttcggccgaggccagagagaagatgaagaagggttcccaaactgtagggaaaataaagaaagcgctggatttcatgaggaatcaacagctagaggtgcccttcattgccttttacagaaaggagtacgttcaacctgaactgaatattaacgatttatggaaagtttataaatatgatgccaagtggtgt

SEQ ID NO: 2437 - DNA, 673 bp, Phyllotreta nemorum
tgctcgatgatgtaaaggaggctaatgctgaagatattctaaatgtattcaagtttgatgaacattatgaagaaaacgaaggcaaatacaaaactctgagtaaagaaatcttgggcagcgatagcgagtcagatacaggatcggaggggtctgaagaggaatccgaaggtgaagacgaggatgaagaagttaaagatgccggaaaaatcatagacaatactgaaacaaatctaatagcccttagaaggacaatatatttgactatacaatccagtttggatttcgaggaatgcgctcataagcttctgaaaatggagttaaaacccggccaagaaatcgaattatgccacatgtttttagattgttgtgccgagcaaagaacatacgaaaaattctacggacttctagctcaaaggttttgccaaataaataaaatatacatcgagcccttccagcagatattcaaagacacctacgccactacccatcgtctggacaccaacagattgaggaacgttagcaaatttttcgcacacctgctcttcaccgacgccataggctgggaggtgttcgagattatgaagctgaacgaagaagacaccaacagctccagtagaatttttatcaagattttgttccaagaattagccgagtatatgggcctaggaaagct

SEQ ID NO: 2438 - DNA, 675 bp, Phyllotreta nemorum
tggtatcggcttgttgtaaaatgcacgacatatctgctgagggcattacactggtcgaagatatcatgaagaagagggagccccttgctacaatggaagctgtgtacttgatcactccttccgagaagtctgtccatgctctcatgaacgatttcgaatctccgaggcccatgtatagaggagcacatgtatttttcacagaagcatgtccagacgaattatttaacaaattaagtaagagtcatgcggcaaaatatataaaaacgttaaaagaaatcaacatagcatttgttccgacagagtcacaggtattttctttagattccccagacactttccaatgtagttacgatccttcctttgctgccgcacgaaatgcgaatatggaaagaatggccgaacagattgctacgttgtgcgccactctgggggaatacccgcacgtccgatataggagcgattgggaacgtaacgtagagttggcgcaattgattcagcagaaattggatgcttacaaagccgacgagccgactatgggagaaggtcctgagaaagccagatcgcagctgctgatcttagaccgaggcttcgattgcgtttcgccgttgctgcacgagctgacgtttcaagctatggcttacgacttgcttccaatcgaaaacgacgtgtacaaat

SEQ ID NO: 2439 - DNA, 716 bp, Phyllotreta nemorum
ttcaatctgggggttttcaagatctaagaagggatttgcaagcggtaataggcactagggcaaacataaacatagctcaaatagaaaattatggtggtgaaacttttgtatcggaggaattggcaataatgattcttcaggatactaagcaagcttttcaacgttgtttattgttatcaaaaggcagcgaaaaagcttccaacgccacccaaattttagacagacttattaacagtttgctcatagaacatgtagactatgcagtagaattgggccttcaagctgtacccgttgtcgaaggcgttagaaatccccctgttttgtatttttttaatgtcgtgcaccaaagcaataatattacccatctcgtcgaaaaacagttcatggatttggtggttccattagtagaaaacactccaaaatacagcgattgcatacagaagaaaaaatttgttttggaggatatagaaagaaaaattaatacgggattggataggtgcttgagtgcgatattaaattgggtgaaattgtatttacaatctgagcagaagaaatccgatttcaagcctgagtctgatgattttgatacagtggcctcaccagcttgcaagaacgtacttaattatgtaaatagcattatcaaagaaatcaaaacaaatttggatggcaataatgtaacagcttttcttcaagaattggggattagactgcataga

SEQ ID NO: 2440 - DNA, 655 bp, Phyllotreta nemorum
tagaaaccatcgatctgcagaaggacccgtattttatgaaaaaccacctgggttcttacgaatgtaagctttgcttgacgctacacaacaacgaaggtagctacttggcgcacacgcaaggcaaaaagcaccaggccaatttggcccggagggcggccaaggaagccaaagatgccccgtcgttgctccaacccgagaagccccgagtggagccgaaaaaattcgtgaaaatcggtagacccggttatcgggtaactaaacaaagggatcccgaaaccggccaacagagtttactcttccaaatcgattatccagaaatcagcgacttggttacgacccgacaccgcttcatgtcagcgtacgagcaaaaaatcgaacctccagaccgcaaatggcagtacttactcttcgcagccgaaccgtacgaaaccatagccttcaaagtaccgagcagagaagtcgagaaaacggataccaaattttggactcactggaacagagacaccaagcagtttttcctgcaattcgctttcaagaacgaaaacaaacgaaacgttaacgcagtcgttcagaggcattcgattgtcggtggagttccaccgcctcccatgctgccggtaccgccgccacccaggcctcccatgtttaatcccat

SEQ ID NO: 2441 - DNA, 253 bp, Phyllotreta nemorum
taacctgcgaaaccataaccggcgaagtttacaggggtaaacttatagaagccgaggataatatgaattgccaaatgactcagataactgtaacgtacagagacggacgagtggcgcaattagaaaacgtttacattagaggatccaaaataaggttcttaatattaccggatatgttaaagaatgctccgatgtttaaaaagcaaaccaaagctggaactgcaggtagagggaagtctgcaattctacgagc

SEQ ID NO: 2442 - DNA, 670 bp, Phyllotreta nemorum
gtttgctcgaacttcttgagcggacgtacggccgtcgtaggttcgggtatcagcgaaaaggatttgacgtcttttgccaattccttgaaaatagaaaacggcgaaggcgaaaccgccccttctccttacgtaggcggtgaactaagatcgaacaaaggtggtgaactggcgtttattgctgtagcaggagagggagctgctctcaagaaccacaaggaagctctggcttttgccgtgcttcagggagccattggaggaggccctcaggtcagacacggagtttcggacaacggaatcttcaggaaggctcttggaagtaaccccaacgttagttctgtagccataaacgccagttactcggacaccggtctctttggactgctactggccgttcctacgaagtccgccagaggtgctatagaaagcgctgttaaagtactcaagagcgggacggtttctgatgaggatgtcagcagaggtaaaaatcaattgaaagcgtcgatcctcttcaatgctgaaagcggggcagatattgtaagaactcttggacaagaggctgttttgacgcaaaaagttacgagtgttgatgcacgtttggccgaagtggattcggtttctaccagtgatgtcgcaaatgctcttaagaaagcaggcaagaagttatcgctag

SEQ ID NO: 2443 - DNA, 199 bp, Phyllotreta nemorum
acgaaaatgatcggatgactaacgaattgcaagagaaaatcggagttctgaaatccctaactatagatatcggaaatgaagttaaataccaggatagaatgctcagggatgttgacgacgatttagaaaagactggagggttcctgggaacaactatgaacaaagtattaaggctgtcgaaaggaggccacaattacat

SEQ ID NO: 2444 - DNA, 729 bp, Phyllotreta nemorum
cgttggtaatcctcgaagatgtcaaatttccgaaattcaacgaaatcgtccagctcaaactggccgacggcagcttacgatccggtcaagtgttggaagtgagcggctcgaaagccgtagtacaagtgttcgaaggtacttcgggaatcgacgccaaaaacaccatgtgcgaattcaccggcgatattctcagaacgcccgtgtcagaagacatgttgggtagggtgtttaacggctcaggaaaacccatcgacaaaggacctccaattttggctgaggactacctggacatccaaggtcagccgatcaatccttggtcgcgtatctacccggaggaaatgatccaaaccggtatctccgctatcgacgtgatgaactcgatcgctcgtggtcagaagatccccatcttctcggcggccggtctgccccacaacgaaatcgccgcgcaaatttgtagacaagccggtcttgtcaaagtgcccggcaagtccgctctggacgatcacgaagacaacttcgccatcgtgttcgctgctatgggagtcaacatggaaaccgctcgtttcttcaagcaagatttcgaagagaacggttcgatggagaacgtatgtctgttcttgaacttggccaacgatcctaccattgagagaatcatcacgccccgtttggccctgaccgctgccgaattcttggcctatcaatgcgagaaacacgtgttggtcatattga

SEQ ID NO: 2445 - DNA, 731 bp, Phyllotreta nemorum
ggaaacaatgggcatcaaaaccgtcttggctcgccaaatattcgactccagaggcaaccccaccgtcgaagtcgacatcaccaccgacttgggcctcttccgagcggccgtaccatcaggagccagtaccggcatctacgaggcgctcgagcttcgcgacaacatcaaaaccgagtaccacggcaaaggcgtgaaccaggccatcaaaaacatcaacaccatcatcgcccccgagctgatcaaagccggcttcgaggtgacccagcagaaggaaatcgatgagttcatgatcaagctggatggtaccgagaacaagtccaaattgggagccaatgctatccttggagtatccttagctatttgcaaggctggagcagccaggaaaaacgtgccgttgtacaagcatatcgctgatttggctggaaacaaggatatcattttaccagtaccggcttttaacgttattaacggtggatcccatgctggtaacaagctggccatgcaagaattcatgattcttcctacgggggctacaaccttcactgaagccatgcgaatgggttccgaaacctaccatcacctcaagaaggttattcacgccaagttcggcttggacgcgacagccgttggagatgaaggcggtttcgccccgaacatcctcaacaacaaagaggggctcgagttgatcaaggtggccatccagaacgccggatacaccggaaaaatcgaca

SEQ ID NO: 2446 - DNA, 730 bp, Phyllotreta nemorum
actacggcatacaagtgatcgtcaagctgttgaacccgccgtcgcgttggccgctggtgaaggcggtcatcggcttgatcaggaacttggcgctgtgtccggccaatcacgctccgctgagggagcacggcgccatccatcatctggtgcagctgctcatgagggccttccaagacactcaaagacaacggggtagcgtcgccagcgggggtagccagccgcctgggacgtacgcggacggggttcgcatggaggagattgtagaaggaacggtgggagcgttgcatatattggcgagggaatcgcacaatcgggccatcatcagacagcaaatggtgattccgattttcgtgcagttgctgttcaacgatatcgagaacatacagcgcgtcgccgccggcgttctttgcgaattggccgccgacaaggagggggccgaaatgatcgaaaacgagggcgccaccgcccctttgactgagttgttgcattcgagaaacgaaggtgttgctacgtacgcagcggcggttttgttcagaatgagcgaagacaaaccgcaggattataaaaagcgactatcaatggagctgactaattctttgtttagagaagaaaatctttggaatcccgacctaggcatgggtccggatttgcaggatattttaagtcccgaccaggcatacgacaatatgtatgctcagggtcccccgagtgttcatagtagccatggagg

SEQ ID NO: 2447 - DNA, 678 bp, Phyllotreta nemorum
cgaaatcgacaagcacaaaaaacgccggccctatttggcgtccgaatgcaagagcctctacgcgtgcgagaaatggcgcatgcaaatcatccgagaaatagcgaaaaaagtggcccaaatccagaacgccgggctcggcgagttccgcatacgcgatctcaacgacgaaatcaacaaactcctgcgcgagaagcgccactgggaggaccaaatcaaagagctcggcgggcccgattaccagcgagtcggcccccggatgctcgaccacgagggcaaggaggtccccggcaaccggggctacaagtacttcggagccgccaaggagctaccaggcgtccgggagctgttcgagcaggagccgccgcctccgccgaggaagagccgggccgagctgatgaaggacatcgacgccgattactacggctacatggacgacgatgacggcatactgatacccttggagaacaaagctgaaaaaatcgccgtgcaaaaggccatatcggattgggtgagcaacaaggagaagaacctggactcgagcaaagggatcgaagagagcatttacgtggtggaggagtcggacgaagaggacgctgtccaacagttcgacggttcgcagcagcggttcgtggctcacgtgccggtaccgtcccagcaggacatcgaacaggccttgtt

SEQ ID NO: 2448 - DNA, 496 bp, Phyllotreta nemorum
gttcgagaaaaagtacgtcgccaccctgggcgtcgaagttcatcccttagtgttcacgacaaaccgaggcaaaatctgcttcaacgtgtgggacacggcgggccaggagaagttcggcggcctcagagacggttattacattcagggacagtgtgccattattatgttcgatgtcacgtccagggttacatacaaaaacgttcccaactggcacagggatattgtcagggtgtgcgaaaacataccgatcgtactatgtggaaacaaggttgatatcaaggataggaaggttaaggctaaaagtatcgtgttccataggaagaagaaccttcagtattatgacatatctgcaaagtctaactacaatttcgagaagcccttcttgtggttggcgagaaagcttattggcgatcccaacttggacttcgtcgccgaatcggcccttctccctccggaagttcaaatggatccgcagtggcagaaacagctagaaaac

SEQ ID NO: 2449 - DNA, 229 bp, Phyllotreta nemorum
gagtaggaggaacatggaacttaaacgaagaaaaaaatcctgatgcggaaattgtggcatctggaatctttgtcggtttcatgatctacactgtcgtatctcttataagtttctgttttgccagcggtgatcacaaaacatctttcaccgatattttaatgaacatagttggagtattcatgtgggtggccgttggggcaacagctcttcactactggctcggttattt

SEQ ID NO: 2450 - DNA, 724 bp, Phyllotreta nemorum
cgtgatgaaatacggcaaaaaccaatggtccagaatagcatctctgcttcacaggaagtctgcgaaacaatgcaaagcccgttggttcgaatggctagaccctagcatcaaaaaaaccgaatggtccagagaagaagatgaaaagttgctgcatttagctaaactaatgcccactcaatggagaactatcgcgcctataataggcaggaccgcagcccaatgtctagaaagatacgaatatttgctggatcaagcgcaaaaaaaagaagaaggcgaggatgctgtggatgatcccaggaagttaaaacccggagaaatcgatcctaatccagaaaccaaacctgccagacccgatcctaaagatatggacgaagacgaattagaaatgctttccgaagccagagccaggctagccaacacccaaggcaaaaaagccaagcgtaaagctcgcgagaagcaattggaggaagcccgtcgtttggctgctttgcagaagcgtcgagaactgagagcagccggcatcgaagtcaattcgaggcgcaagaagaaacgaggcgtagactacaatgctgaaattccgttcgaaaagcaaccagcaatcggtttctacgacacttccaacgaagccctagacttgatggcgccggatttctccaaaatgagacaacaacatttagacggtgaactcaggagtgaaagagaagagagagaacggaaaaaggac

SEQ ID NO: 2451 - DNA, 330 bp, Phyllotreta nemorum
atgtggctcatccagataagctgaagaaaaaaattaccagggaattaattacaaccattcttgccagaaaaccaaaaatgtgcagttttttagaatggagggatttaaaaatcgtttacaaaaggtatgctagcttgtatttttgctgcgctatagaacagtgcgacaacgaactgttaactttggaaatcattcatcgttacgttgaacttttggacaaatactttggaagcgtgtgtgaattggatataattttcaacttcgagaaagcctatttcatcctggacgagctattgcttggcggcgaggtgcaggaaaccagtaagaaga

SEQ ID NO: 2452 - DNA, 779 bp, Phyllotreta nemorum
aagagatcgtcgtttctcagtcgattatacgacaatttcaaagacgaaatgaacaaaaacaaagaaatgaaagaatctttaaaaaaattccgtgaagaagcccaaaaactggagcaaagcgacgccttaaaagccgcccgacaaaagttcgaaaccgtagagaaagaggccagcaaaggcggcgaagtcttcaaagagagtttaggttcgattaaagaaagagtcaaaggagttatagacgaggccagcaaatcggatttagccaagaaagccggtaaattcaccgaagaagtaggaaaaaccacacacaaaatcagcgaaaccgcacaagaaattagcaagacaggagccttccaaagcatctcggaagccaccaaagctgttaaacaggaaatcgacaacaccagcatggaaggtcgagtgtacgtgagccctaagaagctgcgaaaacgaaccgaaaccagcgcagtagtccaacagaaatactacgaaccgaacacggacgcgaccggcgtggagctacacaaagactccaaattctacgaatcctggcaaaacttcaaaaacaacaacccgtacgtgcacaaagtcatggactggaagctcaaattcgacgaaagcgaaaaccccatcatccgagcctccagggcgctcaccgaaaaagtcggcgacatcatgggcggcttgttccaaaaaaccgaactgtccgaaaccctcacggagatctgcaaaatcgacccggacttcgacaccaaacgattcctgaaacaatgcgaaac

SEQ ID NO: 2453 - DNA, 656 bp, Phyllotreta nemorum
gtaagctgaaacctgggttaaataaaatcgaagaggcccctaaacaattcgtgaacaacataagtggcttaaatcagaaaatcgaagaattcaaattgaaactgccatggatcgaacggctggattgtacgaatgcccaagcccccttggcgcccgaattagcagcagaaatgctagttcacgaggaaaagagaagtaatcaactcaggaacaacaagaaacttccccaattccaaccatccgaagatcccgttctaaacgattttaaacgagagctaatatttcacaggcaagcacaagccacaattctggaggcaatcccgaaaatcaaagagtttgggttacctactaaaaggccagatgattattttgctgaaatggccaaatccgatgagcacatgcacaaaatcagagaaaacctgaagcaaaagcaggagcaacagaagcggattgaacgggtgaagcaattgaggcagcagaagaaagaaggaaagtcgctgcaggtgcagatgaaattgcaacggtccaaggagaagaaagaaatgatggatcaagtgaagaaagcgaggaaaaacttcgactttttggatgacaaaaataagcccatgggaaagaaggcggcggaaaaacgtaaaatgaaggacaagaaattcggt

SEQ ID NO: 2454 - DNA, 712 bp, Phyllotreta nemorum; identical to SEQ ID NO: 2428

SEQ ID NO: 2455 - DNA, 763 bp, Phyllotreta nemorum
ccaaagtcatgatggaggaaggccgaagcaagggcttcggcttcgtgtgcttctcctccccggaggaggccaccaaggccgtgaccgagatgaacggccggatcgtcggcacgaaaccgctctacgtcgccctggcccaacgcaaagaggaccgcaaggcccatctgacgtcgcagtacatgcagcgcatggccaacatgcgtatgcaccaaatgggccagttcatccagccgggcggctcgagcggctacttcgtgccgaccattcaagcgacggcgccgcgtttctacgggccggcccagatgccgattcgcactagtccgagatggcaggcgcagacgccggtgcgtcccggcgcccagggcggcaccgccgcctacgcgggaatgcagaacagctacagggccgcggcgaggccgcccggtcaatcgacgatgcgcagcaacatcagcgtgccgcgacccatcaccggacaacaaccaccaagtgttgctgctgctggaaatcgtgcagccaacttcaaatacaccgccaacatgcgtaatccgccgcaggcgttgttgccgggagctcaggctcaagtgcaacaggcagtgcacattcaagggcaggaaccgcttactgcgaccatgttggcagcggctccgccgcaggagcagaaacagatgttgggagagagattgttccctctgattcaaaggatgtattccgatttggctgatgttgcaggtaaaatcaccggtatgttgttggagatcgacaa

SEQ ID NO: 2456 - DNA, 793 bp, Phyllotreta nemorum
acccgatatacgtgaaactggagaagcttgacataatgattcgattggcttctcaagtgaacattgctcaagttctgagcgaacttaaagaatacgcgactgaagtggacgtggactttgtaaggaaagctgtaagagctattggccggtgtgctatcaaagtggagccttcggcggagagatgcgtcgcgacgctgttggatttgattcaaactaaagttaattacgtcgtacaagaagctatagtcgttatcaaagatatatttagaaaatatccgaataaatacgagagtattatcagcaccttgtgcgaaaatttggatactctggatgagccggaagcgagagctagcatggtgtggattataggagaatacgccgagagaatcgataacgccgatgagttactggatagtttcttggaaggtttcggtgacgagaacgctcaagtacaactccagttgctgacggccgttgtgaagctattcttaaagcgtccccaacacacgcaaggtttagtccagcacgtactcagcttagccactcaggactccgacaatccagatttgagagacagaggtttcatatattggagattgttgagtacagatccggccgcagccaaggaggtggttctggcagataaaccgctcatatcagaagaaaccgacctcttggagcccactcttctcgacgagctcatctgtcacatatcatctctggccagcgtttatcacaagccacctacagcgttcgtggaaggtcgaagcgctggtatcaggaagacgttacc

SEQ ID NO: 2457 - DNA, 363 bp, Phyllotreta nemorum
gaggagaagtaggagctacatcatccttggctccgaaaatcggtcctcttggtttgtctcccaacaaaattggtgacgatattgccaaaggtacagctgactggaaaggtttgaaaatcacggtccaattgaaaattcaaaaccgtcaagccaccatctccgtagtaccgtcggctgcttcattaattattaaggctttgaaggaacctcctcgtgacagaaagaaggtgaaaaacattaaacacagtggaaacattacgtttgatgaagttattgcccttgcccagcaaatgaggcctagatcaatggccaaggccctttctggaacagttaaggaagtgctgggtacagctcaatctgtag

SEQ ID NO: 2458 - DNA, 784 bp, Phyllotreta nemorum
gcaaatggaggaggaacttacagtcgaagcgaccaaactgggcgtttccatagtattttcgcacgagactgagcctctaggcaccgcagggccaatagccttagctagagaacacctttcgaaaagtacaaaaccgttttttgtattgaactccgatataatatgcgacttcccgtttagggagctggccaagttccacgaaggccacggcaaggaaggcaccatagtcgtcacgaaggtcgaagagccttccaagtacggcgtagtagtttacgatgaaaacagctgcatcgagagctttgtggaaaaaccgcaggagttcatttcgaacaaaatcaacgccggcctgtacattctgaaccccagcgtgatcgacaggattgaactccggccgacttccatcgaaaaggaagtgtttccttacatggctaaggacaagcagctgtacgccttcgagctgaaagggttctggatggacgtcgggcagcccaaggacttcttgaccgggatgtgcttgtacttgaaccatttgcgggaaactaacagccagaagctgtacaagggacccggtgtggtcgggaacgtgctggtagatccaactgcaaaaattggcagtaattgccaaatcgggcccaacgtaacaatcggaccagacgtggtaatagaagacggggtttgtataaagcgctcgacgatactgaggggtgcggtcgtgtgctcgaactcttggttggagagctgcattgtggggtggaagtgtcacgtgggtaaatgggtgagaatg

SEQ ID NO: 2459 - DNA, 732 bp, Phyllotreta nemorum
ggacggtgaagaagtgataagtgaccaagaaaaagtgaaaatagtttcggatttcatcctccattccccgcccggcgaattcaacgaagttttcaatgatgtaaggaaacttttgaataacgacgaccttctgaaagaaggcgtaaccggggcgttcgcccaatacaataaagaccaactcacccccgttaggatagaaaacgccgatcaaatggtgctgattacagaatacaacgatttaggtaacaatagattcttcgacccccgtagtaaacaaagtttcaaatacgaacatttaagaaaggaagcttctgattaccagccttatagtgtcgatacgacggcggagccctggcgggccgctctagataacgagtttattcaatacactagaaaccattataaagacggcgtttgtagcgtattcggtcgcagtcagaacggtgcgatcacccttactgcttgcatcgaagaccaccaatttcagcccaagaacttctggaacggccgatggagatcccagtggtccgttagcttaaccgatgaatccacagctgaagtacgtggcgtcctgaaagtgcaagtccattattacgaagaaggaaacgttcaattggtgagtactaaggagatcaaggagtcgattccggtttctaacgaagctcaaacggccaaggaaatcatccatgtaatagagaatgctgagaatctgtaccaaactgcgatttctga

SEQ ID NO: 2460 - DNA, 726 bp, Phyllotreta nemorum
gaccgaatcgataaaggtcaacacttacactacaaacaatcaaaacgtcgatatcacaccaataatatggagcaggccgattccgctgggttggtacttccaattccaatgggagaatcaatacggtaaaaattggcccaaatacctctgcgatgattggctcagaacggacagatatctgaagaattttgcccatgaattgccgcaatgtccttgcacggtgcagcaagctttggcggacaaaggaaaattcatgcctgactttgattgcgacaaagattcaaatcctgtttgttattacaacaatcaagctttacattgcgtcaaaactggtgctcccacaatggaaggttccgaacaacaatgttgctacgacaaaaacggctacctgatgctgtcctacgatcaacaatggggttcaagtcctcgtcgatgccacaacctcggcaaaatgccttacaacgaggccaccaaggtccccacgctatctcaatggttcaacgacgtcgtgcccaagtacctctgttgcctctggcaggaagagcaagccgtcggctgcgaaacactgcgattcgagagaaggccgtcgcaggactgcgtcgcatatcaagcgcccgccgtagcgggagtttacggtgacccccacatagtcaccttcgatgatgtggaatacacgttcaacggcaaaggagagtactccttggtgaaatcggttaaagtggacga

SEQ ID NO: 2461 - DNA, 256 bp, Phyllotreta nemorum
  misc_feature (187)..(223): n is a, c, g, or t
tggttctgtaggagttgaagccgaagctgaaaaggtcaaaaaagttttgggcgaactcaatggcaaatccatcgaagagctcatcactaaaggtcgcgagaaattgagttccatgccagtgggtggtgctgctcctgtagctgctgctgctgttgccgctgctcctgctgccgccgaagaaaagaannnnnnnnnnnnnnnnnnnnnnnnnnnnnnnnnnnnncagaagacgacgacatgggctttggtctttttg

SEQ ID NO: 2462 - DNA, 783 bp, Phyllotreta nemorum
atagacgactttttggctgtgtccgaaaaccacatcctagaagacgtcaacaaatgcgtgctagcccttcaagaaggcgatgctgatacgttggaccgcacagccagcggcataaagggccgttcaaacagagtttgcaatgttgtaacagctgaaatggataactacgaaccttgcatttacaccaaacgcgttttggaagcggtgaaagttttgaacgatcaagtgatgcccaagttcacccaaagagtgcaggtggctgtacaggccttgggtaacagcccgcctaaggaagtcgacgaaaacgatttcatcgatgcttccagattggtttacgacggtgtcagggagataagaagagctgtgctcatgaacagagccgatgaagatttggatcctgaagacgtcgagctcgatgagaattacctgattgagaccaggagtaaatcgagtgctcatactggggaacatggcgttgatgagtatcctgatatcagtggaattaccaccgccagggaagctatgggtaagatgccggaagaggacaagcaaaaaatattgcagcaagtggagtttttcaagagcgagaagctcaagttcgatcgcgaagtcgctaaatgggacgacaccggcaacgacatcatcgttttggctaagcacatgtgcatgattatgatggaaatgacagatttcaccaggggaaaaggtcctctgaaaaccaccatggacgtcataaacgcagccaagaaaatttcagaagcaggcactaaattggacaagctc

SEQ ID NO: 2463 - DNA, 715 bp, Phyllotreta nemorum
ttgtttggatcaactgcaactgcagctgcgacgcctatttcagcttcgactggacttagtttcggaacaacagtttcaacaaccccagtttcagcaactccagctgctacagggacccccctttttggagctgctcctacctcaagcagcactactacaatatccagtgtgcccgctttaggtttatcgactacagtttcttcagctgcttcaacaactccgtctacttcattaagtaacacaacatcagctcctcctcctgcttattcggcatcgacacttccttcaaccggttcgttgactttcagccaactggaagattctattaacaagtggactattgatttggaggagcaagggaagtttttcattaatcaagcgaagcagctgaacgcttgggactcgttacttatttcgaacggggaaaaaattctcaatctgaacggtagcatcgagagagttaagcagcagcaacagcaattggaccaggagctcgatttcgtgttggctcagcagaaggagttggaggagttgataacgccgctggaaaaggagttgttggaaattcctgttacggacatagatcgaaatcaaatgtatcaattttcggaaataattgactcccaactgaagcaaatgtctgatgatctgaaagaaattatcgagcatatcaatgaatctaataaaagcgaagaaatttcgaatcctttgacgc

SEQ ID NO: 2464 - DNA, 456 bp, Phyllotreta nemorum
actgctctttttaggactggataacgctggtaaaacgaccctattacacatgcttaaagacgacagactggcccagcacttgcccacgttgcacccgacctccgaggaattgtccatcggtaacatgagattcaccacgttcgatttaggagggcattcgcaggccaggagagtgtggaaagactacttccctgccgtagacgctatcgtatttctcattgacgccaacgacagatcgagattcgtagaaagcaagcaggaattagacgctttgttaacggacgaaactctagccaattgccccgtgctaattttaggcaataaaatcgatttgccggacgccgcgtctgaagatgagctgcgaaacgtttactctttgtacggccagacgaccggtaaaggtaaagtcgctcgatcggacctgcccggccggcctctcgagcttttcatgtgttc

SEQ ID NO: 2465 - DNA, 430 bp, Phyllotreta nemorum
agcaaaatccacgcaattaccgggctattgttgcaaactagaatgatgataaattcagctctcagttgccgagaagcattaacatcaatgttacaacctttaacgactgttaacgattatttgaatccttcgactagtagcaatgatgtagaagtggaagcaaaaaggcagtatttactcgaatcgtatcccgaattaataggtaccgtacaaacaataggaaccttcgaatcgctcttaccgtttcttggatcgattaatatatctaaagtggtggagttttgcgagattttggaagaattggcttcgaacaacactgaactctacggagaatgtagagatgttataaaggaagttcttggtgcattgcaagattataatgatatatcaaattcaattaaagcattactttcacagtgggattttacca

SEQ ID NO: 2466 - DNA, 798 bp, Phyllotreta nemorum
tctggaacggaaacctattgtattcgttcaagggattctccatacacagattctgcttgcctctaatgcacggattcgtttcgattaacttctgcgtagtgaacgggcacagcctaaactggtcgattgttagtagaaggagcgttcaacgagccggcaccaggttgcaccgaagaggcttggacaaggaagggaacgtggccaatttcgtcgaaaccgagcagatagtcgagtaccaaggcgaccgggcgagtttcgtgcaaatacgaggaagcattccgctgttttggcaacaagatccggacctgaggtacaaaccgccgcctactttgctcgacgtcgacccgcaggatcagcactcgatgtgtctgaagcacatgaacgatttaatgactctctacgggaaggtggtttgcgtgaatctagtagatcaaaaaggagccgaaggaaacatggaagtcgcgtttaaggacgccgttagcaacgtgtcgtctccttcggttaagtacgaatcgttcgatttccacgccgagtgcagcaaaatgagatgggacagactgtcgattctgatcgatcggttggcgcacgatcaggacgagatgagcttctttttgttgctcagagacggctcgttgagttcgctgcaagacggtgtgttcagaacgaactgcatcgattgcttggaccgcacgaacgtggtgcaaagcatgctggcccatcggaatctcgagggcgtgttgaggaaattgcaaatcctccatcagaatcaaacgttggaattccagtattcgttcgagg

SEQ ID NO: 2467 - DNA, 661 bp, Phyllotreta nemorum
acgatcatcgacaagcattacagcaagcccaacgtagtgcctgtggacgtcctgccggtctatccagatttcagcttgtggaaatatccttgtgctcaggttattttcgattccgatccggccccagtgggcaaacaagtaccggctcaaatcgaggagatgtcgcaagccatgatcagaggtgtaatggacgaaagcggcgagcagttcgtagcctacttcctccccacagaggaaactctacaaaagcgcagggaagacgtcgcgaaccaggtccaataccaagacgatgaggaatacgagtacaaaatggccagggagtacaactggaacgttaagagcaaggcgagcaaaggctacgaggagaactacttcttcgtcgttcgatcgagcggtatctattacaacgaattagaaaccagagtcaggttgagcaagcgaaggcagaaagtgggccagcccccgagcaacaccaggctcatcgttaaacacaggcctatggatgctaatgaattcaggatgcaacggtacagggagaagcagctcgaacctacaggcgaggatgatgaagagatggaaatcgacgagccccaagacgaggaaaacgtgctggagccggataacggcaaggaaacggagagcgacaacgaaaagaaacgat

SEQ ID NO: 2468 - DNA, 780 bp, Phyllotreta nemorum
caaagaagtaggctggaagttagactctgccttgctgaagaccctcaaagccaagaatgccgaaaaggtcaagcttctggacgaagccatcgaggacgcggagaagaacttgggagagatggaggtgcgggaggcttatttgcgtaaagcggagttttacagcaggatcggcgacaaagaaaacgccgtgagcacctttaggcagacttacgataaaaccgtgtctttgggccaccgcttggacatcattttccacttaattagaataggcttgttctttatggaccacgaccttatcaccagaaatatcgacaaagcaaagaccctcatagaagaaggaggcgattgggacaggagaaaccgattgaaagtctaccaaggtgcttactgtatgtcggtaagagacttcaaaaccgccgctaacctatttttggacaccgtgagcaccttcacgtcctacgagctcatggactacaaggctttcgtcagatacaccgtctacacttccataatcagtctgccgagaaaccagcttagagataaagtaataaaaggctcggagatactggaggtactccactccgagccgttcgttaaagactacctgttttcgttgtacaactgccagtacgcagagttcttctcgaatttggccgaggtcgagacgattctgaggaaagactactttctgaatccgcattaccggtattacgttagggaaatgaagatttcggcttacacgcagctgctggagtcctatcgatctctcacattgcagta

SEQ ID NO: 2469 - DNA, 727 bp, Phyllotreta nemorum
agagaaatggtccagtgttccagttgcaagaagtttgttcatggaacctgcgatcccgaagcagacgttgtcacctacagtcaaaagaaagaaataagcatggactacgaatacgtttgcttgcattgcaaaaatagcacggccagacaaataaccgcgaaacgagcgagtatcgacgatccttccgacgtatccgcttctcacgattccctgtacgacgatacgtccgaattggaccttccttcgcccgacgagttcgccagaaacatgggtttgggcaaagggaagccgtatagcgcgaataaaatagccaagaagcgccttagtttcacagtaaatccggtcggcaggccgaaaggcaccggaaaggtgcctcccgggaaaatggggtttatgaaacgctaccgacttaccgaattcaacagaaaacggggccccaaggccaaaatgagaggtattttcggagtgcccggcgtgggtctgcaaagaccgatttcagatggaaaaaccgacgaagaaccaggagtcgaaaaccgattagtactgtgttcagctaaagataaatttacgcttacacaagatatatgcgtaatgtgcggggcgttcggaaccgatcaagagggctgtttgatcagctgcgtacaatgcgggcaatgttaccacccctattgcatcaacgtcaaagtaactaaagtgatcctacagaaaggatggagatgcttagact

SEQ ID NO: 2470 - DNA, 685 bp, Phyllotreta nemorum
tttgatgatgacttggacgtggagtctgtagcccaagcttcaagtaaaggcaaaggtttgaagagaaaacataaaaatgtatcggaaaatgctggcaagggaaaattgcagcaaatgttttccaccatgccaactaaacagaaaacggcagcaaaagtcgatgacgacgaaatgctctcagaaatcttgggtgaaatcgattccgacacaccaaatacctctaccgttgagaaaccgaaaatatcccagtactcttcactagccattaacttatcggccaaggattacatgaaaaatttggcacagcctgttaaaaaacgcgcaatcgaaaaaagtaccaaagtaccaaaatttctgcccagtgtatccaaaccgattgaaaaagtaccaattaaaccagtaccaattaaaccagtaccagataaaaccgtaccagttgaaattcaaaacaccgcaaaggaacaggtcaatcctgatgaaaatgtcgaaaaagaaataataaatccagctaaaaatgttgaagaggaaaagacagatccagatacatcacacttacaatttgatgatgatttggatgaaactttactagaagaatttagcgaagatctaaatgaaaccgccactacatcccaaacaacagaatctgaaatgaacggggacgatttcacaggggaaatggatacaa

SEQ ID NO: 2471 - DNA, 689 bp, Phyllotreta nemorum
atgagtaaaaccgaggcattgactcaagccattagaaagagcatcggagtaagaataaaggaggagagcgaaattatcgaaggagaagttgtcgatctgagcattgaacgtccagccacaggagttggtactaaagtgggtaaactaattcttaaaactaccgatatggaaactgtatatgatttgggcggtaaaatgattgatagtattcttaaagaaaaagttcaatctggtgatgttataaccattgacaaagctacaggaaagattacgagattgggtagatcttttgctagagctagagattatgatgccaccggtcaacaaacaaggttcgttcaatgcccggaaggtgaattgcaaaaacgaaaagaagttgtccacacggtgactttgcatgaaattgatgtaattaacagtcgtacccacggattcttggcactcttttctggtgatacgggagaaattaaatcagaagtaagagagcagattaatggcaaagtagctgaatggcgcgaagaaggcaaggctgaaattataccaggcgtactctttattgatgaggttcacatgttggatatagaatgcttctcctttttaaacagagccttagaaaacgaaatgtctccaatcgtcataatggccaccaacagaggaatcacgaaaattcgaggcacaacttacaaatc

SEQ ID NO: 2472 - DNA, 766 bp, Phyllotreta nemorum
ttcgactcttcagaggatctctgtacaaaaagtaccctggaatgttcaggaggtctatcactaatgaagaaagaaggaggttgattgaactcggtttgagccagcacgttctagcgagcagcgtatcactgcttagagcagaagaagttgaagatataattgaaggaaatgatgaaaagtataaagctgtatctgtacacacttcggagcctcctatgccaagagaggggaaatccaagaaaaacatgcagtgggtaccttcgttacccaactccagtcatttagatgcagttccacaagctacacccattaataggaacagagtagctgctaaaaaggtgaggacatttccactatgttttgatgacaccgatccccaaataaacatagaaaacgcttgtcaacaagaattgctggttcctattagactagatatggaaatcgaaggccagaagctcagagatacgtttacttggaataaaaatgagagtttaataacgcctgaacaatttgctgaagtcctttgcgacgatcttgatttaaatcctttaacatttgtgccagcaattgctcaagcaataagacaacagctcgatgcgtttccgactgaacctcccagtattatagaggaaacctgcgatcaaagagtcattattaagttaaatattcacgtgggaaatacttctttagtcgatcaagttgaatgggatatgagtgaaaaacagaataatcccgaagaatttgcgttgaaactttgcgctgaatt

SEQ ID NO: 2473 - DNA, 358 bp, Phyllotreta nemorum
gaactcgccttatgggatacggcgggccaggaggactacgaccgcctgcggcccctttcctacccggacacggacgtgattttaatgtgtttctcgatcgactcgcccgactccctagaaaacatcccggaaaagtggacgccggaggtgaaacatttttgtccgaacgtgccgattaccctggtaggcaagaagaaggatctgcgtaacgatcccactaccattaacgaactgaaaaaaatgaagcaggagcctgtcaagccgcaagacggtcggtcgatggccgaaaagataaacgccttcgcctacttggaatgttcggccaaaagcaaggagggcgtcagagaagtgtttgaga

SEQ ID NO: 2474 - DNA, 706 bp, Phyllotreta nemorum
agatgacacggacaattcaaaacaacgatgagaaggaagagatgatccaatcggctctgcagatttgcaaatcaatcggccccactatcaacataaccgatatatgcaaggaattcgctaatcttaaagcgtacaaagccgttacggaattgtgcgcgcatttcggcaagaaaattgatccggataaaatagcagaaagctactataacgccgaagacaacagcggtgaccaagaagggtacaattattatcaaagaaggttggaaatttatcgtcatattttgaatatgttggatcagttatacaacgaacaaaatcaaacacaagtcgttagtagagatcctgcatactcagttaatcagaccatattactggatggtgtcgaacagtcccaagtaggatacgtgatgaagcaagtaataaaagacgttatggaaacgcccgatgaaattatgcacttcgccctttacgattggctggtgttcaagaacatgactggagatttgataaacatccaaaatccgtctttggaaacgtatttgaagcgaacatccacccagaatcccaacaacatcgaggccatgaatttgttatggaaatactacgaaagttgtaacaatcacgcagcagctgccaaaattttgaacaacctcgcctcgagaaccggcataaacgttccattgaaagagaggctgtcttacttagc

SEQ ID NO: 2475 - DNA, 718 bp, Phyllotreta nemorum
gcgattttaaagaaagccgaagatggaaacagttccgaaaacattctggttctattcctgagtttcggaaataaatgccagtttcatgtattgaaaccttcagttagagaccaagaaatctctctgcatagattagccactctcgaatcgcctctgaacgatttgatagacttcgccgcacaagtagactgcttgtggtcggtatggcggtcggacgtgggcgaaacggtggtgtacatggcttcgttcaaatccaaccgatggactcaagtaatactcgaatccgaaccgaccgataaatttttccctgtaaaatgcaacgacgtcaagacgctttacctacagcacattttccatccaggcagattccctctgcacgtcattaacaaaactctttcgatttataaaatgcctacgattgggtcagacagccacatgtccatttcagcgctgaagcaaagagtttgtatggccgtggaaaatgacatacaaaacctgttcaataaagacggtactgatattaacagcgttgaagttgatgagtatgtagagtgtgctgaatggtgttggcaaaagttcgactcctgctgcgttcagtaccagatagccagcaggaaaccgctgggtttgatgcttctaccgtccgtatcgggagctatgttgctgaagaaatcggctttttcgttcctgcgacccgtagattcgttggaacacatga

SEQ ID NO: 2476 - DNA, 696 bp, Phyllotreta nemorum
gcagaggatcgtggaaatattcgggagatatctacaagtgatgctggcgaagtacgcggagaatccgaaggagtattggcgcagcaaagacgcggccttgtacttggtaacgtcgctggtcagcaggggatccactcaaaagcacggcgtcacgcagaccagccagttagtggacattacgcagttctgtcagcagcatattttgcctgaattggaacgacccgacgttaacgatttaccggtattgaaagccgacgctatcaagtacgtaatgacgttcagatcggtacttcccagcgatctagtcgtatcgactttacctcaactaatcaggcacatgccgagcgaaagctgtgtggtccacacgtacgctgcctgcacgttagaaaagatcctcatgttgaaattcaacaatcagcccattgtgaccggagccgagctggagcctttggcctcggaattgttgaccaatttgttcgccgtgctccagaagccggtctccgaggagaacgagtacataatgaaggcgctgatgaggacgttcgctaccctacaggacaggatcataccgtatttgaacgtggccttacccaaaatgaccgaaaagctgcaaatggtcgccaagaatccatccaaaccgctcttcaatcattatctgttcgagtgcttttcgttggccataaagatcgtttgcaa

SEQ ID NO: 2477 - DNA, 457 bp, Phyllotreta nemorum
atcacgttcgaatgcatagaggaattaaaagaagatttagaatggaagatgatttacgtaggttcagctgaaactgaagaacacgatcaagtcttagactctgtgttcgtaggacctattccagaaggtaaacacatgttcgtctttcaggcagatcctccgaacgtctcccgtatacctgaaaatgatgccattggtgtaacagttgttctgctaacttgctcttacaggagccaagaattcattcgcgtaggctattttataaataacgaatacagcgatccggaaatgagggaaaacttgcctagtccaccccagttcgataaggttataagaaatatattggcgtccgagccgagggtgacgaggttcaaaatcaactgggaggaatctagcggtactcaggaaaacggaactacagttgccgaagcacccgctaaccaaacagccgaaactt

SEQ ID NO: 2478 - DNA, 798 bp, Phyllotreta nemorum
gccatacaacaacaacaacagcagcaacaacaacaaagtctacctactactaactcacaagtgcctcctctagctccaatgggaggttctactccaacacttggtctaggtttaggccatgctatgtccatgccacatacgaagtatgtaactggatattcactgcccatcagttctatggctcctcaaacaccccaacatacaatgatgagccctatggtgaatgtaggaggaactggtaccactagttctggtgtaacgcctacgttaggtccctctacaccttcaccaatgactcctatgacaccgcattcagcagatcctggaattgttccacaattacaaaacatcgtctcgactgtaaatttgagctgtaaattagacttgaagaaaattgccttgcacgcgagaaatgccgaatataatcctaaacgttttgccgcagtgattatgaggatacgagagccgaggacgacagctttgatattttcgtcgggtaaaatggtgtgtacgggtgcgaaaagtgaagaagactcgagactagctgcgagaaagtacgctcgaattatacaaaaattgggattccctgcgaaatttctggatttcaaaatacagaacatggtgggcagttgtgatgttaaatttccaatacgattggaaggattggttctaactcacagttcgttcagcagttacgagcccgaattgtttcctggtcttatatatcgtatggtgaaaccaagaattgttctgttaatatttgtgtccggtaaggttgttctgactggtgctaaagtc

SEQ ID NO: 2479 - DNA, 513 bp, Phyllotreta nemorum
gctgtcatactcatctgtcatatttataattttttgacagttttggggttattgaagatttttgaagaatcttttatattttatctaccaaagtcccctttcaaagctcacaaaatggctgcaattcgttccatgtctcgcctgttattctccagatcattacaaactactgtaaaaaggggctacgccgatcaaatgagcttcacctttgctgctggaaaccaggtcttctatgacgcaaaatctgtaaaacaagtagacgttccttctttctccggtagcttcggtatactgccagcccatgttcccacccttgctgttctaaaacctggagtagttactgtttacgaagacggcggttcagtccaaaaaattttcgtatccagtggtactgtcactgttaatgacgattcatcagttcaaatcttagctgaagaggcccacccagtagaaaacttagatgtcagtgcggcccgagatcttctccacaaagcacaaggtcaattgtcatcg

SEQ ID NO: 2480 - DNA, 669 bp, Phyllotreta nemorum
agaaatacgagaagtccagcagggagcagcacgcggccgaattgaaggagaaactcgagcaggaagcgcgcaggaaggcgaaaaaagaggccgaatcggccaaacaggctcaaataaccgaattgacggaagaacaagctgagaaattacaagccgagctcgacgctaaaaagtcccctgcttcggcagcaccttcgaatagctccgatactccttcgacttctactgcgaagattgaggaagacgaggacgagtccgagaagggtaaattattgccgaacagagggaacggctgcgatttagaaaaatacaattggacacagacgcttagtgatatagagctgcgcgtgccgctcaaatgcgatttcagagtaaagcaaaaggatctcacggtgaacattactaaaaagcacctcacctgcggcctgaaaggccacccgcccatcatcgacgatgatttccagcacgagatcaaactagaagagaccaattgggtcatagaagacgggaaatcgttgctcttctccatagaaaaggtgaacaaaatgaactggtggagtaaaatcgtcaagtccgatccggagataagcaccaagaaaatcaatccggagccatcgaagctgagcgatctggacggcgagacgcgcggcatggtcgagaagatgatgt

SEQ ID NO: 2481 - DNA, 334 bp, Phyllotreta nemorum
gcgatagagaaaggtggatttgcgtttatccagcgtacattaattgcaaaaagaccatagcccaaggcaggaaactaaacaaagataaatgcgtggagaatcccactcatcaagagatcagagacgttttggtcgcagcaggtttgaaggttggcgtggaaaataaattgtacagcagagaacgaagcaaagaattgctgtatcgagggcgaataagagttcaattgaaaaacgacgatggttcgttgtgcaatccaaattttcccactagagatgccattatgctccatttaggagacatgattcctaagttgaagagtagacagaacaaggg

SEQ ID NO: 2482 - DNA, 700 bp, Phyllotreta nemorum
attcgtaataacccatccggaagtaaaacattggattaaatatgctcgtttcgaggaaaatcatggtttcattcattcctccaggcaaatttacgaaagagctgtccagttttatggagacgatcatttggacgagaagctttacatagccttcgccaaattcgaggaaaaccagaaggagcacgacagagcgagagttatctacaagtacgctttagaccacattcctaaggatgaaacgaaagaactgtataaggcgtataccatccatgagaagaaatatggagatagaagcggtattgaggaagttataatgtccaaaagaaagctgcagtacgaacaagaaatactccaaaatcctacaaactatgatgcttggttcgattatctcaggctggtagaaggagaagcagatttggaaacgacccgagaaacttacgagagagctattgcaaatatacctccgtcaaaaaacaaacaatactggagaagatacatctatttgtggatcaattatgctttattcgaagaacttgatgctaaggattacgaacgaaccagacaggtatataaagcttgcctggaaatcctgccgcacaaaaccttcacattttccaaaatatggctgctctatgcgcagttcgaagtgcgccagaaaaatctaacagccgcccgtaaagttctaggcatgtccatagga

SEQ ID NO: 2483 - DNA, 749 bp, Phyllotreta nemorum
atcatcatccagctgtttgtggccggtctcatcgtgctgctgctcgacgaattgctgcagaaagggtacggtctgggttccggtatttctcttttcatcgctacgaacatctgcgagacgatcatttggaaggctttctctccggctactgtcaacaccgggagaggaaccgaattcgaaggggctgtaatcgccttgttccacttgctcaccaccagacaggataagatcagagggttacgagaggctttctaccgccagaaccttcccaatttgatgaacctcttggctacagttttagtgtttgctatagtaatatacttccaaggttttagagtcgatttgcccataaagagcgccaggtaccgtggccagcattcgagctaccccatcaagcttttctacacttccaacattcccatcatcctgcaatccgctctggtgtccaacctgtacgtcatatcccagatgttggccgttaaatttcaaggcaacttcttcattaatctcctgggggtgtgggctgacgttgggggcggcggcccggctaggtcgtacccgataggcggtttgtgctattacttgtccccgcccgaaagcgtgagccacattttggaagatcccgtccacgctgttatgtacattatattcatgttgggttcctgcgctttcttctcgaaaacgtggatcgaagtgtccggcagttcggctaaggatgttgccaagcagcttaaggagcaacagatggt

SEQ ID NO: 2484 - DNA, 340 bp, Phyllotreta nemorum
gcaggacaagttattaaggctttctacgacgttgtatgtaggaaatctatcattttacaccacagaagaacaaatatatgaattattttcgaaatgcggcgacattaggcgaatcgttatgggtctggacaagtacaagaaaacaccttgtgggttttgtttcatcgagtattacaaccgcgaagatgcggaaaattgcttaaggtacatcaacggtaccagattggacgatagaatagtacgtacagattgggatgcgggtttcatagaaggcagacaatacggaaggggaaaaaccggtgggcaggtaagggatgaatacaggactgatttcgattcc

SEQ ID NO: 2485 - DNA, 669 bp, Phyllotreta nemorum
cgtcaaagcatcggatttagaattgcacccgcccaagaacatctggagccacagcggaatattcagctcgttggaccacgccagcgttcgaaggggctacgaagtgtacaaacaagtctgcgccgcctgccactcgttgcgtttcgtcgcctatcgcaacctgatcggcgtgtcccacacggaggccgaagcgaaggccgaagccgaagagcagatgatccgagacgggccgaacgacgtaggcgaaatgttcacgcgccccggaaagctatccgactacttccccagcccgtaccccaacgaggaggcggcgcgcgccgccaacaacggggcatacccgcccgatttgagctacattacggccgccaggcacggagccgaggattacatattcgcgctgttgacgggttactgcgaggccccggcgggcgtggtgctgagagaagggcaatattacaatccgtacttccccggcggggccatttcgatggctcaggctctgtataacgagacgatcgagtacggagacggtacgccggcgacggcgagccagctggccaaagacgtgtcgactttcttgaagtggaccgccgagccggagcacgacgacagaaaaaggatgctgattaaagttattggaatattctcgttcctgttagggttgacttg

SEQ ID NO: 2486 - DNA, 679 bp, Phyllotreta nemorum
acgtcagcgaatttcaattcgaaaaccagaggagaacgttcgccagttacggttacgctttggacccttccgtaactaacgacgggcaaataaaagtggtcggatcctcggaagccgacgatagcagcattaagactgtgttcgaagcttccaaaacgagaccgttagataaacgaaaaaggaagaaaaacgacgatcccagtgatgtggacgggttcttaggcccatggggtgggttcatagacgaacaaaaaatatctaaaccgaccgaggaggagcaaatcgaactggacgagatatcgtccaaaaagaataaaaagggtaaacccaacgaagataaacccctcgaagaaaaatcagtcctgcacatcaaagacgccgtggattaccaaggacgttcgttcctccacgcgccccaagatgtcggcgtcaacctcagatcggacacaccgcctgataaatgtttcctaccaaaggctcacattcacacttggactggccactcgaagggcatcgctgctatccgattgttccccaggacggctcatcttctcttatcagccggaatggactgtcgcattaaaatctgggaggtctacaacgaaagacggtgtgtaaggacctactatgggcaccgacaagctgttagggatattaatttcaataattccgggaagca

SEQ ID NO: 2487 - DNA, 691 bp, Phyllotreta nemorum
ctttggcagtcaagaaagtcgagccgaaaaaagaagtcaatcccttattcgaaaagagacccaggaattttggaataggtcaagacatccaaccccctagggacttatcgaggttcgtgaaatggcccaaatacatccgcatccaaaggcagaaagccgtcttgcagaaacgtctgaaagtgccgccgccgatcaaccaggtctcccagaccatcgacaaacaaacagccacccaattattcaaagtgttggagaaataccgaccggaaaccgccttgcagaaaaagaaccgactgaaggccaaagccgaagctaaagtggccaaaaaggaagaggccccgactaaaagacccaacaccttaagagccggtaccaacacggtcaccaagttgattgaacagaaaaaagcccaattggtggtcatcgcccatgacgtagaccctattgaattggtgctcttcctccccgccctgtgcagaaaaatgggagtcccctactgcatagtcaagggcaaagccaggttagggctgctggtcaggcgtaaaacttgtgcgactgtcgcccttacccaagtcgattccggagacaggtcgaacttcaacaaactcctggaggtcgtcaagaccaacttcaacgaccgcgccgatgaaatcaggaggcactggggaggcggtatcctcggttccaaatc

SEQ ID NO: 2488 - DNA, 789 bp, Phyllotreta nemorum
tacgcaatgaccgattacttgaggatatccggcatgtactggggccttacggctctcgaattgatgaatgcctcgcctccgcacacaatagaagagatttcagattacatcaaaaactgtcaagaccccgaaagcggcggcataagctcctgcctgaaccacgatcctcacatactccacaccctgagcgccgtccagatactctgcatgtacgacaatctaaaagccatcgacgtggagggcgtcgtgaagtacgttaaaaacctacagctacccgacggtagcttcacgggagacaaatggggcgaagtggacacgaggttttcgttttgcgctgttgccacgctgtcgcttttaaacagaatggacgctattgatgttaataaagctgtggagttcgtagcttcctgtaaaaacttcgacggaggcttcggatcgaggccactctccgaaagccacgccggcttgatttactgctgcttaggattcttgtcagttaccaatagattggatattgtggatcgggacatgctggcttggtggctgtgcgaacggcagctaccttcggggggtttgaacgggcgtccggagaagctgccagacgtctgttactcctggtgggtgctgtcttcgctgaccatactgggcaagctgcattgcatcgacgccggcgctttgaagagattcatattggcctgccaggacacggagagcggagggttcgctgataggccaggggacattccggatccttttcataccgtgttcggtatatcggcgctttctttg

SEQ ID NO: 2489 - DNA, 727 bp, Phyllotreta nemorum
gctggaaagtttgataaccgatttgaaagcggagccccgcgtggcggccaacgtgtgctgggcattctccggattggccgaagctgcttatgaagcggccgctgttaacgaggaaacggggacgccggatacctacattttgtcgccttactacgaattcattatacagagattactcgagacaactgatagagccgacggggctcaggcgaacttgagaccggcagcgtacgaggccctgatggagatggttaaaaattcacctaaagattgctacgttacggttcagaaaactacgatggttattttagaaagactgcaacaggtactgcagatggaaactcacattaccagccacaacgacagatcacaatttaacgatttgcaaagtcttttgtgcgccacattgcagtcggttttgaggaaagtcacgcctgaggatgccccgcatatttccgatgccattatgacggccatgctgaccatgttcaattcgaattcttgtaaaagtggaggcgtacaagaagacgctctgatggccgtttcgacgctcgtcgaggttctaggtgaaaatttcataaaatacatggacgccttcaagcccttcctctatatcggcttgaagaatcatcaggaatatcaagtgtgcggcaccgcagtcggtttgacgggcgacatttttcgcgcattaaaactcaaagcgcttccctattgcgacgaaatcatg

SEQ ID NO: 2490 - DNA, 793 bp, Phyllotreta nemorum
agagggctatgggaagtatttggatttacacgagtgctacgagaagtacataaatttaaaaggcatcgagaaagtggattatatcacttacctggccatgttcgatcagctctacgacataccgaaagaacgaaagacgggggaatacagaaaatatcttctataccttattgaatacctcacgtggtttgtgcaacgcattcggcccctgatggacctcgacagcgatctgcaggaacaagtcgagcaggctttggtcaattgggataacggcatggtcccgggatggccgaaagaaacaggctcggctttggccaacgtgggcgcccacttggacctatcggccttctccagttgggaggaattggcttcgttgggtttggatcgcttaaaatcagccctaatggctctaggattgaaatgcggaggaacgttagaggagcgagcccaaaggctgttttccactaaaggcaaaggctccttggatccttctctcatgaccaaaaacagcaagaatcgaataactaaagagaaagaagccctgaggcaaagagaactggctactctagaagctcaaatttacagattggctgatctggtctcagcccaacgagcagccaccaaagagaacgtacaaagaaagcaagctcgtacagacggcgaaagagatgatagcgagaacgaagagagcgaggaagagagcccggacgaaggtgacgatgacgtcccgtacaatcccaagaacctcccgctcggctgggacggtaaacccattccgtattggctgtacaaa

SEQ ID NO: 2491 - DNA, 563 bp, Phyllotreta nemorum
cgtttatcggcactttcaaagctttcgacaagcatatgaacatgatactcggcgactgcgaagaattccgaaaaattaaacccaaaaactcgaaagtcgaacgagaagaaaaacgggtattaggatttgtattgctcagaggcgagagcatagtctcactgactgtagaagggcctccaccaccagaagagggacttcctagggtacctatccccggagcagcccaagggccaggtataggaagagcagcaggtagaggaatgcctcccggtatggctggagttccagtaggtctccaaggccctgtaagaggagtcggaggaccgtcccagcaagtaatgacgcctacgggtagaggacaagtttcagcgccaccacaaatgaaccaagcgcctccaagaatgggcggcccaccgcctggtatgatgggaccaccgcccggcatgatgggcatgccaccgcaaatgggcatggggcgcggaggaccgcctccgatgggcatgaggggtcccccgcccggtatgatgagaggcgggccgcccggacccccgaggccatattaa

SEQ ID NO: 2492 - DNA, 690 bp, Phyllotreta nemorum
catccgctaaatacacaacgtttaaatttaggacaatttcactgcttattcggtgaattgcggaagtatccggaaagatttttcaattattacaggatgtcgatcacttccttcgacgaattagttttgtttcttcgacctcggctgcaaaagaacaatactcgattttgcaaagtaataagcgtagaggagaggttaacaataactctaagatatttggcgacgggtacgaattttgctgcaatgcagcactcattcgttatgggaagaactacaatagcggaaatagttaaagatacgtgcactgctctatggataacattacaacccattgaaatgcctgaacctaccacagaaagatggttgcaatatgctaacgaattctggtcgcgttctaattttcccaactgtattggagctgttgacggaaaacatattcgtctaatgtctccacaacatagcgggtcacaatactttaattacaaaaagtatttttcactaatgttaatggcaattgctgatgcaaactactgttttattgctgtcgatattggtgcctatggcagagaagccgattgtaacgtttttaagcaatctaccttgggagtgaaaatgtataataatactttaaatcttcccccccctcgaggtttgcccggaaccaatgaaccatgtcagccatttgtgttt

SEQ ID NO: 2493 - DNA, 321 bp, Phyllotreta nemorum
cgaatcctcggatatgatggccggttacgatcacgaagaaaccgatataatcatctcagatccaaccaccagcgttcccgaagactcaatttccactaaggaagacttcgaggagctcattgacgaaggatcgcgcaaaaacaacatcagcaaacaggaagtgaccgccaaacacattcaggatttccacaggtacaccgaattgttcgattacggcaaacctgacgcagttaagaaaccgggcggcaaaaaattccaaccgaaagtgtctctcgttggaggagtagctttgccgagtaagcccaacgcagagaagattat

SEQ ID NO: 2494 - DNA, 800 bp, Phyllotreta cruciferae
gctcgattgagatctcacattagaatacaagacggacgagccaagccgattgatctactagcgaagtacataagcgccgaagaagaagtcgatgccgttgaaatgcacgagccttacacttacctgaatggcttacaaatcaaagacctagaagacttagtagaagacatcaaagtctacaaggaactagaaagaggaaaaaacctagattactggaacgatataacagtaatagtcgaagacgagcttcagaagttgagaaaaattgaaaaacaaaacgattttgacttgggattgaaccgaagggaaggaatacatcagtctgtcgccactgatgtaacatcagtatttaaaggcaaaacagccgcacaattagcagcgttagaaaaacaaatcggaagcaaaatcagcagcaaagccgatggaatagacataggctattgggaatctttgctatcgcaacttaaggcccacatggcgagggccagactacgtgacagacatcaagatagcttaagaaggaaactgcaagtacttaaagcagaacaagccatcacaggagtaggtcaaagccatagcgaaacccattctactgataacgaagaaaccacttcggaacccaaaccaagcacttcccaggatactttggaaacgatggaagaaagcaacgaaaagaccgaagacgctgctcatgaatggctcaacgaatgcttttcagcctatcaagcaggcgggtacagtcctaagtttttaactcccgatgacaccgagcctggtacgattgtagtctcggaggaaga

SEQ ID NO: 2495 - DNA, 741 bp, Phyllotreta cruciferae
tgtaccgaaaaatcccgaatggaaatgcaaaacctgctgaatcaaccgcccatcgagaacccgtacggggagcccattcaagccgaaaaggccccagaggccatcagcaaggccgtggcttccctgccacccgaacagatgttcgagctcatgaagcaaatgaagactaccatacaaaataatcccacagaggctagacaaatgctattgcagaatccccaactggcttacgctttattacaagcccaagtggtcatgaagattatcgatccccatacggccgccagcctactgcacccggttaaccaagtaccggccactttgctgccgggggacaagaacgtggccgtgcaagtaccaataaacaaccagtaccgggagccccctgcccccgtacaaccgcccaggcaggagtaccagccggtaccgccgcccttagtacatcccaatcacgttcaacaacccgtgtttaccggtcaagatgtggacttgcgatcgatgggaaatgtgactgatccgagaatcaggcccatgattgtggatcaggatatgagacaaatgccggccgttatccagaatcctctaccgcctactattagcgaaagtttttcgagggatccccgaagcggcaccagtttcccatcggatccaaggcaagctaggatggacccgcgtcaaaaaaatatagtaccaccgacgagccaacaagtacccccaacggtgaatcccaagataatgccc

SEQ ID NO: 2496 - DNA, 661 bp, Phyllotreta cruciferae
gaagcaactgacagaagagaaattcattgtaaaggcaacaaacggtcctcgttacgtagtcggttgccgtcgtcagctggataaagccaagttaaaggccggcacaagagtagccctcgacatgaccaccttaaccataatgcggtacttaccgagagaagttgatccgttagtttacaacatgagccacgaagatccaggagatgtcacttactcagccatcggtggactttccgagcagatcagggaattgagagaagtcatcgaattgcctctcatgaatcccgagttgtttatgcgagtgggcattacaccaccaaagggttgtctgttgtatggaccgcctggaactggtaaaactctgttagccagagcagtggcgtctcaactggatgcgaatttcttgaaagtcgtatccagtgctatcgtagacaaatacatcggtgaatctgctaggcttattagagaaatgtttaactacgccaaagaccaccaaccgtgcatcatttttatggatgaaatcgatgctattggtggccgaaggttctctgaaggtacatcggctgatagagaaatccaaaggacgcttatggagttgctgaatcaaatggatgggttcgattcgttaggacaagtaaaaatgattatggcgaccaatagg

SEQ ID NO: 2497 - DNA, 641 bp, Phyllotreta cruciferae
tatgccatggaagccatatcacatgcaggaacatgcctaggcattctggcgaacgacggaatccttcttgccgctgaaagacgtaacaccaataagctgctggacgaagtttttatttcggagaaaatatacaaactcaacgatgatatggtttgcagcgtagcaggaattacttctgacgcaaatgttttaacaaacgaattgcgtctgataggacaaagatacttgtatcagtacggcgaatcgatcccttgcgaacagttagtttcttggttgtgcgatgtaaaacaagcttatactcaatacggaggaaagcggccttttggtgtatcgatcttgtacatgggctgggataagcattatggttatcaattgtaccaatcagatccgagtggaaattattctggttggaaagcgacttgcataggaaataacagttctgctgccatttcgagtttgaaacaggaatacaaggaaggcgatatgactttgaaagatgccaaaggtttggctgtgaaagttttggcaaaaacgttagatatggctaaattgacttcagaaaaagtggaaatggctactctgacacgtagaaacgataagaccatgataaatatattaaatagcaaagaagtggaagaact

SEQ ID NO: 2498 - DNA, 670 bp, Phyllotreta cruciferae
gtgtaccttatgtcgctgatcccgaaaatactactcttcttcaaactgctttaatgctgttcaggaaattcaagcagtaccctcaagcacttcggttggctatgcaactgaacgatcacagtctcatcgaggaaatattcctaaattgccccgatactgacgtacaaaaacagttggcgttcatgttgggcaggcagcagatttacatcgaagttcccgacagcacgccggagtacgaagatctcatcgaaattatggcgaattgtcacctgaataaccactttttgaatctagcacgtgaattggatattatggaccccaaaaccccagaagatgtttacaaatcccacttggaaaacagccgtcctccattcggtggaagccaagtcgattcggccaggcagaacttggctgcaagttttgtcaacggtttcgtaaacgctgccttcgggcaagataagctcttaatggaagatggaaacaaatggctgtataagaacaaagaacatggcatgctaagcgctactgcctctttgggtttagtattattatgggatgtagatggtggtcttacgcctattgataaatacttgtactcctctgaagatcacattaaatccggagctctattggcatgtggtattgtcaattgtggagtcagaaatgagtg

SEQ ID NO: 2499 - DNA, 742 bp, Phyllotreta cruciferae
caaccatcagtaccagaacatgtacatagagagaactacagttgataattctccttctgctactgttttgtatcgggatgatcccaatttgggagcttctagattccaaggaaattacgacatatccagctctcaatcgcaagtgaaccttcttccatccgcaccaggagaaacctactatacatcaacacctaactggacgccgacgagcagcggtacttaccaacagcagtacccatctgggaccataaacgtccttcaggcggattcgactcaagccttcgggagtccatacataaacgcgacatggtcgtcgaattcgatggaggacggacggccgtctagtcaagaggtactagtgaaagagtgcgttaattgtggtgctagcgtcacaccactttggcgtagagacggtacggggcattatctatgtaacgcgtgtggtttataccacaaaattaatggggtgcacagaccgccgactaagccaaccaaaaaaccacaggcgactggaaatagaagaaacggcgtaacgtgtgcaaattgcaaaactaacaacacaactctttggagaagaaacaaccaaggcgagccagtttgtaacgcttgtggactctattacaaattacataatgttaacaggccgatcagtatgaaaaaggaaggtatccaaacgcgcaaaagaaggcccaaaaactcttctgtgggaaaccccgccagtgctgcaggtcaagtaagactt

SEQ ID NO: 2500 - DNA, 667 bp, Phyllotreta cruciferae
ttaggactcagtttgctcacagtagcgttcgaaattagcgcagataacataggcaaatacagcacattgttgaccctagtggaagacgatttgtgcaggaatctgttcgctttgatgaacaccgatcgtttgacgatattcgctgcgaatctgcaagtgtcgtttctgctgttcgaatcgctgagagcccacttgaagtaccaattggaatgctatttgaagaaactgatggaaatcttgcgtagcgaatcgaacaaggttagctacgagcacaaggaaatcgcgctggataatttgctgcaattgtggagagtgcccgggttccatgcggagctgtacgtgaactacgattgtgatatgtattgtactaatttgtacgaagagctcaccgaactgctggccgaacggtccatttccactatagtaggtgtctatcatgcgcatttactgtcgctcgatggacttctgattataatcgatggcatagggaagagattcgacgaagcgaaagatcgtacagacaccgatgagattagtagttatataggagagaatacgagaattaaaggttgtgttaaagttcccgataagaaggtgctggctgccaagaaagggatcaaaaagtggttaccgcaaggtacggagtatttcaatcagaagccgaaga

SEQ ID NO: 2501 - DNA, 480 bp, Phyllotreta cruciferae
atacaagcccaaaccgtcgccacggatttcgagaaagtcttcgaaatgggcccccatttattcgtgggcctccccggcctcgccaccgacacgcaaacagtcatggagaagctcagattccgcaagaacttatacgaattgaaagagaaccggcggatctcgcccaaagtgttcgcagccatgatatcgaacatgctgtacgagaagagattcgggccgttcttcgttgaaccggttgtagcaggtctagctcctgacacattcgagccttatatatgcaacatggatttgatcggttgtataaacgaacccagtgatttcgtcgtaggaggcacagcctccgcgcaattatacggaatgtgcgaatctttatgggaacctaatctagcccccgatgatttattcgagactatatcgcaggctttgattaatgctttcgatagagatgctatatccggttggggcgctacggtttatatc

SEQ ID NO: 2502 - DNA, 722 bp, Phyllotreta cruciferae
aatacacctccgtccttctactgggcgaattagccgaatggatagaaaaacacccggacgccctggaccccgtcctgaatttcctagtatgctgtctccgcagcggcgccgaaggaggaggcgtcgcgacggcggcggccgcggcgctgcagaacgtctgcacgtgctgcggcgctcacatgggcaggcacgttcccattctgttacagttacttcaacagtcggattcgttcggaatcggcaacacggcggtggtgggattgttgaagggcgtcgcgtcggtggtgagttgcggcatgggaggcggcgccgagacggcctccgccgtcagggaattgtgttctatgcaattgtcgccgctgtgcagtttgatggagaacgacgttcggccggttaaagggactctgacggatccggtgctgtggttggatcgattgagttcggttttgcgatacgttaacgtcaatatagtcgaaggcgaaatccatccttgcaaaccggtaatattggagatatggccgatactatcccgcgcattcgacacctaccacagcgacgttcgaataatggaaaggtgctgtcgctcggtgcgtttcatgttgcgttgcgtggcccgacaactccaggatttgctgccctctttggtcggacaaatcgtgcatatttactgtctctacgggcattcgtgttgtttgtacgtgggcagcatcttagtagacgaa

SEQ ID NO: 2503 - DNA, 712 bp, Phyllotreta cruciferae
acatccaagaagccctaaagcgccccatgaagcagaaaagaaaactacgaatcttcatttctaacactttctacccggcaaaagaaccccaacccgaaggccccgacggcccttgccaagagggcacggtagcctcatgggaactgagagtcgaaggcaggcttctcgaagattccaagaacgatccgaacaaagtcaaacgcaaattctcctcgttcttcaagtctttagtcatcgagctcgacaaagagctatatggccccgacaaccacttggtcgagtggcacagaaccttaaccacccaagaaaccgatggatttcaagttaagagacccggagacaagaacgtgagatgcacaattctcttgctcctcgactaccaacctctgcaattcaagctcgatccgaggctggcccgattgcttggtgtacacacacaaacaaggccagtgattatctccgctctgtggcagtacatcaaaacgcaccggctacaagacggccatgaacgcgagtatatcatttgcgacaagtatttagagcagatcttcaactgtactcgcatgaagttcgctgaaatcccccaacgattgaaccccctgctacacccacctgatccgatcgttataaaccacgttatatcagtcgaaggcggcgctgagagcaaacaaacggcttgctatgatatagatgtggaagttgatgacactct

SEQ ID NO: 2504 - DNA, 282 bp, Phyllotreta cruciferae
tcgagccaactttagatgaattggaacaaaaaatgagagaggccgagaccgaatcacacgaaggaaagcgaaagaacgaatcattgtggcccatattcaaaattcaccaccaaaaatcccgatacatcttcgacctcttttacagaagaaaggcaatcagccgggaattgtacgaatattgcttactggaaaacatcgcagacaagaatttaatcgcaaaatggaagaaacaaggctatgaaagcctttgttgcctgagatgcatccaagcaagagacacta

SEQ ID NO: 2505 - DNA, 679 bp, Phyllotreta cruciferae
aatatgtcgcaatggacactgaatttcccggagttgtggctaggcccataggtgaatttcgaagttcggccgattaccaataccaaatgttaaggtgcaacgtagacttactgagaattattcaactaggtttaacgttcttagatgataatggtaaaacaccaggaggtgtttatactacctggcaattcaattttaaattcaaccttcaagaagacatgtatgcacaagatagcattgatttactgcaaaattcaggaatccaattcaagaagcacgaagatgaaggtatcgagccgttagagtttgccgaattactaatgtcatctggaatcgttctcatggaaaatatcaaatggttatcgtttcattccggctacgattttggctatttaataaagttactaaccgacaacaatctcccacaagatgaaactgaattcttcgatctgttgaaattgtattttcctacgatatacgacgtgaagtatttaatgaaatcgtgtaaaaatttaaaaggtggtcttcaagaagttgccgaacaattagaattggaaaggattgggcctcaacatcaagctggatcggactcgcttttgaccggaatggcctttttcaaaatgaaagagatgttttttgaggatactattgacgattcgaagttttcgggccatcttta

SEQ ID NO: 2506 - DNA, 750 bp, Phyllotreta cruciferae
catcttcgcatatggtttcgagaagccttcggctattcagcaaagggccattattcctgtgatgaaaggccgagatgttatagcccaagcacagtcaggtaccggtaaaaccgctacattctccatagctattctgcaagctctggatttaacgatgagagaaacgcaggtgttgtgtttatcccctacgagagaattggctgtacagattcaaaaagttatattagctctaggggatttcatgaacgtacaatgtcatgcttgcatcgggggtacgaaccttggagaagacattagaaagttggattatggacagcatgttgttagtggtacacctggaagagtttacgacatgattcgtagaagagctctgagaactagatcagtgagaatgctagtactagatgaagctgatgaaatgctaaacaaaggcttcaaagaacaaatctacgatgtgtacagatttcttccaccgtccactcaagtggttctcatatctgctacgttaccccacgaaattttggagataacatccaaattcatgaccgatcccatcaggattctagttaaacgtgacgaactgacgctggagggaatcaagcagtttttcgtggccgtggagagggaagaatggaaattcgacactctatgcgatctctacgacaccttaaccatcacccaagccgtaatattctgcaatacgaagagaaaggtggattggttaaccgagaagatgcgagagaacaactt

SEQ ID NO: 2507 - DNA, 678 bp, Phyllotreta cruciferae
tactgtggaagataccgagttgattgagggtatcgttttctcgcagaaatctgctaacgtatctggcccgaagagaatcgaaaaggctaagattggtctcatccaattctgcatttctcctccgaaaactgacatggaccacaatgttattgtatcagattacgctgcgatggatcgagttttgaaggaagaaagagcttacattttgaacattgttaaacagatcaagaaagccggttgcaacgttcttttggttcagaaatcgattctcagagatgctgtatctgatctagctcttcactttttggataaaataaagtgcatggttgtcaaggatattgagcgagaagatatagaatttgtatgcaaatcgttgggttgccgaccaattgcatcactcgatcatttcaccgcagagaatctagtaactgctgatttggtcgaagaagttggagtaggcggtaaccgaatggtaaaaataacaggtattcaaaacgccgggcgtactgttaccctactcgtgagaggctcgaataaactagtattagaggaggctgagaggtctctgcatgacgctctttgcgtcattcgttgtcttgttcgcaagaaggcgctgatcgcaggtggcggggcaccggaaatcgaagtcgcccttaagctggctgctatggctaataa

SEQ ID NO: 2508 - DNA, 741 bp, Phyllotreta cruciferae
gcaagatctagacatggaggatttgtacacgaaatacaagaaactacagcaaaccttggaattccttgaagtccaggaagagtacatcaaagacgagcagaggaacttgaaaaaggagtacctacacgcacaagaagaagtcaaacgtatccaatcagtaccgctggttatcggccaattcctagaagcagtagatcagaataccggcatcgttggatcaactaccggttcgaattactacgttcgcattctctccaccatcgacagggaattactgaaaccctctgctagcgtagccctacacaagcacagcaatgctttggtggacgtgctaccccccgaagcggactcctcgattagcatgctccaagccgacgagaaaccagacgtacaatacagcgacatcggaggtatggatatgcaaaagcaggagattcgagaggccgttgagctgccgttgacccacttcgagctgtacaaacaaatcggtatagaccccccgaggggtgtgctgatgtacggaccacccgggtgtggcaaaaccatgctagctaaagccgtagctcatcacaccacagctgctttcattcgagtggtgggttcggagttcgtgcagaagtacctgggcgaggggccgaggatggttagagacgtgttccgtctggctaaagagaattcccctgctattatattcatcgatgaaatcgatgcgattgctactaagagattcgatgctcagac

SEQ ID NO: 2509 - DNA, 362 bp, Phyllotreta cruciferae
gacgataaaaaccatgctggaggacctcggcatggacgaggaagaggaggaagtggtgccgttgcccaacgtaaactcagccattctacggaaggtcatccaatgggccacctaccacaaagacgacccacccccgcccgaagacgacgacaacaaagagaagcgaacggacgacatatcctcgtgggacgcggatttcctgaaagtcgaccaaggcacactattcgaactgatcctagccgcgaactatctcgatataaaaggcttgctggatgttacttgtaagactgtggccaacatgataaagggcaaagcgccggaggaaatacgtaaaacgtttaacatcaaaaacgatttcacgc

SEQ ID NO: 2510 - DNA, 705 bp, Phyllotreta cruciferae
tgtgtgataaggcgaaagaaatactgtccaaagaatcaaatgtgcaggaggtaaaatgtcctgtcaccgtttgcggagatgtacacggacaatttcacgatctgatggaattatttaggataggtggccgaagtccagatacgaattacctttttatgggtgactatgtcgatcgtgggtattattccgtcgagactgttactcttttggtggctttgaaagtcaggtataaagaaagaattacgatcctgaggggaaaccatgaatcaagacaaatcactcaagtatatggattctacgacgagtgcctgcgaaaatacggaaacgcgaacgtttggaaattcttcaccgatttgttcgattacttgccgcttacagcgctcgtcgatagtcaaatattctgtttgcacggagggctcagtcctagcattgataccttggaccatattagagccttagatcgtttacaagaggttcctcatgaaggtccgatgtgcgatcttctctggtcggatcccgacgatcgcggaggttggggcatttctcctcgcggtgcaggatatacctttggacaagatatatcggaaacgttcaaccacagcaacggtttgacgttggtctctcgggcccatcaacttgtcatggaggggtacaattggtgccatgacagaaacgttgtaacaatcttcagtgctccaaactact

SEQ ID NO: 2511 - DNA, 770 bp, Phyllotreta cruciferae
ttaaagccaagatccaggacaaagaaggtatcccaccagaccaacaaagattgatcttcgccggaaagcaattggaagatggccgtactctttccgactacaatatccagaaggaatctacccttcacttggtacttagacttcgtggtggtatgcagatcttcgtaaaaactctcactggcaagaccatcacccttgaagtcgagccatctgacaccattgagaatgttaaggctaaaattcaggacaaagaaggtatcccaccagaccaacagagattgatcttcgcaggaaaacaattagaagatggccgtactctttccgactacaatatccagaaggaatctactcttcacttggtacttagacttcgtggtggtatgcagatcttcgtaaaaactcttactggaaagaccatcacccttgaagtcgagccatctgacaccattgagaatgttaaggctaaaatccaggacaaagaaggtatcccaccagaccaacagagattgatcttcgccggaaaacaacttgaagatggccgtactctttccgactacaatatccagaaggaatctaccctccacttggtacttagacttcgtggtggtatgcagatcttcgtaaaaactcttactggcaagaccatcacccttgaagtcgaaccatccgacaccatcgagaatgttaaagccaagatccaggacaaagagggaattcccccagaccagcaaagattgatcttcgcaggaaaacaattagaagatggccgt

SEQ ID NO: 2512 - DNA, 702 bp, Phyllotreta cruciferae
agaggcatggacaaattgatcgtttccaacagaggctcggccaccatctcaaacgacggagcgacaatactaaatttactagacgtggtgcatccagcagcgaaaactctagttgacatagcgaagtcacaagacgccgaagtaggcgatggcacgacctcggtggtgctgttagccggcgagtttttgaagcaactcaagtcctacatcgaagaaggcgtccacccgaggatcatcatcagagccgtgcggaaggccacccagatctgcttggagaagatcaacgcgctggccgtcaaaatcgacaaatccaacgccgaggagtacagatcgctgctggacaaatgcgccgccaccgcgatgagctcgaaattaatcaacaaacagaaatcgttcttctccaaaatggtagtcgatgccgtgttactcctcgacgaacttctaccgttgaacatgatcggtataaagaaggtccaaggcggtggtttggaggaatccatgttggtagccggagtggccttcaagaaaaccttctcgtacgccggattcgaaatgcagcccaagatctacaaagactgcaagatcgccctgttgaacatcgaattagaactgaaagcggagagggacaacgccgagatccgcctgagcagcgtcaaggagtaccaaaaagtagtcgatgcggagtggaacatcctgtacaac

SEQ ID NO: 2513 - DNA, 761 bp, Phyllotreta cruciferae
accctttcagagacgatctaatacaagccgttaaagagtaccaagtgctgattataaaaggtgaaaccggttctggtaaaaccacacaaataccgcaatatctccacgaagccggtttcactgctgatggtaaaaaaatcggttgtacacagcctagaagagtcgcagctatgtcagtagcagccagagtagcccaagaaatggacgtaaagctaggcaacgaagtcggatacgccatcagattcgaagattgcacttccgaacgaaccgttataaaatacatgaccgatggtacattacacagggagtttctatcagaaccagacttgcaatcttacagtgtaatgattatagatgaggctcacgaacgaacactgcacactgatatattattcggtttggtgaaagatatagccagatttagaccagatttgaagctgttaatatccagtgctacgttagatgttaccaagttttcggagttcttcgatgatgctccggtgtatcaaatcccaggcaggagatttccagtggatatctactacacgaaagcccctgaagccgattacgtagacgcttgcgttgtctctatactacaaatacacgtaactcaaccattgggtgatattttagtattcttgaccggtcaagatgagatcgaaacttgccacgaactcctgcaggatcgagtacgacgtttgggttcaaaagttaaagaactgattatacttcctttatatgctaaccttccgagtgatctg

SEQ ID NO: 2514 - DNA, 697 bp, Phyllotreta cruciferae
cgagctattgggcttagaattagagaaacaaaggaagtctacgaaggagaagttagcgaactgacacctgtcgaaacagaaaacccagcaggaggttacgggaaaactgtcagtcatgttgtaatcggtttgcgaacagccaaggggagcaagcaattgaaactggatcccagcatatacgaagccctgcaaaaagagaaggttgaggtgggggatgtcatttacattgaagccaccagtggggctgtgaaaagacagggaaggtccgatgcttatgctacggaattcgatttggaagccgaagaatacgtacctcttccgaagggagatgtgcacaagaagaaggaagttgtacaggatgttactttacatgatttggatgctgctaatgcgaagccacagggtggtcaagacgtgttatccatgatggggcaactcttaaaaccaaagaaaaccgaaattacagataaactcagaaaagaaatcaataaaattgttgacaaatacattgatcaaggtattgctgaattggtaccaggtgttttattcatcgacgaagttcatatgttggatatagaaacattcacttatctccatagagctttggaaagcgctatagccccgattgttatttttgctactaatagaggtcgttgtcttattagaggaaccgatgatgtattttctccgcatggaa

SEQ ID NO: 2515 - DNA, 686 bp, Phyllotreta cruciferae
tagttcgcctgatttggaaagtggattttctagggaactgtttttacaatggtgttctaatcctaataacagtattatattaactacaaggacctcacctggaactttagccagggatttaattgacaatggaggaggaagaaccatagacttgatagtagagcgaagagttaaattggaaggccaagaactcgacgattatgaaaggcgacaaaggtctaaatatgacaaattagaagaagatgaagccgattctgattcggattccgatattgaaatgtcagtcacctccaaaggcaaacatgacattgttatcaaacaagaaggcaaaatatccacgggattttttaaagtcaccaaaaaaatgtaccccatgtatcctttcaaggaagataaaataaaatccgacgaatatggcgaaattgtgaaagcagaagattacaaattagcggaaatttcagctgaaggcgaagataacaaagagaacatagtgattaaaaaagaggaagaggaaataactgaaattactgagcaaccaaccaaatgtataattcttcaacgaacagttcaagtaagttgtcaagttcaatacatcgatttcgaaggtagatcagatggagaatcgttgatgaagattttaacgcaattgaaaccgagacgagtgattgttgtacatgggactgaag

SEQ ID NO: 2516 - DNA, 679 bp, Phyllotreta cruciferae
actgctcaattcgtagctagaaatggtcgagcttttttaacccaattgatgaatagagagcagaggaacttccagttcgatttcttgaggccgcagcattccttgttccaatatttcaccaagctgttggaacagtacactaaagtactaatacctccgaagagcatggagcagaggctcagagacgaagccaaaagcgccaaagccgtcctagagcaagtcaagtacagggccgaatggttgcggtatcaggaacagcaaaaggccaaggaagaggagatactcgagagagaacgggtggcgtacgcgcaaatagattggcacgatttcgtggtggtggaaactgtcgattaccaaccgttcgaaatagggaatttcccgccgcctactacccccgaagaagtgggtgctaggatactcatacaggagaggatcgaagaaggcgaagatatcgaaatgcagttggagagcgatgaagatgacgatacgaacgctgatgacggtttgagttccatgcaggataagacgaagcgcaaaggaggcgatgataatcgtttgcaggacatggaagaggatacttctgatgaagataatgatgatgatagcggtaaaacgggagcggcttcatcgctcattcaaccgccattgccgcctataccggataaagtgctggtgaaga

SEQ ID NO: 2517 - DNA, 694 bp, Phyllotreta cruciferae
agtggaccatttcaatcgaatgggcaaaatcggcaatcaaaagcgtgttgtcggtgttctactcggttgctggagggccaaaggagtcttagatgtatccaacagtttcgcagtccctttcgatgaggacgacaaagacaaatctgtatggtttttggaccatgactacctggaaaacatgtacggcatgtttaagaaagtcaacgctagagaacgcgtcgttggttggtaccacaccggtcctaaattacaccaaaacgacatcgctatcaacgaattaattcgaagatactgccccaattcagtcttggtgattatagatgcgaaacctaaagatctggggcttcctactgaagcataccaagcggtagaagaggtccatgatgatggctctcctacatctaaaacgtttgaacacgtcccgagcgaaataggcgcagaagaagctgaggaagtcggagtagaacatttactaagagatattaaagacactacagtgggaactttatctcaaaggattactaatcagttattaggccttaaagggttgcatttgcaattgagagatataagagactatttgatgcaagtgtgcgataacaaactgcccatcaatcatcagatcatctatcaattgcaggatattttcaatttgttgcccgatataaatcaagatgcgttcaacaattcgttt

SEQ ID NO: 2518 - DNA, 675 bp, Phyllotreta cruciferae
agatcgaaacgacaaaaacgccgtagcccaagtggtcaaaggctgcataggaacgaaattcttgagcaagtggtcggatttggccgtcaatatcgctttagatgcggtaaataccgtcttattagaagaaaatggtcgaacggaggtggacatcaaaaggtacgccaaagtcgaaaagattcccggtggttcggtggaggaatccaggatattgagaggcgtaatgttgaacaaagacgttacccatcctaaaatgaagcgacacatcaagaatccgagaatcatccttttggattgcgctttggaatacaagaaaggagaatctcaaaccaacgttgaaattagcaccgaaactgattttaccaaactcctcgaattggaagaagagcacgtcaagcggcaatgcgacgagataatcgccctcaagccggacgtagtgttcaccgaaaagggagtatccgatatagcccagcacttcctgctcaaggccggcatcaccgccatcaggcgtgtcagaaagtcggataacaaccgaatcgctcgagcttgtggcgctgtcatcgtcaacagaacagaggaactccaggagtccgacgtcggcaccggagccggcgtattcgaaatcaagaaattcggcgacgagtacttctgtttcatcgacgaatgcaaaaatcc

SEQ ID NO: 2519 - DNA, 557 bp, Phyllotreta cruciferae
cgttgaacgccagattaatccgtacgctgataatggaggaagcgtagtagcaattgcaggaaaagattttgtggttattggcgcagatacgcgtcttagttccggcttttccatatacactaggaaccagaacaagctgtttcctctatctgagacaactgttttaggatgttcaggttgttggtgcgatactttaacgttgactcgtattataaagtctcgtatgcaaatgtactatcaagagcacaacaagaacatgtctacaacagcggctgctcaaatgctgtcgaccatgttgtactataagcgatttttcccttattacatatcaaacattcttgttggattggataatgagggaaaaggttgtgtctacagctacgatcccgttgggcattgtgaaaaagctacctatcgagcgggtggttctgcaggggctttgcttcagcccttattggacaatcaaattgggcaaaaaaatctacagaagccttcgcaagaagatcttactcaggaaaaggccatttctacactgaaagatgttttcatttcggctg

SEQ ID NO: 2520 - DNA, 691 bp, Phyllotreta cruciferae
tggaaaaataatcatgccgccttcggcactggaacagcttactcgattaaacattaactaccccatgttgtttaaactagttaataagaagacaaatcgtacgactcattgcggtgtattggagttcgtagcggacgaaggaaaggtctacctaccattatggatgatgcacaatttggtactaaccgaaggcgatttggtgcaaatggaaagcgtttcgttgccagtgggaacgttttccaaattccagccgttgaatccggatttcctcgacatcaccaacccgaaagccgtactggagaattgcttgcggtcttttgcttgtctgaccaacggcgacgtgatagccgtgaggtacaatcaaaaggcctatgaattgtgcgtgttggaaaccaagcccggtaacgccatcagtataatcgaatgcgatatgaatgtggaattcgcggctcctgttggctacaaggaacccgaacatgctaaaaaagaagaagaaatgtcggtggatcccgcagatttaatgcccgaaccgtcgggattcgtggcttttaggggggccgggaatcgattggatggtaaaaaacgcaaagattcttcctctaatgatactccttcggttaaaccggcttacgttaggggaattcccgactacgattatcaaattggcactctagatttcatcaggcgtacg

SEQ ID NO: 2521 - DNA, 744 bp, Phyllotreta cruciferae
ttccaatttccgctgaaaacaccgagccccttgtaaaagttgcgatgactacattaggttcgaaaatcattaacaagtgtcacaggcaaatggccgaaattgccgtaaatggcgtgttagcagtagccgatctccaacaaaaggatgtcaactttgaactcattaaagtagaaggaaaggttggtggtaaattggaagacacgacattagtaaaaggcgtcgtcatagataaaacaatgtctcatcctcaaatgccgaaggaacttaagaatgttaaattggccatcctcacctgcccgtttgaacctcccaaacccaagaccaagcataagttggacgtcaccagcgtcgatgactacaaagaactaagattgtacgaacaagaaaaattcaaggaaattgttggcttagtcaaaaaagctggagctaccttggctatttgccaatggggatttgacgatgaggccaaccatttgctgttgcagcaggagttacctgctataagatgggttggcggtccagaaatagaactcatagctattgcgaccggtggaagaatagttccacgattcgaggaactcagccccgagaaacttggttctgccggtttggtacgtgaaatatcgtttggaactaccaaagataagatgatggtgattgaagaatgctcgaattcccgtgccgttaccattctcgtcagaggcggtaatcaaatgttggttgatgaagccaagaggagtttac

SEQ ID NO: 2522 - DNA, 205 bp, Phyllotreta cruciferae
aaaaagtggaatgctgtagcactttgggcttgggatattgttgttgataactgcgctatatgccgaaaccacataatggacttgtgcattgagtgccaggcaaatcaggcctctgcaactagtgaagaatgcactgtagcttggggagtatgcaaccacgctttccactttcactgtatttcaagatggttaaaaactaggcagg

SEQ ID NO: 2523 - DNA, 680 bp, Phyllotreta cruciferae
aacattgctagaacgaccttgagctcgaaaattctatctcaacacaaagaacacttcgcgaagctcgctgtcgatgccgtgctgaggttgaagggctccggcgatttgcaagccattcaattgatcaaaaaaaccggaggaactttgcaagaatcgttcctcgacgaaggtttcctgctcgataagagacccggcgtgcaccagcccaagcgagtcgagaacgctaagatcctgatcgccaatactccgatggacaccgataaaatcaaggtattcggctcgcacatcaaagtcgattccatggctaaaatcgcggaattggaatccgccgagaaagataaaatgaaagacaaagtcaacaaaatcctcaagcacaacgccaatgtattcatcaaccggcaactcatttacaactatcccgaacaactgttcgcagatgctggcgtgatggccattgaacacgctgatttcgatggtatcgaaagactggcgctggtcaccggaggagaaatagtctcaactttcgatcacccagagctcgtgaagctgggaacttgcgatctaatcgaacaaatcatgataggagaagatactctcctgcgtttcagcggagtggccttaggtgaagcctgcacgatagtcattcgaggggctacccagcaaatcatagacgaggcaga

SEQ ID NO: 2524 - DNA, 654 bp, Phyllotreta cruciferae
gcctccatcaagtcgaatatgccatggaagcggtcaatctcggttcggctacggtaggcctaaaaagcaacagtcatgctgttataatagcattgaaaagggcttcatctgaattgtccgcttaccagaagaagatcattcaaatcgacgatcacatcggcatcaccatttccgggctaacggctgatgcgaggattctaagcagatacatgagaaacgaatgtttgaattacaagtactccttggacgcttacatgcctttgaatagattaattaacattttaggtatcaaaatgcaacattgtactcaaagatacgatcgtagaccgttcggtgtgggtctactagtggccggttgcgatgacaacggggcccacatttaccaaacctgtccgtcggcgaatttctacaattgcaaggccatgtcgatcggtgcgagatcccaaagcgcccgaacgtatttggagaagaagctcgacgagttgtcttcgtgttcgctggaagatttgatcaagcacggtttgagagctctgagggacactcttcctcccgaggtcgatttgaacacgaagaacgtttccattggttacgtcggtaaagggattacctttaagattttggaggaagaggagactgctccttatctggctctaa

SEQ ID NO: 2525 - DNA, 674 bp, Phyllotreta cruciferae
gagcaaacgaatggaagaagtggccactaagcagaaccccagcgaagacgatgataccgaattggaactacgtttggctcgattcgaatatcttatggaaaggagattgttacttttaaattcggttttgttgcgacagaacccgcacaatgtgcaagagtggcacaaacgagtgcaactttacgaaggtaaaccacacgaaatcatcaatacatataccgaagcggtgcaaactgtggaccctaaactggccgtaggaaagctgcacacgttgtgggttgaatttgccaagttctacgaaagcaacgagcaaatcgaagaggcccgattgatattcgaaaaagcctcccaagtgccttacgtgaaagtcgacgatttggctaccgtttggtgcgaatggaccgaaatggagattcgcaacgagaactacgacgaagctttgaagctcatgcaaagggcaactgtaatgcctagccgtaaagtggcttaccacgatgatacagaaacagttcaaagtagactttacaagtcgctgaaagtgtggtcgatgtacgcagatttagaggaaagcttcggcagcttcaaatcctgcaaagccatctacgacaggatcattgaactgaaaatcgccacgccgcaaattatcatcaattacggcgtatttctagaggaaa

SEQ ID NO: 2526 - DNA, 712 bp, Phyllotreta cruciferae
atctctgctatgggaactcttcgtacaagcagggccattagtgaacgtacatatgcccaaagatcgcgtcaccatgatgcaccagggctatggtttcgtcgaattcatgggcgaagaggacgccgattacgctataaaaataatgaacatgataaaattgtatgggaaacccatacgagtcaataaggcttccgctcatcagaagaatttggacgtcggagcgaacatatttataggaaatttggatccagaagtcgatgagaaactcttgtacgatacgttttcggcctttggtgtaatattacaaacgcccaagataatgagagatcccgagactggaaattccaaaggctttgcgttcataaacttcgccagtttcgaggcctctgacgcttccatcgaggcgatgaacggccaatatctttgcaatcgaccaatatctgtgtcgtatgcattcaagaaggattccaaaggcgagagacacggttcggcggccgagcgattactggccgcacagaatccattatcacaggccgataggccccatcaattgttcgcagacgcaccgccgataggaatgatgccgatgagtatggcgcctccacctccgcctttaatcaccggcatgatgccccctcctccgccaacgccgggcggaatgccgcctcctcctccgccagtaccgccgccgagttcattcccagctggtata

SEQ ID NO: 2527 - DNA, 666 bp, Phyllotreta cruciferae
cccacactaaaaggaggaaaggggcacccaagctccgttacttagatttctccgaaaggcatggctacatcaagggtgtagtgaaagacatcatccacgaccccggtcgcggcgcccccttggctctagttcacttcagggacccctacaagttccaaactaggaaggaaatattcatcgctcccgagggaatgtacacagggcaattcttgtactgtggaaagaaagctaacctccaaattggaaatgtgttgcctgtaggaactatgcctgaaggtacaattgtctgtaatttggaagagaagactggtgaccgtggccgattggctcgagcatctggtaactacgcaaccgtgattgcccacaatcacgatacaaagaaaactagggttaaattgccatcaggagctaagaaagttatccccagtaacaacagagctatggttggtattgttgctggaggtggtcgtatcgacaagcccatcctgaaagccggtcgtgcctaccacaaatacaaggtgaagcgtaactgctggccgaaggtgcgtggtgttgccatgaaccccgtcgagcatcctcacggaggtggtaaccatcaacacattggtaaagcttccactgttaagagaggaacttccgctggtcgtaaggtgggtcttattgctg

SEQ ID NO: 2528 - DNA, 406 bp, Phyllotreta cruciferae
aacccatgcctatgaactaccaccgcccatcaacgccatgccaggccagtgaggtcgaggtggagcccaagtttgtgaatgttgttgaagcgagacgcttaagaacgctcaccgcggagacggcgggcgagctggatgtccttgctctggatggtgacacgcttggcgtggatggcgcagaggttggtgtcctcgaagagggagacgaggtaggcctcgacggactcctgaagagcaccgatggcggaggactggaagcggagatcggacttgaagtcctgggcaatctcacgaacaagacgctggaagggcagcttgcggatgaggagctcagtcgacttctggtagcgacggatctcacggagagcgacagtaccgggcttgtagcggtgaggcttcttgacac

SEQ ID NO: 2529 - DNA, 669 bp, Phyllotreta cruciferae
ttggagaagctgaaagtacccatcgaagtcaacaaagaatcgttaaccgatgtttgtcgaacgagcttgagaacaaaattgcatcaaaatttggctgatctccttaccgatgtctgcgtcgaggccattctcgctatcaaacagtccgacaaaccggtcgatttgcacatggtggagctcatggagatgcagcacaaaaccgagacggacactcaactggttaaaggaatagtgatggatcacggtgctcgacaccccgatatgcccaagagcttgaagaattgttacatcctcacctgcaatgtgagcatggagtacgaaaagagcgaagtcaattccggtttcttctacaaaactgccgaagaaagggagaaattggtgttggctgaaagggatttcatcgagcaaagagttaagaaagttgtcgagttgaagaaggccctttgcaatggcacaaacaagtcgtttgttgttataaaccaaaaaggtattgacccgatgagcttggacatgctggccaaagagggaatcgttgctctgcgaagggccaagagacgtaacatggaacgtttggctttggcatgcggcggaatagccgtgaacagtttcgacgatttacaggaatctcaccttggttacgccgggcatgtatacgagcatgtattgggc

SEQ ID NO: 2530 - DNA, 652 bp, Phyllotreta cruciferae
ttcgatcaccccattcaattgcatctcgctttctccactctacacaagttcgtggagaagacgggtcgattgccgaaaccctggagcaaagatgacgccaccgagttcatcgctctggcgaaatcgttggctgtaaacggttctacggataccgaagtcaacaccgatatcctcaacattttctccaagtgttgttcgggcgatctgaaccccatcaacgctacgatcggaggaatcgtggcgcaagaggtcatgaaagcttgctcggggaagttctaccccatttaccaatggttgtacttcgatgccatcgaatgcctgccccaggacaaggaggagatcaccgaggaactcgctgcacccgttgatagtagatacgatggacagatcgctgtgttcggaaaagacttccaaaagcgattaggcgaactgaaatatttcatcgttggtgccggagcgatcggttgcgagttgctgaagaacttcgccatgatgggactgggcacgcaaggcggtcaagtcaccgtaaccgacatggatttgattgaaaagtcgaatttgaataggcaatttttgttcaggccccacaacgtccagcaacccaaatccgctaccgctgctaaggtaatcaagaagatgaatcccgacgtta

SEQ ID NO: 2531 - DNA, 718 bp, Phyllotreta cruciferae
tgttcttgtgatgtgccatacgcgcgaattggccttccaaatcagcaaagaatatgaacggttcagcaagtacatgtccaacatcaaagtcggcgtgttcttcggcgggctgcccatccaaaaagacgaagaagtattaaaaaacagctgtccgcacatcgtcgtcggaacgcccggtcgcatcttggctctcgtcagatcaaagaaactcaatctcaagcacataaaacactttattctcgacgaatgcgataaaatgttggagcttctagacatgagacgcgacgttcaagaaatatacagaaatacgccgcacgaaaaacaagtaatgatgttcagtgcgacgctcagcaaagaaattcggccagtttgcaagaaattcatgcaagatcccatggaagtatatgtcgacgatgaagcgaaattgacgttacacggtctacaacaacattatgttaaacttaaagagaacgaaaagaataaaaaattatttgagttacttgatgtgttggagtttaatcaggtggtgatatttgtcaaatcggtgcaaagatgtgtagcattggcacaacttttgactgaacaaaatttccctgcaattggaatacacagaggaatggagcaaaaagaacgattatccagatacgaacaattcaaagatttccaaaagagaatattagtggctactaatctatttggtcgtggtatggatatcgag

SEQ ID NO: 2532 - DNA, 664 bp, Phyllotreta cruciferae
agaaacgatttcgaaggacaagccgtactaattaactgcttattgaggaattatttacactattcgctgtatgatcaagccgataagttggtgaacaaatgcgtttttccggagacagccagcaacaacgaatgggcgagattcttgtactacttgggcaggatcaaagcggctcgattggagtacagtgtagctcataagcatctcatacaagcgatgcgtaaagcgccccagaacactgcgatcggcttccggcaaaccgtccagaaactaacagtcgtagtggagttgctgttgggggatattccggagaggcagatattccggcaggcgagcatgcggcattcgcttgccccgtatttccagttaacgcaggctgtgagaatggggaacttgcaacggttcggggaggtgttggagaattttgggccgcaatttagggtagatcatacgtttactttgatcctgcggcttcggcataatgttatcaagacagctattaggtcgattggtttgtcgtattccaggatatctccgcaggatatagctaagaaattgggcctggattcagcggaggatgcggaattcatcgtagcgaaggccattcgagatggtgttatcgaagctactttggacccacaagggggctacatgaggagtaaag

SEQ ID NO: 2533 - DNA, 713 bp, Phyllotreta cruciferae
gtattacggaacctctggacccacgttgaagcatcaaaggccccaggatgataaacagaaagagtattcagatttgaacgattggtataagagaggcgttgatacttcgaagattgtaacaaagtatcgtaaaggggcttgtgaaaactgcggagcgctaactcacaaaaagagagattgtatggacaggccacgtaaagtcggagcgaaattttcaggtgctaatatagcccccgatgagtttatccaaaagaacttatcactaagttttgacggtaaaagagataggtggagtggttacgatccttccgaacataaaacagtaatagaagaattccagaaagtggaggaagccaaacggcaactaaaatccgacaaattgaatgccaacgaagagtccgaagacgaagaaaaagatgaggataaatacgtcgatgaagtggacatgcctggtacgaaagtcgacagcaaacaaagaataacagtgaggaatttgcgtatacgagaagatacggccaaatacttgagaaatttggatcccaactcggcatattatgaccccaaaaccagatcgatgagagaagatccgaatgctggaatggacgctacataccatggggaaaattttgttcgcttctccggagatactacgaatcacgccagagcccaactgttcgcttgggaggcacacggtaaaggagtcgacgttcatc

SEQ ID NO: 2534 - DNA, 502 bp, Phyllotreta cruciferae
aggaagttcgaattaggtcgtccggcggccaacacgaaactaggaaccagaaggatccattatgttcgtacaaggggtggcaacttgaagtaccgtgccctaagattagacactggaaacttctcttggggaagcgaaggaactgcccgtcaaacacgtattatcgatgtcgtttacaacgctagtaataacgaattggttcgtaccaagacattggtaaagaatgctatcgttgtcgttgacgctaccccgttcagacaatggtacgaaaaccactacatcttaccattgggacgcaagaagggtgctaagatgactcctgaagaggaggagattttcaataagaaacgtagcaaaaaagtacagaagaagtacgaaactaggcaaaaaaccgctaaagtagagcctgcaattgaagaacaattccacaccggaagattgttggcatgcctagcatcaagacctggacaatgcggcagggccgatggttacgtcctcgaag

SEQ ID NO: 2535 - DNA, 697 bp, Phyllotreta cruciferae
catttcatccctagccctactaaaaatgctgaagcacggcagggccggcgtccccatggaagtcatgggtcttatgttaggtgaattcgtcgacgattacacagtgagggtcatagacgtgttcgccatgccccagacgggtactggagtgagcgtagaagccgtggatcccgttttccaggctaaaatgttagatatgctacgtcaaaccggccggccggagatggtggtcggttggtaccattcccatccaggtttcggctgctggttgtcgggaggcgatatcaacactcaacagagctttgaagccctctccgagagggctgtggctgtagtcgtagatccaattcaatccgttaaaggaaaagtcgtcatcgatgcctttaggttaatcaatcctaatatgatggtgttgggacaggagcccaggcaaacgacttcgaatttggggcatttgcagaaaccgtctgtacaggctctgatccacggtttaaatcgccactactactccataagtattaactataggaagaacgagttggagcagaagatgttgctcaatttgcacaagaaatcctggatggatgggctaacgttggctgattattcggagaattgcagcgttaacgagaaaaccgtcgccgatatgttggaattggctaagaattacaacaaagcgttggaagaagaggagaaa

SEQ ID NO: 2536 - DNA, 709 bp, Phyllotreta cruciferae
tgccagattcaacttacgaaatggtgggtggtttggataagcaaatcaaagagatcaaagaggttatcgaattgccggtgaaacatcctgagctctttgatgctttaggtattgctcagcccaagggtgtgttgttgtatggacctccaggaactggcaaaactcttctggctagagctgtagctcaccacacagaatgcacgtttattagagtatcaggatcggagttggtgcaaaaattcattggggaaggttctaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaggctacgaagaacattaaagttataatggctacaaacagaatcgacattttggatcccgctttactcaggcccggcagaattgacaggaagatcgagttccctccaccgaacgaggaagcccgattggacatcttgaaaattcactcgagaaaaatgaatttgaccagagggatcaatttgaggaaaatcgccgaattgatgccaggtgccagcggtgccgaagtgaagggagtgtgtactgaggcaggcatgtacgccctaagggagagaagggtacacgtaac

SEQ ID NO: 2537 - DNA, 499 bp, Phyllotreta cruciferae
gttgaagtctgctttcgatttacaaagtttcagttttttccaaagaggatccgtacaggagtttatgtcattcttttgtaagactatcgtggaaaggactataccatcatccaggcaatccgtcaaagaaggagagtacatgtgtcatgtttatgtaagacatgataacttagccggtgttgtaatatcagatcacgaatacccgtctagagtgtcacatacgcttatcacaaaaattctggatgaatttgctggtaaaataccagctgttaattggcctaccttgcaagagagagacgtagcgtttccacaattgaacacataccttgccaaataccagaaccctaaagaagccgatgcgatgactaaaatacaagaggaccttgacgaaaccaagattattctggtgagaaaaatgttaattatcttgcgttatttatctaagcataacacgattcaagctgtcctggagagaggggaaaagttggacgacttggta

SEQ ID NO: 2538 - DNA, 604 bp, Phyllotreta cruciferae
tggaatatgccattgaagctattaaattgggatctacagctatcggaatatgcactagcgaaggggttgtgctagcagtcgaaaagcgtattacttctccattaatggaacccacaacgattgaaaagatcgtagaagttgataaacacatcggctgtgctgtttcggggctcatggcagattcacgtacaatgatcgatcgggcaagagttgaatgccaaaatcattggttcgtttacaacgaaaacatcaccatcgaatcatgtgctcagggagtatcgaacctagctattcagttcggagattcggatgatgatggtgctgctatgtcgaggccatttggtgtggccatcttgtttgctggcatagacgaaaaagggcctcaactctaccacatggacccatcaggtacatttgttcagttcgatgcaaaagccataggatctggatcagagggcgcacaacaaagcttacaggaagtatatcatcgtagcatgactttagaggaagctaccacagcagcgttgactattctcaagcaggtcatggaggagaaattgaactcttctaatgtagaagtcatgacaatgacgccaaaggatat

SEQ ID NO: 2539 - DNA, 684 bp, Phyllotreta cruciferae
caattagttgggctatccgacgatttgggaaagctggatggtttcgtggagcaggttacccggaaggtggctcagtacctcggtgaggttcttgaagaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggacaaatcgacgccgatcttaagaccaagtcgtcagcgtacaataacttaaaaggcagtcttcaaaatttggagaaaaaacaaacagggagtttgttaacccgtaacttggcagatctggtcaagaaggaacactttattttagattctgagtacttgcaaacgctgctcgtcatcgttcccaaagctcagtttaatgagtggaacgccacttacgaaaagatcacggacatgatcgtccctcgttcgtcggagttgatcattcaagaccacgactacggcctgttcaccgtgtcgctcttcaagaaggtcgtcgaggagttcaagctgcacgccagagagaagaagtttatcgtgcgagatttcacgtacaacgaggaggaactggcggccggcaaaaacgaaatcaccaagctcgtcaccgacaagaagaagcaatacggt

SEQ ID NO: 2540 - DNA, 755 bp, Phyllotreta cruciferae
agccgcagaactacttaaaaatgcagatgaacttgtaaaacaaaaaatccaccctacatcgattataagcggatacaggctggcttgtaaagaagcttgccgatacatacaagaccatttgactatacccgtggaggaattaggcaaggagtctatcgtaaacgttgcgaagacttccatgagctcgaaaattataggagctgatgcggatttcttttcgcaaatggtagtcgatgctgccaccgcagtgaaagtcacggactccaagggcaactcgatgtaccccattaaggcggtgaacgtgttgaaagcccacggcaaaagcgcccgggagagcttcctggtggccggctacgccttgaactgcaccgtcgccagccaggccatgcccaagaagatcgtcaacgccaaaatcgcgtgtctggatttctcgttgcaaaaggccaaaatgaagatgggcgtgcaagtgctgatcacggaccccaatcaactggaaggcgtcagagccagggagctggacatcaccaaggagcgcatccagaagatcctggccaccggcgtcaacgtggtgctgctgtccggcggcatcgacgacgtctgtttgaagtacttcgtggagcgcggcgccatggccgtgcggcgcgtcaagaaggccgatttgaaacgaatcgccaaggccaccggggccgccttcgtcacctccttgagcaacatggagggcgaggagaccttcgattctaatatggtcggcgaag

SEQ ID NO: 2541 - DNA, 647 bp, Phyllotreta cruciferae
gccttctataacttcccaggaacagaatggaaacctgtaacaaacccaataactcatacccaatctccagtaacgacttcaacctcaattgtatctataacctacgataagggagtactaattgccggagacttgctggcctcttacgggtctttagccagatacaaaaattgcccgagggtaatcgaaattaacccaaacatcatcttaggcgctggaggagactacgctgatttccaatatgtaaaaagctttatcgagcagaaaataatcgacgaagattgcttagatgatggtttgaaaatgaaaccgaagtctctttattgctggctcactagaattatgtaccaacgaagaagtaaactcgacccgttctggaacaatttagtagtaggagggatccaagatggagtacctttcctaggaacagtcgataaactgggcactgcgtacacagataaagtaatctgtactggttacggggctcatattgcccttcctgtcttgagggatgccctcgacaagaagccgaatttgaatctaaacgaagctaaggcgctcattaaaaagtgcatggaagttttgttctacagagacgcgagaagttacccgaaatatcagttaggcataatcgatgtggacgaagg

SEQ ID NO: 2542 - DNA, 670 bp, Phyllotreta cruciferae
tgttgatgaaggaactggaggtgaacccggataaatccttgcaggggggactgagagcagctcgcagggctgtgagattgttgaatcaattaggaagggaaacacaatcttgtacgttgttcctgaagttatgcagcagcatgttaagaacgcaatgcaaacgagttaaaagagaaggctccactactacttacataaagcatctttcgagtgtagttttcactaatatgtgtcacatgtctgatgaatttctaagggctttccccgactctccggcttgcgcttcagcgtatgtggtttgggcgagcaatgaactactgcaatttactacccattttatcaagcaggtctttatgccgcagacttccttatcaacggtgaccgagtgcatagttttagttagacaacagtgtgaaagactgtacgtttacggattggacctttgttatcaattggacggggctttgagatcgtcgctgatgaaggcgttgaaagacgctcgagataaactcatcgattcgattaaattgagagtgttagatgataaatggataccgattaatttgcattccaaatcggcgttgagccgttgcgtgcaagagtattcgcaaatgggactcactaacgtaggaaattacgtttctggcgatacttggttgcaattaacagc

SEQ ID NO: 2543 - DNA, 742 bp, Phyllotreta cruciferae
ggcctaaaaagaagatgggagggtttagtgcacatctctcaactaagagccgaaggtagagtcaccaacgtttccgaagtagtctctagaggaagcaaagttaaagtaaaggtgttaactataactggtcagaaagtatccctttcgatgaaagatgtctgccaaacgacaggaaaggatttgaatcctctatcacacgccactacggaacgagaagataaagatcgtaaccctgacaggcctactaataatagcacatcagtgctgaggctaccggttagtatcgatgaaggtgaagaagattccaggaaaagagtaaccagaatatccagtccggaaagatgggaaattaagcaaatgatttcttccggatgtatagacaaaagcgaattacccgaattcgatgatgaaactggtttgctgcccaaagatgaagatggtgaagctgatattgaaattgaattggtcgaagatgagccaccatttttacaaggtcatggtagagctcttcatgatctaagcccagtgagaatcgttaagaatccggacggttcgctagcccaagctgccatgatgcaatcggccttggccaaagagagacgcgagcaaaaaatgctgcaaagagaacaggaagtggattcccagccatctggaaagaacaaaaactggatagatccccttcccgaagaggaatctaaatcgatggcaagaggaatcggtctgcaaagtcaagatttacccg

SEQ ID NO: 2544 - DNA, 761 bp, Phyllotreta cruciferae
aaacgtagtcatgaactgctgtgtgtttagtgataggaaacattcatttttagtagcaggtcaagagaactactctcaactttatggagtcaatacgaaattaatcgaacatgaacaagtagaaacaattggagacacggcaagtgttcgacatagaaataccaagcccaaagcgcacgtagacaataacaaaaacattaaaaaggagctggttttcgacatgaatcctctagatagcatacaaaccgactttaagggatctgaacccctatgtagagtagttcgaattaatcactcgggaaaaatattagctactggaggaactgacggcgatgtaagactttggaaattccctacgatgcagccattgtccattctcaagggacatacgaaggaaatagacgatatagatttcagtaaattcgataacctcatcataactttagcgaaggacggtttggctattttgtgggacgcccaaacgggtaaattgaaatcgaaactgacatggaacactccagagggatcgaaatatttgtacaagaggtgtagatttggcgtaatcgaagatcaaaaaaataagtgcatgctatacatgatagcgaatgcgactaattcgaagcaaaaatcgtttcttcagcaatggatacctgaagagaatactttaaaaaagttctctgaattcaatgaaacactgtccgcacttgcagttagagatgatggacgatttgtagctgtcgggacaatgtttagcggttctg

SEQ ID NO: 2545 - DNA, 720 bp, Phyllotreta cruciferae
tggaatccaccttgttgaaagagttgaagaaactggacgacaaaaacctgctggtcgaagtgcaactgctcgaaagcaaaacatatcacgctctaagcaatttacccaaagcccgggccgccctgacgtccgccagaacgaccgcgaatgccatctattgccctccgaagatgcaggccgccctcgatctgcagtcgggcgtactgcatgcagccgacgaaaaggacttcaagaccgcttactcctatttctacgaagccttcgagggttttgacagcgtcgagtcccccaaagctctgaccgctctgaagtacatgcttttgtccaaaattatgatcaatagtcctgaagatgtacagcaaattgttagtggaaaattagccataaagtatgcaggtaaagatatcgaggccatgaaagcagtcgcacaagcagcccacaaaagatctcttgcagattttcaactggctgtaaaacaattcaaacacgagctggaagatgacgttattgtaagagcacatttaggaacactctacgacaatatgttagaacaaaatttatgcaggatcattgaaccttactcacgtgtccaagtagaatatatcgcaaagacgattaagcttcccgtgttacaagtagagaagaaactatcgcagatgattttagatgccaagtttcatggaattttagaccagggtgatggtgtcctgatagtgtttg

SEQ ID NO: 2546 - DNA, 795 bp, Phyllotreta cruciferae
caggagatcgaattgctgtacgaacagaaaatcaaaaacctgcaggccgccgccgacaggcatcaatcgaccgcctccggcgctctcgacgagttgagacaagttcgaacgaggatcgacaccttctcgtcgaggatccaggatctggagaaccagaaccagggcctggcagctagaactagggatttggagaagttgctcgagaacgaacgcattcgtcacgccgaagacctagcgctagtcgagagggaattgcacaggctgcgagaggaaatggcgactcaactgcaagagtaccaagacttgatggacatcaaagtgtccctcgatttggaaatcgccgcctaccgtaagcttctcgaagcggaagaagctcgattgaacatcacaccaacaggtgttgagcacgaggtgcaccaaaggagctcctctcagcgccggacgccggtgagaatgggggccaagaggaaacgggccctgctcgaggagacgcaggagtcgagcatgtcggattacagcgtgaatagttcgtctaaaggggacattgaagtggccgcggccgatccggacggtcagtttgtgagattgcacaacaaaagtaaccaggaggtgccgctcagcggatggcaagtcatcaggcgggcgggcgatgaggagaccttctacaaattccacagaaccgttaaagtagagggaaatggtacagtaaccatttggagttctgatttaaataaagatcatgaaccccctagtaacctggttatgaaaagccaaaaatgggttactggagacaac

SEQ ID NO: 2547 - DNA, 702 bp, Phyllotreta cruciferae
cgaacgtcaagaaggaattgcaggagttggtgcaatacccggtcgagcatcccgataagttcctgaagttcggcatgcagccgtccaggggagtgctgttttacggaccgcccggttgcggtaaaaccctattggccaaggccatcgctaacgaatgtcaggccaacttcatatccgtcaaaggaccggaattgttaaccatgtggttcggtgaatctgaagctaatgttagagacattttcgataaggccaggtcagcagctccttgtgtgcttttcttcgatgagttagattcgatcgctaagtcgagaggtggaaatgtgggagatgccggcggtgcagccgatagggtgattaatcaaattttaactgaaatggatggcatgggagctaaaaagaacgttttcataattggtgctacaaatagaccagatattattgatcccgcaatattacgtcccggtcgtctggatcagttgatctacatcccgttaccagacgaaaagtctagagaagcaatctttaaggcgaacctaaggaaatcacctgtagctaaagacgtagatcttacatatattgccaaagttacacacggcttttcgggcgccgatttaacagaaatatgtcaaagagcttgcaaactcgctataagacaaagcatcgaaacggagatcagacgagaacgagagagagcattgaatc

SEQ ID NO: 2548 - DNA, 650 bp, Phyllotreta cruciferae
atttagtgccaagtctctgtgaggatcttctatcgtctgtggatcaacctttaaaaatcgctaaagacaaggattcgggcaaggattttcttttatgtgattacaatagagacggagattcttacaggtcaccatggtcgaatacctactatcctccattagaagacggttcgatgccctccgagaggctaaggaaattagaattagacgccaatttagcgttcgatcaatatagagaaatgtatttcgaaggtggcgtatcttctgtttatttttgggacttggatcacggtttcgcaggtgtaattttaattaaaaaaactggcgatggtagtagaaaaattaaaggttgttgggattccctgcacgtggtggaggtacaagagaagagttccggaaggaattcccactacaaaatgacgtccactgctatgctgtggctgcaaaccaataaacaaggctcgggaaccatgaatttgggcggtagtttaacccgacagatcgagagtgatgcagccgtaaacgacatcaatccccacatcgccaacatcggtcgaatggttgaagacatggaaaacaaaattcggaacacgttaaacgaaatctactttagcaaaaccaaggacatagtcaatagcttgaggtcggtg

SEQ ID NO: 2549 - DNA, 697 bp, Phyllotreta cruciferae
cgttgatatgccgatgaaaggcgccaaaggcaagaaagggcgagttagcgtcggtggcggcggcggcagcacgccatcctccagcggaccggtaccagcagctatagtaccaggaggtgtcagaggcaggccgcccgcgaccgtttcctctaccagtaccacaccaattgcgaccactaccggttcgtccggtttgccgttgggtacccaagctcctgcgacgctgccgggaagtaccgccaccacgacgatagcgccggccaacaacaacaacagctctctgacgccgcagcagctcggcacgcccgtcagttcgatgcacggcaccccgggggcccccctatcgaattccctcgatcccagcggagtgctgccctccaacgtcatgccgccggcgcaaccagccaaggtaaaaaaaggcgtgaagagaaaggccgacacgacgacgccggcgacggcctacgattatccgacggtattggaatcgaagtcggcgaagatttcgacgcgcagagaatcgggcaggcagataaagaagccggcgcggcgggaaatcgaccttcatgtacctcaaccggcgatccacaaacccaacgataagttgtcggagtcgctgaaagcttgcaatgaaatccttatggaactgttctccaagaaacattcgaattacgcttggcctttctatcaaccggtcgat

SEQ ID NO: 2550 - DNA, 791 bp, Phyllotreta cruciferae
tttaaggccccaattagaccagatgtcgtcaatttcgttcatcagcaggtctcaatgaaccatcgccagccttacagcgttagcgacaaagctggtcaccagacctccgccgagtcgtggggaacaggtcgcgccgtggcccgtatacctcgtgttcggggtggcggtacccaccgatcgggccagggagccttcggtaacatgtgtcgcggcggtcgcatgttcgcgcccaccaagccgtggcgccgctggcacagacgcgtcaacatcaaccagcgtcgctacgccctggcgtcggccgtggccgccagcggcgtgcccgctctggtcatgagcaaggggcacgtggtcgatcagattcccgagctgccgttggtcgtcagcgataaggtgcaggagatgcacaagaccaaggaggccgtgcagtttctgaggaggatcaaggcttgggctgacatccagaaggtttacaagagccaacggttccgtgccggtaaaggaaaaatgcgtaataggagacgtatccaacgtaaaggaccactcatcgtttactacaaagatcaaggtcttcgtcaagctttccgtaacatcccgggcattgacctcatcagtgtccaaaagttgaacttgttgaagctcgctcctggtggtcacgttggtcgatttgtcatctggaccgaatcggcattccaacgtttagacaaattattcggtacatggaaaaacccatcgaccgaaaagaagggttacaacttacctcaacccaagatgtccaacaccgatttgtctag

SEQ ID NO: 2551 - DNA, 708 bp, Phyllotreta cruciferae
gtaactgacgattcgactgagctggaagacgaggcagagtggatttacagacaagctttttgtaataaggctgtgtccaatgttgatgcgcacctttcggccgaagcgagagagaaaatgaagaaaggctcccaaacggtggggaaaataaagaaggcgttggattttatgaggaaccaacagctcgaggtgccctttatcgctttttacaggaaggaatatgtacaacctgaactgaatattaacgatttatggaaagtttataaatacgatgcaaagtggtgtcaactaaaatctcgaaaggaaaatctccttaaactctttgataaaatgaggcattatcaactggatcagctcgtaaaaaatccggacgctcctattccagacaacgtgcgagtgatgaaagattcggatatcgaaaggctgaaaaacgtccaaactgcagaagaactcaatgatgttcacaatcatttcatattgtattattccggagacttgcctgccatgcatgcagcttggagaatcaaagaaaaagagcagaggaaattcgagaagcgacagaaaagactcaagcaaattgccgaagcggaggaaggtgctgacattcctgatgaaccagaggatgacgatgatgatgaaccagaaacagaaactttgaaatatgctaatcgatcgggcagttatgcattgtgttcgaaagctggatta

SEQ ID NO: 2552 - DNA, 754 bp, Phyllotreta cruciferae
aagaaatcttgggaagcgatagcgagtcggaatcaggatcggagggatctgaagaggaatcagatggcgaaggcgaggacgaagaaatcaaagatgccgggaaaatcatcgacaatactgaaacaaatctaatagctcttagaaggacaatatatttgactatacaatccagtttggatttcgaggaatgcgctcacaagcttttgaaaatggagttaaaacctggtcaagaaatcgaattatgccatatgtttttagattgttgtgctgagcaaaggacatatgaaaaattctacggactgctagctcaaaggttttgccagataaataaaatatacatcgagccttttcagcaaatattcaaagacactttcgcgactacccatcgcttggacaccaatagattgaggaacgttagcaaatttttcgcccatttgctctttacggacgccataggttgggaggtgttcgagattatgaaactcaacgaagaagacactaacagctcgagtaggatttttattaaaattttgtttcaagaattagccgaatatatgggcttaggaaagttgaatgcgagattgaaagatgaaacgcttcaacaacattttgcgggattatttcctagagacaatcctaaaaataccagattttccattaatttcttcacgtccatcggtttaggaggtttaacagacgaacttagagagcatttaaaaaacgtccctaaaattatggaaattaaaacgaccgc

SEQ ID NO: 2553 - DNA, 776 bp, Phyllotreta cruciferae
cccagacactttccaatgtagttacgatccttcctttgctgccgcacgaaatgcgaatatggaaagaatggccgaacagattgcaacattgtgcgccactttgggggaatacccgcacgtccgatataggagcgattgggaacgtaacgtagagttggcgcaattgatccagcagaaattggatgcttacaaagccgacgagccgaccatgggagaagggccggagaaggcccgatcgcaattgctgatcttagaccgaggcttcgattgcgtttcgcctttacttcacgaactgacgtttcaagctatggcctacgatttacttccaatcgaaaacgacgtgtacaaatacgaggcttccgctggggtacaaaaggaggttctcttggatgaaaacgacgagctgtgggtggagttgcgccatcaacacatcgccgtggtatcccaaagcgttactaagaatttgaaaaagttcaccgattcgaagcgcatgactcaaagcgataaacagtccatgaaggatttgtccactatgattaagaagatgccgcaatatcagaaagaattatcgaaatacgctactcacttgcatcttgccgaagactgcatgaaggcctaccaagggtatatcgacaagttgtgcaaagttgaacaggatttggcaatgggaactgacgccgaaggggagaaaattaaagatcatatgcgcaacatcgttccgattcttttagataccaaaataacgaacgaatacgataagatgcgcatcatagctt

SEQ ID NO: 2554 - DNA, 650 bp, Phyllotreta cruciferae
aaaattatggcggtgagactttcttatcggaggaattggcaatcatgattcttcaagatactaaacaagcttttcaacgttgcttattgttatcaaaaggtagtgaaagagcttccaacgccactcaaattttagacaggcttattaatagtttgctgatagaacatgtagactatgcagttgagttgggtctacacgctgtacccgttgtcgaaggcgttagaaatccccctgttttgtatttttttaatatcgtgcatcagagcaataatataacccatctcgtcgagaaacagtttatggatttggtggttccattagtagaaaatacttcaaaatatagcgattgcatacagaagaaaaaatttgttttggaggatatagaaagaaaaattaatacgggattggatagatgtttgagtgcgatattaaattgggtgaagttgtatttacaatctgaacaaaagaaatcggatttcaagccagagtctgatgattttgatacagtggcctcgccagcttgcaagaacgtacttaattatgttaatagtattatcaaagaaattaaaactaatttggatggcaataatgtaacagctatccttcaggaattagggattagactgcatagagttgtttacgagcacttg

SEQ ID NO: 2555 - DNA, 653 bp, Phyllotreta cruciferae
tagaaaccatcgatctgcagaaagacccctattttatgaaaaaccacctggggtcttacgaatgtaagctttgtttgacgctgcacaacaacgagggtagttacttggcccatacgcaaggcaaaaagcatcaagccaatttggccaggagggcggccaaggaagccaaagatgcccccacgttgctccaaccggagaaacctcgagtggagcccaagaaggtcgtgaaaatcggtaggcccggttatcgggtaaccaaacaaagagaccccgaaaccggtcaacagagtttactgttccaaatcgattatccagaaataagcgatttggttttgccccgacaccgcttcatgtctgcgtacgaacagaaaatcgaaccccccgaccgtaaatggcaatacttactcttcgctgccgaaccgtacgagaccattggcttcaaagtaccgagcagagaggtagaaaaaaccgatactaaattttggacacactggaacagggacaccaaacagtttttcctacaattcgccttcaagaacgagaacaaacgcaacgttaactctgtagtacaaaggcattcgattgttggtggcgttccaccgcctcccatgctgccggtaccgccgccacccaggcctcctatgtttaatccc

SEQ ID NO: 2556 - DNA, 253 bp, Phyllotreta cruciferae
taacctgcgaaacgataaccggcgaagtttacaggggtaaacttatagaagccgaggataatatgaattgccaaatgacccaaataactgtaacttacagagatggacgagtggcgcaattagaaaacgtttacattagaggttccaagataaggttcttgatattaccggatatgttaaagaatgctccgatgtttaaaaaacaaaccaaagctggaactgctggcagagggaagtctgcaattctacgagc

SEQ ID NO: 2557 - DNA, 769 bp, Phyllotreta cruciferae
tattcgcaacattcagcaactgggggccaatttaacggccacttccgatagagaaactatctgctacactttagaaggtaccccagaagccgtggaatgtgctatacctttcttgaccgaagtagccacccaacaggaattcagaccttgggagatttccgaattgtctggtagattgcagttggatattgctacaagaccgttgcagttgagagccatcgatttgctgcacaacgctgcctttagaggacgcggcttgggtaattctctgtttattccgaaaactcaaatcggtaaaatttcgtccgaaaccctacaacactacgttgcctcgaacttcgtgagcggccgtatggctgtagtaggctcaggtatcagtcaaaaggaactgacatctttcgcaaactccttgaaaattgaaaatggcgaaggcaacaacgctccttcaccttacgtaggaggtgaactaagatcaaacaaaggtggtcaacttgcattcgttgctgtagcaggagagggtgctgctatcacgaacaccaaggaagctctggctttcgctgtgctacaaggagccttaggaggaggcccacaggttgcacacggagtttccgacaatggtgtcttcaggaaggctcttggaagcaaccccaatgtcagttcagtagccataaacgccagttactcagacaccggtctctttgggcttctactggctgtgccaacgaagtctgcaggaggtgctctagaaaccgctgttaaagtgcttaag

SEQ ID NO: 2558 - DNA, 197 bp, Phyllotreta cruciferae
tgatcggatgactaacgaactacaagagaaaatcggagccctaaaatccctcactatagatataggaaatgaggttaaataccaggacagaatgctcagggatgtcgatgatgatttagagaaaaccggagggttcctgggaaccaccatgaacaaagtcttgaggctgtcgaaagggggccacaattacatcattg

SEQ ID NO: 2559 - DNA, 705 bp, Phyllotreta cruciferae
cgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgcgaattcaccggcgacattctcagaacgcccgtatccgaagacatgttgggcagggtgttcaacggctcaggaaaaccaatcgataaaggacctccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcg

SEQ ID NO: 2560 - DNA, 671 bp, Phyllotreta cruciferae
atcagacgcagctactaaagtcgacggattggagagtttgttgcaatcattggtacaagtgctgcaatcatccgacgtaaacgtggtgacttgcgccgccggcatcctgtcgaatttgacgtgcaacaatcaacgcaacaaagtgacggtgtgccaggtgggcggcgtcgacgccctggtgcgcaccatcgtcagcgccggcgatcgcgaggagatcaccgagccggcggtgtgcgccctacgccacctcacctcccggcacgtggagtccgagatggcccagaacgccgtgcggctgaactacggcatacaagtgattgtcaagctgttgaacccgccgtcgcgttggccgctggtgaaggccgtcatcgggttgattaggaaccttgctctgtgtccggccaatcacgctccgttgagagaacacggcgccattcatcacttggtgcagttgctgatgagagctttccaagacactcaaagacaacggagtagcgtcgctagcggaggcagccaaccgcccggaacgtacgcggacggtgttcgcatggaggagattgtagagggaacggtgggagcgttgcatatattagcgagagaatcgcataatcgggccatcattagacagcaaatggtgattccgatcttcgtgcaattgctgttcaacgata

SEQ ID NO: 2561 - DNA, 664 bp, Phyllotreta cruciferae
aatcgacaagcacaagaaacgccggccatatttagcatcagaatgcaaaagcctgtacgcctgcgagaaatggcgcatgcaaatcatcagggaaatagcgaaaaaagtggcccaaatacagaacgcagggctcggggaattccgcattcgcgacctaaacgacgaaatcaacaaactcctgcgcgagaaacgccattgggaggaccaaatcaaggagctaggcggccctgattaccagcgcgtcggccccaggatgctagatcacgaaggcaaagaagtccccggcaacagaggctataaatacttcggagccgctaaggaactaccaggcgtgcgagagctgttcgaacaggaaccgccgcccccgcctaggaagagccgtgcagaactgatgaaggacatcgatgccgattactacggctacatggacgacgacgacgggatactgatccctttggaaatcaaagctgaaaaaatagccgtacaaaacgcgatagccgaatgggtgaacaacaaggaaaagaacctagaccccgccaaaggaatcgaagagagtatctacgtggtggaggattcagatgaagaagatgttgttcaacagttcgatggttcgcaacagagattcgtggcacacgtaccggtgccatcgcaacaagatatcgag

SEQ ID NO: 2562 - DNA, 659 bp, Phyllotreta cruciferae
cgtgatgaaatacggcaaaaatcaatggtctagaatagcatctctgcttcacaggaagtctgcgaagcaatgtaaagcccgttggttcgaatggttagaccctagcatcaaaaaaaccgaatggtccagagaagaagatgaaaagttgttgcacttagctaaactaatgcccactcaatggagaaccatcgcgcctataataggcaggaccgcagcccaatgtctagaaagatacgaatatttactggatcaagcgcaaaaaaaggaagaaggcgaagatgccgtggatgatccgaggaagctaaaacctggagaaatcgaccccaatccagaaaccaaaccagccagacccgatcctaaagacatggacgaagacgaattagaaatgctttccgaagccagagccagactggccaacacccaaggcaaaaaagccaagcgtaaagctcgtgaaaagcagttagaggaagcccggcgtttggcggctttgcagaaacggcgagaactgagagcagccggtatcgaagtcacctcgaggcgcaagaaaaaacgaggtgtagattacaatgcggaaattccgttcgaaaaacaaccagcaatcggtttctacgacacttctaacgaagccctcgacttgatggcccctgatttctctaaaa

SEQ ID NO: 2563 - DNA, 324 bp, Phyllotreta cruciferae
gctcatcctgataagctgaagaaaaaaattactagggaattaattactaccattcttgccagaaaaccaaaaatgtgcagttttttggaatggagagatttgaaaatcgtttataaaaggtatgccagcttgtatttttgctgcgcgatagaacaatgcgacaatgaactgctaactttggaaatcattcatcgttacgttgaacttttggataagtacttcggaagcgtatgcgaattggatataattttcaactttgaaaaagcgtattttattctggacgagctgatgcttggtggcgaggtgcaggaaaccagtaagaaa

SEQ ID NO: 2564 - DNA, 707 bp, Phyllotreta cruciferae
taaatcggatctggccaaaaaagctggtaaattcaccgaagaagtaggaaaaactacgcacaaaatcagcgaaacggcacaagaaatcagcaaaaccggagcctttcaaagcatatcggaggccaccaaagccgttaaacaagaaatcgacaacaccagcatggaaggtcgagtgtacgtgagccctaagaagcttcgaaaacgaaccgaaaccagcgcagtagtccaacaaaagtactacgaaccgaacacagacgccaccggcgtagagctacacaaagactccaaattctacgagtcctggcagaacttcaaaaacaacaacccctacgtgcacaaagtcatggactggaaactcaaattcgacgaaagcgagaaccccatcatcagagcctccagggcgctcacggaaaaagtgggagacataatgggagggttgtttcaaaaaaccgaactctccgaaacccttacagaaatctgcaaaatcgaccccgacttcgatacgaaacgcttcctaaaacaatgcgaaaccgacatcatccccaacatcctagaagccatgaccagaggcgacttggatgttttaaaggactggtgtcacgaaggccctttcaatttattcgctgtaccgatcaaggaggcctataaaaaaggctacaaaatcgagtccaagatcctcgatgtagaccatgtggatctagtgatgg

SEQ ID NO: 2565 - DNA, 752 bp, Phyllotreta cruciferae
agatggtaagctgaaacctggtttaaataaaatcgaacaggctcctaagcaattcgtaaacaacataagtggtttaaatcagaaaatcgaagaattcaaattgaatctaccatggatcgaaaggctggattgtacgaatgcccaagcccccttagcgcccgagttagcggaggagatgttagctcacgaagaaaagagaagtaatcaactgcgaaacaacaaaaaacttccccaattccaaccgtcggaagatccagttctgaacgatttcaaacgagaactaatattccataggcaagctcaagctacaattctggacgcaattccgaaaatcaaagaattagggatatctactaaaagaccggacgattattttgctgaaatggcaaaatccgatgagcaaatgcacaaaatcagagagaacttaaagcagaagcaggagcagcagaagcggagtgaacgggtgaagcaattgaggcagcaaaggaaagagggaaaatcgctgcaggtgcagctcaagttgcaacgctctaaggagaagaaagagatgatggatcaagtgaagaaagcgagaaaaaatttcgattttctggatgagaaaaataagcccatgggaaagaataaggtggcagaaaggcgtaagatgaaggataaaaaattcggttttggtggtaagaaaaaggggatgaagaaaaatacaaaggacagtgcgggcgatattagcgagtatagaaatcctggaaaagccaaga

SEQ ID NO: 2566 - DNA, 674 bp, Phyllotreta cruciferae
cttcgcaaagaattctcaccgttcggcaccatcacatccgccaaagtaatgatggaagaaggccgaagcaaaggcttcggcttcgtttgcttctcctcgccagaggaggccaccaaggcagtgaccgaaatgaacggcagaatcgtcggcacgaaaccactctacgtcgccctggcccaacgcaaggaagaccgcaaggctcacttaacatcgcaatacatgcaacgcatggccaacatgcgcatgcaccagatgggccagttcatccagccgggcggctccagcggctacttcgtgcccaccattcaagcgacggcgccccgattctacgggccggctcagatgccgattcgcacgagcccgagatggccggcgcagacgcccgtgcgccccggcgcccaagggagcaccgccacctacaccggcatgccgaacagctacagggccgccgccagaccgccgggtcagtccacgatgcgcagcaacatcagcgtgccgcgacccatcaccggacaacaaccaccaagtatgcacggtcgtccacttgttggacaagtgtggctgctgccggaaatcgtgcagccaacttcaaatacaccgccaacatgcgtaatccaccgcaagcgttgttacccggagctcaagctcaagtacagcaagcagtccatattcaa

SEQ ID NO: 2567 - DNA, 662 bp, Phyllotreta cruciferae
ttcttggaaggttttggtgacgagaacgctcaagtacaactacaattgctaacagccgttgtgaagctattcttaaaacgtccacaacatacccaaggcttagtccaacatgtactgagtttagccactcaagactccgacaatcccgatttgagagacagaggtttcatatattggagattgttgagtaccgatccggccgctgccaaggaggtggttctcgctgataaacctcttatttccgaagaaacggatctcttagagccgactcttctcgacgagctcatctgccacatatcatccctggccagcgtctatcacaaaccacccacggcgttcgtagaaggccgaagtgcaggtatcagaaagacattgccggctagacaaggctctgatgacacagccgccgctcccgaaaccactgttattccgaaccaagaaagcctcattggtgatttgctttctatggatattaacgctcctgctccagctgctgctgctcctgccgcccctcagactagtaacgttgatttactcggcggtggattggatgttttgttgggaggaggtaatgatattggggcagcacctgctagtgctgctgctcccaccactactggtcttctcggggacatattcggcatacctactgcacctaccat

SEQ ID NO: 2568 - DNA, 362 bp, Phyllotreta cruciferae
catctttggctccgaaaatcggtccccttggtttgtctcccaaaaaaattggtgacgatattgccaaaggcacagccgactggaaaggtttgaaaattacggtccaattgaaaattcaaaaccgtcaagccaccatctccgtcgttccatcggctgcttccttaatcattaaggctttgaaagaacctcctcgtgacagaaagaagcagaaaaacattaaacacagtggaaacattacattcgatgatgtaatttctattgccaagcaaatgaggcatagatcaatggccaagagcctttctggaactattaaggaagtgctgggcactgctcaatctgtaggttgtacaattgacggcaaa

SEQ ID NO: 2569 - DNA, 653 bp, Phyllotreta cruciferae
ctgaggcctctaactttgagccggcccaaacctctagtcgaattcgcgaacaaaccaatcctgttacatcaaatagaagccctagtagacgccggagtaacggaagtcatattggccgtgtcgtatcgagccaagcaaatggaggaagagcttacagtcgaagcggctaaactgggcatttctatagtattttcgcacgagactgagcctttgggcaccgcaggaccaatagccttagctagagaacacctttcgaaaagcacaaaaccgtttttcgtactgaattcggacataatatgcgacttcccgttcagagagctagagaagttccacgaaggccacggcaaagaaggcaccatagtcgtcacaaaggtagaagaaccctccaaatacggagttgtagtgtacgatcaaaacaactgcatcgagagtttcgtggagaaaccccaggagttcatttcgaataaaatcaacgctggtctgtacattctaaaccccagcgtgattaacagaatagaactccggccgacttccattgaaaaggaagtgttcccttacatggcctctgaccagcagctgtacgctttcgagttgaaaggattctggatggacgtcgggcaaccgaaagatttcttgactggaatgtgcttgta

SEQ ID NO: 2570 - DNA, 678 bp, Phyllotreta cruciferae
ctgaaagaaggagtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgttgataccgcggcggagccctggcgggccgctctagataacgagtttatacaatacacgagaaaccattataaagacggcgtttgtagcgtgttcgctcgcagccaaaacggcgccatcaccctcaccgcttgcatcgaagaccaccaattccagcccaagaacttctggaacggtcgatggagatcccagtggtctgttagtttaaccgatgaagccaccgcagaagtacggggagttctcaaagtgcaagtccattattacgaagaaggtaacgttcaactggtgagcactaaagaaatcaaggaatcgattccggtttcgaacgaagcgcaaacggctaaggaaatcatccacgtaatagaacaggctgagaatctgtatcaaacggcgatttctgagaattaccagacgatgtctgatacgacgtttaaggctctgcgaagactcctgcccgtcaccaggacaaaaatggat

SEQ ID NO: 2571 - DNA, 769 bp, Phyllotreta cruciferae
cacaccgataatatggagcaggccgattcctctaggttggtatttccaattccaatgggagaaccaatacggcaaaaattggcccaaacaactctgcgacgattggctcagaaccgatagatatctgaaaaacttcgctcacgaattaccccaatgtccttgcacggtccaacaggctctggctgataaggggaaattcatgccagactttgattgcgacaaagattcgaatcccgtttgttattacaacaaccaagctttgcattgcgtcaaaaccggtgctcccacaatggaaggctccgagcaacaatgttgctacgacaaaaacggctacctaatgctgtcctacgatcaacaatggggttccagcccccgtcgatgccacaaccttggaaaaatgccttacaacgaagccaccaaggtccccacactatcccaatggttcaacgacatcgtacccaagtacctctgctgtctttggcaggaagagcaagccgtgggctgcgaaacgctgcgattcgaaagaaggccttcgcaggactgcgtcgcctatcaagcgccggctgtggcaggagtgtacggtgatccgcacattgtcaccttcgatgacgtagagtacacgttcaacggcaaaggagagtacgccttggtgaaatccttgaaggtggacgataatttggaaatacaggctagattcgagcaaatggacatcaatgcttatggagaggtcagagccacgcaacttacggcaatcgtagccaaaggaaac

SEQ ID NO: 2572 - DNA, 216 bp, Phyllotreta cruciferae
ctccgctgatgtcgaaaaaatcctcggctccgtaggagtagaagctgaagctgaaaaggtcaagaaagtcctaggcgaacttaaaggcaaatccatcgaagaactcatcactaaaggtcgtgagaaattgagttctatgccagtaggtggcgcagcccctgtagctgccgctgcagttgccgctgccccggctgccgccgaggaaaagaaagaatc

SEQ ID NO: 2573 - DNA, 786 bp, Phyllotreta cruciferae
accgaacattccaataagctcgtagaagtagccaacctcgtctgcagcatgtcgaacaacgaagacggcgtcaaaatggttcgatacgctgccgctcaaatcgacaatctatgtcctgaagtaataaacgccgctaggatcctagcggccagatctcgcagtaaagttgctcaagaaaatatggaagctttcaaacaatcatgggaaaaccaagtgcgcatcttgaccgaagccgttgacgatatcacaactatcgacgactttttggccgtgtccgaaaatcacattctggaagacgttaacaaatgcgtactagctcttcaagaaggcgatgctgatacattggatcgtactgctagcggcataaagggcagatcaaacagagtatgcaatgttgtaacagccgaaatggataattacgagccttgcatttacactaaacgcgttttggaggccgtgaaagttttgaacgatcaagtgatgcccaagtttacccaaagagtacaggtggctgtacaggctttgggcaacagtccgcctaaagaagtggacgaaaacgatttcatcgacgcatcgagattggtttacgacggtgtcagagaaataagaagagctgtactcatgaacagagccgacgaagatttggatcccgaagacgtcgaactcgatgaaaattatttgattgagaccagaagcaaatcgagtgctcatactggtgaacatggcgttgatgaatatcctgacatcagtggaattacaaccgctcgggaagctatgggtaagatg

SEQ ID NO: 2574 - DNA, 742 bp, Phyllotreta cruciferae
agcggtttctacaacatcttcagccaccacagctgctactggaactcccctttttggagttgctccaacctcaagcactactacaatagccagtgtacctgctttaggtttatcgactacagtttctgccgctgcttcaacaactccttcgacttcattaagtactacaacagcacccccagcttactcaacatcgacacttccttctagtggttcattaacatttagtcaactagaagattctattaacaaatggaccattgatttggaagaacagggcaagtttttcattaatcaagcgaaacagcttaatgcttgggattcgttacttatttcaaatggcgagaaaattctcaatctgaatggtagtatcgagagagttaagcagcagcaacagcaattggatcaagaactcgattttgtcttggcgcagcagaaggaattagaagagttaataacacctctggaaaaggaattattggaaattcccgtaacagacatagatcgaaatcaaatgtatcaattttcggaaataatcgattcgcaattaaagcaaatgtctgatgatttgaaagaaattattgagcatattaatgaatctaataaaagcgaagaaatttcaaatcctttgacccaaattagccgcataatgaatgcccacatgaattcccttcagtggttagacagaaatacagcacaaattgtttctcatctggaacaaatcagtaaaatgcaggactcc

SEQ ID NO: 2575 - DNA, 468 bp, Phyllotreta cruciferae
ccgggaaattgctgtttttagggctggataacgctggtaaaaccaccttattacacatgcttaaagacgatagattagcccagcacttgcccacgttacatcccacttctgaagaactgtccatcgggaacatgaggtttaccacgttcgatctaggaggccattcgcaggctcgaagagtatggaaggactacttcccagccgtagacgccattgtattccttatcgacgctaacgacagatctcgattcggagaaagcaaacgggagctcgacgcgctgttgacagacgaaaccctggccaactgccccgtgctgattctaggcaataaaatcgatttacccgacgcggcgtctgaggatgagttgagaaacgtttactcgttgtacggccaaacgaccggtaaaggtaaagtcgctcgatcggatctgccggggagaccgttggagctgtttatgtgctcgattc

SEQ ID NO: 2576 - DNA, 433 bp, Phyllotreta cruciferae
tacgctcaaatctccaacaaaacgcaaaccatcaccaacctgctggtggagacgcaaaccatgatcaactcggcgctgacctgccgcgagtccatcacttccatgctgcagcacctggtggtcatcaacgactacctcaacccggccagcgaggccgacgagctggaggtggaggccaagcggcagtacctgctcgagctctaccccgaattgaaggacaccatacagacggtgagcacgctggagtcgctgttgccgttcatcgattcgatcaacatatcgaaggtggtggagttctctgggaagctggaggaggtggccgtggggaatcttaagttgtacggggagtgcagggatatcaccaagaaggtgttggtggcgttgcagcagtacaacgacatatccaattcgattaagttgttgttttcgcagc

SEQ ID NO: 2577 - DNA, 652 bp, Phyllotreta cruciferae
agaccctgacttacgatacaaaccaccgcctactctgctcgatgtcgatccgcaggatcagcactcgatgtgcctgaagcacatgaacgatctaatgactttctacgggaagatcgtttgcgttaatctagtcgatcagaaaggagccgaagggaacatggaagtggcgttcaagaatgcgataaacaacgtatcgtcgccatcggtgaagtacgaatcgttcgatttccacgccgagtgcagcaaaatgagatgggacagactgtcgattctcatcgatcgattggcgcacgatcaagacgagatgagtttctttctgttgctgagagacggctcgttgagttcccttcaagacggcgtatttagaacgaattgcatcgattgcttggaccgcacgaacgtcgtgcaaagcatgctggcccatcggaatctggaaagcgtgctcagaaaattgcagattctccatcagaaccaaacgttggagttccagtattcgtttgaggtgttgtttaagaacgtttgggcggataatgcggatataataagtacccagtattcgggtactggtgctttgaagacggatttcacgaggactgggaaacgtacgcggtacggtttacttcaggatggtatgaattcgatgacgaggtac

SEQ ID NO: 2578 - DNA, 651 bp, Phyllotreta cruciferae
tatatacgcaatcggagcaggcgccgccttggacccggccgacgagaaactcctagaagaagacatcctcactcctcaagactctaagagatcccgccaccatgccaaatccgtctcgtggcttcgacgaaccgaatacatctccacggaacagaccagattccagccccaaactatggacaaagtcgaagccaaagtgggctacagcatcaagaagtccctgaacaacgaaaccctttacatggacagggactcgcaaatcaaggctatcgagaaaacgttcgaagataccaaaacgatcatcgataagcattacagcaagcctaatgtagtccctgtggatgttttgccagtttatccagatttcagtttgtggaaatatccttgtgcccaggtcattttcgattcggatccggctccagttggcaaacaagtaccggctcaaatcgaggagatgtctcaagctatgattcggggtgtaatggacgaaagcggtgaacaattcgtagcctacttcctccccacggaggaaaccctccaaaaacgcagggaagacgtggccaatcaagtccaatatcaagacgaagaggagtacgaatacaaaatggccagagagtacaattggaacgttaagagcaaggctagtaaagg

SEQ ID NO: 2579 - DNA, 698 bp, Phyllotreta cruciferae
atcaagaaggacgatatggctccatggtacgaactcctctgcaaagaagtcggctggaagttagacgctgccttgctgaaggccctcaaagccaagaactccgaaaaggtcaagcttctggacgaagccatcgaagacgcggagaagaacttgggggagatggaggtgcgggaggcttatttgcgtaaagcggagttttacagcagaatcggcgacaaagaaaacgccgtgaccactttcaggcagacttacgataaaacagtatctttgggccaccgtttggacatcattttccacttaattagaataggcttgttcttcatggaccacgaccttatcactagaaatatcgacaaagcgaagaccctaatcgaagagggaggcgattgggacaggagaaaccgattaaaagtctaccaaggtgcttattgtatgtccgtgagagacttcaaaaccgccgctaacctgtttttggacaccgtgagcaccttcacatcctacgagctcatggactacaaggctttcgtcagatacaccgtctacacttccataatcagcctgccgagaaaccaacttagagataaagtaataaaaggctctgagatactggaggtgcttcattctgaaccgttcgttaaagattacctgttttctttatataactgccagtacgcggagttcttctcgaatttggctga

SEQ ID NO: 2580 - DNA, 737 bp, Phyllotreta cruciferae
attgttcgattacggcaaacctgatgcccaaccggttaagaaaccagtcgccaaaaaattccaaccgaaagtctctctagttagaggagtagctttgcccagtaagcccaacaccgagaagattatcatcacgcaaaattcgaacgtgttgaatacttcacaggcttcgaaagtcaccagcatcattttaacccacaacgcaaatgttagaaggaacattataagcgtaccgaaaatagtgagtaccgtttcaccggctataactatagtgagcgccagtacctcgcaaatggcctctatattaccatctaaattcaccgtgccggttataagcgccagtgcggtacgccagctatccaacgtcaaagtcatcgacaaaccatccacttcttcgttgtcgatttctaccagagacaacgtcctgccgaagaagatattcgaggacgattcggtgtcgccggacagttcgaattgcgacgacgagaaatccaaagattcattcgacgataaagtcaagtcggagtctccgccgcgggaggtcaaacagttcgtgaaatcggatcagcaggtcatatcgctgaaatcgaagaactactccgatcaatcgaagaagatcgagcatctgcaaatagtgaatatatctgcgaaggatgtggttcaaaggcagaggataccgagtcctttgatatcgaaagcttctccggttatcattcacaatacgccagagttgaaaatga

SEQ ID NO: 2581 - DNA, 678 bp, Phyllotreta cruciferae
agtccaacaggcgaattaataaccactaaagagtacaaaggattagatatagtgcgtagggattggtcgcaattgtcttcggaaactggaaaattggtcctcgagcacctcctcagcgatcaatcctccgatgaaaaagtacagaacatctacgactacttggctaaaatcaaatctgatttggttgagggtaaaataccaataccactattagcgatcacgaagcagctgaacaaggcccctcacctgtacaccgataaaaactctatgcctcacgttcaggtggccttgcgatacaacaagaagagccgcgatcacttcagaatgggcgacacagtgccctacgtaatatgcatagacaacacgagtaacaaccccatgcagcgagcctatcacgtggacgaattgaagggtaaccccgagttgaaaatcgactacgattactatctggagcagcagattcatccggtgatatcgagaatttgcgagcccatagagggcttggactcctaccagttagccgaatttctgggcgccaatctgaagcgaatgaagaggcccaaaccgaaagggggcaacgagaacattcaaggggagaacgtcgttaaagccgaggtgaagttcaagaacgccgagaaattttcgttcgtttgctacatttgcaaacaccagaatgtc

SEQ ID NO: 2582 - DNA, 743 bp, Phyllotreta cruciferae
gacgcaggctattagaaagagtattggagtaaggataaaggaagagagtgaaattatcgaaggtgaagttgtcgatctgagtattgaacgtccagctacaggagttggtactaaagtcggtaaattgattctcaaaactacagatatggagactgtatacgatttgggcggtaaaatgattgatagtattctaaaagaaaaagttcagtctggtgatgttatcactatagataaagctacaggaaaaattacgagattgggtagatcttttgctagagctagagattatgatgctactggccaacaaacgaggttcgttcaatgcccagaaggtgaactacaaaaacgtaaagaagttgtccacacagtgactttgcatgaaattgatgtaatcaatagtcgcactcacggattcttggcactattttccggtgacacgggagaaattaaatcagaagtaagagagcagattaatggcaaagtagctgaatggcgtgaagaaggcaaggctgaaattattcctggtgtactgttcattgatgaggttcatatgttggatatagaatgcttctcatttttaaacagagctttagaaaatgaaatgtctccaatcgtcataatggccaccaatagaggtataacaaaaattcgaggtaccacttacaaatctccgcacggcattcctttggatttactggatcgaacaattattgttcctactcagccatatgacgagaaggaat

SEQ ID NO: 2583 - DNA, 799 bp, Phyllotreta cruciferae
cgaagaaagaaggaggttgattgagctcggtttgagccagcatgttttagcgagcagtgtatcactgcttagagcagaagaagttgaagatataattgaaggaaatgatgagaagtataaagctgtatctgtacacacttcggaacctcctatgccaagagagggtaaatccaagaaaaacatgcaatgggtaccatcgttacctaattccagtcatttagatgccgttccacaagctacgcccattaataggaacagagtagctgctaaaaaggtgagaacatttccactatgttttgatgacaccgatccccaaataaacatagaaaatgcttgtcaacaagaattgctagttcctattagactggatatggaaatcgaaggacagaagctcagagatacattcacttggaataaaaatgagagtttaataacgcctgaacaatttgctgaagttctctgtgacgatcttgatttaaatcctttaacatttgtaccagcgattgctcaagcaattagacaacaactcgatgcattcccgactgaacctcctgctattatagaggaaacctgcgatcaaagagtcattattaagttaaatattcacgtgggaaatacatctttagtcgatcaagttgaatgggatatgagtgaaaaacagaataatcccgaagaatttgcgttgaaactttgtgcagaattgggtcttggtggtgagtttgtcactgcgattgcttattctattagaggtcaactctcttggcaccagaggacttatgctttcagtgaagctcctctt

SEQ ID NO: 2584 - DNA, 479 bp, Phyllotreta cruciferae
cggtaaaacgtgtcttttgatagtatttagtaaggatcaattcccggaagtgtacgtgcccaccgtattcgagaattatgtggccgacatcgaggtggacggcaagcaagtggaactcgccttatgggatactgcaggccaggaggactacgatcgcctgcggcccctttcatatccagacaccgacgtgatcttaatgtgcttctcggtggattcgccggactccctcgaaaacatcccggaaaagtggacgccggaggtaaaacatttttgtccgaatgtgccaattatcctggtaggcaataaaaaggatctgcgtaacgatccgactaccattaatgaacttaaaaaaatgaagcaggagcctgttaagccgcaggacggtcgttcgatggccgagaaaataaacgcctttgcgtatttagaatgttcggctaaaagtaaggagggcgtcagggaagtattcgagaatgccactc

SEQ ID NO: 2585 - DNA, 672 bp, Phyllotreta cruciferae
taccaacacaattttccccatgccatctcgcccggggcaaatgcatacgaattgaccagtccattcgttttctctcccaagcacaacggcctctatttatatttaagtagaatattaagacctatttggcatcgaaggacagtggataagctttgcttagatggaaaaattgttacaaatcacagtacagtgactagtgaagactgcatatttattttgaactacataacgtccctgcataatttcctaatgcgcaatactcagctttcaaccttaagcgccggtcctggtcccggtcaaaatcctcaaaccttcaataatactacaattaatatgaccagattgaaccataccattcaagatgttcaattggaggaaagggcatctctggatgctttgaaaacattcgtttgccactgttgtcaaatattaggtctatggagaattctttgcgagcatcaattccacacattaatagcttctttgcctgaaactgagcagcagattttgcaaaatacgactttcaaggatctacttttatatcgacatgatatctgttcgttgttgattgcgacattagtcgatagttacttaggtgataacgcctcagtcgattcgattagcagcaaattgagagaagtctgtccgctgttttacaagacggaagatgca

SEQ ID NO: 2586 - DNA, 734 bp, Phyllotreta cruciferae
tcgttcgaaacagaacttctcaatctccaatcacctgacgttgtgacagaggagctgttgaaaagaatttacgttgaaatggattccgattttttctcgcatattttgcacctaatcaaagacgtcaacgatttgtacaaagccatacacaaaatcctggagctgttgagatatgaaaacaccttggccaaccccgataacgacattaacccatccgctatgtactatttcaattcactgttaggcacttcattggtggcccaaagtttccgacaacaagccgaaatcagatttcaaatttgccgcaatttgttgctattatgcaacttcttggtgatggacaggacgctagattggggcgttttggaaggcgttcgatcagtctgtatgccagacattgtcgttctaacccaagccagtttcgttgttctgtggctaagcgggttgacaatgttcgaaagcgactcgattcgtgattcttcgatgagcatcctgaacccgttaaaactaactccagtttacaatttgctaccgttcactcgttgcacgtctttgttggaagtattcatatcatcatcaggcgttcaagatgccaggaaatcgttcgcaagggtttcctgcaaggacgaggccttggtgcattggcattggtcgttgttgccttacgtaaaccacatcaggcatcttatatggcccataagcggttgtacggtgttagaagagtggctgttgtc

SEQ ID NO: 2587 - DNA, 694 bp, Phyllotreta cruciferae
ccagaactatcccctattgctgctcaatctagtgcacaagcccgaggcggacatgaccatcagggtggccggctcggtggccttcaaaaactacataaaaaggaactgggtagtcgaagaggaccagaccgatcgtatacacgaatccgatcgattggccatcaaaaatctcattgtaactttaatgctgagctcaccggagtcaattcaaaagcaactcagcgatgctatcagcatcatcggaaaaactgattttcctttgaaatggccggagctcatcaccgagatggtcgagaaattttctaccggcgattttaacgtgattaacggcgtgctgagaacggcccattcgctatttaagaagtatcgatacgagttcaagtccaacgaattgtggacggagattaaatatgtactcgagaagctagcgaagcctcttactgatctgttagttgctacgataaatctatcgcaaacccacgcgaacgacgtagcagcattgaaaatcatctacagttcgctcgtgctcatctgcaaagtgttctattcgttgaatttccaagatttgccggagttcttcgaggataacatacaaatctggatgaccaatttccatacgcttctctccgttgatgttaaatcgttacaaagccaagaagacagcgaggcaggggtactagagcagctgaagtct

SEQ ID NO: 2588 - DNA, 458 bp, Phyllotreta cruciferae
atcacgttcgaatgcatagaggaattaaaagaagacttagaatggaagatgatttacgttggttcggccgaaactgaagaacacgatcaaatcttagactctgtatttgtaggacctatcccagaaggcaaacacatgttcgtctttcaagcagatcctccgaacgtctcccgtatacctgaaaatgacgccatcggtgtaacagttgttctcctcacttgctcctacaagagccaagaatttattcgtgtaggttattttataaataatgaatacagcgatcctgaaatgagggaaaatttgcctagtccacctcagttcgataaggtaattagaaatatattggcgtccgaaccgagggtgacgaggtttaaaatcaactgggaagaatcgagtggcactcaggaaaacggaactacaattgccgaaacccccgctaaccaaacaaccgaaacttc

SEQ ID NO: 2589 - DNA, 702 bp, Phyllotreta cruciferae
tttaccaaacgccattcaacaacaacaaagtctacctactactaactcacaagtgcctcctctagctccaatgggaggttctactccaacgcttggtctaggtttaggccatgcgatgtccatgccacatactaagtatgtaaccggattttcactgcctatcagttctatggcacctcaaacaccacaacatacaatgatgagtcctatggtaaatgttggtggaactggtaccactagttctggtgtaacgcccacgttaggtccctctacaccttcaccaatgactcctatgacaccacattcagcagatcctggaatcgttccacaattacaaaacattgtgtcaactgtaaacttgagctgtaaattagatttaaagaaaattgccttgcatgcgagaaatgccgaatataatcctaaacgttttgccgctgtgattatgaggatacgagagccaaggacgacagctttgatattttcgtcgggtaaaatggtgtgtacaggtgcgaaaagtgaagaagactcgagactagctgcaagaaagtatgctcgaattatacaaaaactgggtttccctgccaaatttttggatttcaaaatacagaatatggtgggaagttgtgatgttaaatttccaataagattagaaggattggttctaactcacagttctttcagcagttatgagcccgaattgtt

SEQ ID NO: 2590 - DNA, 329 bp, Phyllotreta cruciferae
gctgatcaaatgagcttcacttttgctgctggaaaccaggtcttctacgatgcgaaatcgataaaacaagtagatgttccttctttctccggtagcttcggtatcctaccagcccatgttcccactcttgctgttctaaagcctggagtagttactgtttacgaagacgctggtaatgtcaagaaaatcttcgtatccagcggtacagtgactgttaatgacgattcatctgttcaaatcttagctgaagaggcccatcccgtagaaaatttagacgttagtgcagccagagatcttcttaacaaagcacaaagtcaattgtcatcggc

SEQ ID NO: 2591 - DNA, 695 bp, Phyllotreta cruciferae
agaattgaaggagaagcaggaacaggaggcccgcaggaaggctaagaaagaggccgaatcggccaagcaagctcaaattactgaattaacagaagagcaggctgagaaattgcaagccgagctcgatgctaagaagtccccagcttcggttaccccttcgaatagctcgagtggcccttcgacctccacgacgaagatcgaagaagacgaagacgagtccgagaagggtaaattgctacccaataaaggcaacggatgtgatttagacaagtataattggacccagactcttagtgatatagagctgcgagtgccgctccagtgcaatttccgagccaagcaaaaggatctcacggtgaatttgaccaaaaaacgcctcacttgcggcctcaaaggccatccccccatcatcgatgacgatttccagcacgaaatcaaactggaagagaccaattgggtgattgaagacgggaaatcgttgctgttttccatagaaaaagtgaataaaatgaattggtggagtaaaatcgtgaagaatgatccggagatcagcactaaaaagattaatccggagccttcgaagttgagcgatttggatggggagacgaggggcatggtggagaagatgatgtacgatcagaggcagaaagagatgggattacccactagtgatgaaagaaagaaacaggacgtgt

SEQ ID NO: 2592 - DNA, 333 bp, Phyllotreta cruciferae
gcgatagagaaaggtggatttgcgtttatccagcatacattaattccaaaaaaaccattgcccaaggcaggaaaataaacaaagaaaaatgcgtggagaatcccactcatcaagaaatcagagacgttttgctcgcagcaggtttgaaggttggcgtagaaaacaaattgtacagcagagaacgaagcaaagaattgctctatcgagggcgaattagagtccaattgaaaaacgacgacggtacgctgtgcaatccaaatttccctaccagagacagcttaatgctccatttgggagacatgattcccaaattgaagagcagacaaaacaagg

SEQ ID NO: 2593 - DNA, 776 bp, Phyllotreta cruciferae
aacaagcttggcaaacttacataaatttcgaactgagatacaaggaaattgatagagccaggcaaatatacgaaagatttgttataacgcacccggaagtgaaacattggatcaaatatgcccgtttcgaagaaaatcacggtttcattcattcagctaggcagatttatgaaagagctgtccaattttacggagacgatcatttggatgagaagctttacatagctttcgccaaattcgaagaaaaccagaaggagcacgatagagctagagttatctacaagtacgccttagaccacatccctaaggatgaaacgaaagaactgtataaggcgtacaccatccatgaaaagaaatatggagacagaagcggtatcgaggaagttataatgtctaaaagaaagctgcagtacgaacaagaaatactccaaaatcccaccaattacgatgcttggttcgattatcttcgactggtagaaggagaagcagatttggaaataactcgagaaacctacgagagagctattgcaaatatacccccatcgaaaaacaaacaatactggagaagatacatttatttgtggatcaattacgctttattcgaagaactggaagctaaggattacgaacgaaccagacaggtatataaagcctgcctggaaatcctgccgcataaaacattcacgttctccaaaatctggctgctctacgcacagttcgaagtgcgacagaagcatttaaaagcagcccgtaaagttctaggcatgtccatagga

SEQ ID NO: 2594 - DNA, 694 bp, Phyllotreta cruciferae
attgggtatttctccgatcgtaacatctggattgatcatgcaactcttagccggagcgaagatcatcgaagttggcgacactccgaaagacagagctttgtttaacggagcccagaaactgtttggtatggttataacggtcggtcaagccatcgtgtatgtaatgaccggaatgtacggagacccagctgaaataggagctggagtctgcctgcttatcatcatccaactgttcgtagcaggtcttatcgtgctccttctcgatgaactgttgcagaaaggatacggtttgggttctggtatttccctgttcatcgctacgaacatctgcgagacgatcatatggaaggctttctctccggctactgtcaacactggaagaggaaccgaattcgaaggagctgtaatcgctttgttccacttgctcaccaccagacaagacaagattagaggactacgagaggcattctaccgccagaatcttcctaatttgatgaacctcctagccacagttttagtgtttgctatagtaatatacttccaaggttttagagttgatttacccataaagagcgccagataccgtggccagcactcgagctaccccatcaaacttttctacacttctaacattccgatcattttgcaatctgcgttggtgtccaatttgtacgttatatcccagatgttggcg

SEQ ID NO: 2595 - DNA, 712 bp, Phyllotreta cruciferae
aatttaaccaccatcggtcagatcagctcttattccaccgccaaagaatggagtagaggtaaaaaggcacttttaggaacattagggttattagccggaggcactggggccgtgctggtggccctcgaccagtcggttaaagcgtcggatctagaactgcacccgccgaagaacatctggagccacagcgggatattcagctcgctcgatcacgccagcgtccggaggggttacgaagtctacaaacaagtatgcgctgcatgccactccatgcgtttcgtggcctaccgcaatctaataggcgttacgcacaccgaggccgaagccaaagccgaagccgaagaccagatgatcgaagatggccccaacgatgagggcaacatgttcaaacgccccgggaaattatccgattacttccccagcccttaccccaacgaggaggcggccagggctgccaacaacggggcctacccgcccgatttgagctacattacgtctgctagacacggaggtgaggattacatttttgcgctgttgactggttactgcgaggccccggccggcgtgattgttagagaagggcagtactacaatccgtacttccccggtggggctatttcgatggctcaggctttgtacaatgaaacgatcgagtacgatgatggtactccggctacggctagtcaattggctaaggatgtgtcgacgtttt

SEQ ID NO: 2596 - DNA, 715 bp, Phyllotreta cruciferae
ctcctgctgaatattcgtcaaaaagcaagctcgcggtttgcgcagcaccagaagtccttcccacaggactagaggaggaccaaatgcacatcgatgtagacacaaaagagctagcgtttaaccccaagttcgatgtcctgttcgcacctgccctaggtcctgctaatccttttaaaacgcaacaacagttggttgaacgaaacatgctctcaggccacatcgagagagcccacgtcagcgaattccaattcgaaaaccaaaggaggactttcaccagttacggttacgctttggacccgtctgtaaccaatgacgggaaaatcaaagtggtaggatcttcggaagccgatgatagtagcatcaagactgtattcgaagcctctaaaacgaggcctttggataaacgaaaaaggaagaagaatgatgaccccagcgatgttgaaggtttcttaggcccttggggtggtttcgtagacgagcaaaaagtttccaaacctaccgaggaagaacaaatcgaattggatgagatatcctccaagaagaataaaaagggtaaacccaacgaagataaacccctcgaagaaaaatcagtcttgcacatcaaagacgccgtggattaccaagggcgctcattcctccatgcgccacaagatgtcggggtcaatctcagatcggacacccctccggaaaaatgtttcctgccaaaagctcatat

SEQ ID NO: 2597 - DNA, 454 bp, Phyllotreta cruciferae
caaccccttattcgaaaagcggcccaggaatttcggaataggccaagacatccaacccccgagggatctatccaggttcgtaaagtggcccaaatacatccgcatccagcggcagaaggccgtcttacagaagcgcttgaaagtgccgccgccaatcaaccaattctcccaaaccatcgacaaacaaacggccacccaattattcaaagttttggagaaataccggccggagaccgccttgcagaaaaagaaccgactgaaggccaaggccgaggccaaggtggccaaaaaggaagaggcccccgccaagagacctaatactttaagagctggtactaacactgttaccaaattagtcgagcagaagaaagcccaattggtggtcatcgcacatgatgtagaccctatcgaattggtactattccttcccgccctgtgtaggaaaatgggagtc

SEQ ID NO: 2598 - DNA, 659 bp, Phyllotreta cruciferae
gatcctcacatactccacactttaagcgccgttcaaatactttgcatgtacgataacttaaaagctatagacgtagaaggcgttgtgaagtatgtaaaaaacctacaactacccgacggtagcttcacaggagacaaatggggcgaagtagacaccaggttctcattctgcgccgtcgcgacgctctcgcttttagacagaatggacgccatcgacgtgaataaagcagtagactttgtagcttcttgtaaaaacttcgatggtggtttcggctcgaggcccctctccgagagccacgccgggttaatatactgctgcttaggattcctgtctgttaccaatcgattggatattgtggatcgagatatgctggcttggtggctctgcgaaaggcaattaccttcgggcggtttgaatgggcgtccggagaagctgcctgatgtttgctactcctggtgggtgctgtcttctttaactatattaggaaaactgcattgtatagacgccaatgcgttgaagaaattcatactagcatgccaggataccgagagcgggggcttcgctgataggcctggggacattccagatcctttccacacagtgtttggaatatcagcgctgtctttactcggaaacgacacggtccagaaagttaatcc

SEQ ID NO: 2599 - DNA, 732 bp, Phyllotreta cruciferae
gccggtttacaactgaaaaaccagctcacttcgaaagacccgaccatcaaagtcggctaccaacagcgctggctgctcttcgccgaagaagtcagagactacatcaagaagaacgtggttggcgccctcgggaccgagaccaacaggccgtcgtcggccgcccaatgcgtcgcctacatagcagtgaccgaattaccgcaaggacaatggccggatctcatatcgacgctggtgagcaacatttgccaggggaactccacggaaatgcagaaggaggccacgctcgaagccatcggttacatctgccaggaaatcgaatccgatgtgttagtcttacaatctaacgatatactaacagccatcgtgcacggcatgagatcctccgagcccagcaatcacgttcgattagccgccacgcaggctttactaaactcattggaattcactaaagctaacttcgatttgaccaccgaaagaaattacattatggaggttgtttgcgaagccacgcagtcgccggtgtcgcaaatcaaagtggccgctttgcaatgtctagtgaaaataatgtcgctgtattatcaacacatggagccctacatggcgcccgctctgtttcccataacgttagaggccatgaagtccgagaacgatgccgtagccctgcagggtatagaattttggtcgaacgtaagcgacgaagaagtggatttgtccatcgaagatactgaagca

SEQ ID NO: 2600 - DNA, 677 bp, Phyllotreta cruciferae
ccaccgaaagactaatcgatttgtacgaagacaaagacggccaacgcaaggccgaggtggccgccctgacgggccccaacgaattcaacgagttctacagcagactgaaacaaatcaaagacttctacagaaggcaccccaacgagatcagcgtaccgatgtccgtggagttcgacgaattcgccaaagctagagagaaccccaacgaagatatggccaatttcgtggaattcaccgacgaagaaggctacgggaagtacctagatttgcacgagtgctacgagaagtacataaacttaaaaggcatcgagaaagtcgattatatcacatatttggcaatgttcgatcagctgtacgatataccgaaagaacgcaagaccggcgagtaccgcaaatacctgctgtacctcatcgagtacctcacgtggttcgtgcagcgcatcaggccgctgatggacctcgatggcgatttgctagagcaggccgagcaggctgcggccggatgggagaacggatcggtgcccgggtggccgaaagaaaccggctcggctttggcgaacgtgggcgctcatttggacctatcggctttctccagttgggaggaattggcttcgttgggcctcgatcgattgaaatccgctcttatggcgttgggattgaaatgcggaggaacttta

SEQ ID NO: 2601 - DNA, 507 bp, Phyllotreta cruciferae
tatcggcacctttaaagctttcgacaaacatatgaacatgatactcggcgattgcgaagaattccgcaaaattaaacccaaaaactcaaaagtcgaacgagaagagaagcgggtattaggatttgtactgctgagaggcgagagcatagtctcactaactgtggaagggcctccaccaccagaagagggacttcccagggtacctatccccggagcagcccaagggccaggtataggaagagcagcaggtaggggaatgcctcccggtatggctggtgtaccagttggtctccaaggtcctgtgagaggagtcggaggaccgtctcagcaagtaatgactcctacgggtagaggacaggtttcagcgccgccacaaatgaaccaagcacctccaaggatgggtggccctccgcctggtatgatgggacctccgccgggaatgatgggcatgccgccgcaaatgggaatggggcgcggaggaccgcctccgatgggtatgaggggtcc

SEQ ID NO: 2602 - DNA, 664 bp, Phyllotreta cruciferae
acttgtttggccatatggaatgttattcaacctcaagaaattccatttcctacgaaggagctgtggttagagaagtccaaggaattttatgagattacacagtttcccaattgtattggaagtatcgacgggaaacatatcaggataatttgtccccctaactctggctcagagtatttcaattacaagaaatacttctcgattgtccttttggcggttgctgacgcaaattattacttcacagctgtcgatattggatcttttggacgcgaaggagactctacgatcttcaaaaagtcaaattttggactaagactcaaaaataacgaactagacctgcctgcagataatcccctaccagtacctgacaatgtggagcaaggttccgaggtaccctatgttttgctcggggatgaggcttttgggttgtcaaagcatgtgatgcggccatacccgtccaagggattatcgcaagaaaagaggatctacaactacagacactgccgagctcggcgtgtcgtagaatgctctttcggaattctctctaacaaatggcgtgtgctacattcttctatgttaatacatcctgaatttgctgtcatcgtagtgcaggcttgttgtgttttgcatagttttgtgcgaagaggagatggctacctttttg

SEQ ID NO: 2603 - DNA, 737 bp, Phyllotreta cruciferae; identical to SEQ ID NO: 2580

SEQ ID NO: 2604 - DNA, 727 bp, Phyllotreta striolata
ttgatgaagaaagaggcgaaggaaagaaggcgaaaagagaaaatgggctgggacaacgaatacttacattacacgaacagcgacaatccattcggagatggaaatttactgaccacattcgtttggaacaaaaaattgtccaaagaaggcatcaaaaacgtcggtcacgcagaaatcgaagcaataaaccggttaaaacaagaggagaataagagggaactcgaaaaagtcaagaaacgtaggctagagagggaattggagaggcaaaaaagagaggaagaaacccaaatgatgcaaagaagtaaagaagctgcccaattcgaggaatgggaaaggcaagaagataaattccacttggagcaggcccgactgagatctcacatcagaattcaagatggtcgagccaagccgatcgatctactagcaaagtacataagcgcagaagaagaagtcgatgccgtcgaaatgcacgagccttacacttacctcaacggcttgcaaatcaaagacctagaagacctagtcgaagacatcaaagtctacaaggaactagaaagaggaaagaacctagattactggaacgacataacagtcatagtagaagacgagcttcaaaagttgagaaaaattgaaaaacaaaacgatttcgacttgggattgaaccgaagagaagggatacatcaatctgttgccactgatgtaacatcagtgtttaaaggcaaaacgg

SEQ ID NO: 2605 - DNA, 711 bp, Phyllotreta striolata
cgaagagaaactgaaggacattttcggggaagtggggcaagtgctgtcgttcaaactggtcttcgaccgtgaaacgggcaaacccaaaggctacggcttctgcgagtaccgagaccaggaaaccgccttgagcgccatgaggaacctaaacggatacgaaattggcgggcggaatttacgcgtggacaacgcctgtacggagaagtctcgaatggagatgcagaatttgctcaatcagccgcccgtcgagaatccctacggggagcccatccaggcggagaaggctccggaggcgatcagcaaagcggtggcttcgctgcctccggagcagatgttcgagctgatgagacagatgaagagtaccatacagaataacccaaccgaagcgagacagatgcttttgcaaaatccccaattggcctacgcccttctacaagcccaagtcgtcatgaaaatcatcgatcctcatacggcagccagtttactgcaccccgtcaatcaagtaccggccactttgctggcgggcgataagaacgtaggcctgcaagtacccatcgggaaccaatacagggagcccccgggacccgtgcaggcccccaggcaggagtaccaacccgtaccgcccccgactgcagtcgtacatccgggtcacgtgcaacaacagccagtttttaccggtcaagacgtcgatttgagatcaatgggaaacgt

SEQ ID NO: 2606 - DNA, 753 bp, Phyllotreta striolata
agtggaatccaggctaaaagaaatgcgagaacagctcaaagatttaactaagcagtacgataagtcagaaaatgatttgaaagccctgcagagtatggggcaaattgtaggtgaagttttgaagcaactgacagaagagaaattcatcgtaaaggcaacaaacggtcctcgttatgtagttggctgccgtcgtcagttggataaggccaaattaaaggccggcactagagtagctctcgacatgaccaccttaaccataatgcggtatttaccgagagaagtcgacccgttagtttacaacatgagccacgaagatccaggagacgtcacttactccgccataggaggactttccgagcagattagggagttgcgagaagtcattgaactgcctctcatgaaccccgaattgtttatgcgagtgggcattacacccccgaaaggttgtctgttgtacgggccgcctggtaccggtaaaactctgttagctagagctgtggcatctcaactggacgcgaactttttaaaagtcgtatcgagtgctattgtagacaaatacatcggcgaatcggccaggcttattagagaaatgttcaactacgccaaagaccatcaaccgtgcatcatcttcatggatgaaatcgacgctatcggtggtcgtaggttctccgaaggtacatcggccgatagagaaatccaaaggacgcttatggagttgctgaatcaaatggacggattcgattcgttaggaca

SEQ ID NO: 2607 - DNA, 657 bp, Phyllotreta striolata
attgtaccaagtcgagtacgccatggaggccatatcccatgccggaacgtgtttaggcatcctggctaacgacggaatccttcttgccgccgaaagacggaacaccaacaagttgctggacgaagttttcatttcggagaaaatatacaaactaaacgaggatatggtttgcagcgtggcgggaattacgtcggacgctaatgttctaactaacgaattgcgtttgatcgggcaaaggtatttgtatcagtacggagagtcgatcccatgcgagcagttggtttcgtggttgtgtgatgttaagcaagcttatactcaatacggaggtaagaggccattcggtgtatcgatcttgtacatgggctgggacaagcattacggttatcaattgtaccagtccgatccgagtggaaattattccggttggaaagcgacttgcataggaaataacagttccgctgctatttcgagtttgaagcaggaatacaaagaaggcgatatgaccttaaaagatgcgaaaggtttggctgtgaaagttctggcgaaaactttggatatggctaaattgacgtcggaaaaagtggaaatggctacactgacgcgtagaaacgataaaaccatcataaatatattaaatagcaaagaagtggaagaact

SEQ ID NO: 2608 - DNA, 736 bp, Phyllotreta striolata
tacttcacatttgctccgaacattacgatggcagtgacagcacagacaagagctctaaagataaggacaaaaaagacgccgcggagaaggagaaagacctttcctcgagacaagcagtggccgtactcggtatagctttgatcagtatgggcgaagatattggtagcgaaatggccttccgcaccttcgggcatttgttgcgctactgcgaaccagtgattagaagagcagtaccgttagctttaggacttatttcagtatcgaatcctaaattgagcatcctcgatactttgagtaaattctcgcacgacagtgacgcggaagtagcccacaatgccatatttgccatgggtttagttggagcgggtacgaataacgcaagattggccgcgatgctgaggcaattggcgcagtatcacgctaaagatccgaacaacctgtttatggttcgcattgctcagggtctaacacatttaggtaaaggaacgttgacgttgagtccttatcacagcgaccgtcaactcatgagtcctgtagcagttgcaggattaatggctacactcgttgggtttttggatgttaaaaatattattttgggaagatcgcattatctcctatacactttagcagcggctatgcaacctaggatgcttgtgacattcgatgaagatttgaatccattgccggtacctgtgagagtgggattggctgttgatgtagttggtcaagctggtaa

SEQ ID NO: 2609 - DNA, 750 bp, Phyllotreta striolata
ttcctaatccgagctttacgcaggacattagttacgtgaacatagaaggaactgttgtgcccgttacaatatcggaaatggaacatcctggggactatgccaatctacaaactgctcaatacaacaacggctatacggatggcacacaatatttaaccaatcatcagtaccagaacatgtatatagagagaagtactgttgataattctccttctgctacagttctataccgtggcgatgatccgaatttgggagcttctagattccaagcaaattacgacatatccagtactcaatcgcaagtgaaccttcttcccgcttccggagaaacctactatacatcaacatctaactggacgccgaccagcagcggttcttacccacaacaatatccatcagggaccataaacgtccttcaagctgattcgacccaagctttcggaactccttacataaacgcgacctggtcgtcgaattcgatggaggacggacggcaatctagtcaagagactggaaatagaagaaacggcgtaacgtgtgcaaattgcaaaactaacaacacaacactttggagaagaaacaaccaaggcgagccagtttgtaacgcttgcgggctttactataaattacataatgttaacaggccgatcagtatgaaaaaggaaggtatccaaacgcgcaaaagaaggccaaaaaactcttcggtcggaagccctgcgagtgctgcaggtcaagtaagaatggggcttc

SEQ ID NO: 2610 - DNA, 762 bp, Phyllotreta striolata
gccttctagtccaaatccaaatgttgatacagacgttactatagacattccaacagacgacagtatgaagaattcagaaacttctaatttagatgatagtggggagaaagaaacggacgaaccttttcaagactatgtcaatcaaaggggtattcggtttacgcctcaattccaacaggaaaccaatctatctccttacggtttagcctgcgtacgcgaactattcagattcctaatcagtctctgtaatcctttggacaagcaaaacacggacgtcatgatacatttaggactcggtttgctcacagtagcgttcgaaattagtgcagacaacataggcaaatacagcaccctgttggctctagtcgaagacgatttatgcaggaatctattcgctttaatgaacaccgatcgtctgacgatattcgcagcgaacttgcaagtgtcgtttctgctgttcgaatcgctacgcgcccacttgaagtaccaattggaatgctacttgaagaaactcatggagatcatgcgcagcgaatcgaacaaagtgagctacgagcacaaggagatcgccttggacaatctgttgcaattgtggcgggtgcccggcttccacgccgagctctacgtgaactatgattgcgacatgtattgcgcgaatttgtacgaagagctcaccgagctactggccgaacgatcaatttccaccgtcgtgggagtgtaccaccagcatttgctgtcgctcgacgggcttctgatcataat

SEQ ID NO: 2611 - DNA, 532 bp, Phyllotreta striolata
tagcaatgaaaggcgaaaactgcgtcgcgatagccgccgaccgccggttcggcatccaagcccaaaccgtcgccacgaacttcgagaaggtcttcgaaatgggcccccacctgttcgtcggcctgcccggcctggccaccgacacgcaaaccgtcatggagaagctccggttccgcaagaacctctacgagctgaaggagaaccggcgcatctcgcccaaggtgttcgccgccatgatatctaacatgctgtacgagaagaggttcgggccgttcttcgtggaacccgtggtggccggtctggcgcccgatacgttcgaaccttacatttgcaacatggatttgatcggttgccttaacgaacccagcgatttcgttgtagggggtaccgcttcggcgcaattgtatggaatgtgcgaatccttatgggagcctaatttagcacccgatgatctgttcgaaaccatttcgcaggctctaataaacgccttcgatagggacgctatatccggttggggagctacggtttatat

SEQ ID NO: 2612 - DNA, 740 bp, Phyllotreta striolata
ggatatcagtcggagcaattggaccgagtcaattaagcgaggatcgggtggtggttgacatggcgttcgacgtgttgaaaacggacataaggccagatgaaaaagaaagcgtaacaggccaacttcacgaagccgccacggattgtatttgcaccttactgttacgtctcgaggataataacaaccacgtcgcattggaaacgcacttattcgaaaatatagtaaatttagaagtggcctatcatgcatctgtcgccctcgaagatcaagcaaagtcgacggactattgtcggctattcaccgaattggcggaatcatttttggggaagattgtagacgatggaggaggcggtggcggcggcgacggcggcggcggagccaagaggcgtaccgtgtacgccgttaaatgtctagatttggtactgatgtgcgtcggccatcatgattacgaggtggccgaaataacatttaacctttggcatatgctaagtgaggaattatatcagaaaaataataaggaattaactgaattattcaaaccatacgtggaaagattgatcacggccctatgtaggcattgccagatggagccagacatggagggtctactcgaaaaaggagatgaatttaaagattttaggatgaaagtctctgatctaataaaggacgtggtctttatagtaggtagcagcagttgcttcaggcaaatgttcatcaatttacaaacctcaggtgttacg

SEQ ID NO: 2613 - DNA, 722 bp, Phyllotreta striolata
aagactctaaaaacgaccccaacaaggtaaagcgaaaattctcctcgttcttcaagtccctggtcatcgagctcgacaaagagctctacggccccgacaatcacctagtcgaatggcaccgaaccctcaccacccaagagaccgacggcttccaagtgaaacggcccggcgacaagaacgtgcgctgcaccattctgttgctcctcgactaccagccgttgcagttcaagctcgacccgaggctggcccgattgctcggcgtccacacgcaaaccagaccggtgatcatatccgccctgtggcagtacatcaagacgcaccggctgcaggacggccacgagcgcgagtacatcatctgcgacaagtatttggagcagatcttcaactgtactcgcatgaagttcgccgagatcccgcaacggttgaatcccctgctgcatccgcccgatccgatcgtcataaaccacgttatatccgtcgaaggcggcgccgagagcaagcaaacggcttgctacgatatagatgttgaggttgacgatacgctgaagactcaaatgaataatttcctgttgagtacggccagtcagcaggaaattcagggattggacgcgaagattcacgagactgttgatactataaatcagctgaagactaacagggagtttttcctgagttttgctaaggatcctcagcagtttatacacaaatggatcgtgtctcaa

SEQ ID NO: 2614 - DNA, 286 bp, Phyllotreta striolata
caacattggacgaattagaacaaaaaatgcgagaagccgagaccgaatcccacgaaggaaaacgaaaaaatgaatcattgtggcccatattcaaaattcaccatcaaaaatctcgatacatcttcgacttattttaccgaagaaaggcgattagccgagaattgtacgagtattgcttactggaaaacatcgccgacaagaatttaattgcaaagtggaagaaacagggctacgaaagcctttgttgcctgagatgcatccaagccagagacaccaatttcggaac

SEQ ID NO: 2615 - DNA, 760 bp, Phyllotreta striolata
ggctcacaatttggaagatgaattccgaactataagacaaatagtgcagaaataccaatatgtcgcaatggacactgaatttcccggcgtcgtggcccgacccataggagaatttcgaagctccgccgattatcaataccaaatgttgaggtgcaacgtagacttactgagaattatccaactaggtttaacgttcttagacgataatggcaaaacaccaggaggagtttacactacctggcagttcaattttaaattcaaccttcaagaagacatgtacgcacaagatagcatcgatttactgcaaaattccgggatacaattcaagaagcacgaagacgaaggtatcgaaccgttagaatttgccgaactactaatgtcctccgggatcgttctaatggaaaatatcaaatggctgtcgtttcattccggctacgattttggctatttaataaagttactcaccgacaacaatctaccgcaagatgaaaatgaatttttcgatctgctgaaattgtattttcccaccatatacgacgtaaagtatttaatgaaatcgtgtaaaaatttaaaaggtggccttcaagaagttgcggaacagttagaattggagaggatcgggccccaacatcaagccggatccgactcgctgttgaccggaatggcctttttcaaaatgaaagaaatgttttttgaggatactattgacgattcgaagttctcaggccatctttacgggctcggaacatctttcactgtt

SEQ ID NO: 2616 - DNA, 681 bp, Phyllotreta striolata
ctgtgtttatcccctacgagagaattggctgtacaaattcagaaagttatattagctctaggtgatttcatgaatgtacaatgtcacgcttgtatcgggggtacaaatcttggagaagacatcaggaagttagattacggacagcacgttgttagtggtacacctggaagggtttacgatatgattcgtagaagagctttgagaactagatccgtgaaaatgctagtactagatgaagccgacgaaatgctaaacaaaggcttcaaagaacaaatctacgatgtgtacagatttcttcccccatccactcaagtggtgttaatatctgctacattaccacacgaaatcctggaaataacatccaaatttatgaccgatcccatcaggattttagtcaaacgtgatgaactgacgctggagggaatcaaacagtttttcgtcgccgtggagagggaagaatggaaattcgacactctatgtgacctgtacgacaccttaaccatcacgcaagccgtaattttctgcaacaccaaaagaaaggtcgattggttgaccgaaaagatgcgagaaaacaacttcaccgtgagctcaatgcacggagacatgcctcagaaagagcgcgacaacattatgaaggaattccggtcgggccaaagcagagttttgatcactaccgacgtt

SEQ ID NO: 2617 - DNA, 794 bp, Phyllotreta striolata
caacagtcgagtctcttagggcctttggcagttgatgctgttcttaaaattgtcgaaccaggacaggaacaagcgtgtaacttggtagatgtgaaagttattaagcaattgggcggtaccgtggaagataccgagttgattgagggtatcgttttctctcagagatccgccaatgtatctggtccgaagagaatcgaaaaagccaagattggttttatacaattctgcatttctcctccgaaaaccgacatggaccacaatgttatcgtatccgattacgctgcgatggatcgagtgttgaaggaggaaagagcgtacattttgaacattgttaaacagattaagaaagccggctgtaacgtacttttggttcagaaatcgattctcagagatgccgtatccgatttggcccttcactttttggataaaataaagtgcatggttattaaggatgtcgaacgagaagacgtggagtttgtgtgcaaatcgttggcttgcagaccgatcgcttctctcgatcacttcaccgctgagaatttagtaactgcagatttagtcgaagaagttggactaggcggtaaccgaatggtgaaagtcacaggtattcaaaatggcggacgcacggtgaccctactagtgagaggctcgaataaattagtattagaggaggcggaacggtctctgcatgatgctctgtgcgtcatccgttgtctcgttcgtaagaaggcgctcatcgccggcggtggagcaccggaaatcgaggtggctcttaaactggctgctatggctaataa

SEQ ID NO: 2618 - DNA, 724 bp, Phyllotreta striolata
agggaattactgaaaccgtccgctagcgtagccctacacaagcacagcaatgctttggtggacgtgctaccgcccgaagcggactcctccattagcatgctacaagccgatgagaaaccggacgtacaatacagcgatatcggaggtatggatatgcaaaagcaggagattcgagaggccgtagaacttccgttgacccactttgagctgtacaaacaaatcggtatagaccctccgagaggtgtgctgatgtacggcccgcccggttgcggtaaaaccatgctcgcaaaagccgtagctcatcacaccacagcggctttcattcgagtggtcggttcggagttcgtgcaaaaatacctgggcgaggggcccaggatggtgcgagacgtgttccgcctggccaaggagaattccccagccatcatcttcatcgacgagatcgacgccatcgcgacgaagcgtttcgacgcccaaacgggcgccgatcgcgaggtgcagaggatcctgttggagctgttgaaccagatggacgggttcgatcagaccaccaacgtgaaggtgatcatggcgacgaatcgggcggatacgttggatccggctttgctgcgacccggtcgtttggataggaagatcgaatttccgttgcccgataggaggcagaagcggttgatattcagcactatcacgtccaaaatgaatctgtctgaagaggttgatttggagg

SEQ ID NO: 2619 - DNA, 365 bp, Phyllotreta striolata
cggtgaccataaaaaccatgctggaggacctgggcatggacgaggaagaggaggaggtcgtgcccttgcccaacgtaaactcagctatcctacggaaggtcatccaatgggccacataccacaaagacgacccgcccccgcccgaagacgacgacaacaaggagaagagaaccgacgacatatcctcgtgggacgcggactttctcaaagtcgaccaaggcactctgttcgaactgatcctagccgcgaactatctcgatatcaaaggcctgctcgacgtcacttgcaagaccgtggccaacatgataaagggcaaagcgccggaggaaatacggaaaacgtttaacatcaagaacgatttcacg

SEQ ID NO: 2620 - DNA, 705 bp, Phyllotreta striolata
tgtgtgataaggcgaaagaaatactgtccaaagaatcaaatgtgcaggaggtaaaatgtcctgtcaccgtttgcggagatgtacacggacagtttcacgatctgatggaattatttaggataggtggtcgaagtccagatacgaattacctttttatgggtgactatgtcgatcgtgggtattattccgtcgagactgttactcttttggtggctttgaaagtcaggtataaagaaagaattacgatcctgagaggaaaccatgaatcgagacaaatcactcaagtatatggattctacgacgagtgcctgcgaaaatacgggaacgcgaacgtttggaaattcttcaccgatttgtttgattacttgccgcttacagcgctcgtcgatagccagatattctgtttgcacggagggctcagtcccagcattgatactttggaccatattagagccttggatcgtttacaagaggtacctcacgaaggtccgatgtgcgatcttctctggtcggatcccgacgatcgcggaggttggggcatttctcctcgcggtgcgggttatacctttggacaagatatatcggaaacgttcaaccacagcaacggcttgacattggtctctcgggcccatcaactcgtcatggaggggtacaattggtgccatgacagaaacgttgtaacgatcttcagtgctccaaactact

SEQ ID NO: 2621 - DNA, 510 bp, Phyllotreta striolata
agctaaaatccaggacaaggaaggtatcccaccagaccaacaacgtttgatcttcgctggaaagcaactagaagatggtcgtactctttctgattacaacatacagaaagaatccacccttcacttggtacttagacttcgtggtggtatgcaaatcttcgttaaaacattaactggaaaaactatcactcttgaagttgaaccatctgataccattgaaaatgtcaaggctaaaatccaggacaaggagggaattcccccagaccaacaaagattgatcttcgccggaaaacaactggaagatggtcgcactctttctgattacaacatccagaaagaatctactcttcacttggttttgagacttcgtggtggaatgcagatctttgtaaaaactttaactggaaagaccatcaccttggaagtcgagccatccgacaccattgagaatgtaaaagctaaaatccaggacaaggaaggtatcccaccagaccagcagagattgatctt

SEQ ID NO: 2622 - DNA, 748 bp, Phyllotreta striolata
gaagcaactgaagtcctacatcgaagaaggcgtgcatccgaggatcatcatcaaagccgtgcggaaggcgacccagatttgcctggagaaaatcaacgccctcgccgttaaaatcaacaaagccaaccccgaggagtacaggtcgttgctggagaaatgcgccgcgacggcgatgagctcgaagttgatcaacaaacagaaatcgttcttctccaaaatggtggtcgatgccgtgctactgctcgacgaactcctgccgttgaacatgatcggcatcaagaaggtgcaaggcggcggtctggaggactccatgttagtcgccggagtggccttcaagaagaccttctcgtacgccgggttcgagatgcagcccaagatttacaaagactgcaagatcgccctgttgaatatagaattggaactgaaagcggagagagacaacgccgagatccgcctgagcagcgtcaaggagtaccaaaaagtcgtcgatgcggagtggaacattttgtacaacaaactccagaaaatttacgaatccggagcgaacgttgttctatcgaaattacccattggtgacgtcgccacgcaatacttcgccgacagagacatgttctgcgccggaagggtccaagaggaagacatgaagagaaccttgaaagcctgcggtggctccataatgaccacagtcaacgatttgaaagacgaagtgctaggtaactgccagctgttcgaagagaagcaaattgga

SEQ ID NO: 2623 - DNA, 672 bp, Phyllotreta striolata
gtcgctgaagatatcccattgctgttcagcttgttgaacgacgtgtttcccaacgtgcaatacaccagagccgaaatggaaggtcttaaggacgaaattagaaaagtgtgcacggaagaatacctcgtttgcggagaaggcgatgaaagaggttcggcttggatggaaaaagtattacaattataccaaatttcgaacctcaaccacggtctaatgatggtcggcccgagtggttcgggcaagagttcagcatggcgagttctgcttaaagccctcgaacgattcgaagggatagaaggcgtagcccatgtaatcgatccgaaagcgatcagcaaagagactttatacggtgtgttggatcccaataccagagaatggaccgatggtctgttcacccatattctaagaaaaattatagacaacgtgagaggtgaaattaacaaacgccaatggattatcttcgacggtgacgtcgatccagaatgggtggaaaacttgaactctgttctcgacgataacaaattgttgactcttcccaacggagaacgtctatccctaccgcctaacattagagtcatgtttgaggtacaagatctaaaatatgccacgttagctacagtgtcgcgttgtggtatggtgtggttctctgaagacgtactatccaccgaaatg

SEQ ID NO: 2624 - DNA, 662 bp, Phyllotreta striolata
caagttttcggagttcttcgacgacgcgccggtgtaccaaatcccgggccggaggtttcccgtggatatttactacacgaaagcccccgaagccgattacgtggacgcctgcgtcgtgtcgatactgcaaattcacgtcacccagccgttgggcgacattttggtgttcctgacgggtcaggacgaaatcgaaacctgccacgagctcctgcaggatcgcgtacgacgattgggttcgaaagtcaaagaactgattatactcccgttgtacgctaacttaccgagtgatatgcaagctaagatattcgagccgaccccgccgggagcgaggaaggtgattctagctacaaacatcgcggagacctcgctaacgatcgataatattatctacgttatcgatccgggtttcgccaagcagaaccacttcaattccagaaccggcatggagagtctgatggtcgtgcctatatctaaagcttcggctaaccagcgagctggaagggccggtagagtggcggccggtaagtgctttaggctgtacacggcctggtcctataagcacgagttagaggaatgtaccgttcccgagatacagaggatcaatttgggaaacgctgtgttgatgttgaaggcgttgggtattaacgatttggtgcatttcg

SEQ ID NO: 2625 - DNA, 687 bp, Phyllotreta striolata
gcgagctattggtcttagaattagagaaacaaaggaagtctacgaaggagaagttagcgaactgacacccgtcgaaacagaaaacccagcaggaggttatggtaaaactgttagccatgttgtaatcggtttgcgaacagccaagggcagcaagcaattgaaactagatcccagcatatacgaagccctgcaaaaggagaaggtggaagtgggagatgtcatttacattgaagctacaagtggagctgttaaaagacagggaaggtccgatgcttatgccacggaattcgatttggaagccgaggaatatgtacctcttccgaagggagatgtgcacaagaagaaggaagttgtacaggacgttactttgcacgatttggatgctgctaatgcgaaaccgcagggtggtcaagacgtgttatccatgatggggcaactgttgaaaccaaagaaaactgaaattacggataaactcaggaaagaaatcaataaaatcgttgacaaatacattgatcaaggtatcgcggaattggtacctggagttttattcatcgacgaagttcatatgttggatatagaaacattcacttatctccacagagctttggaaagcgctatagcacctattgttatttttgctactaatagaggtcgttgtctcattagaggaaccgatgatgtgttttc

SEQ ID NO: 2626 - DNA, 779 bp, Phyllotreta striolata
agggcgagagatgaaaaattaatgacaaatattctccagactttacgaaaccacgggaacgttctgatagctgtagacactgctggtagagtgctggaattggctcacatgttagatcaactgtggagaaacaaggaatcaggacttttggcttattcattggcttttttgaacaatgtcagttataatgtagtcgaatttgccaagtcacaaatagaatggatgagcgataatctaatgagaagttttgaaggagccagaaataatccattccagttcaaatatttgcagctatgccacagtttgggggaactaagcaaagtacccagtccgaaagtggtgctggccagttcgccagatttggagagtggattttcaagggaattgttcttgcagtggtgttctaatccaaataacagtattatattaactacaaggacctcacctggaactttagccagggatttaattgacaacggaggaggaagaaacatagacttgatagtagagcgaagggttaaattagaaggagcagaacttgatgattatgaaaggcgtcaacgatctaaatatgacaaattagaagatgaggaggccgattctgattcagattccgatattgaaatgtcagtcacctctaaaggcaaacatgacattgttatcaaacaagaaggcaaaatatcaacaggattttttaaagtcaccaaaaagatgtaccccatgtatcctttcaaggaagataaaataaagtccgatgaatacggcgaaattgtaaaagc

SEQ ID NO: 2627 - DNA, 667 bp, Phyllotreta striolata
cttggaggagcagatacatcagatacataaagtgaaaggtctccttcccgacgaagagaaggagaagatcggtccgaagaatatcggttcgaagaagattaacatccaaagcgttatcactacgaaaccgccgaatccctctacgcagcaatccaaacagtcgatttcgatgatgcaaacgagcgcccagccgatcatgccggttccggcgcaaccgacgatgatggcgccgcaaccgtccattatgatgatgccggcccctccgatgcccgccatacgaccgccgccgctcatgatggccggtggtgtggcgatgggcggctatccggtgggaccgatgcccggcgggccgccgggtcccggcatgaacatggcccccatgaagcatcccagcgacgggcccagcgaggacgagccgagcaacaagaaattgagaaacgaggattcgttggtgccggagaacgtgtttttgtccagaaatccgagtcaagtgtctatcaaaatttcggtgcctctgatgccggagaaatcggaatggaggctgaagggccaaatggtatcgtggacgttggcgttgacggagtcggtggtgaatctgaaggccaaaatccaggaggaaacgaacatgccgccggccaaacagaagttattcttcgacgggatgttc

SEQ ID NO: 2628 - DNA, 757 bp, Phyllotreta striolata
aaaggagtcttggatgtgtctaacagttttgcagtcccttttgatgaggacgacaaagataaatctgtatggttcttggaccacgactacttggaaaacatgtacggcatgtttaagaaagtcaacgctagagaacgcgtcgttggttggtaccacactggtcctaaattgcaccaaaatgacatcgctattaacgaattaattcgaagatactgccctaattccgtgttggtgattatcgatgcgaaacctaaagatctggggcttcctactgaagcgtaccaagcggtcgaagaagtccacgatgatggctctcccacgtccaaaacatttgaacacgttccgagcgaaataggcgcagaagaagccgaggaagtcggcgtagaacatttattaagagatatcaaagacactacagtgggcactttatctcagaggatcaccaatcagttattaggcctgaaagggttgcatttgcaattgagagacataagagactatttgatgcaagtgggcgataccaaactgcccattaatcatcagatcatctatcaattgcaagacattttcaatttgctgcccgatataaaccaagatgcattcaacaattcgttttatgttaaaaacaacgatcaaatgcttgtagtttatttagcagctctcgttcgatctatcgtcgcattgcacaatctaatcaacaacaaactcaccaacagagacgcagaagaaggcaaaaaggaagagaagaaggacaagg

SEQ ID NO: 2629 - DNA, 652 bp, Phyllotreta striolata
aatatcgctttagatgcggtaaataccgttctattagaagaaaatggccgaactgaggtggatatcaagagatacgccaaagtggaaaagattcccggtggttcggtggaggaatcgaggattttgagaggagtcatgttgaacaaagacgttacccatcctaaaatgaagcgacacattaagaatccgagaatcatccttttggactgcgctttggaatacaagaagggagaatctcaaaccaacgttgaaattagtaccgaaactgattttaccaaactcctcgaattggaagaagagcacgtgaagcgccaatgcgacgagatcatcgccctcaagccggacgtcgtgttcaccgaaaagggagtatccgatatagcccagcacttcctgctgaaggccggcatcaccgccatcaggcgtgtgagaaagtccgacaacaaccgaatcgccagagcttgcggcgccgtcatcgtcaacagaaccgaggaactccaagagtccgacgtgggcaccggggctggtgtgttcgaaatcaaaaaattcggcgacgagtacttctgtttcgtcgacgaatgcaaaaatccaaaggcctgtacgatcctcctgcgaggagccagcaaggatatcctgaacgaaatcgaaaggaacc

SEQ ID NO: 2630 - DNA, 563 bp, Phyllotreta striolata
cagattaatccgtacgctgataatggagggagcgtagtagcaattgcaggaaaagatttcgtggttattggtgccgacacgcgtctcagttccggcttttccatttacactagaaaccagaacaagctgtttcctctttctgagacaaccgttttaggatgttcgggctgttggtgcgatactttaacgttgactcgcattttaaagtctcgcatgcaaatgtaccatcaagagcacaacaagaacatgtctacaacggcggctgctcaaatgctttccaccatgttgtactacaagcgatttttcccttattacatatcgaacattctcgttggattggataacgagggaaaaggttgcgtgtacagctacgatcctgtaggacattgcgaaaaagccacttacagagcaggcggttctgcaggggctttgcttcaacccttattggacaatcaaatcgggcagaagaatctacagaagccttcacaagaagatcttactcaggaaaaagccctttctacactgaaagatgttttcatatccgccgcagaaagggatattta

SEQ ID NO: 2631 - DNA, 656 bp, Phyllotreta striolata
aaatgttactcagtggccatgtttccggggaacgaaagacaggacgtcgaacgtggaggaaaaataatcatgccaccctctgcactggaacagctcactcgattaaacatcaactaccccatgttatttaaactagtcaataagaagacgagtcgcacgactcattgcggcgtgttggaattcgtggcggacgaaggaaaggtctaccttccgttatggatgatgcacaatttggtactaaccgaaggcgatttggttcaaatggaaagcgtctcgttgccggtgggcaccttttccaaattccaaccgttaaacccggacttcctcgacataaccaacccgaaggccgtgctggagaattgcctgcggtcctttgcttgtctgacgaccggcgacgtgatagccgtgcgatacaatcaaaaggcgtacgaattgtgcgtgctggaaacgaaacccggcaacgccatcagtataatcgaatgcgatatgaacgtggaattcgccgctcccgtgggctacaaggaacccgagcatgcgaagaaagaagaggaaatgtcggtggatcccgccgacttgatgccggaaccgtcgggattcgtggcttttagaggggccggtaaccgattggacgggaaaaaacgcaaagattcttcgtc

SEQ ID NO: 2632 - DNA, 707 bp, Phyllotreta striolata
accactttaggctcgaaaataattaacaagtgtcacaggcaaatggccgaaatcgccgtcaatggcgtattagctgtggcggatcttgaacaaaaggatgtcaactttgaactcattaaagtagaaggaaaggttggtggtaaattggaagacacgacattagtgaaaggtgtcgttatagataaaacaatgtctcatcctcaaatgccgaaggaacttaagaatgttaaattggcaatcctcacctgcccgtttgaacctcccaaacccaagaccaagcataagttggatgtcaccagcgtagaagactacaaagaactaagattgtacgaacaagaaaaattcaaggaaattgttggcttagtcaaaaaagctggagctaccttggccatttgccaatggggattcgacgatgaagctaaccatttgctgttgcagcaggagttgcctgctatacgatgggttggtggtccagaaatagagctgatagccatcgcaaccggaggaagaatagttccacgattcgaggaacttagccctgaaaaactcggctctgccggtttggtgcgcgagatatcgtttggaactaccaaagataagatgatggtgattgaagaatgctcgaattcccgtgccgttaccattcttgtcagaggcggtaatcaaatgttggttgatgaagctaagaggagtttacacgatgcttt

SEQ ID NO: 2633 - DNA, 202 bp, Phyllotreta striolata
aaaagtggaatgctgtagctctttgggcttgggatattgttgttgataactgcgctatatgtcgaaaccacataatggacttgtgcattgagtgccaggcaaatcaggcctctgcaactagtgaggaatgcactgtagcttggggagtatgcaaccacgcatttcactttcactgtatttcaagatggttaaaaactaggca

SEQ ID NO: 2634 - DNA, 771 bp, Phyllotreta striolata
gccaacttagaaacgttcagagaagatctgatgaacatcgcccgaaccacattgagctcgaaaattctatctcaacacaaagagcactttgcgaagctcgcagtcgacgccgtgctgagattgaagggatccggcgatttgcaagccattcaactgatcaaaaaaaccggcggtacgttgcaggattcgttcctcgacgaaggattcctgctggacaagaaacccggcgtgcaccagcccaagcgagtcgagaacgctaaaatcctgatcgccaacaccccgatggacacagataaaatcaaagtgtttggctcgcacatcaaagtcgactcgatggccaaaatcgccgaattggagtccgccgagaaggataaaatgaaagacaaagtcaacaagatcctcaagcacaacgccaacgtgttcatcaaccggcaactcatctacaactacccggaacagttgttcgccgatgccggcgtgatggccattgaacacgccgatttcgatggcatcgaaagactggcgctggtcaccggaggagaaatagtctcgacgttcgatcacccggagctcgtcaaactgggaacttgcgacgtgattgaacaaatgatgataggagaagatacgctgctgcgtttcagcggagtagctttgggggaggcttgcacgatagtcattcgaggggccacccagcagatcatcgacgaagcggatcgctccctgcacgacgctctttgcgtactagccgcaacggtgaaagaaagcagaatc

SEQ ID NO: 2635 - DNA, 668 bp, Phyllotreta striolata
ccagtcacgccgttataatagcgttgaaaagggcctcgtccgaactgtccgcctatcagaagaagatcatccagatcgacgatcacatcggcatcaccatctccggtttgacggcggacgcgagaatactgagcagatatatgaggaacgaatgtttgaattacaagtactcgatggattcgtacatgcctttgaacaggctgatcaacatcttaggcataaaaatgcaacattgcacccaacgctacgaccgtagaccgttcggcgtcggtctactcgtcgccggctacgacgacgacaccggcgcccacgtctaccagacctgtccctcggcgaatttctacgattgcaaggccatgtcgatcggcgcgcgatcgcaaagcgcccgaacctacttggagaaaaagctcgacgagctgccctccatggctttggaggatctcatcaagcacggcttgagagctttgagagatactctcccacccgaagtggatttgaccacgaaaaacgtttcgatcggttacgtgggaaaagggacgagcttcaagatattggaggaggaggagacggcgccgtttttggcgttgatcgaaggggaggaacgtagagggggtagcggtggtggtgggggtgctgtggagggggcggctgatcctttgagggaatcg

SEQ ID NO: 2636 - DNA, 687 bp, Phyllotreta striolata
ttaccgggttcgtacaaattgtggtacaattacctgcggaccaggaggaatcaaattaaaagcaaatgcatcaccgatccgggtttcgaagaggtaaacaacgccttcgagcgttcgttggtgttcatgcacaagatgccccgaatttggatggattattgcaccttcctcaccgaccagtgtaaaataacgagaacccgaaaggtcttcgacagggcccttcgagccttacccgttacgcagcacaacagaatatggcctttgtatttgaagttcgtacagaaacacgatatatccgaaactgccgttcgagttttcagaaggtacatgaaattgtgtccggaaaacgccgaagagtacatcgattacttagcgtcggtggaacgattagacgaagccgctataatcacggctaaaatagtaaacgacgataacttcgtgtcgcaacagggcaaatcgaagcaccaactttggaacgagctctgcgagttgatctccaaaaatccggaaaaagtccgctcgctaaacgtcgacgccatcatcagaggcggcctgcgccggtacaccgaccaattgggccacctgtggaactccttggccaattactacgttcgcagcggtttattcgagcgggctagggacatctacgaagaggccattcaaaccgttacgaccgtcagagatttc

SEQ ID NO: 2637 - DNA, 773 bp, Phyllotreta striolata
taagagtcaacaaggcttccgctcaccaaaagaacttggacgtcggcgcgaacattttcatagggaacttggatccagaagtcgatgagaaactcttgtacgatacgttttcggccttcggtgtaatattacaaacgcccaagataatgagagatccggagactggaaattccaaaggtttcgcgttcataaacttcgccagtttcgaagcctccgatgcctccatcgaggcgatgaacggccagtacctttgcaatcgaccgatatccgtctcttacgcgttcaagaaggattccaagggcgagagacacggctcggcggccgagcgattattggccgcccagaatccattatcgcaggccgacaggccccatcagttgttcgcagacgccccaccgataggaatgatgccgatgagcatggcgccgccacctccgcctctaatcaccggcatgatgcctcccccaccgcctacgccgggcggaatgccgccgcctcctccgccggttccgccgccgagttccttccccgcgggcatcccgccgccgccgttaccgccctctcaaccgccgctgccgccgggcgcgccgcccgcgatggcgccggtgccgggcggcgccgccagaccgccgccgccgcctccgtgggccggtgcggcggccaacgtgccgatgccgccgggaccgcctgcggcgaacgcgggcggcggcttcgggggaatgctgccgcctccgccgccgcccggcgggaggcctttaccgcctaattggaga

SEQ ID NO: 2638 - DNA, 664 bp, Phyllotreta striolata
cacactaagaggaggaaaggggcacccaagctccgttacttagatttctccgaaaggcatgggtacatcaagggtgtcgtgaaagacatcatccacgaccccggtcgtggcgcccccttggctctggtgcacttcagggacccctacaagttccaaactaggaaggaaatattcattgctcccgagggaatgtacacagggcaatttttgtactgtggaaagaaagctaacctccaaattggaaatgtgttgcctgtaggaactatgcccgaaggtacaatcgtctgtaatttggaagaaaaaactggtgaccgtggccgattggctcgagcttccggtaactacgccaccgtgattgcccacaatcacgacacaaagaaaactagggttaaattgccatcgggagccaagaaagttatcccgagcaacaacagagctatggtcggtatcgttgccggaggtggtcgtatcgacaagcccatcctgaaggccggtcgcgcctaccacaagtacaaggtgaagcgtaactgctggccgaaggtgcgtggtgttgccatgaaccccgtcgagcatcctcacggaggtggtaaccatcaacacattggtaaggcctccaccgttaagagaggaacgtccgctggtcgtaaggtcggtcttattgctg

SEQ ID NO: 2639 - DNA, 262 bp, Phyllotreta striolata
taaacaactggccaccaaagccgcgaggaaatccgccccatcgaccggaggtgtgaaaaaaccccatcgttaccgtcccggtacagtcgccctgagagaaatcaggagataccagaaatccaccgaattgctcatcagaaaactgcctttccaacgattagtcagagaaatcgcccaggacttcaagacagatctccgtttccagtctgcggctatcggtgctctacaagaagcgagcgaagcatacttggtgggtctgttc

SEQ ID NO: 2640 - DNA, 775 bp, Phyllotreta striolata
caacaaggaatcgttaaccgacgtttgtcgaacgagcttaagaacgaaactgcaccaaaatttggctgacttactgaccgacgtgtgcgtcgaggccatcctcgccatcaagcaatcggacaagccggtcgatttgcacatggtggagctgatggagatgcagcacaagaccgaaaccgatacgcaactggtcaaagggctggtgctcgaccacggcgcccgccatcccgacatgcccaagagcctgcggaactgctacattctcacctgcaacgtcagcatggagtacgagaagagcgaagtcaattcgggcttcttctacaaaaccgccgaggaaagggagaagctcgtgctggccgagcgcgatttcatcgagcagcgcgtcaagaaggtgatcgaattgaagaagaccctttgcaagggcaacgacaagtcgtttgtcgtgataaaccagaagggtatcgatcccatgagcttggacatgctggccaaagagggcatcgtggccctgcgaagggccaagaggcgtaacatggaacgattggctctggcctgcggtggaatagccgtgaacagtttcgatgatttacaagaatctcatctcggttacgccgggcacgtgtacgagcacgtattgggcgagaacaaatacacgttcgtcgaggactgcaaagtgccccaatcggtgacgattctaatgaagggccccaacaagcacactctgttgcagatcaaagacgccgtcagagacggtttaagggctatcaataacgcc

SEQ ID NO: 2641 - DNA, 781 bp, Phyllotreta striolata
tcaaaatcaaagtgttgggcccgtacacgttcagcatcggcgacaccaccaaattctccaagtacgtccgaggcggtatcgtaacgcaagtgaagatgcccaaggaggtgcacttcaagccgctgaaggagtcgctgcagaatcccgaattcgtggtgaccgatttcgccaagttcgatcaccccatccaattgcacctcgccttctccacgctgcacaagttcgtggagaagaccggccggttgccgaagccctggaacaaggacgacgccgccgagtttatcgccttggcgaaatccttggcggtgaacggttccaccgacaacgaggtcaacaccgatatactcaacgttttctccaagtgttgctcgggcgatttgaatcccatcaacgccacgatcggaggcatcgtggcgcaggaggtcatgaaagcctgctcggggaagttctatcccatctaccaatggttgtatttcgatgccatcgaatgcctgccccaagacaaggacgagatcacagaggaactggccgctcccgttgatagtcgatacgacggacagatcgctgtgttcggtaaagatttccagaagcgattaggtgaattgaaatatttcattgtgggcgccggagcgatcggttgcgaattattgaagaacttcgccatgatgggattgggaacgcaaggcggtcaaatcaccgtaaccgatatggatttgatcgaaaagtcgaatttaaacaggcaatttttattcagaccccacaacgttcaacaacccaaatc

SEQ ID NO: 2642 - DNA, 660 bp, Phyllotreta striolata
cgtttcagcaagtacatgtccaacatcaaggtcggcgtgttcttcgggggcctgcccatccaaaaagacgaagaagtattaaaaaacagctgtccgcacatcgtcgtcggaacgcccggccgcatcttggccctcgtcagatcgaagaaactcaatctcaagcacatcaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaggcgaaattgacgttacacggtctacaacaacattatgttaagcttaaagagaacgaaaagaataaaaaattatttgagttacttgatgtgttggagtttaatcaggtggtgatatttgtaaaatccgtgcagagatgtgtagcgttggcgcaacttttgacggaacaaaatttcccagcaattggaatacaccgaggaatggagcaaaaagaacgattatccagatacgaacaattcaaagattttcaaaagagaatattggtagccactaatcttttcggtcgtggtatggatatcgag

SEQ ID NO: 2643 - DNA, 772 bp, Phyllotreta striolata
ccagaaggaaactaaacggaacagtcctcagaagccttatcaatcaaatgtaccccgtcgccgaaagggacgtgctgttcggcctcagcgaggaatctaccagtgacgtagacgctacacagtcgagggccagatcagccactaaaacgcctcttcccgaagtagatgcttacattcacttactacttttagttcgactgatcgataccaataaactagctgaagccgagcggtgttcgaacataatcatgaacaaaatcaccagccagaaccgacgaaccatcgaccacatagcagctaaatgttacttctaccattcgagagtggccgagctcaccgacaagctcgattctatccggagtttcctccactcccgtctacgaacagccaccctgcgaaacgacttcgaaggccaagccgtgctgattaactgcttgctgaggaattacctgcactactcgctgtacgatcaagccgataaattggtgaacaaatgcgtctatcccgaaacggccagtaacaacgaatgggcgaggtatttgtactacttgggccggatcaaagccgcccggttggagtacagcgttgcgcacaaacacctaattcaagcgatgagaaaagcgcctcaaaacgctgcgatgggttttcgtcaaacggtgcagaaactgaccatcgttgtggagttactgctgggggatataccagaaaggcaggtcttcaggcaggccaatatgaggcactcattggctccttacttccaattaacccaggc

SEQ ID NO: 2644 - DNA, 712 bp, Phyllotreta striolata
caagacggttatcgaggaattccagaaagtggaggaagccaaacggcaactgaaatcggataaattgaatgcgaacgaggagtccgacgacgaagaaaaagacgaggacaaatacgtggatgaagtggacatgcccggaacgaaagtagacagcaaacaaagaataacggtcaggaatttgcgtatacgagaagatacggctaaatacctgagaaatttggatcctaactcggcgtactacgaccccaaaaccagatcgatgagggaagatccgaatcccggaaacgacgccacataccacggggagaattttgttcggttttccggagacactacgaaccacgcgagagctcagctgtttgcatgggaagcgcacggtaaaggagtagacgttcatttgctcgcagaacccacgaaattggaattgttgaagaaagaatacgagaaaaagaaagacgaggttaagtcgaacattcagggaacggttttagagaaatatggaggtgaggagtacctcgaagcgcctccgaagagtttactgttggctcaaaccgaaaactacgttgaatattcgagatcgggtaaagttattaaaggcgctgaaaaagaagttattagatcgaaatacgaagaagatgtgtatattaataatcatacgtctgtatggggttcttattggcgcggaggacaatggggttatcgatgttgctat

SEQ ID NO: 2645 - DNA, 480 bp, Phyllotreta striolata
cgtaagaagaggaagttcgaattaggtcgcccggcggctaacaccaaactaggaaccagaaggatccactatgttcgtacaaggggtggcaacttgaagtaccgcgccctaagattagacaccggaaacttctcttggggaagcgaaggaactgcccgtcaaacgcgtattatcgatgtcgtttacaacgctagtaataacgaattggtccgtaccaagacattggtaaagaatgctattgttgtcgttgacgctaccccgttcaggcaatggtacgaaaaccactacatcttaccattgggacgcaagaagggtgccaaaatgacgcccgaagaggaggagatattcaataagaaacgtagcaaaaaagtacagaagaagtacgaaactaggcaaaaaaccgctaaagtagagcctgcgattgaagaacagttccacactggaagattgttggcatgcctagcatctagacctggacaa

SEQ ID NO: 2646 - DNA, 651 bp, Phyllotreta striolata
ctgtgagagtcatagacgtgttcgctatgccccagacgggtaccggagtgagcgtagaagctgtggatcccgtattccaagcgaaaatgttagatatgctacgacagaccgggcgaccagaaatggttgtcggttggtaccattcccatccgggtttcggctgttggttgtcgggcgtcgacataaacacccaacagagcttcgaggcgctctccgagagggcggtagccgtagtcgtagatccgattcaatccgttaaaggaaaggtcgtcatcgatgcctttaggttaatcaatcccaatatgatggtattgggacaggaaccccgtcagacgacctcgaatttggggcatttgcagaaaccgtccgtgcaggcgctgattcacggtttaaatcgccactactactccataagcatcaattacaggaagaacgagctggagcagaagatgctgctcaatttgcacaagaaatcgtggatggacggtttgactctggcggattattcggagaattgcagcgtgaacgagaagaccgtggccgatatgctggaactggccaagaattacaacaaggccttggaggaagaggagaaaatgactccggaacaactcgctatcaagaacgtgggtaaacaagatcccaagaggc

SEQ ID NO: 2647 - DNA, 708 bp, Phyllotreta striolata
tttggtgtcccttatgatggtcgaaaaagtaccggattccacttacgaaatggtcggcggtctggataagcaaatcaaagagatcaaagaggtgattgaattgcccgtgaagcatcccgagctgttcgatgccttgggcatcgcccagcccaagggcgtgttgttgtacgggccgccgggaaccggtaaaactcttctggccagagccgtggctcaccacacggaatgtacctttatcagagtatcgggttcggagttggtgcaaaaattcatcggtgaaggttctcgaatggtcagagaactgttcgtgatggccagagagcacgccccgtcgatcattttcatggatgaaatcgattctatcggatcctcgcgaatcgaatcaggttccggtggcgactcggaggttcaaaggactatgttggagttgctgaaccagctcgacgggttcgaggccacgaagaacattaaggtgataatggcaacgaacagaatcgacattttggatccggctttgctgaggcccggcagaatcgacaggaaaatcgagttcccgccaccgaacgaggaagctcgattggacatcctgaagattcactcgaggaaaatgaatttgaccagagggattaatttgaggaagatcgcggaattgatgccgggcgctagcggtgcagaagtgaagggagtgtgtactgaggctggtatgta

SEQ ID NO: 2648 - DNA, 460 bp, Phyllotreta striolata
tgaagtccgctttcgatttacaaagtttcagttttttccaaagagggtctgtacaggagtttatgtcattcttttgtaagactattgtggaaaggaccataccatcatcgagacaatccgtcaaagaaggagaatacatgtgtcatgtttatgtaagacatgataacttagctggtgttgtaatatcagaccacgaatatccctccagggtatcgcatacgctgattacgaaaattttggacgaattcgctgctaaaatacccgctgtgaattggcctaccttgcaggagagagatgtcacgtttccacagctaaacacttaccttaccaaataccagaaccccaaggaagccgatgcaatgactaaaatacaggaggaccttgacgaaaccaagattattctgcataacacgattcaagcagtcctggaaagaggcgagaaactggacgacttggtaaa

SEQ ID NO: 2649 - DNA, 581 bp, Phyllotreta striolata
aattgggatccacagctatcggaatatgcacgagcgaaggggtcgtgctagcagtcgaaaagcgtattacttctcctttaatggagcctacaacgattgaaaagatcgtagaagtagacaaacacatcggctgtgctgtttcggggctcatggcagattcacgcacgatgatcgatagggcaagagtagaatgccaaaatcattggttcgtttacaatgaaaacatcaccatcgaatcgtgcgctcagggagtatcgaacctagctattcaattcggagattccgatgatgatggtgctgctatgtcgaggccattcggtgtggcaatcttgtttgctggcatcgacgaaaaagggcctcaactttaccacatggatccttcaggtacatttgttcagttcgatgcgaaagctataggatccggttcagagggggcgcagcagagcttgcaggaagtgtaccatcgtagcatgactctagaggaggctaccacagcggcattgaccattctcaagcaggtcatggaggagaaattgaactcttccaatgtagaagtcatgacaatgacgccaaaggatttg

SEQ ID NO: 2650 - DNA, 665 bp, Phyllotreta striolata
atgatttgggaaagctggatggattcgtggagcaggttacccggaaggtggcccagtacctcggagaggttctcgaggaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggtcaaatcgatgccgatcttaagaccaagtcctcggcctacaataatttaaaaggcagtcttcaaaacttggagaaaaaacaaacagggagtttgctaacccgtaacttggcagatctggtcaagaaggaacactttattttagattccgagtacttgcaaacgctgctcgtcatcgttcccaaggctcagttcaacgagtggaacgccacttacgagaaaatcacggacatgatcgtccctcgatcgtcggagctgatcatccaagacggcgactacggcctgttcaccgtgtcgctcttcaagaaggtcgtcgaggagttcaagctgcacgccagagagaagaagttcatcgtgcgagatttcacgtacaacgaggaggaattggcggccggcaaaaacgaaatcaccaagctcgttaccgacaagaagaagcaatacggt

SEQ ID NO: 2651 - DNA, 693 bp, Phyllotreta striolata
ctatacccgtggaggaattgggcaaggaatccatcgtgaacgtcgccaagacatcgatgagctccaaaatcataggagctgacgcggatttcttctcgcaaatggttgtcgacgcggcgaccgccgtcaaagtgacggacgccaaaggcaactcgatgtaccccattaaggcggtgaacgtgttaaaagcgcacggcaaaagcgcccgcgagagcttcctggtggccggatacgccttgaactgcaccgtcgccagccaggccatgcccaagaggatcgtcaacgccaaaatcgcctgtctggatttctcgctgcaaaaggccaaaatgaagatgggcgtgcaagtgctgatcaccgatccgggtcaattggagggcgtgcgcgcccgcgagctcgacatcaccaaggagcgcatccagaagatcctcgccaccggcgtcaacgtggtgctgctctccggcggcatcgacgacgtctgtctgaagtacttcgtcgaacgcggcgccatggccgtgcgtcgcgtcaagaaggccgatctgaagcgcatcgccaaggcgacgggggcgtcgttcgtgacgtcgttgagcaacatggagggcgacgagacgttcgacgccaatatggtgggcgaggcggcggaggtggtgcaggagaggatatccgacgatgagttgatcgttatcaaaggtccga

SEQ ID NO: 2652 - DNA, 628 bp, Phyllotreta striolata
ggggctttctataacttcccaggaacagtagcacctgtaactaatccaataactcatactcagtctccagtaacgacttcaacttcaattgtgtctataacctacgataagggggtactaattgccggagacttgctggcctcctacgggtcattagccagatataaaaattgccctagggtgatcgaaattaacccgaacatcatcatgggtgctggaggagattacgctgattttcaatacgtaaaaagcttcattgagcagaaaataatcgatgaggactgcttagatgatggtttgaaaatgaaaccaaaatctctttattgctggctgactagaattatgtaccaacgaaggagtaaactcgaccccttctggaacaacctagtagtaggagggatacaggatggtgtacctttcctgggaacagtcgataaactcggcactgcttacacagataaagtaatctgtactgggtatggtgctcatattgcccttcccgtcttgagagatgccctcgacaagaaaccgaacttgaatctaaacgaagctaagcaactcattaaaaagtgcatggaagttttgttctacagagacgcgagaagttacccgaaatatcagttgggaa

SEQ ID NO: 2653 - DNA, 734 bp, Phyllotreta striolata
aaattgaacccaccgaaaacaccgccttaaaaatagttcacgtttatttatttacagatagttttatgataactacaagaaattcaaacagtcgaggtctcatgaaatacatctatgaaagtatatatgacctaagcagcctagcagttgtaaacgtaagagatttgggaaacgtcaaacacgcctttaagcttctcattttccccgataccagagtgttccaatgctcttcaaactccaataaaaaagagtggctagacaagttcgatcaagccaagaagaccaggctggctcaagaacagcaaaaaagagaatccatatcggaaaaatctcccacccgtgtatccttcgagtcacctagctacaatcctttcgatgaagtggaagaagaaacgagcgccttgcatccggaatggttcctggagattcccgaagagctggacgtttgtgtagcccaaaggcatttcgaggaggctctgtctctattgcaaaaagccaaagaatacttgaatcaagcatcatccgcgtccggtgacaagcgggacaccgttttcacggatattcaaaggaaagtagagcaaagacagaacaatttaactgaggtgttaatgaaggaattggaagtaaacccggacaaatcgttgcaggggggattgagagcggctcgcagggctgtgagactgctgaatcaattaggaagagaaacacagtcttgtacgttgtttctgaagctg

SEQ ID NO: 2654 - DNA, 696 bp, Phyllotreta striolata
tcgatacagcttgcgaaatattgtacgaaagaatgaaaagtttaggtcccgatgtacccgaactgatcattctacccgtatactccgctctgccgtcggagatgcaaactagaatattcgaaccggcgcctcctggcagcaggaaagttgtaattgccacgaacatcgcagagacttcgttaacaatcgatgggatttattacgtggtcgatccgggattcgtcaagcaaaaagtttacaattccaagaccggaatggattcattagtggttacgccaatttcgcaggcgcaagcgaaacaacgagcaggccgagcgggcaggaccggtcctggtaaatgttacagactttacacagagagagcgtacagggacgaaatgcttccgacgccggtgcccgaaatccagcgaactaatttggcaacgacagtacttcaactgaaaactatgggtataaatgatttgctgcatttcgattttatggacgcccctccggtggaatcgctcataatggcactcgagcagttgcattctctatcagctttagatgatgaaggtttattaaccagactaggaagaagaatggctgaattcccgctggagccgaatttgtgcaagatgttgatcatgtcggtagccctccaatgctccgacgaaatattgactatagtgagcatgttgtctgttcaaaacgtgt

SEQ ID NO: 2655 - DNA, 702 bp, Phyllotreta striolata
aggaaccgaacctctatgtagagtagttagaattaatcactcaggaaaaattttagctactgggggaactgatggggatgtaagactttggaaatttcccacaatgcagccaatgtcgattctaaagggacatacaaaggaaatagacgatatagatttcagtaaattcgataacctcatcataactttagctaaagacggtttggctattttgtgggacgcccaaacgggaaagcagaaatcgaaactgacatggaaaactccagagggatcaaaatatttgtacaagagatgcagatttggcgttattgaagatcaaaaaaacaagtgcatgctatacatgatagcgaatgcgactaattcgaagcaagcatcgtttcttcaacaatggatacccgaggagaatactttaaaaaagttctcggaatttaatgaaaccctgtctgcacttgcagtgagagacgatgggcgatttgtagctgtcgggacaatgttcagcggttccgtttccattcacatagcctttagtttacagaaattattagtagttgtcggtgctcactcgatgtttgtaactggtctggaattcctatctcacgaaaatactaatcattccataagtagtgttgctgagactgctgtgttgtctatttcggtggataatcagctttgtatacattcagtgccatacagacgaagtat

SEQ ID NO: 2656 - DNA, 754 bp, Phyllotreta striolata
ttcgataccggaatgtacaccgatgccctacaactggaatccaccctgttaaaagagctgaagaaactggacgacaaaaatctgctggtcgaagtgcaactgctcgaaagcaaaacatatcacgctctcagcaatttacccaaagctcgagccgctctaacgtccgctagaacgaccgctaacgctatttattgccctccgaagatgcaggccgccctcgatctgcaatcgggcgtgctgcacgcagccgacgaaaaggatttcaagacagcttactcctatttttacgaagccttcgaagggttcgatagcgtcgaatcccccaaagctctgactgctcttaagtacatgcttctgtccaaaattatgattaatagtcccgaagacgtacagcaaattgtgagtggaaaattagccataaagtatgcaggtaaagatatcgaggccatgaaagcagtcgcacaagcagcccataaaagatctcttgcagattttcaacttgccgtaaaacaattcaaacatgagctggaagatgacgttatcgtacgagcacatttaggaaccctctacgacaatatgttagaacaaaatttgtgcagaatcattgaaccttactcgcgtgtccaagtagaatatatagcaaaaacgattaagcttcctgttttacaagtagagaagaaactatcgcagatgattttagatgccaagtttcatggaattttagaccagggtgatggtgtcctgatagtgtttg

SEQ ID NO: 2657 - DNA, 798 bp, Phyllotreta striolata
agtagaggtcgagaatcacaatcagagtcttagggaagagctaaccttcaaagatcagattcaccagcaagagctcaccgagacccgtacgcgccgacaggtcgagatcagcgaaatcgacggccgcctggcgcagaagtacgaggccaagctgcaggaggcgctccaggacctgcgcgaccagtacgaatcgcagatggccaacaatcgacaggagatcgagctgttgtacgagcagaaaatcaaaaacctgcaggcggccgccgacaggcaccaatcgaccgcctccggcgctctcgacgagctgagacaggtccggacgaggatcgacaccttcacgtcgcgcatccaagacctggagaaccagaacaacggcctgtcggctaggactagggatttggagaagttgctcgagaacgagcgcattcgtcatgccgaagatctggcgatggtcgagagggaattgcacaggatgcgagaggaaatggccacgcaactacaggaataccaagacctgatggatatcaaagtatcgctcgatttggaaatcgccgcctacaggaaacttctcgaagctgaagaagctcgattgaacatcacaccaacaggcgttgagcacgaggtgcaccagaggagttcctctcaacgtcggacgccggtgagggtgggagcgaagaggaaacgggccctgctcgaggagacgcaggagtcgagcatgtcggattacagcgtgaacagttcttcgaaaggggacatcgaagtggccgcagtcgatccggagggtcagtttgtgagatt

SEQ ID NO: 2658 - DNA, 725 bp, Phyllotreta striolata
ctgagaatccacaccaagaacatgaagttggccgacgacgtcgatttggagcaaatcgcggccgagactcacggtcacgtgggcgccgatttggcttcgctctgttcggaagcggcgcttcaacagatcagagaaaagatggacctaatcgatctcgaagacgatcaaatagacgcggaggtgctcaattcgttggccgtgaccatggagaacttccgttacgctatgacgaagagcagcccgagcgccctgcgcgaaaccgtggtcgaggtgccgaacgtcacatgggaagatatcggcggtttggcgaacgtcaagaaggaattgcaggagctggtgcaatatccggtggagcatcccgataagttcctcaagttcggcatgcagccgtctaggggtgtgctgttttacgggccgcccggttgcggtaaaaccctattggccaaggccatcgctaacgaatgtcaggcaaacttcatttccgtcaaaggaccggaattgttaacgatgtggttcggtgaatctgaagctaatgttagagacattttcgataaggccaggtcagcagctccttgtgtacttttcttcgatgagttagattcgatcgccaagtcaagaggtggaaatgtgggagatgccggcggtgccgccgatagggtgattaatcaaattttaaccgaaatggatggtatgggagcgaaaaagaacgttttcataatcggtgc

SEQ ID NO: 2659 - DNA, 650 bp, Phyllotreta striolata
atttagtgccaagtctttgtgaggatcttctttcgtctgtcgatcaacctttaaaaatcgctaaagacaaggattcgggcaaggattttcttttatgtgattacaatagagacggggattcttacaggtcaccatggtcgaatacctattaccctccgttagaagacggttcgatgccctccgagaggctaaggaaattagaattagacgccaatttagcgttcgatcaatatagagaaatgtatttcgaaggtggcgtgtcttctgtttatttttgggacttagatcacggttttgcaggagtaattttaattaaaaaaaccggcgatggtagtagaaaaattaaaggttgttgggattccctgcacgtagtggaggtacaagaaaagggttcaggaaggaattcccactacaaaatgacctccaccgcaatgctgtggctgcaaaccaataaacaaggctcgggtaccatgaatttgggcggtagtttaacccgacagatcgagctggatgcggccgtaaacgacatcaacccccacatcgccaacatcggtcgaatggtggaagacatggaaaacaaaattcggaacacgttaaacgaaatctactttagcaaaaccaaggacatagtcaatagcttgagatcggtg

SEQ ID NO: 2660 - DNA, 767 bp, Phyllotreta striolata
cgttgatatgccgatgaaaggcgccaaaggcaagaaagggcgagttagcgtcggcggtggaagcaccccatcgtcgagcggaccggtaccgggggcggcggctataccaggagctgtcagaggcagaccgcccgcgaccgtttcttctaccagtaccacgccaattgccaccactactggttcgtcgggcctgccgttgggtacccaagcgccggccacgctgccgggcagtaccgccacgacgacgatagcgccggccaacaacaacaacagctctctgacgccgcaacagctcgtcggcacgcccgtcggttcgatgcacggcacgcccggaggagcgccactgtccaattccctcgatcccggcggcgtgatgcccggcaacgtcatgccgccggcgcaaccggccaaggtaaaaaaaggcgtgaagagaaaggccgacacgacgacgccggcgacggcctacgactatccgacggtgttggaatcgaaatcggcgaagatttcgacgcgccgagaatcgggcaggcagatcaagaaaccggcgcggcgggaaatcgaccttcatgtacctcaaccggcgatccacaaacccaacgagaagttgtcggaatcgctgaaggcttgcaatgaaatcctcatggaattgttctccaagaaacattcgaattacgcatggccgttctatcaaccggtcgatgcggaattattgggcctgcacgactaccacgacatcatcaagagacccatggactttggtactgtca

SEQ ID NO: 2661 - DNA, 751 bp, Phyllotreta striolata
caatttcgttcatcagcaggtctccatgaaccatcgccagccctacagcgtcagcgacaaagctggtcaccaaacctccgccgagtcttggggaaccggtcgcgccgtggcccgtatacctcgtgtacgaggcggcggtacccaccgatcgggccagggagccttcggtaacatgtgtcgcggcggtcgcatgttcgccccgaccaagccgtggcgccgctggcatcgacgcgtcaacatcaaccagcgtcgctacgccctggcgtcggccgtcgccgccagcggcgtgcccgctttggtcatgagcaaggggcacgtggtcgatcagatacccgagttgccgttggtcgtcagcgacaaggtgcaggagatgcacaagaccaaggaggcggtgcaattcctgaggaggatcaaggcctgggccgacatccagaaggtctacaagagccaacggttccgtgccggtaaaggaaaaatgcgtaacaggagacgtatccaacgtaaagggccacttatcgtttactacaaagatcaaggtcttcgtcaagctttccgtaacatcccgggcatcgatctcatcagtgtccaaaagttgaacttgttgaagttggctcctggaggtcacgtgggtcgatttgtcatctggaccgaatcggcgttccaacgtttagacaaattattcggtacatggaagaacccatcgaccgagaagaagggttacaatttacctcaacccaagatgtccaatacc

SEQ ID NO: 2662 - DNA, 690 bp, Phyllotreta striolata
caagaatgtccactggaagaacgccatacgatatgagtaccgaagctattcaaagagtcgcgcaaaatctccccagcgacatggtccaagccctatcagctgcaaccaatcaaactcctcactacccgcacacccctggcggttacggtggtaattacatcaacacaccgtatacacctagcggtcaaacgccctacatgactccattccaaacgcctcacgctcaacagacgccgcggtacggccaacagacgccttcgcagccgtctctgagcaatccgttcctccatccgggcgccgtgacgccgtcgcaacggacgcccagctacaggaacctgccgacgcagagtccgatgataccgcagagcccggtgccgagcccgggatcgcagagctcgtacagcagccacatgagccaccatacgcgagcgagttacggggattcgttgaggttccagccgccggagtcgccgaggaattacccgagcagcaggggatcctaccccgatgggaggtacggtggtagcgagtcgatggattggcagaaggcagctgaagcttgggcttctaggtccaaatcgacaccacgaagcgaaggtcgcgggactcccagatcgtctggtcacagaactccacgtaattatgataatatgtccgaaagtgaccggtcgaggatgaagcatatgagca

SEQ ID NO: 2663 - DNA, 656 bp, Phyllotreta striolata
ttgtcgagactcctactgatgattccgtagaggtggcgatttcttttctgaaagagtgcggacagaagctcacagaagtctcgagtaaaggaataactgccatattcgagatgttgcgtaacatcctgcacgagggccagctcgagaaaagaatacagtacatgatcgaggtgatgttccaaattagaaaggacggttttaaagaccacgctgctgtaacagaggaattggatttggtagaagaagaggatcaattcacccatctaatcatgctcgatgatgttaaggaggttaatgctgaagatattctaaatgtgttcaagttcgatgaacattatgaagaaaacgaagggaaatacaaaactctgagcaaagaaatcttggggagcgacagcgagtcagattcgggatcggagggatctggagaggaatccgaaggcgaagacgaggaagaagaggtcaaagatgccggaaaaatcatcgacaatactgaaacaaatctaatagctctcagaaggacaatatatttgactatacaatccagtttggatttcgaggaatgcgctcacaagcttttgaaaatggagttgaaacccggccaagagatcgaattatgccacatgtttttagattgctgtgctgagcaaagaacatac

SEQ ID NO: 2664 - DNA, 742 bp, Phyllotreta striolata
agaggagcacacgtatttttcacagaagcatgcccagacgaattatttaacaaattaagtaagagtcatgcagcaaaatatataaaaacgttaaaagaaatcaacatagcatttattccgacagagtcacaggtattttctttagattcccctgacactttccaatgtagttacgatccttcctttgctgccgcacgaaacgcgaatatggaaagaatggccgaacagattgcaacgttgtgcgccactttgggggaatacccgcacgtccgatataggagcgattgggaacgtaacgtagagttggcgcaattgattcagcagaaattggacgcttacaaagccgacgagccgaccatgggcgaagggccggagaaagccagatcgcaattgctgatcttagatcgaggcttcgattgcgtttcaccgctactgcacgaactgacgtttcaagcgatggcctacgacttgcttccgatcgaaaacgacgtgtacaaatacgaagcttccgccggggtgcagaaggaggtgctcttggacgaaaacgacgagctgtgggtggaattgcgccatcaacacatcgccgtcgtgtctcaaagcgtcaccaagaatttgaaaaagttcaccgattccaaacgtatgacccaaagtgataaacaatccatgaaggatttgtccactatgatcaaaaagatgccgcaataccagaaggaattatcgaaatacgccactcacttacatc

SEQ ID NO: 2665 - DNA, 758 bp, Phyllotreta striolata
tcgaagagccatcaaaagaaacagattcaatccgggggctttcaagatcttaggagagatttacaagcagtaataggtacgagggcaaatattaacatagcacaaattgaaaattacggaggtgaaactttcgtatcggaggaattggctatcatgattcttcaggatactaaacaagcttttcaacgttgcttattgttgtcgaaaggcagtgaaagagcctctaacgccactcaaattttagacagacttattaatagtttgctaatagagcatgtagactatgcagttgaattgggtctacaagccgtaccagttgtcgaaggcgttagaaatccccctgttttgtatttttttaatgtcgtgcatcaaagcaataatataacccatctcgtcgagaaacagtttatggatttggtggttcccttagtagaaaatactccaaaatatagcgattgtgttcagaagaaaaaatttgttttggaggatatagaaagaaaaattaatacgggattagataggtgcttgagtgcgatattaaattgggtgaagttgtatttgcaatctgagcaaaagaaatccgattttaagccggagtctgatgattttgatacagtggcatcacctgcatgcaagaacgtacttaactatgttaatagcattatcaaagaaattaaaacaaatttggatggcaataatgtaacggctatccttcaagaattaggaattagactgcatagagttgtttacgagcacat

SEQ ID NO: 2666 - DNA, 611 bp, Phyllotreta striolata
aaaatcacctggggtcttacgaatgtaagctttgcttgaccctacacaacaacgaggggagctacttggcgcatacacaaggtaaaaagcaccaggccaatttggccaggagggcagccaaggaagccaaagatgctcccacgtcgctgcaaccggagaagccccgagtggagcccaagaagttcgtgaaaatcggtagacccggttatcgggtgactaaacagagagatccagaaaccggtcaacagagtttactgttccaaatcgattatccagaaataagcgatctggttttgccccgacaccgcttcatgtctgcgtacgagcaaaaaatcgagcccccagaccgtaaatggcagtacttactgtttgctgcggaaccgtatgaaaccattgcttttaaagtaccgagcagagaagtcgagaaaacggataataagttctggacacactggaacagggacaccaaacaatttttcctgcaattcgctttcaagaacgagaacaaacgctccgttaactctgtaattcaaaggcattcgattgttggcggagttccaccgcctcccatgctgccggtaccgccgccgcccaggcctcctatgtttaat

SEQ ID NO: 2667 - DNA, 252 bp, Phyllotreta striolata
aaactataaccggcgaagtttacaggggtaaacttatagaagccgaggataacatgaattgccaaatgactcaaataacggtaacgtacagagatgggcgggtggcgcaattagaaaacgtttacattagaggttccaaaataaggtttttgatattaccggatatgttaaagaacgctccgatgtttaaaaaacaaaccaaagccgggactgctggtagagggaagtctgctattctacgagctcaagcac

SEQ ID NO: 2668 - DNA, 655 bp, Phyllotreta striolata
caagtcggagccaatttaacggccacatccgatagagaaactatctgctacacgctggaaggtacccctgaggctgtggaatgcgctttaccattcttaaccgaagtagccacccagcaagaatttagaccttgggaagtttccgatttgtccagtagattgcagttggatattgctacaagaccattgcagttgagagctatcgatttactgcacaatgctgcttttagaggacgcggtttgggtaattctctgtttattccgaaaactcaaattggtaaaatttcgtctgaaactctgcaacattacgtttgctcgaacttcaaaagcggacgtatggcggtcgtaggttcaggaatcagtcaaaaggagttgacgtcttttgctaactctttgaaaatagaaaatggtgatggcgataacaccccatctccttacaaaggaggcgaactaagatcgaacaaaggtggtcaactagcatttattgctgtagcaggagaaggtgctgctctcaaaaacagcaaggaagctctcgcttttgctgtactacaaggagcccttggaggaggtccccaggttaaacacggaattacagacagcggtgtcttcaggaaggctcttggaaatagccctgacgttagttccgtagccataa

SEQ ID NO: 2669 - DNA, 206 bp, Phyllotreta striolata
acgaaaatgatcggatgactaacgaattgcaagagaaaattggagcgctgaagtccctaactattgatatcggaaatgaagttaaatatcaggatagaatgctcagggatgttgacgacgatttagaaaaaactggagggtttctaggaacaaccatgaacaaagtactgaggctgtcgaaagggggccacaactacatcattgtg

SEQ ID NO: 2670 - DNA, 729 bp, Phyllotreta striolata
cgttggttatcctcgaagatgtcaaatttccgaaattcaacgaaatcgtccagctcaaactggccgatggcagtctacgatccggtcaagtactggaagtaagcggctcgaaagccgtagtacaagtgttcgaaggtacttcgggaatcgatgccaaaaacaccatgtgcgaattcaccggcgacatcctccgaacgcccgtatccgaagacatgttgggcagagtgttcaacggctctggaaaaccgatcgataaaggtcccccaattttggccgaggacttcttggacatccaaggtcaaccgatcaatccgtggtcgcgtatctacccggaggagatgatccaaaccggtatctccgccatcgatgtgatgaactcgatcgctcgtggtcagaagattcccattttctcggcggccggtctgccccacaacgaaatcgccgcccagatttgtaggcaagccggtctcgtcaaggtgcccggcaagtcggcgttggacgatcacgaggacaacttcgccatcgtgttcgccgctatgggtgtcaacatggaaaccgctcgtttcttcaaacaagatttcgaagagaacggttcgatggagaacgtatgtttgttcttgaatttggccaacgatcctaccatcgagagaatcatcacgcctcgtttggctctaacagcggccgaattcttggcctatcaatgcgagaaacacgtgttggtcatattga

SEQ ID NO: 2671 - DNA, 207 bp, Phyllotreta striolata
cgtttcgggatcgtacatatcctggtcgtagatcaacgcggtgcctctgctttctttaaatttagtgaagtattcctgcgcgtacgatactacgtcttcgggctgttcgagcaagtagctgcaagtgaattcgagcaacatggctcgcaattcgtcagggactctgattcctgccctttcgcgttcgcgtatttcgttcattttcga

SEQ ID NO: 2672 - DNA, 729 bp, Phyllotreta striolata
actacggcatacaagtgatcgtcaagctgttgaatccgccgtcgcgttggccgctggtgaaggcggtcatcggtctgatcaggaacctggcactgtgtccggccaatcacgctccgttgagagagcacggcgccattcatcatttggtgcagttgctgatgagggccttccaagacactcaaagacaacggggtagcgtggctagcggaggcagccaaccgccgggaacgtacgcggacggggtgcgcatggaggagattgtcgagggtacggtgggagcgttgcatatattggcgagagaatcgcacaatcgggccatcattagacagcaaatggtgattccgatcttcgtgcaattgctgttcaacgatatcgagaacatacaacgcgtcgccgccggcgttctttgcgaattggcggccgacaaagagggggcggaaatgattgaaaacgagggcgccacggccccattgactgagttgttgcattcgagaaacgaaggtgttgctacgtacgcagctgcggttttgtttagaatgagcgaagacaaaccacaagattataaaaaacggctgtcgatggagttgactaattctttgtttagagaagaaaatctttggaatcccgatctaggcatgggtccggatttgcaggatattttaagtcccgaccaagcatatgacaacatgtatgctcagggtccccccagtgttcatagtagtcatggcg

SEQ ID NO: 2673 - DNA, 667 bp, Phyllotreta striolata
gaaatcgacaagcacaagaagcgccgtccgtatttggcctccgaatgcaagagcctgtacgcctgcgagaaatggcgcatgcagataatcagagaaatagcgaaaaaagtcgctcaaatccagaacgccggactgggcgagttccgcatacgcgatctaaacgacgaaattaacaaactgctgcgcgagaagcgccattgggaggaccagatcaaggaattgggggggcccgattaccagcgcgtcgggccccggatgctcgaccacgagggcaaagaggtgcccggcaacaggggctacaaatacttcggagccgccaaggaattgccaggcgtccgagagctgttcgaacaggaacccccgcctccgcctcgaaagagccgagccgaattgatgaaggacatcgatgccgattactacggttacatggacgacgacgacgggattttgataccgttggagatcaaagctgaaaaaatcgccgtccaaaacgccatcaccgaatgggtgaacaacaaagagaagaacctcgactcgagcaaaaccatcgaagagagcatctacgcggtggaggattccgacgaggaggagaccgtcgaacgattcgacggttcccaacagcggttcgtcgcccacgtaccggtaccctctcaacaggacatcgaac

SEQ ID NO: 2674 - DNA, 504 bp, Phyllotreta striolata
ggcgaattcgagaaaaagtacgtcgccacattgggcgtcgaagtgcaccctttagtgttcacaacgaacagaggtaaaatctgtttcaacgtgtgggatacggcgggccaggagaaattcggcggtctcagagacggttattacattcagggacaatgtgccattattatgttcgacgtcacgtccagggttacctacaaaaacgtccccaattggcacagggacattgtcagggtgtgcgaaaacataccgatcgtactgtgcggaaacaaggtcgacatcaaggataggaaggttaaggctaaaagtatcgtgttccatagaaagaagaatcttcagtattacgacatatctgcaaaatcgaactacaacttcgagaagcccttcttgtggctggcgaggaaactgatcggcgatcccaatttagatttcgtggcggaatcggccctgttgcctccggaagtgcaaatggacccgcagtggcaacaacagttggagaaggat

SEQ ID NO: 2675 - DNA, 340 bp, Phyllotreta striolata
taccagggctacttcttaggagtaggaggaacatggaacttaaacgaagaaaaaaatcctgattcggaaattgtggcatctggaatctttgtcggctacatgatctacactatcgtatctcttataagcctgtgtttcgccagcggtgatcacaaaacatctttcaccgatattttaatgaatatagtcggtgtattcatgtgggtggccgttggagcaacagcacttcactactggctcggttatttgtcagaatataaatactcgagcgttgattccgagcgacaggtgggcttggcgttaggagccttgtgcgttataaacggtgcagtctatctag

SEQ ID NO: 2676 - DNA, 724 bp, Phyllotreta striolata
caaatgcgaaatggttacgatgttgcaatacgacaatctgaagaaccctctgccggcgcaaagtaagcgatcgaacatgtcgcaggctcagcaattggcctttctcgagcaacatccgtacgattcgttcaaaacggaggatttggacgtggctaaatcgctgttgaggagcgaaatggatgtggtaaaaagcggcatgaatcacggagaattgccgttggacgtgtacaatcaggtatgggaagagtgcctgggccaagtgttgtatcttccgaatcagacgaggtacacccgcgcgcatttggcgagcaaaaaagatagattagaatcggcggaaaagcggctggaacagaaccgatcgcacatggccaaggaggccaaacgcgccgccaagatggagaagaaattgaagatattaacgggcggttaccaatccagggcgcaggtgctgattaaacagttacaggatcaatacgagagcatcgatcaatcgacgttggagttgaacacgttcaaattcctggccgagcaggagaagaacgctttgccgatgcgaatacagtctcttactgaggacgtgaataggcagatggaaagagagaaggtacttcaaatgaaatacgctgattaccagaatcagattaaagagttacaagaggagtatttaggtcaaatgcaaaatgttccaaatgaagaatcaaataaatatgacgaggtcacttcg

SEQ ID NO: 2677 - DNA, 325 bp, Phyllotreta striolata
gctcatcctgataagctgaagaaaaaaattactagggaattaattaccactattcttgccagaaaaccaaaaatgtgcagtttcttagaatggagagatttgaaaatcgtttataaaaggtatgctagcttgtatttttgctgcgcgatagaacaatgcgacaatgaactgttaacattggaaatcattcatcgttacgttgaactattggataagtacttcggaagtgtatgcgagttggatataattttcaactttgagaaggcctatttcattctggacgagctaatgcttggtggagaggtgcaggaaaccagtaagaaga

SEQ ID NO: 2678 - DNA, 776 bp, Phyllotreta striolata
aaaattagagcaaagcgacgctttgaaagctgcccggcagaagttcgaaaccgtagagaaagaggccagcaaaggcggcgaagtgttcaaagagagtttaggttctatcaaagatcgagtcaaaggcgtcatagacgaggccagtaaatcggatttagccaagaaggccggtaagtttaccgaagaagtaggaaaaactacgcacaaaatcagcgaaaccgcacaagaaatcagcaaaaccggagcgtttcagagcatatcggaagccaccaaagccgtcaaacaagaaatcgacaacaccagcatggaaggtcgagtgtatgtcagtcctaaaaagctacgaaaacgaaccgaaaccagcgccgtagtccaacagaaatactacgaacccaacacggacgccacaggcgtggaactccacaaagactccaaattctacgaatcctggcagaacttcaaaaacaacaacccctacgtacacaaagtcatggactggaaactcaaattcgacgaaagcgagaaccccatcatccgagcctccagggcgctcacggaaaaagtcggagacatcatgggcggcttattccaaaaaaccgaactctccgaaaccctaacggaaatctgtaaaatcgacccggacttcgatacaaaacgcttcctgaaacaatgcgaaaccgacatcatccctaacgtactcgaagctatgacgcgaggagacctcgaggttctgaaggactggtgtcacgaaggacccttcaatctattcgccataccca

SEQ ID NO: 2679 - DNA, 685 bp, Phyllotreta striolata
cgtaaacaacataagtggcctaaaccagaaaatagaagaattcaaattgaaactgccatggatcgagaggttggactgtacaaacgcccaagcccccctggcgcccgaattggctgcggaaatgttagttcacgaagaaaagaggagtaatcaactgagaaacaacaaaaaacttccccaattccaaccatccgaagacccggttctgaacgatttcaaacgagagctaatattccacaggcaagcacaagctacaattctagaagccatcccgaaaatcaaagaattagggatatccactaaaagaccagaagattattttgctgaaatggccaaatccgatgagcaaatgcacaaaatcagggagaacctgaagcagaagcaggagcaacagaagcggattgaacgggtgaagcaattgaggcagcaaaggaaagaaggaaaatcgctgcaggtgcagctgaaactgcaacgctctaaggagaagaaagaaatgatggatcaagtaaagaaagcgaagaaaaatttcgattttctcgacgataaaaataagcccatgggtaagagggcggcggagaagcgtaagatgaaggataagaaattcggtttcggcggtaagaagaaagggatgaagaagaatacaaaggacagtgcaggcgatataagcgagtatagaaatcctggg

SEQ ID NO: 2680 - DNA, 514 bp, Phyllotreta striolata
agatgaacgaattagagaagctagaatacctttctttggtctcaaaaatttgcacagaattggacaatcatcttggaatgaacgataaggatttagctgaatttattatacatctctccgagaaaaacaacacattggagtctttcaagaaggtgctctcagaaaatggcgccgaattctcggattcatttgtttctaacttgctgcgaattatccagcacatgaagccgaagaaatcctccaataaggaagagttcgataaagtggaaaaagagggactagcttttaaatttcccggtctagcaatacctaatgagaaacaaaaacctttacaattagaagaatttgataatgaaaatgaaaatgatgaaatagacgttgtagctgatatgatgaaacagctcgaggccgatgcaccttctcaaaaacaaaccaaagaaaggtccagaagccccagcatcgaaaagaaaccgagagtaagatctggaagtagatcgaaggaacgaagaagatc

SEQ ID NO: 2681 - DNA, 792 bp, Phyllotreta striolata
ggatgataccatagacgacgagcgcctccgcaaggaattctcgccgttcggcaccatcacgtccgccaaagtaatgatggaagaaggcaggagcaagggcttcggcttcgtgtgcttctcctcgccggaggaggccaccaaggccgtaaccgaaatgaacggcagaatcgtcggcacgaaaccgctgtacgtcgccctggcccaacgcaaggaggaccgcaaggcccatctgacgtcccaatacatgcaacgcatggcgaacatgcgcatgcaccagatgggccagttcatccagccgggcggctcgagcggctacttcgtgcccaccatccaggcgacggcgccgcgtttctacgggccggcccagatgccgattcgcacgagcccgagatggccggcgcaaacgcccgtgcggcccggcgcccaagggagcaccgccacctacaccggtatgcagaacagctacagggccgccgcccgaccgccgggccaatccacgatgcgcagcaacatcagcgttccgcgacctatcaccggacaacaaccaccaagtatgcacggtcgtccacttgttggacaaggtgtggctgctgctggaaatcgtgccaacttcaaatacaccgccaacatgcgtaatccaccacaagcaatgttgtccggagctcaagctcaagtacaacaagcagtccacattcaagggcaggaaccccttactgctaccatgttggccgccgctcctccgcaggagcagaagcagatgttgggagagagattgttccctctcatccaaag

SEQ ID NO: 2682 - DNA, 764 bp, Phyllotreta striolata
ccggtatcagaaaaacgttgccggccaggcaaggttccgatgaaggcgtcggtgccggcgccgccgccgccgaaacgacggtcatcccgaaccaagagagcctcatcggagatttgctttctatggatatcaacgcgcccgctccctcggccgccgccgctcccgccgccccattggctagcaacgtcgatttgctcggcggtggattggacgttttgctcggaggcggtagtgatatcggcggtggtggcgccgttagcgccgccgctcccaccaccaccggtcttctgggggatatattcggaataccttccgctcctaccatgtacacacctccgaaggttatctggttgcccgccgaaaagggcaagggtatggaaatctacggtactttctccagacggtccgggcagatggccatggaaatgactattaccaataaggctatgcaggccatgtccggtttcgccattcaattcaacaagaacagcttcgggatcacgccgtgcgcgcccatgaacgtgccggccctgcagccgggccaaaatctcgaatacagtttaccgttgaacacgacggggcctgttcaacggatggatccattgatgacgctccagatcgccattaaaaacaacgttgacgtgttttactacgcctgccagatacctatccagatattgttcggcgaggacggtactctggataagagggtgttccttaccacttggagggacattccgggagctaatgaggtccagtacacg

SEQ ID NO: 2683 - DNA, 364 bp, Phyllotreta striolata
gaggagaagtaggagctacatcatctttggctccgaaaatcggtccccttggtctgtctcccaaaaaagttggtgacgatattgccaagggtactgctgactggaaaggtttaaaaattacggtacaattgaaaattcaaaaccgtcaagccaccatctccgttgtaccatcggctgcttccttaattatcaaggcattgaaagaacctcctcgtgacagaaagaagcagaaaaacattaaacacagtggaaacattacattcgatgaagtgcttgccattgcgaagcaaatgaggcctagatcaatggccaagagcctttctggaactgttaaggaagtgctaggtacagctcaatctgtagg

SEQ ID NO: 2684 - DNA, 697 bp, Phyllotreta striolata
gcaaatggaggaggaacttacagttgaagcggccaaactgggcattactatagtattttcgcatgagactgagcctatgggcaccgcaggaccaatagcattagcgagagaacacctctcgaaaagcaccaagccgtttttcgtattgaactccgacataatatgcgacttcccgttcagggagctggccaagttccacgaaggccacggaaaagaaggcacgatagtcgtcacgaaggtcgaggaaccctccaaatacggcgtggtggtgtacgatcaaaacaactgcatcgagagcttcgtcgagaaaccccaggagttcatttcgaataaaatcaacgccggtttgtacattctgaatccgagcgtgatcgatcggatagagctccggccgacttccatcgaaaaggaagtgttcccttacatggcgaccgacaagcagctctacgccttcgagttgcaagggttctggatggacgtcgggcaacccaaggacttcctcaccgggatgtgcttgtatttgaaccatttgcgggaaactaacagccagaagctgtacaaaggtcccggtgttgtggggaatgtactggtcgatcctacagccaaaattggcagtaattgccagattgggcctaacgttacgatcgggccgggcgttgtaatagaaaacggtgtttgtataaagcggtcgacgata

SEQ ID NO: 2685 - DNA, 676 bp, Phyllotreta striolata
aaaagaaggagtaactggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtcttgatacgacggcggagccttggcgggccgccctagataacgagtttatacaatacacaagaaaccattataaagacggcgtttgtagcgtattcggtcgcagtcaaaacggtgcgatcacccttacagcttgcatcgaagaccaccaatttcaacccaagaacttttggaacggtcgatggagatcccaatggtctgttagtttaaccgatgattcaaccgcagaagtacggggcgtcctcaaagtgcaagtgcattattatgaagaaggaaatgttcaactggtgagtactaaagagatcaaggaatccattctggtttctaacgaagctcaaacggctaaggaaatcatccatgtaatagagaacgctgagaatctgtatcaaacggctatttcggaaaattatcagacgatgtcggacacgacatttaaggctctgcgaagactcctgcccgtcaccaggacaaaaatggat

SEQ ID NO: 2686 - DNA, 709 bp, Phyllotreta striolata
tctcaatggttcaacgacatagtgcccaaatacctctgctgtctctggcaggaagagcaagccgtgggctgcgaaaccctgcgattcgaacgaaggccttcgcaggattgcgtcgcctatcaagcaccaggtgtagcaggagtgtacggtgacccgcacatagtcaccttcgacgatgtcgaatacacattcaacggtaaaggggagtactccttagtgaaatcggtcaaggtggacgataatttagaaatacaggcgagattcgagcaaatgagccccaatgcttatggagaggtgagagcgacgcaactaacggcgatcgtggctaaaggaaacaagactattcccattgaagttagaagtagaccgatagaatccagatggaggtatagattagatgttatagccgagaacaggaggttgtactttgatagaccttcgttgaaattccaacatttccaaggcgtgactgtttatacaccaacctacattctaaatcaatctgaagtactgataatgttcgacaacggcgccggtgttgaagtactggacaatcaagggtacatgagcgccagagtatacttaccttggtcgtttataaataaaacggttggattgttcggaaattggagtttcaacaaagaagacgacttcaccctgccggacggttccaaggcggccgtcgtgtcaaacatcaacgacatggaga

SEQ ID NO: 2687 - DNA, 163 bp, Phyllotreta striolata
ttctttcttttcttctgcggcagcaggagcagcggcaactgcagcagcagctacgggtgctgcaccacctactggcatggaactcaacttctcgcgacctttagtaatgagctcttcgatggatttgccgttgagttcacccaagaccttcttgaccttttcg

SEQ ID NO: 2688 - DNA, 789 bp, Phyllotreta striolata
agcggtactcaagaaacattccacgatgcttctaacggcttccaaagtctacgtccgtcaccccgaactagccgccgccaaagccaacagagactacgtcttgaagcaagtctgcgaagccgttaatacgatcaacgacgtcgcgcagggccggacgccccagcccgcttcgggcccctacgacggacctggcgaactggcggccgctttggacgatttcgatgatcacatggtgatggagcctctggcttacaacgaggtccacacgagaccatcgctcgaggagcgtttggagagcatcatcagcggtgccgctctaatggctgattccagttgcaccagggacgagagaagggaacgtatcgttgccgaatgcaacgctgtaaggcaggcgttgcaggatttgttgtccgagtacatgacgaatatgggtaagaaggataagagcgacaacctcaacagggccatcgacaacatgggcaggaagacccgcgacctcagaaggcagctcagaaaggccgtcgtcgatcacgtttcagacagcttcttggagaccaacgtacccctgctggtgctcataaaagcggctcaaaacggcaacgaaaaagaggtggaggaatacgccgtcgtattcaccgaacattccaacaaactggtcgaagtagccaatctcgtctgcagcatgtcgaacaacgaagacggcgtgaagatggttcgatacgccgccgctcaaatcgacaatctctgccctgaagtaataaacgcagctagaatattagcggcgagatc

SEQ ID NO: 2689 - DNA, 699 bp, Phyllotreta striolata
tagcctcattgagtactccaacatcttcttcccaatttggactaacctccagggcccctaaggacacatcagggttatatggatcaaccacagctgcagcgcctactccagcatcaaccggacttggttttggaccagcagtttcaacaacgtcttcagcagccccagctactacaggaactacccccctttttggagtcgcatctaccccgagcaccactacattagccagtgcccctgctttaggtttatcgaccacaatttcttccgctgcttcaacaactccatcgacttcattaagtactacaacagcacccccggcttactcaacatcgacacttacttctactggttcgttaactttcagtcaactggaagattctattaacaaatggaccattgatttggaagagcaaggaaaatttttcattaatcaagcgaagcagcttaatgcttgggattcgttgcttatttcaaatggtgaaaagattctcaacctgaacggtagtatcgagagagtcaagcagcagcaacagcaattggatcaagaactcgattttgtcttagcacagcagaaggaattggaagagttgataacaccgctggaaaaggaattattggaaattcccgtgacggacatagatcgaaatcaaatgtatcaattttcggaaataatcgattcgcaattgaagcaaatgt

SEQ ID NO: 2690 - DNA, 452 bp, Phyllotreta striolata
ttgctgtttttaggactggataatgctggtaaaacgaccttattgcacatgcttaaagatgatagactggcccagcacttgcctacattgcatccgacttcagaggaattatccatcggtaacatgagattcaccacgttcgatctcggagggcattcgcaggctagaagagtgtggaaggattacttcccagctgtagacgccattgtattcctcattgatgctaacgacagatcgagattcgtagagagcaaacaggaattggatgctttactaacagacgaaaccctagcgaattgccccgtgctgattctaggcaataaaatcgatctaccggacgccgcctctgaggatgagttgcgaaacgtttactcgttgtatggccaaacgaccggtaaaggtaaagtcgctcgatcggatttgcccggaaggcctttcgagctgtttatgtg

SEQ ID NO: 2691 - DNA, 432 bp, Phyllotreta striolata
tatccaacaaaacgcaaaccataacgaatttgctggtggaaacgcaaaccatgatcaattcggcgttgacctgtcgcgaatcgatcacgtcgatgctgcaacacctggtcgtcatcaacgactacctgaatcccacgagcgaggcggacgagctcgaggtggaagcgaaacgccagtatttactcgaattgtatcccgaattgaaggatacgatacagacggtgagcacgttggagtccctgttgccattcatcgattccattaacatatccaaagtggtggagttctcggggaagttggaagaggtggccgtgggcaatctcaaattgtacggggaatgcagggacatcaccaagaaagtgctggtcgcgttacagcaatacaacgacatatccaattccattaagttattgttctcgcaattggatatgg

SEQ ID NO: 2692 - DNA, 673 bp, Phyllotreta striolata
agaaggaaacgtggctaatttcgttgaaaccgagcaaatagtcgaataccaaggcgaccgggcgagtttcgtgcaaatacgagggagcattcccctgttttggcaacaagatcccgacttgagatacaaaccgccgcctactctactcgatgtcgatccgcaagatcagcactcgatgtgtctgaagcacatgaacgatttgatgactttctacggaaagatcgtctgcgtgaatctagtggatcaaaaaggagctgaaggaaacatggaagtcgcatttaagaacgccattaccaacgtatcgtctccatcggtgaagtacgaatcgttcgatttccacgccgagtgcagcaaaatgcgatgggacagactgtcgattctcatcgatcgattggcgcacgatcaagacgaaatgagtttcttcttattgctaagagacggctcgttgagttcgttgcaggacggtgtattcagaacgaactgcatcgattgcttggaccgcacaaacgtcgtgcaaagcatgctggcccatcggaatctcgaaagcgtgctcagaaaattgcagatcctccatcagaatcaaacgttggagttccagtattcgttcgaggtgttgttcaagaacgtttgggcggacaatgcggatataatcagtacccaatattcgggtacc

SEQ ID NO: 2693 - DNA, 737 bp, Phyllotreta striolata
gagaaaacgttcgaagacaccaagacgatcatcgataagcattacagcaagcccaacgtggtccccgtggacgtcctgccggtttatccagatttcagtttgtggaaatatccttgtgcgcaggttatcttcgattcagatccggctccagtgggcaaacaagtacccgcccaaatcgaggagatgtctcaagctatgatcagaggtgtaatggacgaaagcggtgagcaattcgtggcctacttccttcccaccgaggaaacactccagaaacgcagggaagacgtcgcgaaccaagtccaatatcaagacgaagaggaatacgaatacaaaatggccagagagtacaattggaacgttaaaagcaaggcgagcaaaggctacgaggagaattatttctttgttgtacgatcgagtggtatttattacaacgaattagaaacccgggttaggttgagcaagcgaaggcagaaagtaggccaacccccgagcaatacgaggcttatcgttaaacataggcctatggatgcgaacgaattcagaatgcaaaggtacagagaaaagcaactggagcctacaggcgaggatgacgaagagatggaaatggacgagcctcaagacgaggaaaacgtgcttgagccggataacgaaagtcgcgacaaagaaaccgagagcgacaacgagaagaaacgatccagagcttcctcagtgtcttcccaaaggagatcgagatccag

SEQ ID NO: 2694 - DNA, 776 bp, Phyllotreta striolata
ctgcctcactacaagtttctcctaacgctcccggaataccgcagcgaccggaatgtccattcgaagatcacagaggccatcaagaaggatgatatggccccatggtatgagctcctttgcaaagaagtaggctggaagttagacgcggccttgctgaagaccctcaaagccaagaacgccgaaaaggtcaagcttctggacgaggccatcgaagatgcggagaagaacttgggagagatggaggtgcgggaggcttatttgcgtaaagcggagttttacagcagaatcggcgacaaagagaacgccgtgagcactttcaggcagacctacgataaaacagtgtctttgggccaccgtttggacatcattttccacttaatcagaataggcttgttcttcatggaccacgaccttatcacgaggaacatcgacaaagcgaagacccttatcgaagaaggaggcgattgggaccggaggaaccgattaaaagtctaccaaggtgcttactgcatgtcggtgagagacttcaaaactgccgctaacctatttttggacaccgtgagcaccttcacctcctacgagctcatggactacaaggcttttgtcagatacgccgtctacacctccataatcagcctgccgcggaaccaacttagagataaagtaataaagggctcggagatactggaggtccttcattccgagccgttcgttaaagactacctgttctcgttgtacaactgccagtacgccgagttcttctcgaatttggcaga

SEQ ID NO: 2695 - DNA, 650 bp, Phyllotreta striolata
agcaggacatcaacatcaatcgccagctgagggagctgttgcagcggcagcaggtcaagaagctggacgagttgttgccgggcaaagcgccgccgccgccgccgcagaggttgtggcacgcgaacgatcagcaggagggcggcggcgacgcctcgatgacttcgggcggcgcccagggcgccgacgccacctttcggcaacctctgccgccgggcgtggtcaaacctaggttggccatcgcggccgttaacaggccgatattgaacgccgttagagtgaatcaattggatcccaggattcagaatttggatccgaggatgaggttgattttgcaacatcagcaacaaagactagcgacgggcattcaacagcaattcatccgtttcacgtcgaacgtgcgaccgacgacggtggagcagtacgagcaactgttgcagcgtcagggcaacaatcagaatcaaatgcacgccgaggaccagcagcagggcgtcgcgcgaatgcccgtagcccaatcgggcgtcgtgcaaagaccgcacgtcgcccaggcgtcggtgacgggcgccgtcgcgacggcttctacggagagcaatcccagcgaggaaggtatccccgataacgtgactgcggaattggaaaaactggaacaggaa

SEQ ID NO: 2696 - DNA, 770 bp, Phyllotreta striolata
aaagcttcaaaatagcgacgggttccgaagacgctgaatcttcttcagcaattccggttgatactccgtttgtgaaagtcgacgggaaaaatgtgtttaggttcttctggtgggacgcctacgtggatccgcaacaccaacaaggaaccgtcttcctcttcggcaaaacctactgcgaaacctccaagaaatacgaaagttgctgcgtagccgtaaagaacatagaaagaacgctatttgttttacccaggccttttgaactagatgagaacggtaaacccaccgataaaccggttacattcaaaacagtccacgatgaattcaacaatcgtatattaaagcgaacaggcattacatctttcaaatcgagattgatcacgaaaaaatacgccttcgacgcgaacataccggccgaatcggaatatttagaagtcagataccccgcgtcatttccgcggatcctttgcaacgaagaccgccaacacgacgacgacgaatccaccgacaacgacgatctcggctacagcactttctcgaagatattcggcatcaaaacgaacttcttggagtcccttttcctcgaacgtaagatcaaagggccctgttggatcgacgtgtccgatcccgaaacggccgccaatccgatgagtttctgcaagttcgaagtgaactgcctgaagcccaacaacctgaaaatcaccccgttcgagaaaccagttccaccgccacccctcgtagtcgccaccataaacatgaggaactgcatcaat

SEQ ID NO: 2697 - DNA, 685 bp, Phyllotreta striolata
tcactagtatggctggatcagagatatattcattagagatgagtaaaactgaagcattgacgcaagctattagaaagagtattggagtcaggataaaggaagagagtgaaattattgaaggtgaagttgtcgatctgagcattgaacgtccagcaacaggagttggtactaaagtgggtaaattgattctcaaaactacagatatggagactgtgtatgatttgggcgggaaaatgatcgatagtattctgaaagagaaagttcagtctggtgatgttataaccatagataaagctacaggaaaaattacgagattgggtcgatctttcgctagagctagagattatgatgctactggtcaacaaacgaggttcgttcaatgtcccgaaggtgaactgcaaaagcgcaaagaagttgtccacaccgtgactttgcatgaaattgatgtaattaacagtcgcacccatggattcttggcactgttttcaggtgatacgggagaaattaaaccagaagtaagagagcagattaatggcaaagtagctgaatggcgtgaagaaggaaaggctgaaattattcctggtgtactgtttattgatgaggttcacatgttggatatagaatgcttctcctttttaaacagagccttagaaaatgaaatgtctccaattgtcataatggccac

SEQ ID NO: 2698 - DNA, 777 bp, Phyllotreta striolata
gggaaattatcttcgcctctttagaggatccctgtacaaaaaatatcctggaatgttcaggaggtccataaccaatgaagaaagacgaaggttgattgaactcggtttgagccagcatgttctagccagtagcgtatcattgcttagagcagaagaagttgaagatataattgaaggaaatgatgaaaagtataaagctgtatctgtacacacttccgaacctcctatgccaagagagggaaaatccaagaaaaacatgcagtgggtaccttcgttacccaattccagtcacttagatgccgttccacaagctacatctattaatagaaacagagtagctgctaaaaaggtgagaacatttccactatgttttgatgacaccgatccccaaataaacatagaaaatgcttgtcaacaagaactgctagttcctattagactcgacatggaaatcgaaggacagaagctcagagatacatttacttggaataaaaacgagagtttaataacgccggaacaatttgctgaagtcctctgcgacgatcttgatttaaatcctttaacatttgtaccagcgattgctcaagcgattagacagcaactcgatgcattccccacggaacctcctagtattatagaggaaacctgcgatcaaagagtcattattaagttaaacattcacgtgggaaatacatctttagtcgatcaagtcgaatgggatatgagcgaaaagcaaaataatcccgaagaatttgcgttgaaactttgcgcagaatt

SEQ ID NO: 2699 - DNA, 443 bp, Phyllotreta striolata
atcaattcccggaagtgtacgtgcccaccgtattcgaaaattatgtggcggacatcgaggtggatggtaagcaagtggaactcgccttatgggataccgcaggccaagaagactacgatcgcctgcgtcccctttcatatccagacaccgacgtgattttaatgtgtttctcggtcgattcgccggattccttagaaaacatcccggaaaagtggacgccggaggtaaaacatttttgtccgaatgtgccaattatcctggtaggcaataaaaaggatctgcgtaacgatccgactaccattaatgaacttaaaaaaatgaagcaagagcctgtcaagccgcaagacggtcgatctatggctgaaaaaataaacgcctttgcgtatttagaatgttcggctaaaagtaaggagggcgtcagagaagtattcgagaatgccacc

SEQ ID NO: 2700 - DNA, 664 bp, Phyllotreta striolata
gcagcaaattgagagaagtctgtccgctgttttataaaaccgaagatgcggcattttcaaaagccgtggaaatattaaagatgacgcgggcgattcaaaacaacgacgaaaaggaggagatgatccaatcggccctgcagatttgcaaatcaatcgggcccactatcaatatcaccgatatatgcaaggaattcgctaatctcaaagcgtacaaagctgttacggaattgtgcgcgcatttcggtaagaaaatagatcccgataaaatagcggagagttactataacgccgaagataacagcggtgaccaagaggggtacaattattatcaaagacggttggaaatttaccgtcacatattgaacatgttggatcaattatacaacgaacaaaatcaaacgcaagtcattagtagagattccgcgtactcggttaatcagaccatattgctcgatggtgtcgaacaatcccaagtaggatacgtgatgaagcaagtaataaaagacgtcatggaaacgcccgacgaaatcatgcatttcgcactttacgattggctggtgttcaaaaatatgactggagatttgataaacatccaaaatccctcgctggaaacatatttgaagcgaacgtccacccagaatcccaacaacatcgagaccatgaa

SEQ ID NO: 2701 - DNA, 706 bp, Phyllotreta striolata
cggaaataaatgccagttccatattttaaaaccctccattcgagaacaagaaatctctctgcatagattggctgctctcgaatcgccattgaacgatttgatagacttcgcagcgcaattagactgcttgtggtcagtatggcgatcggacgtgggcgaaacactggtgtacaaggcatcgttcaaatccaaccaatggactcaagtcatactggaacccgaaccgtgcgaaaaacagttccctatcaaattcaacgatgtcaagaccatgtacttacagcacattttccacccgggcaggttccccctgcacgttatcaacaaaaccctttcgatttataaaatgcctacgatcgcctcggactcgcatctttccatctcggcgctaaaacaaagagtatgcatggccgtggaaaacgacatacaaaatctgttcaacagagacgggactgatattaacagcgttgaagtcgatgaatacatagaatgcgccgagtggtgctggcagaaattcgactcccgctgcgtacaataccagatagccagcaggaaaccgctgggtttgatgctcctgccgtccgtctcgggcgccatgctgttgaagaaatcggcgttttcgttcctgcggcccgtcgattcgctcgaacacatgacgttgtgcaccgatttgtacagggagcagttcttcaatttttccatgttggcc

SEQ ID NO: 2702 - DNA, 658 bp, Phyllotreta striolata
tattggctccgatattgtgggaacgtccggcgaatatcagcccgttggtgagattgttggccgcgttcgctacgcaggcagcccctcaaatcgtgctacaggacaaagtgggcggatttttgggggtgttccagaagttgttggcatcgaaatcgaacgatcacgaaggtttccggctgatgcaaagcctcattcagaatctacctaccgaagctctcacgccctatcacaaacagatattcttcctgttgttccaacgattgtcgtccagtaaaacgaccaaatacgttattaatttgatcgtgttcttttgcttgtatatggtgaagtattcgcccaacgatttggtggctttgatcgatgaaatccaagctcagatgtttggtatggttctggagaagcttctaatcgcggaattgcagaaaatcgccggcgatgtcgagaggaaaatcgtcgcttgtggcgttactaaattactgtgcgaatgcccggggatgtatacggggtcttaccaaaaatattggccgcaattgttgcaggcgttattggcgttcttcgagatgcccagagacgagacgacgttccccgatgatcatttcatcgaagtggacgatacgccggcctatcaagcgaccagcgctaaattgaatttcgccga

SEQ ID NO: 2703 - DNA, 451 bp, Phyllotreta striolata
gttcgagtgcatagaggaattaaaagaagatttagaatggaagatgatttacgttggctccgctgaaactgaagaacacgatcaaattttagactccgtattcgtcggacccattccagaaggtaaacacatgttcgtcttccaggcagatcctccgaacgtctcccgcatacctgaaaacgatgccatcggtgtcacagtcgttctactcacttgctcctataaaagccaagagtttattcgtgtaggttattttataaacaacgaatacagcgatccggagatgagagaaaacttgcccagtccacctcagttcgataaggtaattagaaatatattggcgtccgaaccgagggtgacgaggtttaaaatcaactgggaagaatcgagtggtacgcaggaaaacggtactacaatcgcagaagcacccgccaaccaaacatccgagact

SEQ ID NO: 2704 - DNA, 700 bp, Phyllotreta striolata
aacgcttggtctaggtttaggccatgctatgtctatgccacatacaaagtatgtaactggattttcactgcctatcagttctatggctcctcaaacaccacaacatacaatgatgagtcctatggtaaacgttggtggaactggtaccactagttctggtgtaacccctacattgggtccctctacaccttcaccaatgactcctatgacaccgcattcagcagatcccggaatcgttccacaattacaaaacatcgtctcaactgtaaacttgagctgtaaattagatttaaagaaaattgccttgcacgcgagaaatgccgaatacaatcctaagcgatttgctgccgtgattatgaggataagagaaccgaggacgacggctttgatattttcgtcggggaaaatggtgtgtacaggtgcgaaaagtgaagaagactcgagactagcggcgagaaagtacgctcgaattatacaaaagttggggttccctgcgaagtttttagattttaaaatacagaatatggtgggaagttgtgatgttaaatttccgatacgattggaaggtttggttttaactcacagttctttcagtagttacgagccggaattgtttcctggtcttatatatcgtatggtgaaaccaagaattgttctgttaatatttgtttccggcaaggttgttctgactggtgctaaa

SEQ ID NO: 2705 - DNA, 454 bp, Phyllotreta striolata
tccaacaaaatcccctttcaaagctcagaaaatggctgcaatgcgttccatgtctcgcctgttattctccagatcatttcaaactactgtaaaaaggggttatgctgatcaaatgagcttcacttttgcttctggaaaccaggtcttctacgatgcgaaatcaataaaacaagtagacgttccttctttctctggtagcttcggtatcctaccagcccacgttcccactcttgctgtcctcaaacctggagtagttactgtttatgaagacggcggttcagtccagaaaatttttgtatccagtggtacagtcactgttaatgacgattcatctgttcaaatcttagctgaagaggcccatccagtagaaaatttagatattagtgcagccagggatcttcttaccaaagcacaaagtcaattgtcatcggccactacagatcaggctagagct

SEQ ID NO: 2706 - DNA, 688 bp, Phyllotreta striolata
agaaatacgagaagtccagcagggagcagcacgcggccgaattgaaggagaaactcgaacaagaagcgcgccggaaggcgaaaaaagaggccgaacgggcccgaataaccgagctaacggacgagcaagcggagaaactccaagccgagctcgacgccaagaaggccccttcgagcgcccccgacgccccttcgagcacctccggcgccccttcgacttccaccgctaagatcgaagaggacgaggacgagtccgagaagggtaaattgttaccgaacaaaggcaacgggtgcgatttggacaagtacagttggactcaaacccttagtgatatagagctgcgcgtgccgctcgaatgcgatttccgagccaagcaaaaggatctcacggtgaacatcaccaaaaagcggctcgtttgcggcctcaaaaaccaccggcccatcatcgacgacgatttccagcacgagatcaagctggaggagaccaattgggtgatcgaggacgggaaatcgttgctattctccatcgaaaaagtgaacaagatgaattggtggagcaaattggtgaaatccgatccggagatcagcaccaagaagatcaatccggagccgtcgaagctgagcgatctggacggcgagacccgaggcatggtcgagaagatgatgtacgatcagcgacagaaagagat

SEQ ID NO: 2707 - DNA, 339 bp, Phyllotreta striolata
agtacagcgatagagagaggtggatttgcgtttatccagcgtacattaactgcaaaaaaaccatagcccaaggcaggaaattaaacaaggaaaaatgcgtggagaatcccactcatcaagagatcagagacgtattagtcgcagcaggtttgaaggtcggcgtggaaaacaaattatacagcagggaacgaagcaaagaattgttgtatcgaggacgaattagagttcaattgaaaaacgacgacggtacgctgtgcaatccaagttttcccactagagacagcttaatgctccatctgggagacatgattcctaaattgaagagcaggcaaaataagg

SEQ ID NO: 2708 - DNA, 660 bp, Phyllotreta striolata
agtaaatcacgccagaaacttatgggacagagccacagttcttttacccagagtaaatcagttttggtacaagtacacctatatggaggaaatgctggaaaatgtagccggagcaagagcagtattcgaaagatggatggattggcaacccgatgagcaagcttggcaaacttacattaattttgaactgagatacaaagaaattgacagagccaggcaaatatacgaaagatttgttataacgcatccggaagtgaaacattggattaaatacgcccggtttgaagaaaatcacggttttatccattccgctaggcagatttatgaaagagctgtccagttttatggagacgatcacttggatgagaagctttacatagcttttgccagattcgaagaaaaccaaaaggaacacgatagagctagagttatctacaaatacgctttagatcacattcctaaggatgaaacgaaggaactctataaagcatataccatccacgagaagaaatatggagacagaagcggtatcgaggaagttataatgtctaaaagaaaactgcagtacgaacaagaaatactccaaaatcccaccaattatgatgcttggttcgattacctgagactcgtagaaggagaggctgatttggaaataacccg

SEQ ID NO: 2709 - DNA, 791 bp, Phyllotreta striolata
ggagatccagctgaaataggagccggagtctgccttctgatcatcatccaactgttcgtggcgggtctcatcgtgctcctgctcgatgaattgttgcagaaaggatacggtttgggttcgggtatttctcttttcatcgctacaaacatctgcgagacgatcatctggaaggctttctcgccggctactgtcaacactggaagaggaacggagttcgaaggagccgtcatcgccttgttccacttgctcaccaccagacaggacaagattcgaggattgcgcgaggctttctaccgccagaaccttcctaatttgatgaatctactagctacagttctagtgtttgctatagtaatatacttccaaggtttcagagtcgatttgcccataaagagcgccagataccgtggccagcattcgagctatcccattaaacttttctacacttccaacattccgatcattttgcaatccgctttggtgtcgaatttgtacgttatatcccagatgttggccgttaaattccaaggcaacttcttcattaatctcttgggggtttgggccgatgttggaggcggcggcccggctaggtcttacccgatcggcggtttgtgctattacttatcgccgcccgagagcgtgagccacatcttggaagatcccgtccacgccgttatgtacattatattcatgttgggttcctgcgctttcttctcgaaaacgtggatcgaagtgtccggcagttcggctaaagatgtcgcgaaacagcttaaagagcaacagatggtcat

SEQ ID NO: 2710 - DNA, 344 bp, Phyllotreta striolata
caggacaagttattacggctttctacgacgttgtacgtaggaaacctatcattttacactacagaagaacaaatttacgaattattttcgaaatgcggcgacattaggcgaatcgtgatgggtctggacaagtataagaaaacaccgtgtggattttgtttcatcgagtattacaaccgcgaagatgcagaaaattgcttaaggtatatcaatgggacaagattggacgatagaatagtaagaacagactgggatgcgggttttatagaaggcagacaatacggaagggggaaaaccggtggacaggttagggatgagtatagaactgattatgattccggtcg

SEQ ID NO: 2711 - DNA, 657 bp, Phyllotreta striolata
aaatggaacttcatcctcccagatttccttgggcctacaaaggcataattacagcactagaccatgcgagtttacgacgtggttacgaagtctaccggcaagtttgcgcctcctgccattcgcttaaacacgtaacctttcgagaactggttggagttacgcacactgaagcagaggcgaaagccgaagctgagcagcaaatggtcgaagacgggcccaatgaagaaggcaatatgttccagcgtcctgggaaattatccgataaatttccgcctccatatcccaacgaagaagctgctcgtttcgccaacggtggatcctacccactcgacttaacttacataatattagccagagaaggtggcgataattatattttctcgctattgactggctactgtgaaccacctgcaggtgtaacattaaaagaaggattgtactataatccttattttcttggaggttctatagctatggccccaccgctattttcagaatctgctacatattctgatggtactcaagctcatgccagtcaactggccaaggatgtcgttacttttctcaaatgggctggagagccggaatttgacgataggaaagtgatgatggtcaaatgcttaggttggtttatagtcggttcagtaatatcgtggt

SEQ ID NO: 2712 - DNA, 663 bp, Phyllotreta striolata
tgcgtgagaacctattatggacaccgacaggccgttagagatatcaatttcaacaattccggaaagcatttcttatctgcgggttacgacaggtatataaaattgtgggatacggaaacgggtcaggttttgtcgcgtttcaccagcaggaaaataccctactgcgttaaattcaatccggataggaacaaacagcatttgttcgtggccggtacatcggataagaagatcatctgttgggatacgagatcgggggatatcgtgcaagagtacgacaggcatttgggcgctgtgaatagtattacattcgtcgacgaaaaccgacggttcgtgacgacttcggacgataaatcgttgagagtgtgggaatgggacattccggtcgatatgaaatacattgcagatcccacgatgcacagcatgccttcggtaacaccggcaccgaacggtaaatggttggcttgccaaagcatggacaacaaagtcgtcatattctcttccatgaatcggtttaagattaatcgtaagaagacgttcagcggtcacatggtggccggttacgcctgctccttggacttttctcctgacatgagctacctgacgtcaggggatgccgatggtaaagtgtatatttgggactggaagtccactaagctgttcaag

SEQ ID NO: 2713 - DNA, 691 bp, Phyllotreta striolata
ctttggcagtgaaaaaggtcgagcagaaaaaagaagtgaatcccctattcgaaaagcgacccaggaacttcggaataggccaagacatccaaatcccccgggatctatcgaggttcgtgaaatggcccaaatacatccgcatccaaaggcagaaggccgtcttgcagaagcgcctgaaagtcccgccgcccatcaaccaattctcccagaccatcgacaaacaaacagccacccaattgttcaaagtattggagaaataccggccggaaaccgctctccagaaaaggaaccgattgaaggccaaagctgaagctaaagtggccaagaaggaagagaccccttcgaaaagacccaatactttaagggctggtactaacaccgtcaccaaattggttgaacagaaaaaggcccaattggtggtgatcgcccacgatgtagaccctattgagcttgtactattcctccccgcgctctgcaggaaaatgggagtcccttactgcatagtaaagggcaaagcaaggttagggctgctcgttaggcgtaaaacttgcgcggctgtcgcccttacgcaagtcgattcaggtgacaggtctaacttcaacaagcttttggaggttatcaagacgaacttcaacgatcgcgccgatgagatcaggaggcactggggaggcggtatcctcggatcgaaatc

SEQ ID NO: 2714 - DNA, 737 bp, Phyllotreta striolata
cataaaggaatacggccagaaggaaaacaactttgaatatgcaatgaccgattatttgaggatatccggcatgtattggggccttacggccctcgaattgatgaacgcctcgcccccgcacacgatagaagagatttcagattacattaaacattgtcaagaccccgaaagcggcggaataagctcgtgcctcaatcacgaccctcacatactgcacacactgagcgccgtgcagatactctgcatgtacgacaatttaaaagccatcgatgtggagggcgtcgtgaagtacgtgaaaaacctacagttacccaacggtagcttcacgggggacaaatggggcgaagtggacacgaggttctccttctgcgccgtcgccacgttgtctcttttaaacagaatggacgctattgacgtgaataaagcagtcgactttgtagcttcgtgtaaaaacttcgatggcgggttcggctcgaggcctctttccgaaagccacgccggtttaatatactgctgcttaggatttttatctgttaccaataggttggatatagtggatcgagacaagctcgcttggtggctgtgcgaacgacaactaccttcggggggtttgaacggacgcccggagaagctgcccgacgtgtgctactcctggtgggtgctgtcctctttaacgatactaggcaagttgcattgcatcgatgccaacgctttgaagaaattcatattggcctgcc

SEQ ID NO: 2715 - DNA, 697 bp, Phyllotreta striolata
cttacatagccgtaaccgaattaccgcaaggacaatggccggatctcatatcgacgctcgtaagcaacatttgccaagggaattccaccgaaatgcaaaaggaggccacgctggaggccatcggttacatctgccaagaaatcgagtccgacgtgttggtgtcccaatcgaacgatatattgacggccatcgtgcacggcatgagatcctccgaaccgagcaatcacgtacgattagccgccacgcaggctttactgaactcattggaattcaccaaggctaacttcgatctcaccaccgaaagaaactacattatggaggtggtttgcgaagccacgcagtcgccggtgtcgcaaatcaaggtggccgctttgcaatgtctagtgaagataatgtcgctgtattaccaacacatggagccctacatggcgcccgcgctgtttcccatcacgttggaggccatgaaatccgagaacgacgccgtcgccctgcagggtatagaattttggtcgaacgtcagcgacgaagaagtcgatttggccatcgaggatacggaagcggccgaagcgggacggcctcctacaagagtatcgaggcattatgcaaaaggagctctgcagtatataataccaatcattcttcaaaaactcacgaaacaagaggagttagatgatgaggacgattggaatccgagtaa

SEQ ID NO: 2716 - DNA, 690 bp, Phyllotreta striolata
gaccaactctacgacataccgaaagaacgaaagaccggcgaatacaggaaatacctgctctacctcatcgaatacctcacgtggttcgtgcaacgcatcagaccgctgatggacctcgacagcgatctccaggaccaggtcgaacaggtgttggccaattgggataacgggatggtgcccgggtggccgaaagaaaccggttcggctttggccaacgtcggcgcccatttggacctgtcggccttctccagctgggaggaattggcctcgttgggtctggatcgtttgaaatccgccctcatggcgttgggattgaaatgcggaggaacgttggaggaacgagcccagagattgttctcgacgaaaggaaaaggctctttagatccctctctcatgacgaaaaacagcaagaaccgcgtgacgaaggagaaggaggcgctcaggcaacgggaactggccacgttagaggcccaaatttacagattggccgatctggtgtcagcccaacgggcggcgaccaaagagaacgtgcaaaggaaacaggcccgtactgacggcgaacgggacgacagcgagaacgaagagagcgaggaggagagccccgacgaggccgacgacgatgtaccctacaatcccaaaaacctaccgctcggttgggacggaaaacccattccgtattggctgtacaaa

SEQ ID NO: 2717 - DNA, 507 bp, Phyllotreta striolata
tatcggcacctttaaagctttcgacaagcatatgaacatgatactcggcgactgcgaagaattccgtaaaattaaacccaaaaactcgaaagtcgaacgagaagagaaacgggtattaggatttgtactgctgagaggcgagagcatagtctcactaactgtagaagggcctccaccaccagaagagggacttcctcgggtgcctattcccggagcagcccaaggaccaggtatcggaagagcagcaggtaggggaatgccaccgggtatggctggagtcccagtaggtctgcaaggtcccgtgagaggagtcggaggaccatcccagcaagtaatgacgcctacgggtagaggacaggtttcggcgccgccacaaatgaaccaagcgcctccgaggatgggtggccctccgcctggtatgatggggcctccgcccggaatgatgggcatgccgccgcaaatgggcatggggcgcggtggaccgcctccgatgggtatgaggggtcc

SEQ ID NO: 2718 - DNA, 774 bp, Phyllotreta striolata
tcggatgtccatctctacttttcacgatcttctacaaagactgcaagataaattgagaaaacaggatacaaacatgagaaaagccgtcagccctgaagagaaattagcgatatgtataaggtatttggcctcaggatgttccttcagagacatacattatagttaccgaataggtatatcgaccatcagcaacataatagaagaagtgacagaatgcatttggaataatttacaccatgaatttatgcctataatcgataaagtgtccgaatgggaaaaaatatcggatgcatttgatgaaaaagccaattttccccactgtcttggcgcagttgacggaaagcatatcaggcttaaaaagccatcaaatagtggttcaatgtatatgaactataaagactttttttcgatagtattattagcagtggtagatgccgattatcgttttatttacgttagtgtaggctcctatggaaaagagtgcgattcgtcgatatttaaggaatccaatttttggaaaaaattaacggaaggcagcttaaatattcctcaaccaagacctctaaccaccgactcaacaactgcggttccttatgtaataataggcgatgagggatttggattacatgacaatttattgagaccttttggtggaacacacttagataaagaaaaaagaatatttaactacaggttaaccagagcccgacggtatgtagagtgtgcttttgggatttttgcaaataagtggaggatttttcatcgacccttgga

SEQ ID NO: 2719 - DNA, 793 bp, Phyllotreta striolata
ataacgaggaggcggatataattatttcggatcagactagcggcgtggccgaagactcgatttcgactaaagaggacttcgaggagctcatcgatgagggatcgaggaagaacaacgtagggaaacaggaggtgaccgcaaagcacatacaggacttccaccggtacaccgaactgttcgattacggtaaacccgatgttaagaaaccggccgctaaaaaattccaaccgaaggtatcactcgttagaggagtgactttgcccagcaaacccaacgccgagaagattattatcacgcaaaattcgaacacttcgcaagcttccaaagttaccagcatcattctcacgcacaacgctaacgtgaggaggaacattataggcgtaccgaagatagtcagtaccgtttcgccggctataactatagtgagcgctagtacctcgcaaatggcctcgatattaccctctaaattcacggtgcctgtcataagcgcgagcgccgttcgccagctatccaacgtaaaagtcatcgataaaccgtcgtcatcgtcgctatcgatttcgacgagagacaacgtcctgcccaagaagatattcgaggacgattcggtgtctcccgacagcagttcgaattgcgacgacgagaaatcgaaggattcgttcgacgacaaggcgaaatgcgagtcgccgccgcgcgatctcaaacagcccaactcgcagatcgtctcgttgaaatcgaaaacctacgcggagcaatcgaagaagatcgaacacctccaaatcgtgaacgtatcgtc

SEQ ID NO: 2720 - DNA, 663 bp, Phyllotreta atra
tagagagggaattggagaggcaaaagagagaggaagaaacgcaaatgatgcaacgaactaaagaagcagcccaattcgaggaatgggagaggcaagaagataaattccacttggaacaagctcgattgagatctcacataagaatacaagacggacgagccaagccgattgatctgctagcgaagtacataagcgccgaagaagaagtcgatgccgtcgaaatgcacgagccttacacttacctgaatggcttgcaaatcaaagacctagaagacttagtcgaagacatcaaagtctacaaagaactagaaagaggaaaaaacctagattactggaacgatataacagtcatagtcgaagacgagcttcaaaagttgcgaaaaatagaaaaacaaaacgatttcgacttgggattgaaccgaagggaaggaatacatcaatctgtcgccaccgatgtgacatcagtatttaaaggcaaaacagccgcacaattagcagctttagaaaaacaaatcggaagtaaaatcagcagcaaagccgatggaatagacataggctattgggaatctttgctatcgcaacttaaggcccacatggcgagggcgagactacgcgacagacaccaagatagcttaagaaggaagctgcaagtactaaaagcag

SEQ ID NO: 2721 - DNA, 687 bp, Phyllotreta atra
cttaaacggctacgaaatcggcggcaggaacttgcgagtagacaacgcttgtacggaaaaatcccgcatggaaatgcaaaacctgctcaaccaaccgcccatcgagaacccctacggcgagcccatccaagccgaaaaggccccggaggccatcagcaaggccgtggcctccctgccgcccgaacagatgttcgagctcatgaagcaaatgaagactaccatacaaaataaccccacagaagcgagacaaatgctattgcagaatccccaattggcgtacgctttactacaagcccaagtggttatgaagattatcgatccccatacggccgccagcctactgcacccggttaaccaagtaccagccactttgctgccgggggacaagaacgtggcagtacaagtaccgatcaacaaccagtaccgggaaccccctgcgcccgtacaaccgcccaggcaggagtaccaacccgtaccgccgcccctggtacatcccaatcacgttcaacagcccgtttttaccggtcaagatgtggacttgcgatcgatggggaatgtgaccgatccgagaatcaggcccatgattgtggatcaggatatgagacaaatgccggccgttatccagaatcccctaccgcctactattagcgaaagtcttgccaaagcgggagattcgaaaccggataa

SEQ ID NO: 2722 - DNA, 642 bp, Phyllotreta atra
cagactgaaagaaatgcgagaacaactcaaagatttaaccaagcagtacgataaatcagaaaacgatttgaaagccctccaaagtatgggccaaatcgtaggtgaagttctgaagcaactgacagaagagaaattcattgtaaaggcaacaaacggtccccgttacgtagtaggctgccgtcgtcagctggataaagccaagttaaaggccggcacaagagtagccctcgacatgaccaccttaaccataatgcggtacttgccgagagaagtcgatccgttagtttacaacatgagccacgaagatccaggagacgtcacttactcagccattggaggactttccgaacagattagggaattgagagaagtcatcgaattgcctctcatgaatcccgagttgtttatgcgagtgggcattacaccaccaaaaggttgtctattgtacggaccgcctggaactggtaaaactctgttagccagagctgtggcatcccaactggacgcgaatttcttgaaggtcgtatccagtgctatcgtagataaatacatcggcgaatctgccaggcttattagagaaatgtttaactacgccaagaccaccaaccgtgcatcatcttcatggatgaaatcgacgctatt

SEQ ID NO: 2723 - DNA, 637 bp, Phyllotreta atra
ccatggaagccatatctcacgcgggcacatgtctgggcatcctggcgaacgatggaatccttctcgctgcagaaagacgcaacaccaacaagctactagatgaggttttcgtctcggagaaaatctacaaactcaacgacgatatggtgtgcagcgtagctggaattacgtctgacgctaacgtattgacaaacgaattgcgtttgattggacaaagatatttataccagtatggggaatcgatcccttgcgaacagctggtttcgtggctgtgcgatgttaaacaagcgtatactcaatacggaggtaagaggccgtttggcgtatccatcttgtacatgggctgggacaagcattacggttaccaattgtaccaatcggatccgagcgggaattattccggttggaaggcgacttgcataggaaataacagttccgccgccatttcgagtttgaaacaggaatataaagaaggcgatatggctttgaaggatgccaaaggtttggccgtgaaggttttggctaaaacgttagatatggctaaattgacttcagaaaaagtggaaatggctactcttacacgtagaaacgacaagaccatgataaatatattaaatagcaaagaagtggaagaact

SEQ ID NO: 2724 - DNA, 785 bp, Phyllotreta atra
aggtcttacgcctatcgataaatacttgtactcttctgaagatcacattaaatccggagctctattagcctgtggtattgtcaattgcggagtcagaaatgagtgtgatcctgccttggctctattgagcgactatgtcctacataacacgaatataatgaggataggcgctatcgtgggcctcggtttagcttacgttggatccaacagagaagcagttttaagtttactgactcccgtcttttccgatccgaaatccaacatggaagtgatcggtatgtcggcgctagcttgcggaatgatcgcagtgggatctggaaatctccaagttaccaccacaatcatgcagacgctaatggaaaaatcagaaaccgaactgaaagatacgtacgctagatttttgcctctaggtctcggcttgtgcatgttaggcaaacaagaaggcatcgattccataatagccgcattggaagtcataccggagccttttaaatccatggcaactacgatggtcgacatttgcgcttacgctggtaccggcaacgtacttaaagtccaacatttactgcacatttgctccgagcattacgacggcagcgacagctcagacaagagttccaaagataaggacaagaaagatgctacggagaaggagaaggacctttcctcgagacaagcagtggctgtactcggtatagctttgatcagcatgggtgaagacattggcagtgaaatggccttccgtaccttcgggcatttgttgcgctactgcgaaccggtaatta

SEQ ID NO: 2725 - DNA, 742 bp, Phyllotreta atra
caaccatcagtaccagaacatgtacatagagagaactacagttgataattctccttctgctactgttttgtatcgggacgatcccaatttgggagcttctagattccaaggaaattacgacatatccagttcccaatcgcaagtgaaccttcttccagctgcgtcaggagaaacctactatacatcgacccctaactggacgccgacgagcagcggtacttaccaacaacaatacccatccgggaccataaacgtccttcaggcggattcgactcaagccttcgggagtccatacataaacgcgacatggtcgtcgaattcgatggaggacggacggccgtctagtcaagaggtactagtgaaagagtgcgttaattgtggtgctagcgtcacaccactttggcgtagagacggtacggggcattatctatgtaacgcgtgtggtttataccacaaaattaatggggtgcacagaccgccgacaaagccaaccaaaaaaccacaggcgactggaaatagaagaaacggcgtaacgtgcgcaaattgcaaaactaacaacacaactctttggagaagaaacaaccaaggcgagccagtttgtaacgcttgtggactctactacaaattacataatgttaacaggcctatcagtatgaaaaaggaaggtatccagactcgcaaaagaaggcccaaaaactcctctgtgggaaaccccgccagtgctgcaggtcaagtaagactt

SEQ ID NO: 2726 - DNA, 762 bp, Phyllotreta atra
ccatttccaccattgtaggagtgtaccatgcgcatttactgtcgctcgatggacttctaatcataatcgatggtatagggaagagattcgacgaagcgaaagatcgtactgataccgatgagattagtagttatataggagagaatacgagaattaaaggttgtgttaaagttcccgataagaaggtgttggctgcgaagaaagggatcaaaaagtggttaccgcaaggtacagagtatttcaatcagaagccgaagaaaggtatacagttcctgcaggaacacggcgttttgaagcaggagctcgacgtggaagagatcgctagattcttgcgggagaatcccgcattgaacaaagcgatgattggtgagtacatcagcaatcgggggaatttgaagatcctcgaggctttcgtgagcacgttcgatttcactgggatccgaatcgacgaagcgcttagagcgtttttggagacgtttcgattaccaggcgaggctcctacgatttcgttgattctcgaacatttcgccgagcattggcacaaaagcaacggagaaccattcgctgatgtggactcggcttttacattagcctatgctgttattatgctaaacgtcgaccagcacaacgaaaacgccaaaaaacaaacaattccgatgtcacctaacgcgtttaagaagaatctgaaaggcgtaaatggaggcgacgacttcgaggaggacatgctcgacgaaatatacacttcaatcaaaagcgaggaga

SEQ ID NO: 2727 - DNA, 480 bp, Phyllotreta atra
atacaagcccaaacggtggccacgaatttcgagaaagtcttcgaaatgggcccccacctgttcgtggggctccccggcctcgccaccgacacgcaaacggtcatggagaagctcagattccgcaagaacttgtacgaattgaaagaaaacaggcgaatctcccccaaagtgttcgcggcgatgatatcgaacatgttgtacgagaagaggttcggaccgttcttcgtcgaaccggtcgtggccggtttagctcccgatacattcgagccttacatatgcaacatggatttgatcggttgcatcaacgaacctagtgattttgtcgtagggggcacagcctctgcgcaattgtatggaatgtgcgaatctttatgggaacctaatctagcccccgatgatttattcgaaaccatatcgcaggctttgattaatgctttcgatagagacgctatatccggttggggtgctacggtttatatt

SEQ ID NO: 2728 - DNA, 754 bp, Phyllotreta atra
ggaattgtgttcgatgcaattgtcgccgctgtgcagtttgatggagaacgacgttcggccggtgaaagggaccctgacggatccggtgctgtggttggatcgattgagttcggttttgcgatacgttaacgtcaatatagtcgaaggcgaaatccatccttgcaagccggtaatattggagatatggccgatactgtcccgagcattcgacacctaccacagcgacgtgcgaataatggaaaggtgctgtcgttcggtgcgtttcatgttgcgctgcgtggcccgccagctgcaggatttgctgccctctttggtcgggcaaatcgtgcacatttactgtcgctacgggcattcgtgttgcttgtacgtgggcagcatcttggtggacgagtacgccggcgacgcgacttgcgtgcaaggtctgctcgacatgttgaacgcctttttggagccgacgtttcgcttgttgcaagaggagaacggcttgaagaaccatccggataccgtggacgatttctttaggttatgcgctcgattcgtacagagggcgcctaaggcgtttctaagcggcggggcccatctggcgcccattatgcaatgtgctcttctcgccgccaccttagatcacaaggaggccaacgtgtcggttatgaagtttttctacgatttgataaaccagggattgagcggtagaggtgagcccgacttcgacgagagaaaagccttagttagaagcctactaaacgaatacggt

SEQ ID NO: 2729 - DNA, 744 bp, Phyllotreta atra
gttacaacagaagaacagcgactatagtcatggcactagtaagaaaaaaaagaaactcgccgataaaattctaccccaaaaagtaagagatttggtgccagaaagccaagcctacatggacctgttagctttcgaacgtaaactggattccaccattatgcgaaagcgattagacatccaagaagccctaaagcgccccatgaagcaaaaaagaaaactgcgaatcttcatttctaacaccttctacccagcgaaagaaccccaacccgaaggccccgacggcccttgccaagaaggcacagtagcctcatgggaactgagagtcgaaggcagacttctggaagattccaagaacgatccgaacaaagtaaaacgcaaattctcctcgttcttcaagtctttggtcatcgagctcgacaaagaactatacggacccgacaaccacttggtcgagtggcacagaaccttaaccacccaagaaaccgatgggttccaggtgaagagacccggagacaagaacgtgagatgcacgattctcctactcctcgactaccaacctctgcaattcaagctcgatccgagactggcccgattgcttggcgtacacacgcaaacaaggccagtgattatatcggctctgtggcagtatattaaaacccaccggctacaagacggccatgaacgcgagtacatcatttgcgacaagtatttagagcagatttttaactgtactcgcatgaagtt

SEQ ID NO: 2730 - DNA, 288 bp, Phyllotreta atra
agcccacattggatgaattagaacaaaaaatgagagaggccgagaccgaatcccacgaaggaaaacgaaagaacgaatctctgtggcccatattcaaaattcaccaccaaaaatcccgatacatcttcgacctcttttacagaagaaaggcaatcagccgcgaactgtacgaatattgcttactggaaaacatcgctgacaagaatttaatcgcaaaatggaagaaacaaggctacgagagcctttgttgcctgagatgcatccaagcaagagacaccaatttcggaa

SEQ ID NO: 2731 - DNA, 678 bp, Phyllotreta atra
gggcccacaatttagaagatgaatttcgaactataaggcaaatagtgcagaaataccaatatgtcgccatggacactgaatttcccggagtcgtggccaggcccataggtgaattccgaagttcggccgattaccaataccaaatgttaaggtgcaacgtagacttactgagaatcattcaactaggtttaacgttcttagatgataatggtaaaacaccaggaggtgtttataccacctggcagttcaattttaaattcaaccttcaagaagacatgtatgcacaagatagcatcgatttactgcaaaattcaggaatccaattcaagaagcacgaagatgaaggtatcgagccgttggagttcgccgaattgctaatgtcgtctggaatcgttctcatggaaaatatcaaatggttatcgtttcattccggctacgatttcggctatttaataaagttactaaccgacaacaatctcccacaagatgaaactgaattcttcgatctgttgaaattgtattttcctacgatatacgacgtgaagtatttaatgaaatcgtgtaaaaatttaaaaggtggtcttcaagaagttgccgaacagttagaattggaaaggattgggcctcaacatcaagctggatcggactcgcttttgaccggaatggcctttttcaaaa

SEQ ID NO: 2732 - DNA, 756 bp, Phyllotreta atra
catcttcgcatatggtttcgagaagccttcggctattcagcaaagagctattattcctgtgatgaaaggccgagatgttatagcccaagcacagtcaggtaccggtaaaaccgctacattctccatagctattctacaagccctggatttaacgatgagagaaacgcaggtgttgtgtttatccccaacgagagaattggctgtacagattcaaaaagttatattagctctgggcgatttcatgaacgtacaatgtcatgcttgcatcgggggtaccaaccttggagaagacattagaaagttggattatggacagcacgttgttagtggtacacctggaagagtttacgacatgattcgtagacgagctctgagaaccagatcagtgagaatgctagtcctggatgaagccgacgaaatgctaaacaaaggcttcaaagaacaaatctacgatgtgtacagattccttccaccgtccactcaagtggttctcatatctgctacgttaccccacgaaatcttggagataacgtccaaattcatgaccgatcccatcaggattctagtcaaacgtgatgaactgacgctggagggaatcaagcagtttttcgtggccgtggagagggaagaatggaaattcgacaccctatgcgatctgtacgacaccttaaccatcacgcaagccgtaatattctgcaacacgaagagaaaggtggattggttaaccgaaaagatgcgagagaataacttcaccgt

SEQ ID NO: 2733 - DNA, 794 bp, Phyllotreta atra
caacagtcgagtctcttaggtcctttggcagtcgatgctgttcttaaaattgttgaaccagggcaagaacaagcatgtaacttattggacgtcaaagtgattaaacaattgggtggtactgtagaagataccgagttgattgagggtatcgttttctcgcagaaatctgctaacgtatctggccccaagagaatcgaaaaggctaagattggtttaatccaattctgcatttctcctccgaaaaccgacatggaccacaatgttattgtatcagattatgctgccatggatcgagttttgaaggaagaaagagcttacattttgaacattgttaaacagatcaagaaagccggttgtaacgtacttttggttcagaaatcgattctcagagatgctgtctccgatctggcccttcactttttggataaaataaagtgcatggttgtcaaggatattgagcgagaagatgtagaattcgtatgcaaatcgttgggttgtcggccaatcgcatcactcgatcatttcaccgcagagaatctagtaactgctgatttggtcgaagaagttggagtaggcggtaaccgaatggtgaaaataacaggtattcaaaacgccgggcgtactgttaccctgcttgtgagaggctcgaataaactagtattagaggaggctgagaggtctctgcacgacgctctttgcgtcattcgttgtcttgttcgcaagaaggcgctgatcgcaggtggcggggcaccggaaattgaagtcgctcttaagctggctgctatggctaataa

SEQ ID NO: 2734 - DNA, 738 bp, Phyllotreta atra
agagctagacatggaggatttgtacacgaaatacaagaaactacaacaaaccctggaattcctagaagtccaggaggagtacatcaaagacgagcagaggaacttgaaaaaggagtacctgcacgcacaagaagaagtcaaacgtatccaatcagtaccgctggtcatcggccaatttttagaagcggtagatcagaataccggcatcgttggctcaactaccggctcgaattactacgttcgcattctctccaccatcgacagggagctactgaaaccctctgccagcgtagccctgcacaagcacagcaacgctttggtggacgtgttaccccccgaagccgattcctccattagcatgctccaagccgacgagaaaccggacgtgcaatacagcgacatcggaggtatggatatgcaaaagcaggagattcgcgaggccgtggagctgccgttgacccacttcgagctgtacaaacaaatcggtatagacccgccgaggggcgtgctgatgtacgggccccccggctgcggcaaaaccatgctggctaaagctgtagctcatcacaccacagccgctttcattcgagtggtgggttcggagttcgtgcagaagtacctgggcgaggggcctaggatggttagagatgtgtttcgtttagctaaggagaattcgccggctattatattcatcgatgaaatcgatgcgatagctactaagagattcgatgctcagac

SEQ ID NO: 2735 - DNA, 362 bp, Phyllotreta atra
gacgataaaaaccatgctggaggacctcggcatggacgaggaagaggaggaagtggtgccgttgcccaacgtaaactcagccattctacggaaggtcatccaatgggccacctaccacaaagacgacccacccccgcccgaagacgacgacaacaaggagaagcgaacggacgacatatcctcgtgggacgcggatttcttgaaagtcgatcaaggaacgctgttcgaactgatcctagccgcgaactatctcgatataaaaggcttgctcgatgttacttgtaagactgtggccaacatgataaagggcaaagcgccggaggagatacgtaaaacgtttaacatcaaaaacgatttcacgc

SEQ ID NO: 2736 - DNA, 754 bp, Phyllotreta atra
tgtgtgataaggcgaaagaaatactgtccaaagaatcaaatgtgcaggaggtaaaatgtcctgtcaccgtctgcggagatgtgcacgggcaatttcacgatctgatggaattatttaggataggtggccgaagtccagatacgaattacctttttatgggtgactatgtcgaccgtgggtattattccgtcgagactgttactcttttggtggctttgaaagtcaggtataaagaaagaatcacgatcctgaggggaaaccatgaatcaagacaaatcactcaagtatatggattctacgacgagtgcctgcgaaaatacggaaacgcgaacgtttggaaattcttcaccgatctgttcgattacttgccgcttacggcgctcgtcgatagtcaaatattctgtttgcacggagggctcagtcctagcatcgataccttggaccatattagagccttagatcgtttacaagaggttcctcacgaaggcccgatgtgcgatctgctctggtcggatcccgacgatcgcggaggttggggcatttctcctcgcggcgcaggatatacctttggacaggatatatcggaaacgttcaaccacagcaacggtttgacgctggtctctcgggcccatcagctcgtcatggaggggtacaattggtgccacgacagaaacgttgtaacaatcttcagtgctccgaactactgctatagatgtggtaatcaagctgccattatggaattagatgatgcgct

SEQ ID NO: 2737 - DNA, 792 bp, Phyllotreta atra
actatcgagaacgttaaggctaaaatccaagacaaagaggggattcctccagatcagcaacgtctaatcttcgccggaaagcaactggaagacggaagaaccttgtccgactacaacattcagaaagagtccacactgcatttagttcttcgtctacgtggaggaatgcaaatattcgtcaaaactcttactggtaaaactataaccctcgaagttgaaccatctgatactatcgagaacgttaaggcgaaaatccaagacaaagaggggattcctccagatcagcaacgtttaatcttcgccggtaaacaactggaagatggaagaaccttatccgactacaatattcaaaaagaatctactctacatttagtacttcgtctccgtggagggatgcaaatattcgttaaaactcttactggtaaaactataaccctcgaagttgaaccatctgatactattgagaacgtgaaggccaaaatccaagacaaagaggggatcccaccagatcagcaacgtctaatcttcgccggtaaacaactggaagatggaagaacattgtctgactacaacattcagaaagagtccacattgcatttagttcttcgtctacgtggaggaatgcaaatattcgttaaaactcttactggtaaaactataaccctcgaagttgaaccatctgattctattgagaacgttaaggccaaaatccaagacaaagagggaatcccgccagatcagcaacgtctaatcttcgccggtaaacaactggaagatggcagaacattgtct

SEQ ID NO: 2738 - DNA, 748 bp, Phyllotreta atra
gaggaatacagatcgttgctggacaaatgcgccgccaccgcgatgagctcgaagctgatcaacaaacagaaatcgttcttctccaaaatggtagtcgacgccgtgttgctcctcgatgagctcctgccgttgaacatgatcggtataaagaaggtccaaggcggcggtttggaggaatccatgctggtggctggagtggccttcaagaaaaccttctcgtacgccgggttcgaaatgcagcccaagatctacaaagactgcaagatcgccctgttgaacatcgaattagaactgaaagcggagagggacaacgccgagatccgtttgagcagcgtcaaggaataccaaaaagtagtcgatgccgagtggaacatcctgtacaacaaactcgagaaaatctacgaatccggtgctaacgtcgtactatccaaactacccatcggcgacgttgccacgcagtacttcgccgacagggacatgttctgcgctggcagagtccaagaagaagacatgaagaggactttgaaagcctgcggtggctccgtgatgaccacagccaacgatttgaaagatgaagtgctaggtaaatgccagctgttcgaagagaaacaaataggaggcgaacggtacaacttcttcaaaggctgtcccaacgccaaaacctgcaccatcatcctacgaggtggagccgagcaattcttagaagaaaccgaaagatccctacacgatgctatcatgattgtacgca

SEQ ID NO: 2739 - DNA, 681 bp, Phyllotreta atra
ggcgagcaattagaagtagacgtcagatcgttggaaacgtgtccttactccgccaacaccttcgccgacatattatcgaagatccaacacgctgtcgacgatctatccctgaagcagttctcgaacctgcacatttgggtgttgcgattggacgaggaagtcgagaagaacctcgccaggcgactccaagcgggcgtcgaagcctggacggaagccttaagcggccagaagaaagaaatcgatcatagcatggacacggacgccccggcccaacccacccacaaacccggaggcgatccccaaatccaaaccatgatacacgaagtgcgaatcaccaatcaaaccatgtacttgtttccgagcatcgaagaggcccggttcctgattatgcagcaattgttcgcttggcaggcgatcgtgacgtgccagcaacgtcttcaaagcagccgctaccaagtgggcgtggataagccggtcgttgaaacttacaggaatattttgactagattaccggccggcgctcaaccgttgatcaacgcttacagtgctatttcttctaaaattaaagaggttcaaaattatgtaaatgaatggttaacttaccagtctctgtgggatctgcaagctgataatctttacgggaaactgggagaagatattagcaaatggatggaatgtctg

SEQ ID NO: 2740 - DNA, 699 bp, Phyllotreta atra
accctttcagagacgatctaatccaagccgttaaagagtaccaagtgctgattataaaaggtgaaaccggttcgggaaaaaccacacaaataccgcagtacctccacgaagccggtttcactgctgatggtaaaaaaatcggttgcacccagcctagaagagtcgctgctatgtcagtagcagccagagtagcccaagaaatggacgtaaagctaggcaacgaagtcggatacgccatcagattcgaagattgcacatccgaacgaaccgttataaaatacatgaccgatggtactttacacagagagtttctatcagaaccggacttgcaatcctacagtgtgatgattatagacgaagctcacgaacgaacgcttcacactgatatattattcggtttggtgaaagacatagctagatttagaccagatttgaagctgttaatatccagtgctacgttagatgttaccaagttttcggaattcttcgacgatgctccggtgtaccaaatcccaggcaggagattcccagtggatatttactacacgaaagcccccgaagcagattacgtagacgcttgcgttgtttcaatactacaaatacatgtaactcaaccattgggcgatattttagtattcttgacgggtcaagatgaaatcgaaacttgccatgaactcctgcaggatcgagtaagatgtt

SEQ ID NO: 2741 - DNA, 651 bp, Phyllotreta atra
aagaattgggcaacaaagtgccattttgccccatggtgggctctgaagtctacagcacggaaataaagaaaaccgaagtactcatggaaaatttcagacgagccatcgggcttagaattagagaaacgaaggaagtctacgaaggagaagtcagcgaactaactcctgtcgaaacagaaaacccagcaggaggttacggtaaaaccgtcagtcacgttgtaatcggtttgcggacggccaagggcagcaagcaattgaagctggatcccagcatatacgaggccctgcaaaaggagaaggtcgaggtgggagatgtcatttacatcgaggccaccagcggggctgtgaaacgacagggaaggtccgatgcttatgccacggaattcgatttggaagccgaggaatacgtgccccttccgaagggggatgtgcacaagaagaaggaagttgtacaggatgttactttacatgatttggacgctgctaatgcgaaaccgcagggtggtcaagacgtgttgtccatgatggggcaactgttaaaaccaaagaaaaccgaaataacagataaactcagaaaggaaatcaataaaattgttgacaaatacattgatcaaggtattgctgaattggtaccgggtgtattattcatcg

SEQ ID NO: 2742 - DNA, 653 bp, Phyllotreta atra
atccggacttttggcttattcgttggcttttttgaacaacgttagttacaatgtcgtcgaatttgccaaatcacaaatagaatggatgagcgataatctaatgaggagtttcgaaggagccagaaacaatcccttccagttcaaatatttgcagctatgccacagtttaggggagttgagcaaagtgcccagtccgaaggtcgtactggctagttcgcctgatttggaaagtggattttctagggaactgtttttacaatggtgttctaatcctaataacagtattatattaactacaaggacctcaccaggaactttagccagggatttaatagacaatggaggaggaagaaccatagacttgatagtagagcgaagagttaaattggaaggccaagaactcgacgattatgaaaggcgacaaaggtctaaatatgacaaattagaagaagatgaagccgattccgattcggattccgatattgaaatgtcagtcacctctaaaggcaaacatgacattgttatcaaacaagaaggcaaaatatccacagggttttttaaagtcaccaaaaaaatgtaccccatgtatcctttcaaggaagataaaataaagtccgacgaatacggcgaaattgtgaaagcggaagattaca

SEQ ID NO: 2743 - DNA, 753 bp, Phyllotreta atra
gaacaacgggacaaacaaatgtccgataaaatgaaccaagacacggtgtacgcggccggtagcgccatcgacgcttcgctgaagttgctagccgaaagacgtacggatattttcggcgtgggcgacgaagaaacggctatcggcaagaaaatcggcgaagaggacgtgaggaaggacgaaaaggtgacgtgggacgggcacacgagcagcgtggaggcggccacgagggcggccagggccaacatcacgctggaggagcagatccatcagatacataaagtgaaggggctgttgcctgatgaggagaaggagaagatcgggccgaagaatatcggttcgaagaagattaatatacagagcgttattactacgaagccggcgaatcaagctgcgcagcaacccaaaccgccggtctcgatgatccaaaccggcgcccaaccaataattccaacgcaacccgcgatgctggccccgcaaccgtccatcatgatgatgccagcgccgcctatgcccaccattcgaccgccgccattgatgatgcccggaggcgtggcgatgggcggttatcccgtaggccccatgcccccggggcccggcatgaacatggcccccatgaagcaccccaacgaggggcccagcgaggacgagccgagcaacaagaagttgcgaaacgaggattcgttggtgcccgagaacgtgttcctgtccaggaatccgagtcaagtgtctatcaagatttcgataccggtgatg

SEQ ID NO: 2744 - DNA, 703 bp, Phyllotreta atra
tgaggacgacaaagacaaatctgtatggttcttggaccacgactacctggaaaacatgtacggcatgtttaagaaagtcaacgctagagaacgagtcgttggttggtaccacaccggtcctaaattacaccaaaacgacatcgctatcaacgaattagttcgaagatactgccccaattcagtcttggtgattatagatgcgaaacctaaagatctggggcttcctactgaagcataccaagcggtagaagaagtccacgatgatggctcacccacatctaaaacgtttgaacacgtcccgagcgaaataggcgcagaagaagctgaagaagtcggagtagaacatttactaagagatatcaaagacactacagtgggaactttatctcagaggattactaatcagttattaggccttaaagggttgcatttgcaattgaaagatataagagactatttgatgcaagtgtgcgataacaaactgcccatcaaccatcagatcatctatcaattgcaggatattttcaatttgttgcccgatataaatcaggatgcgttcaacaattcgttttacgttaaaaataacgatcaaatgcttgtagtttatttaggggctctcgttcgatctatcgtcgcattgcacaacctaatcaacaacaaactcaccaacagagacgcagaagaaggcaaaaaggaggagaaa

SEQ ID NO: 2745 - DNA, 746 bp, Phyllotreta atra
agggagtatccgatatagcccagcacttcctgctcaaggccggcatcaccgccatcaggcgcgtcagaaaatctgacaacaaccgaatcgccagagcctgtggcgccgtcatcgtcaacagaaccgaggaactccaggagtccgacgtcggcaccggagccggcgtattcgaaatcaagaaattcggcgacgagtacttctgtttcatcgacgaatgcaaaaatcctaaggcctgtacgatccttctgcgaggagccagcaaggatattctgaacgaaatcgagcgaaacctccaagatgccctgcaagtcgccaggaacatcgtgctgtcgccgcgtttggtgcccggcggcggggccattgaaatggccgtggcccaacggttgatgcaaaaggccacgcacgggccctaccgggcgctcgcccacgcgttggaaatcattccgagaacgttggcgcaaaattgcggcgccaataccatcagaacgttgacggcgctgagggccaagcacgccaaccacgctgaagccgacaaaccgtgcacttggggtatcgatggcgaaagcggggaattggtcgatatgaaaatcaaaggcttgtgggagccgttgtctgtgaaactgcaaacctacaaaacagccgttgagaccgccattctcctgttacgtatcgacgatattgtatcgggatccaaaaagaagggcgacaaggaggtcccgacgcccagtcaaatgcaacaacaggaa

SEQ ID NO: 2746 - DNA, 562 bp, Phyllotreta atra
cagattaatccgtacgctgataatggaggaagcgtagtagcaattgcaggaaaagattttgtggttattggcgcagatacgcgtcttagttccggcttttccatttacacgaggaaccagaacaagctgtttcctctgtctgagacaactgttttaggatgttcaggttgttggtgcgatactttaacgttgactcgtattataaagtctcgtatgcaaatgtactatcaagagcacaacaagaacatgtctacaacagcggctgctcaaatgttgtcgaccatgttgtactataagcgatttttcccttattacatatcaaacattcttgttggattggataatgagggaaaaggttgcgtctacagctacgatcccgttgggcattgtgaaaaagctacctaccgagcaggtggttctgcaggagctttgcttcagcccttattggacaatcaaattgggcagaaaaatccacagaagccttcgcaagaagatcttactcaggaaaaagccatctctacactgaaggatgtcttcatttcggctgcagaaagggatattt

SEQ ID NO: 2747 - DNA, 704 bp, Phyllotreta atra
catgacctacaagtgctactcggtggccatgttcccgggaaacgaaagacaggacgtcgaacgtggtggaaaaataatcatgccaccttcggcactggaacagcttactcgattaaacattaactaccccatgttgtttaaactagttaataagaaaacaaatcgtacgactcattgtggcgtattggagttcgtagcggacgaaggaaaggtctacctaccattatggatgatgcacaatttggtactaaccgaaggcgatttggtgcaaatggaaagcgtctcgttgccagtgggaacgttttccaaattccaaccgttgaatccggatttcctcgacataaccaacccgaaagccgtactggagaattgcttgcggtcttttgcttgtctgaccaccggcgacgtaatagctgtgaggtacaatcaaaaggcctacgaattgtgcgtattggaaaccaagcctggtaacgccatcagtataatcgaatgcgatatgaacgtggaattcgccgctcctgttggctacaaggaacccgaacaagctaaaaaagaagaagaaatgtctgtggatcccgcagacttgatgcccgaaccgtcgggattcgtggcttttaggggggctggtgttcgattggatgggaaaaaacgcaaagattcttcatctaatgacactccttcggttaaaccggtttacgttaggg

SEQ ID NO: 2748 - DNA, 709 bp, Phyllotreta atra
aaagttgcgatgactacactgggttcgaaaataattaacaagtgtcacaggcaaatggccgaaattgccgtaaatggcgtgttagcagttgcggatctccaacaaaaggatgtcaactttgaactcattaaagtagaaggaaaggttggcggtaaattggaggacacgacattagtgaaaggtgtcgtcatagataaaacaatgtctcatccacaaatgccgaaggaacttaagaatgttaaattggccatcctcacctgtccgtttgaacctcccaaacccaagaccaagcataagttggacgtcaccagcgtcgaagactacaaagaactaagattgtacgagcaagaaaaattcaaggaaattgttggcttagtcaaaaaagctggagctaccttggctatttgccaatggggatttgacgatgaggccaaccatttgctgttgcagcaggagttacctgctataagatgggttggcggtccagaaatagaactaatagctattgcgaccggtggaagaatagtaccaagattcgaggaactcagccctgagaaacttggttctgccggtttggtacgtgaaatatcgtttggaactaccaaagataagatgatggtgattgaagaatgctcgaattcccgtgccgttaccattctcgtcagaggcggtaatcaaatgttggttgatgaagccaagaggagtttac

SEQ ID NO: 2749 - DNA, 202 bp, Phyllotreta atra
aaaggtgagaagaaacggttcgaggtgaagaagtggaacgctgttgccttgtgggcgtgggacattgtcgtcgacaactgtgccatctgtcgtaaccacatcatggatctttgcatcgaatgccaagccaatcaagctgccgccaccagtgaagaatgcacagtcgcctggggtgtgtgtaaccacgcttttcattttcact

SEQ ID NO: 2750 - DNA, 657 bp, Phyllotreta atra
ctcgaaaattctatcgcagcacaaagaacacttcgcgaagctcgccgtggacgccgtgctgagattgaagggctctggtgatttgcaagccattcaattgatcaaaaaaaccggaggaactttgcaagaatcgttccttgatgatggtttcctgctcgataagagacctggcgtacaccagcccaagcgagtcgagaacgctaagatcctgatcgccaacactccgatggacaccgataaaatcaaggtattcggctcgcacatcaaagtcgactcgatggctaaaatcgccgaattggaatccgccgagaaagataaaatgaaggacaaagtcaacaaaatcctcaagcacaacgccaacgtattcatcaaccggcaactcatctacaactatcccgaacaattgttcgcagatgccggtgtaatggccattgaacacgccgatttcgatgggatcgaaagactggcgctggtcaccggaggagaaatagtctcaactttcgatcacccggagctcgtgaaactgggaacttgcgatctgatcgaacaaatcatgataggagaagatactctcctgcgtttcagcggtgtggccttaggtgaagcctgcacgatagtcattcgaggagccacccagcaaatcatagacgaggcaga

SEQ ID NO: 2751 - DNA, 656 bp, Phyllotreta atra
gccgtcataatagccctaaaacgggcctcgtccgaactatccgcttaccaaaagaagatcattcaaatcgacgatcacatcggcatcaccatctcgggcctaacggcggacgcgagaatcttgagcagatatatgcgcaacgaatgtttgaactacaagtactctttagacgcttacatgcctttgaatagattaattaacatcttaggtatcaaaatgcagcactgtactcaacgatacgatcgcagaccgttcggcgtgggtctgctagtagccggctgcgacgacaacggggcccacatataccaaacgtgcccctcggcgaatttctacaattgcaaggccatgtcgatcggggcgcggtcccaaagcgctcgcacctatctggagaagaagctcgacgagttgccgtcgtgttcgctggaagatttgatcaagcacggcttgagggctctaagagacactctgccgccggaggtggatttgaatacgaagaacgtgtcgatcggttacgtgggcaaagggattacgtttaagatattggaggaggaggagacggctccctatttggctttgatcgagggcgaggagcgtagaggaggcgctggtggtggcggcggtagttccgaaggacaggccgatcctttgagggaatc

SEQ ID NO: 2752 - DNA, 658 bp, Phyllotreta atra
gtaaataatgccttcgagcgttcgttggtgttcatgcacaagatgcctcgaatttggatggactattgcacgtttctcacagatcaatgcaaaataacgagaacacgaaaggtgtttgacagggctctgcgagccctgcctgttacgcagcacaacaggatatggcctttgtatctgaagttcgtgcagaaacacgatatatcagaaactgctgttcgagtattcagaaggtacatgaaattgtgtcccgaaaacgccgaagaatacatagattacttaacaaaagtagaaagattagacgaagccgctataattacagctaaaatagtaaacgacgataacttcgtatcgcaacagggcaaatcgaagcatcaactatggaacgaactgtgcgaattgatttccaaaaaccccgaaaaagttcgctctctaaacgtcgacgccatcatcagaggcggcctgcgcagatacaccgaccaattgggccacttgtggaactctttggccaattactacgttcgcagcggcttgttcgaacgggctagagacatctacgaagaggccatacaaaccgttacaaccgttagagatttcacacaagtgtttgatgcttatgcgcaattcgaagagttaagtttgagcaaacgaatggaagaag

SEQ ID NO: 2753 - DNA, 656 bp, Phyllotreta atra
gcggtttagacgacaaagtatcggaatctctgctatgggaactcttcgtgcaagcggggccgttagtgaacgtacatatgcccaaagatcgcgtcacgatgatgcaccagggctacggcttcgtcgaattcatgggcgaagaggacgccgattacgccataaaaataatgaacatgataaaattgtacgggaaacccatacgggtcaacaaggcgtccgctcaccagaagaatttggacgtcggagcgaacattttcataggcaatttggacccggaagtcgacgagaaactcttgtacgacacgttttcggcctttggcgtcatattacaaacgcccaagataatgagagatcccgagactggtaattccaaaggcttcgcgttcataaacttcgccagcttcgaggcctcggacgcttccatcgaggcgatgaacggccaatatctctgcaatcgacccatatccgtatcgtacgcgttcaaaaaggattccaaaggcgaacgacacggctcggcggccgagcgattgttggccgcacagaatccgctatcgcaggccgacaggccccatcaattgttcgcagacgcccctccgattggaatgatgccgatgagcatggcgccgccaccgccgcctctaatcaccggcatgatg

SEQ ID NO: 2754 - DNA, 639 bp, Phyllotreta atra
ccaagctccgttacttagatttctccgaaaggcatggctacatcaagggtgttgtgaaagacatcatccacgaccccggtcgcggcgcccccttggctctagtgcacttcagggacccctacaagttccaaactaggaaggaaatattcatcgctcccgagggcatgtacacagggcaattcttgtactgtggaaagaaagctaacctccaaattggaaatgtgttgcctgtaggaacgatgcctgaaggtacaatcgtctgtaatttggaagaaaagactggtgaccgtggccgattggctcgagcatccggtaactacgcaaccgtgattgcccacaatcacgatacaaagaaaactagagttaaattgccatcaggagctaagaaagttatccccagcaacaacagagctatggttggtatcgttgctggtggtggtcgtatcgacaagcccatcctgaaagccggtcgtgcctaccacaagtacaaggtgaagcgtaactgctggccgaaggtgcgtggtgttgccatgaaccccgtcgagcatcctcacggaggtggtaaccaccagcacattggtaaagcgtccacggttaagaggggaacgtccgctggtcgtaaggtgggtcttattgctg

SEQ ID NO: 2755 - DNA, 285 bp, Phyllotreta atra
aacttgctacgaaggctgcgcgtaagtccgcaccggcgaccggcggtgtgaagaagcctcatcgctaccgtcctggtaccgtggctttacgcgagattcgtcgctaccaaaagtcgactgaactgcttattcgtaaggctccgttccagcgccttgttcgagagatcgctcaggacttcaagacggatttgcgtttccagtcgtcggccgtgtctgccttgcaggaggcatcggaagcatacttggtcggtctttttgaagacacgaacttgtgcgctatacatg

SEQ ID NO: 2756 - DNA, 733 bp, Phyllotreta atra
ggctgatctccttactgatgtctgcgtcgaggccattctcgctatcaaacagtccgacaaaccggtcgatttgcacatggtggagctcatggagatgcagcacaagaccgagacggacactcaactggtcaaagggatagtgatggatcatggtgctcgacaccctgatatgccgaagagcttgaagaattgctacatccttacatgcaacgtgagcatggagtatgaaaagagcgaagttaattccggtttcttctacaaaaccgccgaagaaagggagaaattggtgttggccgagagagatttcatcgaacagcgagtcaagaaggtggtcgagttgaagaaggccctttgcaacggcacaaacaaatcgtttgtcgttataaaccaaaaaggtattgacccgatgagcttggacatgctggccaaagagggaatcgtggctctgcgaagggccaagagacgtaacatggaacgtttggctttggcatgcggtggaatagccgtgaacagtttcgacgatttacaggaatctcacctcggttacgccgggcatgtatacgagcacgtcctgggcgaaagcaaatatacgtttgttgaagattgcaaagttccccaatctgtgacgatcttaataaaaggacccaacaagcacactttgatgcagatcaaagacgccgttagagatggcttgagagctatcaataacgcaatcgatgacaaagcgcttata

SEQ ID NO: 2757 - DNA, 652 bp, Phyllotreta atra
ttcgatcaccccattcaattgcatctcgctttctccaccctacacaagttcgtggagaagaccggtcgattgccgaaaccctggaacaaagacgacgccaccgagttcatcgctttggcgaaatcgttggccgtaaacggatctacggataccgaagtcaacaccgatatcctcaacattttctccaagtgttgctcaggcgatcttaaccccatcaatgctacgatcggaggtatcgtggcgcaagaggtcatgaaagcctgttcggggaaattctaccccatctaccaatggttgtacttcgatgccatcgaatgcctgccccaggacaaggaggagatcactgaggaactcgctgcccccgttgatagtagatacgatggacagatcgctgtgttcggaaaagacttccaaaagcgattaggtgaactgaaatatttcatcgttggtgccggagcgatcggttgcgagttgctgaagaacttcgccatgatgggaataggcacgcaaggcggtcaagtcaccgttaccgacatggatttgatcgaaaagtcgaatttgaataggcaatttttgttcaggccccacaacgtccagcaacccaaatccgctaccgctgctaaggtaattaagaagatgaatcccgacgtta

SEQ ID NO: 2758 - DNA, 695 bp, Phyllotreta atra
tagctgattgtggtttcgaacacccttcagaagtgcaacacgaatgcattccccaagcagtaatcggcatggacatcctctgccaagcgaaaagcggtatgggtaaaacggcggtcttcgtcctagccacactacagcaactcgaacccaccgaaaacgtcgtctacgtgctggtgatgtgccatacgcgcgaactggccttccaaatcagcaaagaatacgagcggttcagcaagtacatgtccaacatcaaagtcggcgtgttcttcggcgggctgcccatccaaaaagacgaagaagtattaaaaaacagctgtccgcacatcgtcgtcggaacgcccggccgcatcttggccctcgtcagatcgaagaaactcaatctcaagcacatcaaacactttattctcgacgaatgcgataaaatgttggagctacttgacatgagacgcgacgttcaagaaatatacagaaatacgccgcacgagaaacaagtaatgatgttcagtgcgacgctcagcaaagaaattcggccagtttgcaagaaattcatgcaagatcccatggaagtgtatgttgacgatgaagcgaaattgacgttacacggtctacaacaacattacgttaagcttaaagagaacgaaaagaataaaaaattatttgagttacttgatgtgttggagtttaatcaggtggtg

SEQ ID NO: 2759 - DNA, 654 bp, Phyllotreta atra
gttcttgtactacttgggcaggatcaaagcggcgcgattggagtacagcgtggcgcataagcatctgatacaagcgatgcgcaaagcgccccagaacacggcgatcggcttccggcaaaccgtacaaaaactaacggtcgtggtggagttgctgttgggggatattccggagaggcagatattccggcaggcgagcatgcggcattcgctcgccccgtatttccagttaacgcaggccgtgagaatggggaacttgcaacggttcggggaggtgttggagaatttcgggccgcaatttaggctggatcatacgtttactctaatcctgcggcttcggcataatgttataaagacagctatcagatcgattgggctgtcgtattccaggatatccccacaggatatagctaagaagctggggctggattcagccgaggatgcggaattcatcgtagcgaaggctattcgagatggggttatcgaagctactttggacccacaaggggggtacatgaggagtaaagagagtactgatatctactgtactaaagagccccaactggcttttcatcagaggatatcattttgtttggatttgcataatcagagcgttaaggctatgagatacccgccgaatgcgtatggaaaggaact

SEQ ID NO: 2760 - DNA, 723 bp, Phyllotreta atra
gtatacgagaagatacggccaaatatttgagaaatttggatcccaactcggcgtactacgaccccaaaaccagatcgatgagagaagatccgaacgctggaatggacgctacataccatggggaaaacttcgttcgtttctccggagatactacgaatcacgccagagcccagctgttcgcttgggaagcgcacggtaaaggagtcgacgttcatctactagcagaacctacgaaattggaattactgaagaaggaatacgagaagaagaaggacgaagtgaagtcgaatattcagggtacagtattagagaaatacggaggtgaagaatacctcgaagcgccgccgaagagtttgttgttagctcaaactgaaaactacgtggaatattcgagatcgggtaaagttatcaaaggtgccgaaaaagaagttattagatcgaaatacgaagaagatgtttacattaataatcacacgtcagtttggggttcttattggagtgggggacattggggttatcgctgttgccattctttcattaagaattcttattgtttgggagaatcgggaaaattagtgaacgctcaacctacggcagaattaataactaatgatgagcctaaagaggaacagagtcaagaagatgataaggttgaagcattagaaaaagaaagcgaagaatctgaatctagcagttcatcggacgatgaaaaatccaaagcga

SEQ ID NO: 2761 - DNA, 472 bp, Phyllotreta atra
aggaagttcgaattaggtcgtccggcggccaacacgaaactaggaaccagaaggatccactatgttcgtacaaggggtggcaacttgaagtaccgtgcgctaagattagacactggaaacttctcttggggaagcgaaggaactgcccgtcaaacacgtattatcgatgtcgtttacaacgctagtaataacgaattggtgcgtaccaagacgttggtaaagaacgctattgtcgtcgtcgacgctaccccgttcagacaatggtacgagagccactacatcttaccgttgggacgcaagaagggtgctaagatgacgcctgaggaggaggagattttcaataagaaacgtagcaaaaaagtacagaagaagtacgaaactaggcaaaaaaccgctaaagtagagcctgcgattgaagaacaattccacactggaagattgttggcatgcctagcatcaagacctggacaat

SEQ ID NO: 2762 - DNA, 710 bp, Phyllotreta atra
gtcatgggtcttatgctaggtgaattcgtcgacgattacacagtgagggtcatagacgtgttcgccatgccccagacgggtactggagtgagcgtagaagccgtggatcccgttttccaagcgaaaatgttagatatgctacggcaaaccggccggccggagatggtggtcggttggtaccattcccatccgggtttcggctgctggttgtcgggagtcgatatcaacactcagcagagcttcgaggccctctccgagagggcggtggctgtagtcgtcgatccgattcaatccgttaaaggaaaagtcgtcatcgatgcctttaggttaatcaatcctaatatgatggtgttggggcaggaaccccgacaaacgacttcgaatttggggcatttgcagaaaccgtccgtacaggctctgatccacggtttaaatcgccactactactccataagtattaactacaggaagaacgagctggagcagaagatgttgctcaatttgcacaagaaatcctggatggatgggttaacgttggctgattattcggagaattgcagcgttaacgagaaaaccgtcgccgatatgttggaattggctaagaattacaacaaagcgttggaggaagaggagaaaatgacaccggaacaactcgctattaagaacgtgggcaaacaggctaccaagaggcatttggaggagaaagtgga

SEQ ID NO: 2763 - DNA, 691 bp, Phyllotreta atra
tggtcaaacccatggataagaagaaagtactggtgaaagttcacccggagggaaaatttgttgttgatatcgacaaaaatatcgacattaatgacgttacgccaaattgtagagtcgctctgcgaaatgaatcgtacactttgcataagattttaccgaataaggtggacccgttagtgtctcttatgatggtagaaaaagtaccagattcgacttacgaaatggtgggtggtttggataagcaaatcaaagagatcaaagaggttatcgaattgccggtgaaacatcctgagctctttgatgctttaggtattgctcagcccaagggtgtgttgttgtatggacctccaggaactggaaaaactcttctggctagagctgtagctcaccacacagaatgtacgtttattagagtatcaggatcggagttggtgcaaaaattcatcggggaaggttccaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaagctacgaagaacattaaagttataatggctacgaacagaatcgacattttggatcccgctttact

SEQ ID NO: 2764 - DNA, 450 bp, Phyllotreta atra
gttgaagtctgctttcgatttacaaagtttcagttttttccaaaggggatctgtacaggagtttatgtcattcttttgtaagactatcgtggaaaggactataccatcgtccaggcaatccgtcaaagaaggagaatacatgtgtcatgtttatgtaagacatgataacttggccggtgttgtaatatcagatcacgaatacccgtctagggtgtcgcatacgctgatcacaaaaattttggacgaatttgccgctaaaataccagctgtgaattggcctaccttgcaagagagagacgtggcgtttccacagttgaacacatacctggccaaataccaaaaccctaaggaagccgatgcgatgactaaaatacaagaggaccttgacgaaaccaagattattctgcataatacgattcaagctgtcctggaaagaggggaaaagttgga

SEQ ID NO: 2765 - DNA, 604 bp, Phyllotreta atra
tggaatatgccattgaagctattaaattgggatctacagctatcggaatatgcactagcgaaggggttgtgctagcagtcgaaaagcgtattacttctccattaatggaacccactacgattgaaaagatcgtagaagttgataaacacatcggctgtgctgtttcggggctcatggcagattcacgtacaatgatcgatagagcaagagttgagtgccaaaatcattggttcgtttacaacgaaaacatcaccatcgaatcgtgtgctcagggagtatcgaacctagccattcagttcggagattcggatgatgatggtgctgctatgtcgaggccattcggtgtggccatcttgtttgctggcatagacgaaaaagggcctcaactctaccacatggacccatcaggtacatttgttcagttcgatgcgaaagccataggatctggttcagagggcgcacaacaaagcttacaagaagtatatcatcgtagcatgactttagaggaagctaccacagcagcgttgactattctcaagcaggtcatggaggagaaattgaactcttctaatgtagaagtcatgacaatgacgccaaaggatat

SEQ ID NO: 2766 - DNA, 737 bp, Phyllotreta atra
gaggttcttgaagaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggacaaatcgatgccgatcttaagaccaagtcgtcagcgtacaataacttaaaaggcagtcttcagaatttggagaaaaaacaaacagggagtttgttaacccgtaacttggcagatctggtcaagaaggaacactttattttagattctgagtacttgcaaacgctgctcgtcatcgttcccaaagctcagttcaatgagtggaacgccacttacgaaaagatcacggacatgatcgtccctcgttcgtcggagttgatcattcaagaccacgactacggcctgttcaccgtgtcgctcttcaagaaggtggtcgaggagttcaagctgcacgccagagagaagaagtttatcgtgcgagatttcacgtacaacgaggaggaactggcggccggcaaaaacgaaatcaccaagctcgttaccgacaagaagaagcaatacggtccgttggtgagatggttgaaagtcaacttcagcgaatgcttttgcgcttggatacacgttaaagcgctgagagtgttcgtggagtccgtgttgagatacgggttaccagtcaattttcaggctattctgatccatcc

SEQ ID NO: 2767 - DNA, 719 bp, Phyllotreta atra
ctcgatgtaccccattaaggcggtgaacgtgttaaaggctcacgggaaaagcgccagggagagtttcctagtggccggctacgccttgaactgcactgtcgccagccaagccatgcccaagaagatcgtcaacgccaaaatcgcctgtctggatttctcattgcaaaaggccaaaatgaagatgggcgtgcaagtgctgatcacggaccccaatcaactggagggcgtcagagccagggagctggacatcaccaaggagcgcatccagaagatcctggccaccggcgtcaacgtggtgctgctgtccggcggcatcgacgacgtctgtttgaagtacttcgtggagcgcggcgccatggccgtgcgccgcgtcaagaaggccgatttgaagcgcatcgccaaggcgacgggggcggcgttcgtcacatccttgagcaacatggagggcgacgagaccttcgattccaatatggttggtgaagccgccgaggtagtgcaagagaggatttccgatgatgaattgatcgtcattaaaggccccaaggctcgcacggccgcctcgatcatcctgcgaggccccaacgatttctactgcgacgagatggagcgctccgtccacgacgccctctccgtggtgaaacgcgtactggaatcgaagagcgtggtggcgggaggcggtagcgtggaggcggcgctctccatctacctggagaacttcg

SEQ ID NO: 2768 - DNA, 684 bp, Phyllotreta atra
gccttctataacttcccaggaacagaatggaaacctgtatcacatccaataactcatacccaatctccagtaacaacttcaacctcaattgtatctataacctacgataagggagtactaatagccggagacttgctggcctcttacgggtctttagccagatacaaaaactgccctagggtaatcgaaattaacccaaacatcatcctaggcgctggaggagactacgctgatttccaatacgtcaaaagctttatcgagcagaaaataatcgatgaagattgcctagatgatggctggaaaatgaaaccgaaatctctttattgctggctaactaggattaggtaccaacgaaggagtaaactcgacccgttctggaacaatctagtagtcggaggaatccaagatggagtacctttcctaggaacagtcgataaacttggcactgcgtacacagataaagtaatctgtactggttacggggctcatattgcccttcctgtcttgcgggatgccctcgacaagaagccgaatttacatctaaatgaggctaaggctctaattaaaaagtgcatggaagttttgttctacagagacgcgagaagttacccgacatatcagttgggtataatcgatatggatgatggtgttaagatcgagggaccgatttctgtcgaggagaat

SEQ ID NO: 2769 - DNA, 760 bp, Phyllotreta atra
tccgaattgcaaaatcttcgcagaaaaatccaagggctctccgaagaaactagctctaatttgaagaaaaatgtttacgaaaactacattcaatttatcgaaaccgcgaaagagatttcacatctcgaaagtgaaatgtaccagctttcccacttactttcagagcaaaaggccttacttaattgtctatcagccacctcgatactagaagatgtccaacctgttaacatcgagagagataataaagtaaacgaaaaggatattgaagaagaaaataaacaaaaaatagctgctatattagaaaaagtagaaggttgtcaggaattgttaaaagtgccagggagaatttttttgtacgaaggagatttattagaaatcgaacccaccgaaaacactgctttaaaaatagttcatgtttatttattcaccgatagctttatgataaccactagaaattcaaacagtcgaggcctcatgaaatacatctacgaaagcatatacgacctaagcagcctagcagtcgtgaacgtaagagatttgggaaacgttaaacacgcctttaaacttctcattttccccgataccagagttttccaatgctcttccaactccaataaaaaagaatggttagacaagttcgatcaagccaagaagacccggctagcccaagaacaacaaaaaagggaatccatatcggaaaaatcccccacccgcgtttccttcgagtcccccagctacaatccctttgatgaagtggaag

SEQ ID NO: 2770 - DNA, 789 bp, Phyllotreta atra
cccaaagatgaagatggtgaagctgatattgaaattgaattggtcgaagatgagccaccatttttacagggtcatggtagagctcttcatgatttaagcccagtgagaatagttaaaaacccggacggttcgctagcccaagctgccatgatgcaatcggccttggccaaagagagacgcgagcaaaaaatgctgcaaagagaacaggaagtggattcccagccgtctggaaagaacaaaaactggatagatccccttccggaagaggaatctaaatcgatggcaagaggaatcggtctgcaaagtcaagatttacccgaatggaaaaaacacgttatcggtaattatttctcgatcacacaattaatttcgaagtttgtactaaacaacattttaggtggtaaaaagtcttcttttggtaaaaaaaccaacttaacgatcatcgaacaaaggcagtctcttcctatatacaaactcaaagaggagttacgaaaagccgtaacggataatcaaatactgatcgttatcggtgaaaccggttcaggaaaaaccacacaaatcacccagtacttagccgaagccggtttcacagccagagggaaaattggctgtacacaacccagaagagttgcagccatgtcggttgctaaaagagtggccgaagagtttggttgtagattaggccaagaagttggatataccattcgattcgaagattgcaccagtcccgaaacgatgatcaaatacatgacagacggtatgttgcttcgtgaatgcctgatggatttg

SEQ ID NO: 2771 - DNA, 715 bp, Phyllotreta atra
aaaccgactttaagggatccgaacccctatgcagagtagttcgaattaatcactcgggaaaaatattagctactggaggaactgacggcgacgtaagactttggaaattccctacgatgcagccattgtccattctcaagggacatacgaaggaaatagacgatatagatttcagtaaattcgataatctcatcataactttagcgaaggacggtttggctattttgtgggacgcccaaacgggtaaattgaaatcgaaactgacatggaacactccagagggatcgaaatatttgtacaagagatgcaggtttggcgttatcgaagatcaaaagaataagtgcatgctatacatgatagcgaatgcgactaattcgaagcaaaaatcgtttctacaacaatggatacctgaggagaatactttaaaaaagttctcggaatttaatgaaacactgtccgcacttgcagttagagacgatggacgatttgttgctgtcgggacaatgttcagcggttctgtttcgattcacattgcatttagtttacagaaaatattagtagttgtcggtgctcattcgatgtttgtaactggtctggaattcctatctcatgaaaatactaatcattccataagtagtgtcgcagaggccgctgtattgtctatttcggtggataatcagctttgtatacactcggtgccatacagacgaagtat

SEQ ID NO: 2772 - DNA, 711 bp, Phyllotreta atra
ccttgttaaaagagctgcagaaactggacgacaaaaacctgctggtcgaagtgcagctgctcgaaagcaaaacatatcacgctttaagcaatttaccgaaagcccgggccgctctgacgtccgccagaacgaccgccaatgccatctattgccctccgaagatgcaggccgccctcgacctgcagtcgggcgtgctgcatgcagccgacgaaaaggatttcaagaccgcttactcctatttctacgaggccttcgagggtttcgacagcgtcgagtcccccaaagctcggaccgctctgaagtacatgcttttgtccaaaattatgatcaatagtcctgaagatgtacagcaaattgttagtggaaaattagccataaagtatgcaggtaaagatatcgaggccatgaaagcagtcgcacaagcagcccacaaaagatctcttgcagattttcaactggctgtaaaacaattcaaacacgagctggaagacgacgttattgtaagagcacatttaggaacactctacgacaatatgttagaacaaaatttatgcaggatcatggaaccttactcacgtgtccaagtagaatatatcgcaaagacgattaagcttcccgtgttacaagtagagaagaaactgtcgcagatgattttagatgccaagtttcatggaattttagaccagggtgatggtgtcctgatagtgtttg

SEQ ID NO: 2773 - DNA, 752 bp, Phyllotreta atra
cgagcagaaaatcaagaacctgcaggccgccgccgaccggcatcaatccaccgcctccggcgctctcgacgagctgagacaggttcgaacgaggatcgacaccttctcgtcgaggatccaggacctggagaaccagaaccagggtctggcagctagaactagggatttggagaagttgctcgagaacgagcgcattcgtcacgccgaagacctagcgttagtagagagggaattgcacaggatgcgcgaggaaatggcgactcaactgcaagagtaccaagacttgatggacatcaaagtgtccctcgatttggagatcgccgcctaccgtaaactgctcgaagcggaagaagctcgattgaacatcacgccaacaggcggtgaccacgaggtgcaccaaaggagctcctctcaacgccggacgccggtgcgactgggggccaagaggaaacgggccctgctcgaggagacgcaggagtcgagcatgtcggactacagcgtgaatagttcgtctaaaggggacattgaagtggccgcagtcgatccggacgggcagtttgtgagattgcacaacaaaagtaaccaggaggtgccgctcagcggatggcaggtcataaggcgggcgggcgatgaggagactttctacaaattccacagaaccgttaaagtagagggaaatggtaccgtaaccatttggagttctgatttaaataaggatcacgaaccccctagtaacctggttatgaaagggc

SEQ ID NO: 2774 - DNA, 767 bp, Phyllotreta atra
ctgagaatccacaccaagaacatgaagttggccgacgacgtcgatttggagcaaatcgcggccgagactcacggtcacgtgggcgccgatttggcctcgctctgttcggaagcggcgcttcaacagattagggagaagatggacctgatcgatctcgaagacgatcaaatcgacgccgaggttctcaattcgctggccgtgaccatggagaacttccgctacgccatgacgaagagcagcccgagcgctctgcgcgaaaccgtggtcgaggttccgaacgtcacttgggacgatatcggcggcttggcgaacgtcaagaaggagttgcaggagttggtgcaatatccggtcgagcatcccgataagttcctgaaattcggcatgcagccgtccaggggagtgctgttttacgggccgcccggttgcggtaaaaccctgttggccaaggccatcgctaacgaatgtcaggccaacttcatatccgtcaagggaccggaattgttaaccatgtggttcggtgaatctgaagctaatgttagagacattttcgataaggccaggtcagcagctccttgtgtactgttctttgatgagttagattcgatcgctaagtcgagaggtggaaatgtgggagatgccggcggcgcagccgatagggtgattaatcaaattttaactgaaatggatggtatgggagctaaaaagaacgttttcataattggtgctacaaatagaccagatattattgatcccgctatattacgtcc

SEQ ID NO: 2775 - DNA, 659 bp, Phyllotreta atra
gcgacttgatagatttagtgccaagtctctgcgaggatctcctttcgtccgtggatcaacctttaaaaatcgctaaagacaaggattcgggcaaggattttcttttatgtgattacaatagagacggggattcttacaggtcaccatggtcgaatacctactatcctccattagaagacggttcgatgccctccgagaggctaaggaaattagaattagacgccaatttagcgttcgatcaatatagagaaatgtatttcgaaggcggcgtatcttctgtttatttttgggacttggatcacggtttcgcaggtgtaattttaattaaaaaaaccggcgatggtagtaggaaaattaaaggttgttgggattccctgcacgtggtggaggtacaagagaagagttccggaaggaattcccactacaaaatgacgtccaccgccatgctgtggctgcaaaccaataaacaaggctcggggaccatgaatttgggcggcagtttaacccgacagatcgagaatgatgcggccgtgaacgacatcaatccccacatcgccaacatcggtcgaatggtggaagacatggaaaacaaaattcggaacacgttaaacgaaatctactttagcaaaaccaaggacatagtcaatagcttgaggtcg

SEQ ID NO: 2776 - DNA, 792 bp, Phyllotreta atra
tcaggatttcaacacgatgttcacgaattgctacgtctacaaccagcccggcgaagatgtggtggtcatggcccaaacattagaaaaagtatttttaaccaaagtggccgacatgcctaaacaagaatttgtcgttgatatgccgatgaaaggcgccaaaggcaagaaagggcgagttagcgtcggtggcgtcggtggcggcggcggcggcggcagcacgccatcctccagcggcccggtaccagcagctatagtaccaggaggtgtcagaggcaggccgcccgcgaccgtatcctctaccagtaccacaccgattgcgaccactaccggttcgtccggcttgccgttgggcacccaagcgcccgcgacgctgccgggcagtaccgccaccacgacgatagcgccggccaacaacaacaacagctctctgacgccgcagcagctcggcacgcccgtcagctcgatgcacggcacgccgggggcgccgctgtcgaattccctcgatcccaccggaggagtgctaccctctaacgtcatgccgccggcgcaaccagccaaggtaaaaaagggcgtgaagagaaaggccgacacgacgacgccggcgacggcctacgattatccgacggtgttggaatcgaagtcggcgaagatttcgacgcgccgagaatcgggcaggcagatcaagaagccggcgcggcgggaaatcgaccttcacgtacctcagccggcgatccacaagcccaacgacaagttgtcggagtcgctcaaggcctgcaatgaaatcctcatgga

SEQ ID NO: 2777 - DNA, 681 bp, Phyllotreta atra
tttaaggccccaattagaccagatgtcgtcaatttcgttcatcagcaggtctcaatgaaccatcgccagccttacagcgttagcgacaaagctggacaccagacctccgccgagtcgtggggaaccggtcgcgccgtggcccgtatacctcgtgtacgcggtggcggtacccaccgatccggtcagggagccttcggcaacatgtgtcgcggcggtcgcatgttcgcgcccaccaagccgtggcgccgctggcacagacgcgtcaacatcaaccagcgtcgctacgccctggcgtcggccgtcgccgccagcggcgtcccagctctggtcatgagcaaggggcacgtggtcgatcagattcccgagctgccgttggtcgtcagcgacaaggtgcaggagatgcacaagaccaaggaggccgtgcagtttctgaggaggatcaaggcttgggctgacatccagaaggtttacaagagccagcggttccgtgccggtaaaggaaagatgcgtaataggagacgtatccaacgtaaaggaccactcatcgtctactacaaggatcaaggtcttcgtcaagctttccgtaacatcccaggcattgaccttatcagtgtccaaaagttgaacttgttgaagctcgctcctggcggtcacgtaggtcgattcgtgatctggactgaa

SEQ ID NO: 2778 - DNA, 650 bp, Phyllotreta atra
cgaggaagaggaagaagatgacgaagaaaaaattagagaagaattaaaagatctaatcgacgataatccaatcgaagaaagtgatgctgaatccgatgcttcaggtcgtgagaaaagaaaaaaatctgatgacgaagacctcgatgatcgattggaagacgaagattacgatctgttggaagaaaatttgggtcataaagtagaacgaaggaaattcaaacgtttacgccggtttgaagatgaagaaagcgaaggggaagaagaacatgatcccgaccaggatcgcgaacaaatcgctatggacatattttccgacgatgacgaagaaagaaggtcggaaagaagccaaagaccggtcgtcgagcaagaatctttcggtgtaggcgaagaagaagaagaaggcgattattcggacgccgatgattttattgtagacgacgacggcagaccgttaatcgagaagaagagaaagaagaaaccgattttcaccgacgccgcgctgcaagaggcccaagaaacgttcggcgttgatttcgattacgacgagttcaccaaatacgatcaagacgaatacgaggacgaggaggacgaagaagaggacgaatacgaagaagatgacaacgaacgaaggaaacatccgaagaaagctg

SEQ ID NO: 2779 - DNA, 724 bp, Phyllotreta atra
gtagctcacttggtaaaccaacgggtggctcatgagatactggcgctcgaaatactgactttgctcgtcgaaactcctactgatgattccgtggaagtggctatttcttttctcaaagagtgcggacagaagctcacggaagtctcgagtaaaggaattactgccatattcgagatgcttagaaacatcctgcacgaaggccagctcgagaaaagaatacagtacatgatcgaggtgatgttccaaattagaaaggacggctttaaagatcacgccgctgtaaccgaggaattagatttagtagaagaagaggatcaattcacccacctaatcatgcttgatgacgtaaaggaggttaacgctgaagatattctaaatgtattcaagttcgatgaacattacgaagaaaacgaaggcaaatacaaaactctgagtaaggaaatcttgggaagcgatagcgaatcggaatcgggatcggagggatccgaagaggaatcggagggcgagggcgaggacgaagaagtcaaagatgccgggaaaatcatcgacaataccgaaacgaatctaatagcccttagaaggacgatatatttgactatacaatccagtttggatttcgaggaatgcgctcataagcttttgaaaatggagttaaaacctggacaagaaatcgaattatgccatatgtttttagattgttgtgccgagcaaaggacatatgaga

SEQ ID NO: 2780 - DNA, 712 bp, Phyllotreta atra
cccagacactttccaatgtagttacgatccttcctttgctgccgcacgaaatgcgaatatggaaagaatggccgaacagattgcaacattgtgcgccactttgggggaatacccgcacgtccgatataggagcgactgggaacgtaacgtagagttggcgcaattgattcagcagaaattggatgcttacaaagcggacgagccgaccatgggagaagggccggagaaggcccgatcgcaattgctgatcttagaccgaggcttcgattgcgtgtcacctttactccacgaactgacgttccaagctatggcctacgatttacttccaatcgaaaatgacgtgtacaaatacgaggcttccgctggggtacaaaaggaggttctcttggatgaaaatgacgagctgtgggtggagttgcgccatcaacacatcgccgtggtatcccaaagcgttactaagaatttgaaaaagttcaccgattcgaagcgcatgactcaaagcgataaacaatccatgaaggatttgtccactatgattaaaaagatgccgcaatatcagaaagaattatcgaaatacgctactcacttgcatcttgccgaggactgcatgaaggcctaccaagggtatatcgataagttatgcaaagttgaacaggatttggcaatgggaactgacgccgaaggggagaaaattaaagatcacatgcgcaac

SEQ ID NO: 2781 - DNA, 697 bp, Phyllotreta atra
acaagcagtaataggcacaagggcaaacattaacatagcacaaatagaaaattatggcggcgagactttcttatctgaggaattggcaatcatgatccttcaagatactaaacaagcttttcaacgttgcttattgttatcaaaaggtagtgaaagggcttccaacgccactcaaattttagacaggcttattaatagtttgctgatagaacatgtagactatgcagttgaattgggtctacacgctgtacccgttgtcgaaggcgttagaaatccccctgttttgtatttttttaacatcgttcatcagagtaataatataacccatctcgtcgagaaacagttcatggatttggtggttccattagtagaaaatacttcgaaatatagcgattgcgtacagaagaaaaaatttgttttggaggatatagaaagaaaaattaatacgggattggatagatgcttgagtgcgatattaaattgggtgaagttgtatttacaatctgaacaaaagaaatcggattttaagccagagtctgatgattttgatacagtggcctcaccagcctgcaagaacgtacttaattatgttaatagtattgtcaaagaaattaaaactaatttggatggcaataatgtaacagctatccttcaggagttagggattagactgcatagagttgtttacgagcacttg

SEQ ID NO: 2782 - DNA, 653 bp, Phyllotreta atra
tagaaaccatcgatctgcagaaagacccctatttcatgaaaaaccacctggggtcttacgaatgtaagctttgtttgacgctacacaacaacgagggcagctacttggcccatacgcaaggcaaaaagcaccaagccaatttggccaggagggcggccaaggaagctaaagacgcccccacgttactccaaccggagaagcctcgagtggagcccaagaagttcgtgaaaatcggtagacccggttatcgggtaaccaaacaaagagaccccgaaactggtcaacagagtttactgttccaaatcgattatccagaaataagcgacttggttctgccccgacaccgcttcatgtctgcgtacgaacaaaaaatcgaaccccccgaccgtaaatggcaatacctactcttcgctgccgaaccgtacgagaccatcggcttcaaagtgccgagcagagaagtggaaaaaactgacactaaattttggacgcactggaacagggacaccaagcagtttttcctgcaattcgcctttaagaacgagaacaaacgcaacgttaactcggtagttcaaaggcattcgatcgttggcggcgttccaccgcctcccatgctgccggtaccgccgccacccaggcctcctatgtttaatccc

SEQ ID NO: 2783 - DNA, 253 bp, Phyllotreta atra
taacctgcgaaacgataaccggcgaagtttacaggggtaaacttatagaagccgaggataatatgaattgccaaatgacccaaataactgtaacttacagagacggacgagtggcgcaattagaaaacgtttacattagaggttccaagataaggttcttgatattaccggatatgttaaagaacgctccgatgtttaaaaaacaaaccaaagctggcactgctggcagagggaagtctgcaattctacgagc

SEQ ID NO: 2784 - DNA, 794 bp, Phyllotreta atra
tattcgcaacattcagcaactaggggccaatttaacggccacttccgatagagaaactatctgctacacgttggaaggcaccccggaagctgtggaatgcgctataccattcttaaccgaagtagccacccaacaggaattcagaccgtgggagatttccgaattgtccggtagattgcagttggacattgctacaagaccgttgcagttgagagctatcgatttgctgcacaacgctgcctttagaggacgcggcttgggtaattctctatttattccgaaaactcaaatcggtaaaatttcgtccgaaaccctacaacactacgttgcctcgaacttcgtgagcggccgcatggccgtagtaggctcaggtatctgtcaaaaggaactgacatctttcgcaaactccttgaaaattgaaaatggcgaaggcaacaacgctccttcaccttacgtaggaggtgaactaagatcgaacaaaggcggtcaactagcattcattgctgtagcaggagagggtgctgctatcacgaacaccaaggaggctctggctttcgctgtgctgcaaggagccttaggaggaggcccgcaggttacacatggagtttgtgacaacggtgtcttcaggaaggctctgggaagcaaccccaatgtcagttcagtggccataaacgccagttactcagacacaggtctctttgggcttctgctggctgtaccaacgaagtctgcaggaggtgctctggaagcagctgttaaagtgctcaagagtggatcggtgtctgatgaagatg

SEQ ID NO: 2785 - DNA, 197 bp, Phyllotreta atra
tgatcggatgactaacgaactacaagagaaaatcggagccctaaaatccctcactattgatataggaaatgaggttaaataccaggacagaatgctcagggatgtcgatgacgatttggagaaaaccggaggcttcctgggaaccaccatgaacaaagtgttgaggctgtcgaaagggggccacaattacatcattg

SEQ ID NO: 2786 - DNA, 705 bp, Phyllotreta atra
cgttggtaatcctcgaagatgtcaaatttccgaaattcaacgaaatcgtccagctcaaactggccgatggcagtctacgatccggtcaagtattggaggtgagcggctccaaagccgtagtacaagtgttcgaaggtacttcgggaatcgacgccaaaaacaccgtgtgcgaattcaccggcgacattctcagaaccccagtgtccgaagacatgctgggcagggtgttcaacggctcaggaaaaccaatcgataaaggacccccgattttggccgaggacttcttggacatccaaggtcaaccgatcaatccttggtcgcgtatctacccggaggagatgatccaaaccggtatctccgccatcgatgtgatgaactcgatcgctcgtggccagaagatccccatcttctcggcggccggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaacggctcgtttcttcaaacaagatttcgaagagaacggttcgatggagaacgtatgtttgttcttgaatttggccaacgatcctactattgagagaatcatcacgccccgtttggctctaacggctgccgaatttttggcctatcaatgcg

SEQ ID NO: 2787 - DNA, 345 bp, Phyllotreta atra
tcgaattcacttgcagctatttgctagaacagcccgaagatgtagtatcgtatgcacaagaatacttcactaaatttaaagaaagtagaggcactgcgttgatatatgatcaggacatgtacgaagaggaaacgatgggtatcaaaacagtcttggctcgccaaatcttcgactccagaggcaacccgaccgtcgaagtcgacatcaccaccgagttggggctcttcagagcagccgtaccatcaggagccagtactggtatctacgaagccctcgagctccgcgacaacatcaaaaccgaataccatggcaaaggcgtgagtcaggccatcaaaaacatcaaca

SEQ ID NO: 2788 - DNA, 664 bp, Phyllotreta atra
atcagacgcagctactaaagtcgacggattggagagcttgttgcagtcgttggtgcaagtgctgcaatcgtccgacgtgaacgtggtgacctgcgccgccggcatcctgtcgaatctgacgtgcaacaatcaacgcaacaaagtgacggtgtgccaggtgggcggcgtcgacgccctggtgcgcaccatcgtcagcgccggcgatcgcgaggagatcaccgagccggcggtgtgcgccctacggcacctcacctcccgccacgtggagtccgagatggcccagaacgccgtgcggctgaactacggcatacaagtgattgtcaagctgttgaacccgccgtcgcgttggccgctggtgaaggccgtcatcggtttgattaggaaccttgctctgtgtccggccaatcacgccccgctgcgcgagcacggcgccattcatcacttggtgcagttgctgatgagggctttccaagacactcaaagacaacggagtagcgtcgctagtggtggcagccaaccgcccggaacgtacgcggacggtgttcgcatggaggagattgtagagggaacggtgggagcgttgcatatattggcgagagaatcgcataatcgggccatcattagacagcaaatggtgattccgatattcgtgcaattgctgttc

SEQ ID NO: 2789 - DNA, 654 bp, Phyllotreta atra
ggccctatttagcttcagaatgcaaaagtctgtacgcctgcgagaagtggcgcatgcagataatcagggaaatagcgaaaaaagtggcccaaatacagaacgcaggactcggggaattccgcattcgcgacctaaacgacgaaatcaacaaactcctgcgcgagaaacgccattgggaggaccaaatcaaggagctaggcggccccgattaccaacgagtcggccccaggatgctggatcacgaaggcaaagaagtccccgggaacagaggctacaagtacttcggagccgctaaggaattacctggcgttcgagagctgttcgaacaggaaccgccgcccccgccgaggaagagtcgcgcggaactgatgaaggacatcgatgccgattactacggctacatggacgacgacgacgggatactgatacctttggaaatcaaagctgaaaaaacagccgtacaaaatgcgatagccgaatgggtgaacaacaaggaaaagaacctagactctaccaaaggaatcgaagagagtatctacgtggtggaggattcggatgaagaagatgtcgttcaacagttcgatggttcgcaacagagattcgtagcccacgtaccggtgccatcgcaacaggatatcgaacaggctttgttga

SEQ ID NO: 2790 - DNA, 509 bp, Phyllotreta atra
tacaggcaaaacaactttcgtcaaacggcacttaactggtgaatttgaaaagaagtatgttgcaacactaggagttgaagttcatccactggtttttcacactaacagaggcccaatccgattcaatgtttgggatacagcaggacaagagaaatttggcggtcttcgtgatggttattacattcagggtcagtgcgctatcgtcatgtttgacgtcacatcacgagtaacgtacaaaaatgttccaaactggcatagagatcttgttcgtgtttgtgaaaatatcccaattgttctctgcggaaacaaagttgatataaaagaccgcaaagtcaaggccaaaagtatagtttttcatcggaagaaaaatcttcagtactacgacatcagcgccaagagcaattacaactttgagaaaccatttttatggctggccagaaaattgatcggggatgctaaccttgaatttgtagcgatgcctgctcttgtacctcctgaagttgtaatgg

SEQ ID NO: 2791 - DNA, 125 bp, Phyllotreta atra
ataagtctctgtttcgccagcggtgatcacaaaacatctttcaccgatattttaatgaacatagtcggtgtgttcatgtgggtggccgttggagcaacagcacttcactactggctcggttattt

SEQ ID NO: 2792 - DNA, 747 bp, Phyllotreta atra
agaaacgaggcgtagattacaacgcggaaattccgttcgaaaaacaaccggctatcggtttctacgacacttccaacgaagccctcgacttgatggccccggatttctccaaaatgagacaacagcatttggacggcgaactcagaagcgaaagggaagagagggaacggaagaaggataagcaaaagttgaagcaacgcaaggaaaacgacattcctcaagccatgctgcaaaacgaggaacccgctaagaaacgatccaaactggtattgccggaaccgcagatatccgatcaagagatgcaccaggtggttaagttaggcaaagcgagcgaaacggccagagaaatcgcaacagaaagcggagtcgaaaccactgacactctacttaacgattacatgttcacaccgcaagctgccgctactccaagaactcccgcgccccaaactgacaggatacttcaagaagctcagaacatgatggctcttacgcacgtcgatacgcctcttaaagggggtttgaacacgcccctgcataactcggatttcagcggggttctgccgcaatcgcaagcgattaccactcctaatacggtactcgctaccccgttcagatctactagaagcgatgggggagctacaccgggaagtactgccggattcatgactcctaaaagcggagccctgactcctgttggcaaaaacgcgacgccttctatcagagataagctgaatattaacgccgaag

SEQ ID NO: 2793 - DNA, 339 bp, Phyllotreta atra
gctcatcctgataagctgaagaaaaaaattacaagggaattaattactaccattcttgccagaaaaccaaaaatgtgcagttttttggaatggagggatttgaaaatcgtttataaaaggtatgccagcttgtatttttgctgcgcgatagaacaatgcgacaatgaactgctaactttggaaatcattcatcgttacgttgaacttttggataagtacttcggaagcgtatgcgaattggatataattttcaactttgaaaaagcgtatttcattctggacgagctgatgcttggtggcgaggtgcaggaaaccagtaagaaaaatgtcctgaaggca

SEQ ID NO: 2794 - DNA, 782 bp, Phyllotreta atra
aagagatcgtcgtttctcagccgcctgtacgacaatttcaaagacgaaatgaacaaaaacaaagaaatgaaagaatccctaaaaaaattccgcgaagaagcccaaaaactcgagcaaagcgacgctctaaaagccgcccgacagaagttcgaaaccgtagagaaagaggccagtaaaagcggcgaagtcttcaaagagagtttaggttccattaaagaaagagtcaaaggagtaatagacgaggccagtaagtcagatttagccaaaaaggctgggaagtttaccgaagaagtggggaaaaccacgcacaaaatcagcgaaaccgcacaggaaatcagcaaaaccggagcctttcaaagcatatcggaagccaccaaagccgttaaacaagaaatcgacaacaccagcatggaaggtcgagtgtacgtcagccctaagaagcttcgaaaacgaaccgaaaccagcgcagtggtccaacaaaagtactacgaaccgaacacagacgccaccggcgtagagctacacaaagactccaaattctacgagtcctggcaaaacttcaaaaacaacaacccctacgtgcacaaagtcatggactggaaactcaaattcgacgaaagcgagaaccccatcatccgagcctccagggcgctcacagaaaaagtaggagacataatggggggactgtttcagaaaaccgaactctccgaaacccttacggaaatctgcaaaatcgaccccgacttcgacacgaaacggttcctaaaacaatgcgaaaccga

SEQ ID NO: 2795 - DNA, 752 bp, Phyllotreta atra
agatggtaagctgaaacctggattaaataaaatcgaacaggccccaaagcaattcgtaaacaacgtaagtggtttaaatcagaaaatcgaagagttcaaattgaatctgccatggatcgaaaggctggattgtacgaacgcccaagcccccttagcgcccgaattagcggaagagatgttagctcacgaagaaaaaagaagtaatcaactgcgaaacaacaaaaagcttccccaattccaaccgtcggaagatccagttctaaacgattttaaacgagaactaatattccacaggcaagctcaagccacaattctagacgcaattccgaaaatcaaagaattagggatatctactaaaagaccagacgattattttgctgaaatggcgaaatccgatgagcaaatgcacaaaatcagagagaatctgaagcagaagcaggagcagcagaagcggagtgaaagggtgaagcaattgaggcagcaaaggaaagagggcaaatcgctgcaggtgcagctgaagctgcaacgctctaaggagaagaaggaaatgatggatcaagtgaagaaagcgaaaaaaaatttcgattttctggatgagaaaaacaagcccatgggaaagaataaggtggcggaaaggcgcaagatgaaggacaagaaattcggttttggtggtaagaaaaagggaatgaagaaaaatacaaaggacagtgcgggcgatattagtgagtatagaaatcctggaaaagccaaga

SEQ ID NO: 2796 - DNA, 789 bp, Phyllotreta atra; identical to SEQ ID NO: 2770

SEQ ID NO: 2797 - DNA, 783 bp, Phyllotreta atra
ttaacttccaacaacctgctgacgccgaacgtgccctggacactatgaatttcgacttgatcaaaggcaggcccattcgcatcatgtggtcccaacgcgacccttctctgcgaaaatctggagttggcaacgtgttcatcaagaacttggaccgatccatcgataacaaggccatgtacgatactttttctgcgttcggcaacatcctcagctgcaaagtggctcaagacgagagcggagtcagcaagggatacggtttcgttcacttcgaaaccgaagaagccgccaacaagtccattgaaaaggtaaacggtatgctgttgaacggcaaaaaggtctacgttggtcgcttcatcccgcgcaaagaaagggaaaaggaattgggcgagaaagccaagctcttcacgaacgtttatgtgaaaaatttcggagaggacttgtccgaggaacagctgagaacgatgttcgagaaatacggcaagataaccagctacaaaataatgagcaaggacgatgggaagtcgaaaggattcggattcgtcgcattcgagagtcccgaggcagccgaatcagctgttgaagccctaaacggcaaagaaatattggaaggcaaacctctgtacgtcgggcgggcccagaagaaggccgaacgccagcaggaattgaagcgtcgcttcgaggctctaaaaatggaaaggctcaaccgttaccaaggcgtaaatctatacgtcaaaaacttggatgataccatagacgacgaacgccttcgcaaagaattctcac

SEQ ID NO: 2798 - DNA, 772 bp, Phyllotreta atra
gcgaaaatttggataccctggacgagccggaagcccgagccagtatggtctggattataggagaatacgccgagagaatcgataacgcagatgagttactggatagtttcttggaaggtttcggtgacgagaacgctcaagtacaactacaattgctaacagccgttgtgaagctattcttaaaacgtcctcaacatacgcaaggcttagtccaacacgtactgagtttggccactcaagactccgacaatcccgatttgagagacagaggtttcatatattggagattgttgagtaccgatccggccgctgccaaggaggtggttctcgctgataaacctcttatttcggaagaaacggacctcttagagccgactcttctcgacgagctcatctgccacatatcatccctggccagcgtttatcacaagccacccacagcgttcgtagaaggccgaagtgcaggtatcagaaagacattgccggctagacaaggctccgatgacacagccgccgctcccgaaacaacggttattccgaaccaagaaagcctcattggtgatttgctttctatggatattaacgcgcccgccccgtctgctgctgctgctcctgccgcccctcagactagtaacgttgatttactcggcggtggattggatgttttgttgggaggaggtaatgatattgcggcggctcctgctagtgctgctgctcccaccaccactggtcttctcggggacatattcggcatacctactgcacctaccat

SEQ ID NO: 2799 - DNA, 348 bp, Phyllotreta atra
attggtccactaggtttgtcccccaaaaaggttggagatgatatcgccaaggctacatctgactggaaaggacttaaaataactgtacagttgacaattcaaaacagggtggccacaatctcagtagtcccatctgccgcatctttagtaattaaagccctcaaggaaccccctagggaccgaaagaaggtcaagaacatcaaacacagtggtaatatcacattcgatgatgtactcaacatagcaaggaccatgcgatcaagatcaatggccaaagaattcaaaggaaccgtcaaagaaatattaggaacctgccagtctgtcggatgtgtcattgatggcaaacaa

SEQ ID NO: 2800 - DNA, 660 bp, Phyllotreta atra
ctagagaagttccacgaaggccacggcaaagaaggcaccatagtcgtcacaaaggtcgaagaaccctccaaatacggggtggtagtgtacgatcaaaacaactgcatcgagagcttcgtggagaaaccccaggagttcatttcgaataaaatcaacgccggcctgtacatcctgaatcccagcgtgatcaaccgaatagaactccggccgacttccatcgaaaaggaagtgttcccttacatggcctccgaccagcagctgtacgccttcgagttgaagggattctggatggacgtcgggcaaccgaaggatttcctgaccggaatgtgcctgtatctgaaccatttgcgggagaccaacagccagaagttgtacaaaggtcctggagtggtcgggagcgtgctggtcgatcccacggccaaaattggcagtaattgccaaattggacccaacgttacaatcgggccaggtgttgtaatagaaaatggtgtttgtataaaacgctcgacgatactaaggggtgcaacggtttgttccaactcttggttagaaagttgcattgtggggtggaagtgtcacataggtaaatgggtgagaatggaaggaagtactgtacttggagaggatgttattgtgaaagatgagacgtacataaacggg

SEQ ID NO: 2801 - DNA, 675 bp, Phyllotreta atra
cgatgtaaggaagcttctgaataacgatgaccttctgaaagaaggggtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgttgataccgcggcggagccctggcgggccgctctagataacgagtttatacagtacacgagaaaccattataaagacggcgtttgtagcgtgttcggtcgcagccaaaacggcgccatcgccctcaccgcttgcatcgaagaccaccaattccagcccaagaacttctggaacggtcgatggagatcccagtggtctgttagtttaaccgatgaagccaccgcagaagtacggggagtcctcaaagtgcaagttcattattacgaagaaggaaacgttcaactggtgagtactaaggaaatcaaggaatcgattccggtttcgaacgaagcgcaaacggccaaggaaatcatccatgtaatagagcaggcggagaatctgtaccaaacggcgatttctgaaaactaccagacgatgtctgatacgacgtttaaggctct

SEQ ID NO: 2802 - DNA, 714 bp, Phyllotreta atra
gttgttggatacgtcgtagacaggaatcgtgctatttgcatccaacctcgcctttactccgaaggttgggtgaggttgcaaatcgccatcaattcggacgccttcaagtggaaaggaaaatactacgtcgaatcgccggccagcgcctcgcagaagatcttcttcaaagacatgaagtaccacgagaagtcgcccagcgagattcgcatcacgtggcagaagcagaacttgaccaccaacgaaaatgccaacatcagaatttccttgtggggttacagggaaactaccatgagacccacgttcgtttacatcacagaaatagccgataatgtccagaacaccggggagtacaccatcgtaccgtcgcagtacaggggcaaaatcaaccagttcctcactgacattaagtttggattcctccaaataaatttgaccgaatcgataaaggtcaacatttactctaccaacaaccagaacatcgatatcacaccgataatatggagcaggccgattcctctaggttggtatttccaattccaatgggagaaccaatacggcaaaaattggcctaaacacctctgcgacgattggctcaggaccgacagatatctgaaaaacttcgctcacgaattaccccaatgtccttgcacggtccaacaggctctggctgataaggggaaattcatgcccgactttgattgcgacaaagattcg

SEQ ID NO: 2803 - DNA, 171 bp, Phyllotreta atra
ctgaagctgaaaaggtcaagaaagtcctaggcgaactcaaaggcaaatccatcgaagagctcatcactaaaggtcgtgataaattgagttccatgccagtaggtggcgcagcccccgtagctgttgctgcagttgccgctgcaccagctgccgccgagcaaaagaaaggta

SEQ ID NO: 2804 - DNA, 796 bp, Phyllotreta atra
cagatcgaacagagtatgcaacgtggtaacggccgaaatggacaattacgagccgtgcatttacaccaagcgcgtgctggaggcggtgaaagttttgaacgatcaagtgatgcccaagtttacccagagagtccaggtggctgtgcaggctttgggcaacagcccgcccaaggaggtcgacgagaacgatttcatcgatgcgtcgagattggtttacgacggtgttagagaaataagaagagctgtactgatgaacagagccgacgaagatttggatcccgaagatgtagaactcgatgagaattatttgatcgagaccagaagcaaatcgagtgctcatactggtgaacatggcgttgatgagtatcctgacatcagtggaattacaacagctcgggaagctatgggtaagatgccggaagaggataagcagaaaatattgcagcaggtggagtttttcaagagcgagaagctcaagttcgatcgcgaggtcgccaaatgggacgataccggcaacgatatcatcgtgttggctaaacacatgtgcatgattatgatggaaatgacagattttactaggggaaaaggtcccctgaaaactaccatggacgtcataaacgcggccaagaaaatatcagaagcgggcactaaattggacaagttgaccagacaaattgccgaacagtgtccggaaagttcaacgaagaaagacttactcgcctatctacagcgtatcgctctttactgccatcagatgaatatcacttctaaggttaaagctgacgtccagaatatc

SEQ ID NO: 2805 - DNA, 770 bp, Phyllotreta atra
cagcttcaactggacttagttttggaacagcggtgtctacaacatcttcagccaccgcagctgctacaggaacccccctttttggagttgctcctacctcgagcactactacaatagccagtgtacctgctttaggtttatcgactacagtttctgtcgctgcttcgacaactccatcgacttcgttaagtactacaacagcacccccggcttactcgacatcgacgcttccttctagtggttcgttaacttttagtcaactagaagattctattaacaaatggaccattgatttggaagaacagggcaagtttttcattaatcaagcgaaacagctcaatgcttgggattcgttgcttatttcaaatggcgagaaaattctcaatctgaatggtagtatcgagagagttaagcagcagcagcagcaattggatcaagaactcgattttgtcttggcgcaacagaaggaattggaagagttaataacgccgctggaaaaggaattattggaaattcccgtaacagacatagatcgaaatcaaatgtatcaattttcggaaataatcgattcgcaattaaagcaaatgtctgatgatttgaaagaaattattgagcacattaatgaatctaataaaagcgaagaaatttcgaatcctttgacccaaattagccgcataatgaatgcccacatgaattccctccagtggttagacagaaatacggcgcaaattgtttctcatctggaacaaatcagtaaaatgcaggactcc

SEQ ID NO: 2806 - DNA, 468 bp, Phyllotreta atra
ccgggaaattgctgtttttagggctggacaacgctggtaaaaccaccttattacacatgcttaaagacgacagattagcccagcatttacctacattacatcccacatctgaggaattatcaatcgggaatatgaggtttaccacgttcgatctaggaggccattcgcaggctcgaagagtatggaaagactacttcccagctgtagacgctatcgtattccttgtagatgctaacgacagatctcgattcggcgaaagcaaacgggagctcgatgcgctgttgacggacgaaaccctggccaactgccccgtgctgattctaggcaataaaatcgatctgcccgacgcggcgtctgaggatgagttgcgaaacgtttactcgttgtacggccaaacgaccggtaaaggtaaagtcgctcgatcggatctgcctggcagaccgttggagctgtttatgtgctcgattc

SEQ ID NO: 2807 - DNA, 767 bp, Phyllotreta atra
caacctgttgtactccttcaagggattctccatacaccgattctgcttgccgctcatgcacggattcgtttcgataaacttctgcgtggtgaacggccacagtttgaactggtcgattgtaagtagaagaagcgtgcaaagagcgggcacccgattgcaccgaagagggttggacaaggaaggaaacgtcgccaatttcgtggaaaccgagcagatcatcgaataccaaggggaccgggcgagcttcgtgcaaatacgaggcagcattccactgttctggcaacaagaccccgatttacgatacaaaccaccgcccactctgctcgacgtcgatccgcaggatcagcactcgatgtgcctgaagcacatgaacgatctaatgactttctacgggaagatcgtttgcgttaatctggtggatcagaaaggagccgaagggaacatggaaatggcaatgaagaatgcgataaacaacgtatcatcaccatcggttaagtacgaatcgttcgatttccatgccgagtgcagcaaaatgagatgggacagactgtcgatactcatcgatcgattggctcacgatcaagacgagatgagtttctttctgttgttgagagacggctcgttgagttcgttacaagacggcgtattcagaacgaattgcatcgattgcttggaccgcacgaacgtggtgcagagcatgctggcccatcggaatctggaaagcgtgctcagaaaattgcagatcctccatcagaatcaaacgttgg

SEQ ID NO: 2808 - DNA, 776 bp, Phyllotreta atra
catcaagaagtccctgaacaacgaaaccctctacatggacagggactcgcaaatcaaggccatcgagaagacgttcgacgataccaaaactacaatcgacaagcattacagcaagcctaacgtagtccctgtggatgtactgccggtgtatccagatttcagtttgtggaaatacccttgtgcgcaggttattttcgattcggatccggctccggtgggcaagcaagtaccggctcaaatcgaggagatgtctcaagctatgattcggggtgtaatggacgaaagcggtgaacaattcgtagcctacttcctccccacggaggaaactctgcaaaaacgcagggaagacgtggccaatcaagtccaataccaagacgaagaagaatacgaatacaaaatggccagagagtacaattggaacgtcaagagcaaggctagtaaaggctacgaggagaattacttcttcgtcgtacgatcgagtggtattttttacaacgaattggagactagagttaggttgagcaagcgtagacagaaggttgggcagccgccgagtaatactaggctcatcgttaaacacaggccgatggatgctaatgaatttaggatgcaacggtacagggaaaagcagctggagcctacaggtgaagatgatgaagagatggaaatcgacgagccccaggaagaggataacgtgcttgagccggataacgaaagtcgggataaagaaaccgaaagcgacaacgaaaagaaacgatccagagcttcctcagtat

SEQ ID NO: 2809 - DNA, 659 bp, Phyllotreta atra
cgataaaacggtgtctttgggccaccgtttggacatcattttccacttaattagaataggcttgttcttcatggaccacgaccttatcactagaaatatcgacaaagcgaagaccctaatcgaagagggaggcgattgggacaggaggaaccgattaaaagtctaccaaggcgcttattgtatgtccgtgagggacttcaaaaccgccgctaacctgtttttggacaccgtgagcaccttcacatcctacgagctcatggactacaaggctttcgtcaggtacaccgtctacacttccataatcagcctgccgagaaaccaacttagagataaagtaataaaaggctccgagatactggaggtgcttcattccgagccgttcgttaaagattacctgttttctttgtacaactgccagtacgcggagttcttctcgaatttggccgaggtcgagacgatcttgaggaaagattacttcctgaatccccattaccggtattacgttagggaaatgaagatttcggcctacacgcaactgctggagtcctatcgatctcttacgttgcaatatatggccgaagctttcggggttaccatcgagtacatcgatgaggagttgtcgactttcatcgccgctggaaggctgcattgtaaaatcg

SEQ ID NO: 2810 - DNA, 799 bp, Phyllotreta atra
ttcgtcgaaagttgaagagtaaattagcagaaacgtttccagcctatcttcaagaggcttttttcgggaaagatcttatggatacggtcgattgtaaaaaggaagaagtcgattgctatagcagcgatgatgagaaaactgacaagcattttaaatcgattaatttatcacaagacgaaataatagcaatagtggcatcaggtaaaaccgagaaattggaaaacaataacaaagattcgaccaaagaagtcaaaccgactgtgttgaaggaggaagaagaagataatccggaggatttgaaagatgttcttgccctaccgggcgacttactcgataccgatttggttaatagcattatggaagatgaggaggaactgagcaaaactacagcgtctcttgttgctttagattcgaatttacagcacgatgcggaactgacggacactttgagtagttcaggaaattcgaaagaaaccaaagatgaattgagcgacattttaggccctcatttcaacctcgattccatatcgaacataaacagcaaggacgtcgaagacatatttaagggcgtattaacagacgagtcgcaggaatcccaagaaagcagtagcttctccctacaaggaaataatatgttttcgaataataatgcgcaacaaaacgttgcccaacaccccattattaatcaagcggtgagaccgaaaacattgcctactgttaatcacaatttgaattcccctgttagtttcccacccccctcaccgtaccactcggaatacagcaacagtcctcagtttag

SEQ ID NO: 2811 - DNA, 733 bp, Phyllotreta atra
cggctatcgagaaacctaaaattagcaagtactctacactggccattaacttgtcagctaaggattacatgaggaatttttcccaaccggttaaaaaacgcgctatcgaaaaaaatgtacaacccagtgtgcccaaaccagtaatcaagttaaacaaaaaactaactaaatcaattcaaccaattaaaattgaagataccaaaaacgaaacgattgagcctgatgagcatatcgataaagaaaaggctgatccagatacatcacactttgatgatgatttggatgaaactttactagaagaaatcagcgaagatctgaataaaaccgccactgaatcccaaataaccgaatcagaaatgaacgaagacgattttccaggggattttgatacaacagtaatagatgaaatcgaagaacgaattaacattgccagcgaacaactaatcaacgatattcaagcggaagtcgagacggaatggcagtatttcaacgatgctaataaaagctttaaaatagcaacagtagattctggagatactgattctattgcttcggaagataccgattctattgccgattctcctgctgtcactactgccgatactccatttgtagaagtcgaagggaacagtgtgtttaggttcttttggtgggatgcttacgtggatccactacatcaacaagggactgtttttctctttggtaaaacgtactgcgaaacctccaagaaata

SEQ ID NO: 2812 - DNA, 744 bp, Phyllotreta atra
gacgcaggctattagaaagagtattggagtaaggataaaggaagagagtgaaattatcgaaggtgaagtcgtcgatctgagcattgaacgtccagctacaggagttggtactaaagtcggtaaattgattctcaaaactacagacatggaaactgtatacgatttgggcggtaaaatgattgatagtattctaaaagaaaaagttcagtctggtgatgttatcactatagataaagctacaggaaaaattacgagattgggtagatcttttgctagagctagagattacgatgctactggccaacaaacgaggttcgttcaatgtccagaaggtgaactgcaaaaacgtaaagaagttgtccacacagtgactttgcatgaaattgatgtaatcaacagtcgcacccacggattcttggcactattttccggtgacactggagaaattaaatcagaagtaagagagcagattaacggcaaagtagctgaatggcgtgaagaaggcaaggctgaaattatacctggcgtactgttcattgatgaggttcatatgttggatatagaatgcttctcatttttaaacagagctttagaaaatgaaatgtctccaatcgtcataatggccaccaatagaggtataacaaaaattcgaggtaccacttacaaatctccgcacggcattccgttagatttactggatcgaacaattattgttcctactcagccatacgacgagaaggaatt

SEQ ID NO: 2813 - DNA, 771 bp, Phyllotreta atra
ttatctgcgactgttcagaggatccctgtacaaaaaatatcctgggatgttcaggaggtctataaccaacgaagaaagacgaaggttgattgaactcggtttgagccagcacgttttagcgagcagtgtatcactgcttagagcagaagaagttgaagatataattgaaggaaatgatgagaagtataaagctgtatctgtacacacttcggagcctcctatgccaagagagggtaaatccaagaaaaacatgcaatgggtaccatcgttacctaattccagtcacttagatgccgttccacaagctacccccattaataggaacagagtagctgctaaaaaggtgaggacattcccactatgttttgatgacacagatccccaaataaacatagaaaatgcttgtcaacaagaattgctagttcctattagactggacatggaaatcgaaggacagaagctcagagatacattcacttggaataaaaatgagagtttaataacgcctgaacaatttgctgaagttctctgcgacgatcttgatttaaatcctttaacatttgtaccagcgattgctcaagcgattagacaacaactcgatgcattcccaacagaacctcctgctattatagaggaaacctgcgatcaaagagtcattattaagttaaacattcacgtgggaaacacttctttagtcgatcaagttgaatgggatatgagtgaaaaacagaataatcccgaagaatttgcgttgaaactttgcgcagaatt

SEQ ID NO: 2814 - DNA, 560 bp, Phyllotreta atra
tcatcagctacaccactaacgcctttccgggcgaatacattcccaccgtattcgacaattattcggccaacgtgatggtcgatggacgacccattaatttggggctttgggataccgctggtcaagaggattacgatcggcttcgaccgctcagctatccgcaaacggattgtttccttctttgtttcagcctagtgaatccggcatcgtttgaaaatgtaagagcgaaatggtaccctgaagtattgcatcattgtcctagaacgccgatcatcttagttggtacgaaacttgatctccgcgacgacccggcatcgtttgaaaatgtaagagcgaaatggtaccctgaagtattgcatcattgtcctagaacgccgatcatcttagttggtacgaaacttgatctccgcgacgacccgaaatccattgaaaagctaaaagagcgaagattatttccgatcacgtatacacagggtttgcaaatggccaaagaaatcaaagccgtcaaatacttggaatgttcagcgttgacgcaagtcggcttgaagcaggtgttcgat

SEQ ID NO: 2815 - DNA, 749 bp, Phyllotreta atra
ttcatattgcctaccgatggttccactgttacgataatcaacagtactgatgatgggaggattttctatggcacaaaagaagggaatttatttgaaattgcatatcaagctgagagtggttggttcggcaaaagatgcaaaaaaattaatctatcgaccagcactttgtcgttcctggttccctcgtttattaatgcagcgttaagtgaagaggatggaataacgcaaatttcaattgacgatagccgacatattctctacattcttacggaaaaaggatccattgaagtttgcgacctaggagacaaagggaattcgttttccagaattagtaaaatatctcaaaacacgttggttaaccaagcaatgaatactgttaaaactcttgacagtcagaattttcgaccaatagtgagcatatccgccatcgaagcgtccgaatcggttaatttaaatttagtagctgtatctcaaactggagtaagattttatatgagtgttacgagtttgtcaaaccaaaatcctaatcaaagaccatacacgctaaccctggctcatgtaaggcttccaccgggctattcagcgaacattaccgtaagacccagggcggtgcatgtgtcccaatatagggacagaaacttgatattgatatccacagttaatgagaaagatgtgttgtggtgtatgagctcagacttatttccattcggccgaggactgacagaagcttacacggccattaatttgga

SEQ ID NO: 2816 - DNA, 679 bp, Phyllotreta atra
cagtatggcgatcagaagaaggcgaaacggtggtgtacaatgcatcgttcaaatccaaccgatggactcaagttatactggaaaccgaaccgtgcgaatttaaatatatccctataaaacacaacgatgtcaagacgctttacttacagcacattttccatccaggcagattccctttgcacgttattaacaaaactctttcgatatataaaatgcctacgattgcctcagactcccatctttccgtttctgctctaaagcaaagagtgtgcttggctgtcgagaacgacatacaaaatctctttaataatggtagcgatatcgatagcgttgaagttgatgagtatgtagagtgtgctgaatggagttggcaaaaattctacacctattgtgtccaataccatacagctagcagaaaaccgttgggtttgatgctattaccatccgtatcaggagctatgttcttgaaaaaatctgtgttttcgtttctacgccctgtggattcgttggaacatatgacgttgtgtacagatttgtacagagagcagttttacaatttttccatgttgtccgaagatttggatacagtagacgacgtaatcaacgtgtttaaagtgattgtttacatcgaacaacaactaaaggatgttttcatgcaatcgttcgaaacagaacttct

SEQ ID NO: 2817 - DNA, 775 bp, Phyllotreta atra
acaaccgaaatacgatttgctggtttcgaacgccttacagttcctttcgtctgtggccgaacgctcccaatacagaaacctcttcgaggacgacaacgtgttgagcagcatctgcgagaaagtcatcatacccaacatggaattcagaacctccgatgaggaattgttcgaagacaatcccgaagagtacacgagaagggacatagaaggctccgacattgacacgcgcagacgagccgcctgcgatttggtcaacactttgagccagaacttcgagcaacggatcgtcgagatattcggcagatatctacaagtgatgctcgcgaagtacgcggagaacccgaaggagttctggcgcagcaaggacgcggccttgtacttggtaacgtcgctggttagcaggggatccactcagaagcacggcgttacgcagaccagccaattggtggacattacccagttctgtcggcagcacattttgcccgaattagagcgaccggacgttaacgatttgccggtgttgaaagccgatgctataaagtacgtgatgacgttcagatcggtactgcccagcgatttggtcgtatctactttaccgcaactgataaggcatatgccgagcgaaagttgcgtggttcacacgtacgccgcgtgcactttggagaagattcttatgttgaaatccaacaatcaagctatagtaaccggggctcagttggagccgttggcctccgagttgttgaccaatttgttcgccgtattacaaaaacccgtg

SEQ ID NO: 2818 - DNA, 458 bp, Phyllotreta atra
atcacgttcgaatgcatagaggaattaaaagaagacttagaatggaagatgatttacgttggttcggccgaaactgaagaacacgatcaaatcttagactccgtatttgtaggacctatcccagaaggcaaacacatgttcgtctttcaggcagatcctccgaacgtctctcgtatacctgaaaatgatgccatcggtgtaacagttgtgcttctcacttgctcctacaagagccaagaattcattcgtgtaggttattttataaataatgaatacagcgatccggaaatgagggaaaatttgcctagtccacctcaattcgataaggtaattagaaatatattggcttccgaaccgagggtgacgaggtttaaaatcaattgggaagaatcgagcggtactcaggaaaacggaactacaattgccgaggcccccgctaaccaaacaaccgaaacttc

SEQ ID NO: 2819 - DNA, 702 bp, Phyllotreta atra
tttaccaaacgccattcaacaacaacaaagtctacctactactaactcacaagtgcctcctctagctccaatgggaggttctactccaacgcttggtctaggtttaggccatgctatgtccatgccacatactaagtatgtaaccggattttcactgcctatcagctctatggcacctcaaacaccacaacatacaatgatgagtcccatggtaaatgttggtggaactggtaccactagttctggtgtaacgcctacgttaggtccctctacaccttcaccaatgactcctatgacaccacattcagcagatcctggaatcgttccacaattacaaaacattgtgtcaactgtaaacttgagctgtaaattagatttaaagaaaattgccttgcatgcgagaaatgccgaatataatcctaaacgttttgccgctgtgattatgaggatacgagagccaaggacgacagctttgatattttcgtcgggtaaaatggtgtgtacaggtgcgaaaagtgaagaagactcgagactagctgcaagaaagtatgctcgaattatacaaaaactgggtttccctgcgaaatttttggatttcaaaatacagaatatggtgggaagttgtgatgttaaatttccaatacgattagagggattggttctaactcacagttctttcagtagttatgagcccgaattgtt

SEQ ID NO: 2820 - DNA, 305 bp, Phyllotreta atra
tacgcagatcaaatgagcttcacttttgctgctggaaaccaggtcttctacaacgcaacatcaataaaacaagtagatgttccttctttctcaggtagctttggtatcctaccagcccacgttcccactcttgctgttctaaagcctggagtagttactgtttatgaagacgctggtaatgtcaagaaaatcttcgtatccagcggtacagtgactgttaatgacgattcatctgttcaaatcttagctgaagaggcccatccagtagaaaatttagacgttagtgcagccagagatcttcttaa

SEQ ID NO: 2821 - DNA, 719 bp, Phyllotreta atra
gcgaatgggaaaagttagtgttgaatacgttcaagaagtacgagaagtccagcagggagcagcacgcggccgaattgaaggagaaacaggaacaggaggcccgcaggaaggccaagaaagaggccgaatcggccaagcaggctcaaattaccgaactaacggaagagcaggctgagaaattgcaagccgaactcgatgctaaaaagtccccagcttcggcagccacttcgaatagctcgagtggcccttcgacttccactgcgaagatcgaagaagacgaagacgagtcggagaagggtaaattgttacccaataaaggcaacggatgtgatttagacaagtataattggacccagactcttagtgatatagagctgcgagtgccgctccggtgcaatttccgagccaagcaaaaggatctcacggtgaatttaaccaaaaaacatctcacgtgcggcctcaaaggccatccccccatcatcgacgacgatttccagcacgagatcaaactggaagagaccaattgggtgattgaggatgggaaatcgttgctgttttccatagaaaaagtgaataagatgaattggtggagtaaaatcgtgaagaatgatccggagattagcactaagaaaataaatccggagccttcgaagttgagcgatctggatggtgagacgaggggtatggtggagaagatgatgtacgatcaaaggcagaaa

SEQ ID NO: 2822 - DNA, 359 bp, Phyllotreta atra
gcaatggagccctgataaaaaatacagcgatagagaaaggtggatttgcgtttatccagcatacatcaattgcaaaaaaaccatagcccaaggcaggaaaataaacaaagaaaaatgcgtggagaatcccactcatcaagagatcagagacgttttgctcgctgcaggtttgaaggttggcgtagaaaacaaattgtacagcagggaacgaagcaaagaattgttgtatcgagggcgaattagagtccaattgaaaaacgacgacggtacgctgtgcaatccaaacttcccaaccagagacagcctaatgctccatttgggagacatgattcccaaattgaagagcagacaaaacaagg

SEQ ID NO: 2823 - DNA, 685 bp, Phyllotreta atra
gaccacaggaacattaccatttggttgaaatacaccgaaatggaaatgcggaacagacaagtaaatcatgccaggaacttatgggacagagctacagttcttttaccaagggtaaaccagttttggtacaagtacacctatatggaagaaatgctggaaaacgtagccggagcaagagcggtattcgaaagatggatggattggcaacctgacgaacaagcttggcaaacttacataaatttcgaactgagatacaaggaaattgacagagccaggcaaatatacgaaagatttgttataacgcatccggaggtgaagcattggatcaaatatgcccgtttcgaagaaaatcacggtttcattcattcagctagacagatttacgaaagagctgtccagttttacggagacgatcatttggatgagaagctctacatagctttcgccaaattcgaagaaaaccaaaaggagcacgatagagccagggttatctacaagtacgccttagaccacatccctaaggatgaaacgaaagaactgtataaggcgtacaccatccatgaaaagaaatatggagacagaagcggtatcgaggaagttataatgtctaaacgaaagctgcagtacgaacaagaaatactccaaaatcccaccaattacgatgcttggttcgattatctccgac

SEQ ID NO: 2824 - DNA, 787 bp, Phyllotreta atra
tctgcctgcttatcatcatccaactgttcgtggcaggtcttatcgtgctccttctcgatgaattgttgcagaaaggatacggtttgggttctggtatttcgcttttcatcgctacaaacatctgcgagacgatcatatggaaggctttctctccggctactgtcaacactggaagaggcaccgaattcgaaggagctgtaatcgctctgttccacttgctcaccaccagacaagacaagattagaggattacgagaggctttctaccgccagaatcttcctaacttgatgaacctcctagccacagttttagtgtttgctatagtaatatacttccaaggttttagagtcgatttaccgataaagagcgccaggtaccgtggccagcactcgagctaccccatcaaacttttctacacttccaacattccgatcattttgcaatctgctttggtgtccaatttgtacgttatatcccagatgttggcggttaaatttcaagggaacttcttcatcaatctgttgggggtttgggccgatgttgggggcggcggcccggctaggtcttaccccatcggcggtttgtgctattacttatcgccgcctgagagcgttagccacattctggaagatcccgtccacgctgttatgtacattattttcatgctgggttcctgcgctttcttctcgaaaacgtggatcgaggtatccggcagttcggctaaggatgtcgccaagcagctgaaggaacagcagatggtcatgagaggtcacagagacaattccat

SEQ ID NO: 2825 - DNA, 318 bp, Phyllotreta atra
ggtttcatcttcagctgttgaattaagttcatacagggatcagcattttaagggcagtcgagctgagcaggacaagttattaaggctttctacgaccttatacgtaggaaacctatcattttacacaacagaagaacaaatttatgaattattttcgaaatgcggcgacattaggcgaatcgtgatgggcctggacaagtataagaaaacaccttgtggattttgtttcatcgagtattacaatcgcgaagatgcagaaaattgcttaaggtacatcaacggtacaagattggacgataggatagttcgaacggattg

SEQ ID NO: 2826 - DNA, 712 bp, Phyllotreta atra
aatttaaccaccatcggtcagatcaactcctattcgaccgccaaagaatggagtagaggtaaaaaggcacttttaggaacattagggttattagccggaggcactggggccgtactagtggccctcgaccaatcggttaaagcgtcggatctagaactgcacccgccgaagaacatctggagccacagcgggatattcagctcacttgatcacgccagcgtccggaggggttacgaagtctacaaacaagtatgcgccgcatgtcactccttgcgtttcgtggcctaccgcaatctaataggcgttactcacaccgaagccgaagccaaagccgaagccgaagaccagatgatcgaagacggccccaacgaggagggcaacatgttcaaacgccccgggaaattgtccgactacttccccagcccttaccccaacgaggaggcggccagggccgccaacaacggggcctacccgcccgatttgagctacattacgtctgctagacacggagccgaggattatatttttgcgctgttgactggttactgcgaggccccagccggggtggttgttagagaagggcagtactacaatccgtacttccccggcggggctatttcgatggctcaggctttgtataacgagacgattgagtacggtgacggtactccggctacggctagtcaattagctaaggatgtgtcgacgtttt

SEQ ID NO: 2827 - DNA, 713 bp, Phyllotreta atra
cgacgggaaaattaaagtggttggatcttcggaagccgatgataatagcattaagactgtgttcgaagcctctaagacgagacctttagataagcgaaaaaggaagaagaatgatgaccccagcgatgtggaaggtttcttaggtccttggggtggattcatagacgaacaaaaagtatccaaaccgaccgaggaagaacaaatcgaattggatgagatatcctccaagaagaataaaaagggtaaacccaacgaagataaacccctcgaagaaaaatcagtcttgcacatcaaagacgccgtggattaccaagggcgctcattcctccatgcgccacaagatgtcggggttaatctcagatcggacactcctccagagaaatgtttcctacccaaagctcatattcacacttggactggccattcgaagggcatcgctgctatccgattgttccccaggactgctcatcttctattatcagccggaatggactgtcgtattaaaatttgggaggtttacaacgaaagacggtgcgttaggacctactatggacatcgacaagccgttagggatattaatttcaacaattccggaaagcattttctttcggccggttacgacaggtatataaaattgtgggatacggaaacaggacaggttttgtcgcgtttcaccagcaggaagataccctattgcgtaaaattcaatccgg

SEQ ID NO: 2828 - DNA, 591 bp, Phyllotreta atra
cgagcaaaagaaagaagtcaatcccttattcgaaaagagacctaggaatttcggaataggccaagacatccaacccccgagggatctatccaggttcgtgaaatggcccaaatacatccgcatccagaggcagaaggccgtcttacagaaacgcttgaaagtgccgccgccaatcaaccaattctcccaaaccatcgacaaacaaacggccacccaattgttcaaagttttggagaagtaccgaccggaaaccgccttgcagaaaaagaaccgactgaaggctaaggccgaggccaaggtggccaaaaaggaagaggcccccgccaagagacccaatactttgagagccggtactaacaccgttaccaaattggtcgagcaaaagaaagcccaattggtggtcatcgcacacgatgtagaccctatcgaattggtactattccttcccgccctctgcaggaaaatgggagtcccctactgcatagtgaagggtaaagctaggttagggctactcgttaggcgtaaaacttgtgcgactgtggcactaacacaagtcgattccggagacaggtccaacttcaacaagctctt

SEQ ID NO: 2829 - DNA, 766 bp, Phyllotreta atra
cttcgaatatgcaatgaccgactatttgaggatatccggcatgtactggggcctcacggctctcgaattaatgaacgcctcaccaccacactcaatagacgagatttcagattacatcaaacagtgccaagaccccgaaagcggtgggatcagctcttgcctgaaccacgatcctcacatactccacaccttaagcgccgttcagatactgtgcatgtacgataacttaaaagctatagatgtagagggcgttgtgaagtacgtaaaaaacctacaattacccgacggtagcttcacaggagacaaatggggcgaagtggacaccaggttctcattctgtgccgtcgcgacgctctcgctattggacagaatggacgtcatcgacgttaataaagcagtagacttcgtagattcttgtaaaaacttcgatggcggtttcggctcgaggcccctctccgaaagccacgccggcttaatatactgctgcttaggattcctgtctgttaccaatcgattggatgttgtggatcgagatatgctggcttggtggctctgcgaaaggcaattaccttcaggcggtttgaacgggcgtccggagaagctgcccgacgtttgctactcctggtgggtgctgtcttctttaactatattaggaaaactgcattgtatcgacgccaatgcgttgaagaaatttatattagcatgccaggataccgagagcgggggcttcgctgataggcctggagacattccagatcctttccac

SEQ ID NO: 2830 - DNA, 703 bp, Phyllotreta atra
tacagctgaagaaccaactcacttcgaaagacgcgaccatcaaagccacctaccaacagcgctggctggtcttctccgaagaagtcagagactacatcaagaagaacgtggtcggcgccctcgggaccgagaccaacaggccgtcgtcggccgcccaatgcgtcgcctacatagcggtgaccgaattaccgcaaggacaatggccggatctcatatcgacgctggtgagcaacatttgccaggggaattccaccgaaatgcagaaggaggccacgctcgaagccatcggctacatctgccaggaaatcgaatccgatgtcctagtgacccaatccaacgatatactaacagccatcgtgcacggcatgagatcttcagaacccagcaatcacgttcgattggccgccacgcaggctttgctaaactcgttggaattcaccaaagccaacttcgatttacccaccgaaaggaattacatcatggaggtcgtttgcgaagccacgcagtcgccggtgtcgcaaatcaaggtggccgctttgcaatgtctagtgaaaatcatgtcgctgtattaccaacacatggagccctacatggcgcccgcgctgtttcccataacgttagaggccatgaagtcggagaacgatgccgtggctctgcagggtatcgaattttggtcgaacgtgagcgatgaagaagtggattt

SEQ ID NO: 2831 - DNA, 793 bp, Phyllotreta atra
cggcaaaagtaccttctagacagatacatgacgtccaccgaaagactgatagatttgtacgaagacaaagacggacaacgtaaggccgaggtggccgccctgacgggccccaatgaattcaacgagttctacagcagactgaagcaaatcaaagatttctacagaaggcacccgaacgagataagtgtaccgatgtcggtggagttcgatgaattcgccaaagccagggagaatcccaacgaagatatggccaatttcgtggaatttaccgacgaagaaggctacgggaaatatttagatttacacgagtgctacgagaagtacataaatctaaaaggcatcgagaaagtcgattatatcacctacttggccatgttcgatcaactgtacgacataccgaaagaacgaaagaccggcgagtacaggaaatatttgctgtacctcatcgagtacctcacgtggttcgtgcaacgcatcagaccgctgatggatctcgatagcgatttgcaggagcaggccgatcaggcgtcgggcggctgggagaacggaacggtgcccgggtggccgaaagaaaccggttcggctttggcgaacgtgggcgcccatttggacctgtcggccttctccagttgggaggaattggcttcgttgggcttggatcgcttgaaatccgcccttatggcgttgggattgaaatgcggaggaaccttggaggagcgcgcccaacggttgttctcgacgaaaggcaagggctccttggacccgtcgctgatgacgaagaacagcaagaatc

SEQ ID NO: 2832 - DNA, 507 bp, Phyllotreta atra
tatcggcacctttaaagctttcgacaagcatatgaacatgatactcggcgattgcgaagaattccgtaaaattaaacccaaaaactcgaaagtcgaacgagaagagaagcgggtattaggatttgtactgctgagaggcgagagcatagtctcactaactgtagaagggcctccaccaccagaagaaggacttcccagggtacctatacccggagcagctcaagggccaggtataggaagagcagcaggtaggggaatgcctcccggtatggctggagtaccggttggtctccaaggtcccgttagaggagtcggaggaccgtctcagcaagtaatgactcctacgggtagaggacaggtctcagcgccaccacaaatgaaccaagcgcctccgaggatgggtggccctccgcctggtatgatggggccgccgccgggaatgatgggcatgccgccgcaaatgggtatggggcgcggaggaccgcctccgatgggtatgaggggtcc

SEQ ID NO: 2833 - DNA, 667 bp, Phyllotreta atra
acttgtttggccatatggaatgttattcaacctcaagaaattccatttcctacgaaggagctgtggttagagaagtccaaggaattttatgagattacacagtttcccaattgtattggaagtatcgacgggaaacatatcaggataatttgtccccctaactctggctcagagtatttcaattacaagaaatacttctcgattgtccttttggcggttgctgacgcaaattattacttcacagctgtcgatattggatcttttggacgcgaaggagactctacgatcttcaaaaagtcaaattttggactaagactcaaaaataacgaactagacctgcctgcagataatcccctaccagtacctgacaatgtggagcaaggttccgaggtaccctatgttttgctcggggatgaggcttttgggttgtcaaagcatgtgatgcggccatacccgtccaagggattatcgcaagaaaagaggatctacaactacagacactgccgagctcggcgtgtcgtagaatgctctttcggaattctctctaacaaatggcgtgtgctacattcttctatgttaatacatcctgaatttgctgtcatcgtagtgcaggcttgttgtgttttgcataattttgtgcgaagaagagatggctacctttttgagg

SEQ ID NO: 2834 - DNA, 799 bp, Phyllotreta atra
ttcgtcgaaagttgaagagtaaattagcagaaacgtttccagcctatcttcaagaggcttttttcgggaaagatcttatggatacggtcgattgtaaaaaggaagaagtcgattgttatagcagcgatgatgagaaaactgacaagcattttaaatcgattaatttatcacaagacgaaataatagcaatcgtggcatcaggtaaaaccgagaaattggaaaacaataacaaagattcgaccaaagaagtcaaaccgactgtgttgaaggaggaagaagaagataatccggaggatttgaaagatgttcttgccctaccgggcgacttactcgataccgatttggttaatagcattatggaagacgaggaggaactgagcaaaactacagcgtctcttgttgctttagattcgaatttacagcatgatgcggaactgacggacactttgagtagttcaggaaattcgaaagaaaccaaagatgaattgagcgacattttaggccctcatttcaacctcgattccatatcgaacataaacagcaaggacgtcgaagacatatttaagggcgtattaacagacgagtcgcaggaatcccaagaaagcagtagcttctccttacaaggaaataatatgttttcgaataataatgcgcaacaaaacgttgcccaacaccccattattaatcaagcggtgagaccgaaaacattgcctactgttaatcacaatttgaattcccctgttagtttcccacccccctcaccttaccactcggagtacagcaacagtcctcagtttag

SEQ ID NO: 2835 - DNA, 713 bp, Psylliodes chrysocephala
aagaacgtcagtcaacaagacatagaggctagaaacaggttaaaacaggaagaaaataagagagaacttgaaaaagtgaagaaaaggaggttggaacgagaattagaaagacaaaagagagaagaagaaacacaaatgttacaaaggagtaaagaagctgcacaatttgaagaatgggaaaggcaggaagacaagtttcatttggaacaagctagattaaggtctcatataaggatacaagatggtcgagctaaacctatagatttgctggcaaagtatataagtgctgaagaagaggtagatgcagtggagatgcatgagccatatacatacctcaatgggttacaaattaaagacctagaagatctagttgaggatattaaagtgtacaaagaattagaaaggggtaaaaatttggattattggaatgatataacagtcatagttgaagatgagctacaaaaattgagaaaaatagagaagcaaaacgattttgatttaggattaaatagaagagaaggtatacatcagtcagttgctactgatgttacatcagtgttcaaaggaaaaactgctgctcaactagcagctttagaaaagcacattgaaagtaaaattagtggcaaagctgatggaatagatataggctactgggaatctttattgtcccaactaaaagcccacatggcgagagcaagattacgagataggca

SEQ ID NO: 2836 - DNA, 694 bp, Psylliodes chrysocephala
atagagatcaagaaaccgccttgagtgcgatgagaaatctaaatggctacgaaattggcggcagaaacctaagagtagataatgcttgtacagaaaaatctcgaatggaaatgcaaaatttgcttaatcaacctccagtagaaaacccttatggagagcctattcaagctgagaaagctcctgaagctattagcaaggctgtagcttctctgccaccagaacaaatgtttgagttgatgaagcaaatgaaaactacaatacagaacaacccaacagaagcaaggcaaatgttacttcaaaatccacaattagcttatgctcttttgcaggctcaagtagttatgaaaataattgatccccatacagcagctacattattacatcctgtaaatcaagttcctgcaactttaatgcctggtgataagaatgttccagtgcaagtaccaattaataaccaatatagggaacccccagcacctgttcaaccacctagacaagaattccagcctgtgcctccacctattatgattcccaaccatgttcaaccacctgtttttactgggcaagatgttgacttaaggtccctgggaaccgccccagatccaagactcgggcctgtggtgagggaccaagatatgagacaaattccaggccctattcaaaatcccttaccgcctaccattggagaaagctt

SEQ ID NO: 2837 - DNA, 693 bp, Psylliodes chrysocephala
acaacatgagccatgaagatcctggtgatgtaacttattctgctattggtggtctttctgaacaaattagagaactccgagaagttattgaattaccattaatgaacccggagttatttatgagagttggaattacacctccaaaaggttgtttgctttatggaccaccaggtacaggaaaaactttgttggcaagagctgtggcttcacaacttgatgcaaatttcttgaaagttgtatctagtgctattgttgacaaatatattggagagtctgccagacttatcagagaaatgttcaactatgctaaagatcatcaaccttgcattatttttatggatgaaattgatgctataggtggtcgcaggttttcagaaggtacatcagcagacagagaaattcagagaactctcatggaattgcttaatcaaatggatggatttgactctttaggacaagtaaaaatgataatggccaccaacagacctgacacattagatcctgctttactccgtccaggccgtttggatagaaaaattgaaatccctctaccaaatgaacaggcccgtcttgaaattctcaaaatccatgccttccctattgccaaacatggggaaattgattatgaggcaattgttaaactatctgatactttcaatggtgcagatttaaggaatgtttgtaccgaagcag

SEQ ID NO: 2838 - DNA, 257 bp, Psylliodes chrysocephala
tcgctacgattcaagaacaaccatcttctcgcctgagggccgactctaccaggttgaatatgcgctcgaggctatttcccatgccggtaccgccattggtatccttgccaaggacggcatcgtccttgctgccgaacgcaaggtcacatccaagctcctcgagcaagacacctctgccgaaaagctctacgtcctcaacgataacatgatctgcgccgtcgctggtatgacagccgatgccaacatcctcatcaact

SEQ ID NO: 2839 - DNA, 655 bp, Psylliodes chrysocephala
agctcttagattagccatgcaactaaatgatcacagtcttatagaagaaatatttgtgaattgtccagacactgatattcaaaagcagttggcattcatgttagggaggcaacaaatttatattgaaattccagaaagcactccagaatatgaagacctcatagaaataatggccaactgtcatctgaacaaccacttcctaaatctcgcccgtgaattggatatcatggatccaaaaactcctgaagatgtgtacaagtcacatttagaaaacagccgtcccccatttgggggtagtcaagttgactctgccagacaaaacttagctgcaagctttgtaaatggttttgtgaatgctgcttttggccaggataagctcttgatggaagatggtaataaatggttgtacaaaaacaaagaacatggaatgctcagcgcaactgcttcattgggattggtattactgtgggatgtagatggtggtcttacccccattgataaatatttgtactcttctgaagatcacatcaaatctggagctctgttagcatgtggtatcgtaaattgtggtgttaggaatgaatgtgacccagcactagctctgttgagtgattatgtgctacataatacaaacatcatgaggataggcgctata

SEQ ID NO: 2840 - DNA, 723 bp, Psylliodes chrysocephala
gttgtaccggtaactctctcagaaatcgaacatcctggagattatgccaaccttcagactgcgcaatataataacggttacgctgatggttctcaatacctagctcaacatcagtatcaaaatttgttcataaacagaaacgatgttgataattcttctcccacggcggttttatacagaggcgatcccaatttagcagattctagataccaagtaaactttgaagtatccagtactcaaccccaagtgaacatcctcccttcttccggagattcctacacctacaccaccccaggaagttggaatgctagtagcagtggttcttatcaacaacaatatcccggaaacataaatgttcttcatcaagccgacagtactcagtcgtactctgctggacaatacgcaaactccacttggtcatctaacacgatggaggatggacggccatctagtcaagaggtactagtgaaagagtgcgttaattgtggcgctagcgttacacctctttggcgtagagacggtaccgggcattatctatgtaacgcgtgtggtttataccacaaaattaatggggttcacagaccgccgattagaccaaccaaaaaaccacaggcgactggaaataggcgaaacggagtatcgtgtgctaactgcaaaactaataatactaccctttggagaagaaataaccaaggtgaacctgtttgtaacgcttgtggacta

SEQ ID NO: 2841 - DNA, 791 bp, Psylliodes chrysocephala
tctcttgaaaagaacctcggcagccacgatccgcgaagcatgatgaaatgctgcgagagcctcgcgttccttgtacgcgacgtggcccacatcactccatacaatttcgacgtgtgcgttcactgcatacgaaccttcgtcgaggccagtctgcacggcaccagcctcagacgaaccagatcgagaaaaaagtcctcggacaggcaccggacgagaaagagccctgccagcagtcctgatgaggacgacagtgatgacgacgacattccaagcggctaccatcaaatatccatacaattattagatttgatgcacacgctgcatacacgaacggcgcagatttttaaatggtgggccgaagagggcggcgaaatatcgcaagagacgtcgctgtggactcaaggctggtgcccgctgttacaagggatcgcgcgattgtgctgtgataccagaagacccgtgcggatgagcgctataacgtacctgcagagagcgttgctggtgcacgatcttcaaacattgagcgggcccgaatgggagcaatgtttccagagagttttattcccgcttttaagttacctactacaatcgatcagtcctaaagacgccatcgccatggaggaaactagaataagagcggcaacggtgctatcgaaagtatttttacatcacctcaccccactgctagcgttgccgagttttttcaatctttggttggtcgttctggactttatggacaaatatatgcatgcggataggagcgaactcttatacgaagctattccggaaag

SEQ ID NO: 2842 - DNA, 470 bp, Psylliodes chrysocephala
ctcaaaccgtagcaacaaatttcgaaaaagtattcgaaatgggcccacatctattcgtcggcctacccggtttagctacagacacccaaaccgtaatggaaaagttacgatttcgtaaaaatctttacgaactcaaagaaaacagacgtatttcaccaaaagtatttgctgcaatgatttcaaatatgttatacgaaaagaggtttggcccctttttcgtcgaaccggtagttgcaggattaatgcctggaacttttgagccttatatatgtaatatggatcttattggttgtattaatcaacctactgattttgttgttggtggtactgcttccgcacaattgtatggtatgtgcgaagcactatgggaacctaatttgggacctgacgatttgtttgagactatatcgcaagcgctgatgaatgctttcgatagagatgctatttctggttggggagctacagtttat

SEQ ID NO: 2843 - DNA, 675 bp, Psylliodes chrysocephala
ctggcagaaagctactctagatttaataaataggttttctcagactaatatttggcctttattagaaattctgactgttttaccagaggaattggaaagtagatctgtaaggctaggtgaaaataggcgaattgaggtattagaagacatgaaattttgcgcccccactgtcaacgaattcttgaaacattgctccaatctttacggcacaaattggcaagagcacgttcaggtcaatgtaaaaatattgcgttgtttcacatcttgggtatccgtaggtgccataagtctgaacgatcttgcaaataacgtagtaatcaatagggcatttgaaatactgaactttaagcctcaaaatgacaaacataccatatcaggtgccttccacgaggctgctacagactgtatatgcaccttattgttatgtttagaagataacaataatcaactaggtttagaaagttatctttttaataatataattaatttggatgtaccttatcacttgtcagtcgccaacgaagatcaaggaaaatctatggactattgtaggttattcacagaattagcagaatcatttttggaaaagattatcaacaatagtaacacggaacagatgcattatgctactaaaattttggatttcgttttaatgtgtgttgggcatcatgatta

SEQ ID NO: 2844 - DNA, 709 bp, Psylliodes chrysocephala
ttagttccagaaagtcaggcatatatggatttgttggcatttgaaagaaaacttgattcaacaattatgagaaaaagactagatattcaagaagcattaaaacgtccaatgaaacaaaaacgaaagctaagaatttttatttctaatacattctatcctgctaaagaacctcaacccgaggggccagaagggccttgtcaggaaggttctgtagcatcttgggaacttagagtagaaggtagacttttagaagattctaaaaatgatccaaataaagttaaacgtaaattttcatctttctttaagtctttggtaattgaacttgataaggaactctatggacctgataatcatttagtagaatggcatagaacattgactacacaagaaacagatggctttcaggtaaagagacctggtgataaaaatgtccgctgtacaatcctgttactacttgattatcaaccactacagtttaaacttgatcctagactggctcgtcttcttggtgtgcatacacagactaggccagtcatcatttcagctttatggcagtatattaaaacacatcgccttcaggattctcatgaacgtgaatatattgtatgtgataaatatttagaacaaattttcaattgtactcgtatgaaatttgctgaaattccacaacgtttgaatccattattacacccaccagatccaattgtta

SEQ ID NO: 2845 - DNA, 312 bp, Psylliodes chrysocephala
aaccaactttagacgagcttgagcaaaaaatgagagaagctgaaacagaatctcatgaaggtaaaagaaaaaatgaatcgttgtggcccatctttaaaattcaccaccaaaaatcaagatatatttttgatctgttttatagaagaaaagcaattagtcgtgaactctatgaatattgtttagtggaaaatattgctgacaaaaatttgatagccaagtggaagaagcaaggctatgaaagcctttgttgcttaaggtgtattcaaacaagagatactaattttggaacaaattgcatttgtcgtgtaccta

SEQ ID NO: 2846 - DNA, 652 bp, Psylliodes chrysocephala
aaggcccataggagagtttagaagttctgctgattaccaataccaaatgctaaggtgcaatgtagacttattgaggataattcaactaggccttacatttttggatgacaacggaaagacacctggtggggcttatactacatggcagttcaattttaaatttaatctccaggaagacatgtatgcacaagacagtattgacttgctgcaaaattcaggaattcaattcaagaagcatgaggatgagggtatagaacctctagaatttgcggaattgctgatgtcttctggtattgttcttatggaaaatataaaatggttgtcttttcattctggctacgattttggatatcttataaaactattgactgacaacaaccttccacaagatgaaactgagtttttcgatttattaaaattatattttcccacaatatatgatgttaaatatctaatgaaatcatgtaaaaatttaaaaggtggtcttcaagaagtagctgaacaactcgaattagaaaggattggaccacagcatcaggcaggatctgattcacttttaacaggaatggcattttttaaaatgaaagagatgttttttgaagatacgatcgatgattccaaattttccggccacctatatggactcggaaca

SEQ ID NO: 2847 - DNA, 653 bp, Psylliodes chrysocephala
ttcgaaaccagtgaagatgtggaagttattgaaaagttcaaaaacatgaatctgaaggaagaattgcttcgtggaatttttgcatatggttttgaaaagccttcagctattcaacaaagggctattaagcctattatgaagggcagagatgttatcgcccaagcacagtcgggaactggtaaaactgctactttttcaatatcaattttgcaagcccttgatttgacgatgagagaaacacaagtattgtgcttatctccaacaagagaattggctgttcagattcagaaagttatactagctttaggtgactttatgaatgtacaatgtcatgcatgtattggtggaacaaatcttggagaggatataaggaaacttgattatggacaacatgttgttagtggaacaccaggaagagtatatgacatgattcgaagaagagcccttaggacaagatcagtaaaaatgctggttctagatgaagctgatgaaatgttaaataagggtttcaaagaacaaatctatgatgtatacagatttcttcctccttccacacaagtcgttcttatatcagctactttgccccatgaaattttggaaattacatcaaagtttatgactgatcccatcagaatcttggtcaaacgtgatga

SEQ ID NO: 2848 - DNA, 680 bp, Psylliodes chrysocephala
tcgaactttcaagagctcaagacattgaagctggtgacggtaccacctcagtcgtagtaattgccggtgcccttttggacgctgctgaaaaattgttgcacagaggaatccacccaactgccatttcagaatctttccaaagagcagctcttttagcagtagaaatattgaatggtatttctacaccaatagaaattacaaatagggaattgttaatcaaaagtgcttctacttccttaaattctaaagttgtatcacagcattctagtctattgggaccgttggctgttgatgcagtactcaaaattgttgaaccaggccacgaagaagcttgcaacttagaagacataaaagtaatcaaacaattaggaggaacggtcgaagacaccgaattagttgaaggaatcgtcttctcgcaaagatccgcaaacgtatctggcccaaaaagaatcgaaaaggccaaaatcggtttgatacaattctgcatttcaccaccaaaaaccgacatggaccataacgtcataatatccgattacgccgcgatggatagagttttgaaagaggagagagcttacattttgaatatagtcaagcagattaagaaagctggatgtaatgttcttttggttcaaaagtcaattctcagagacgccgtttcagatctagccctccactttttg

SEQ ID NO: 2849 - DNA, 729 bp, Psylliodes chrysocephala
ttagtagatgttttgccccctgaagctgattcttcaataagtatgctacaagcagatgaaaaacctgatgtacaatattgcgatataggaggtatggacatgcaaaaacaggaaatcagagaagctgttgaattacctttgactcattttgagttgtataaacaaattggtattgatcccccacgaggtgtgttgatgtatggaccgcctggttgtgggaaaactatgttagcaaaggcagtggcacatcatactacagccgctttcattcgtgtagtcggttcggaattcgtccaaaaatatttaggagaaggaccgcgtatggtgcgagacgtattccgtttggccaaagaaaattcgcccgccattatctttattgacgaaatcgacgctatagctacgaaacgtttcgacgcccaaaccggcgccgaccgcgaagtccaacgaattttgctcgaactgcttaatcaaatggacggatttgatcaaactacaaacgttaaggttataatggctactaacagagcagatacattggatcctgctcttctaagacccggtcgtttggatagaaaaattgaatttcctttgcccgatagaaggcaaaaacggttgatattcagtactatcacttctaaaatgaacctttctgaagaagttgatttggaagactatgtggcaagacctgacagaatttcgggggctgatataaacgccatctgtcaagaa

SEQ ID NO: 2850 - DNA, 510 bp, Psylliodes chrysocephala
accatcgcactcttcttatcccatttctgactactattcatctcacaaaatggccgacgctaagcctatgtccaagatctggctgatctccaacgattcggccaccatcgaagttgaccgtgccgttgtcgagcgctccatgctcatcaagaacatgctcgaggatgtcggcgacgacaccatcagccagaccaaccccattcccattcccaacgtgaatgaggccgttttgcgcaaggtcatcgagtggtgcaaccaccaccgcgacgaccccgcccaggccgccgacgacgagtcggatgctcgaaagaagacgactgatatcgacgagtgggaccagaagttcatgcaggtcgatcaggagatgctcttcgagattatcctcgcctccaactacctcgatatcaagccccttctcgatgtcggctgcaagactgtcgccaacatgatcaagggcaagtcgcccgaggagattcgcaagacgttcaacattaccaacgacttcactcc

SEQ ID NO: 2851 - DNA, 697 bp, Psylliodes chrysocephala
ggacagttccatgacttgatggagttattcaggataggcggtcgtagtccagatacaaattatctttttatgggtgactatgtcgatcgtggttattactcagttgaaactgtcaccctcttggtagcactgaaagtcaggtataaagaaagaatcacaatcttgagagggaatcacgaatcaaggcaaatcacacaagtctacggtttctacgatgaatgtctaagaaaatatggaaatgccaatgtatggaaatttttcactgatttgttcgattacttgcctctaacggcgctcgttgatagtcaaatattctgtctgcatggtgggttgagtcctagcattgatactttggaccatattagggcgctagatcgtttacaagaggtacctcacgaaggcccaatgtgcgacctcctttggtcagacccggacgaccgcggaggttggggcatctctccccgtggtgccggttatacctttggacaagacatctcagaaactttcaatcacagcaatggtctgacgctggtatcgagggcgcatcaattggtcatggaagggtataactggtgtcacgatagaaacgttgtaaccatattcagcgcccccaactattgctatagatgtggcaatcaagctgccattatggaattagacgatgctcttaaatattcattcttacagttcgatccgg

SEQ ID NO: 2852 - DNA, 763 bp, Psylliodes chrysocephala
atttggtgcttagacttcgtggtggtatgcaaatcttcgtcaaaactttgactggtaaaacaatcaccttagaagttgaggcatcagacaccattgaaaacgtcaaagccaagatccaggataaggaaggcatcccaccagaccaacagaggttgatctttgccggtaaacaattagaagatggtagaacattatctgactacaatatccagaaagagtcgactctccatttggtacttagacttcgtggtggtatgcagatctttgtcaaaacactaactggaaagaccatcactcttgaagtagagccatctgatactattgaaaacgttaaagctaaaattcaagataaagaaggtatcccaccagaccagcaaagattgatcttcgcaggaaaacagctagaagacgggcgtactctatctgattacaacatacagaaagagtctaccctgcatttggtgcttagacttcgtggtggtatgcaaatcttcgtcaaaactttgactggtaaaacaatcacattagaagttgaggcatcagacaccattgaaaatgtcaaagccaagatccaggataaggaaggcatcccaccagaccaacagaggttgatctttgctggtaaacagttagaagacggcagaacattatctgactataatatccaaaaagagtctactctccatttggtacttagacttcgcggtggtatgcaaatcttcgtcaaaactctgactggaaagaccatcactctagaagtcga

SEQ ID NO: 2853 - DNA, 725 bp, Psylliodes chrysocephala
aaatccatgaatctggtgctaatgctgttttatccaaacttcccattggtgatgtagccactcaatattttgctgatcgagatatgttctgtgctggtagggtaggagaagatgatatgaaaagaaccctaaaagcatgtggtggtgctgtaatgaccactgttaatgatctaaatgattcagtactaggtaaatgtcagctttttgaagaaaaacaaataggaggtgagagatacaatttctttaaaggatgtcctaatgctaaaacttgtacattactcttaagaggaggatctgaacaatttctcgaagaaactgaaagatctttacatgatgccatcatgattgtccgtagaactatcaagaatgactcagttgtagcaggaggaggagcaattgaaatggaattatcaaaattattaagagatcattcaagaactatagcaggaaaagaacaactccttattggggctattgctaaagctttggagataatcccaagacagttatgtgataatgcaggttttgatgctacaaacatactaaataagttaagacagaagcatgcccagaataacccttggtatggtgttgatattgccaaagaagacattattgacaactttgaagcttgtgtttgggaaccagccattgtcaaggttaatgctttaacggcagctgcagaagctacctgtctaatactttctgtggacgagactatcaag

SEQ ID NO: 2854 - DNA, 740 bp, Psylliodes chrysocephala
tcttgggtttccttagaacgcattcaatttgtaggtgcttgcaatcctcctacagaccctggaagaaaacctctttctcatcgtttcctcagacatgtaccagtcatttatgtggattatcctggagaaacctctttaaagcaaatttatggtactttcactagagccatgttgaggttggctccaggtttaaaaggttatgcgaatcctttgacaaatgctatggttgaattttacctagcgtctcaagacagatttactcaagatatgcaaccccattatgtttattcccctcgagagatgacaagatgggtaagaggaatatgcgaggctatcagaccattagataatctctctgtagagggattagtaaggctttgggcgcatgaagctctacgtctattccaagatagacttgttgaagacacagaaagacgttggaccaacgaaaatatcgacgctgtcgccttaaaacatttcccatcagcgaattgtgaacgtgcattggaacgacctattttatacagtaattggttgtctaaagattacgttcctgttggaagagagcagttaagggaatacgttaaagcaaggctgaaagtattttatgaagaagagcttgatgtgcccttagtactatttgatgaagtattagatcatgtattaagaatagacagaattttcagacagcctcaagggcatttacttctgattggtgtctctggagctggaaaaactac

SEQ ID NO: 2855 - DNA, 713 bp, Psylliodes chrysocephala
gaggctgatattgctgatgatgaatatctgtttgaagaaaaagtattaacagaaagagaaaagaaagaacgccagcataaaaaggaactattacaacttgctcaggaacatgaaaaagcaagagaacttgaacgaattcagaggtatcacatgcccagagatttgggtaaagactctacagcagattatattgaagttgatgaacttgaaaaagtacctcaatccgaacagaaaaaatgggaaaaagaccagatggcttctgctgtttttaagtttggtgctaaagatgtcaagaaaaaggatgattatgagttgctgttggaagatcagattgattttattcaagccttgcaaatgccaggggtcattgaaaaaaaggaaaaagagttaactgaagtagagaagaaaaagttgagtattgaagaaactaagaagagtttaccaatatttccatttaaagatgatctgattcaggcaattagagaacatcaggtattaatcattgagggagaaacaggatctggaaaaactacacaaattcctcagtatctacatgaagctggattcactgaagatggaaaaaagattggctgtacacaaccacgtcgagtagcagccatgtctgtagcatcaagagtagcacaagaaatgggtgtaaaattgggcaatgaagttggatatgccattagatttgaagattgcacttccgaaag

SEQ ID NO: 2856 - DNA, 765 bp, Psylliodes chrysocephala
agagacagaaaatccagcaggagggtatggtaaaactgttagtcatgttgtaattggtttgagaactgctaagggtagtaaacaattgaagctggatcctagcatctatgaagctctacaaaaagagaaagttgaggttggagatgttatttacattgaagctacaagtggagctgtcaaaagacaaggaagatctgatgcatatgccactgaatttgacttggaagctgaagaatatgttccccttccaaaaggagatgtacataagaagaaagaagtagttcaggatgttactttacatgatttggatgctgctaatgctaaaccacaaggaggtcaagatgtattatccatgatgggacaactattaaaaccaaagaagactgaaattacagacaaattaaggaaagaaattaacaaaattgttgacaaatatattgatcagggtatagcggaattggtacctggtgtactttttattgatgaagttcatatgttagatctagaaacatttacttatcttcatagagctttagaaagtgccatagcacctattgtaatttttgcaacaaatagagggcgttgtcttattagaggaacagatgacattttctcttcacatggtataccattagatcttttggatagattgctgattattcgaacaattccttatggtagatctgatatggaacaaattttgaaactaagggccaccacagaaggtttagaaattgaatcagatgccatcgcaatattaggaga

SEQ ID NO: 2857 - DNA, 732 bp, Psylliodes chrysocephala
ctaatagacaacggaggtggaagaaacatcgatttaacagtagaaagacgggtgagattagaaggacaagaactcgacgattacgaaagaagacaaaggtctagaagtgataaaattgacaatgaggacgcggattcagattcggactctgacatcgagatgtcggtaatctcgaaggggaagcacgacatcgtgatcaagcaggaaggtaaaatatcgacgggatttttcaaggttaccaaaaaaatgtacccgatgtatccgttccacgaggaaaagattaagtgcgacgaatacggcgagatcgtcaaacccgaggattacaaattggccgaagtaatacccgaaggcgaagacaataaggaaaatatcgtgataaagaaagaagaggaggaaattactgaaattacggaacaaccgacgaaatgcatcgtgctgcaaaggacggttcaagttaactgtcaagtccagtacatcgatttcgagggtagatcagacggtgaatcgctgatgaagattttgacgcaactgaaacccaggagagtgattgtggtgcgcggcacggaagaaaatacggccgtcatcgagaagcattgcttggagaacatgcaggggcgagtgtttacgccctctaggggcgaaatagtcgacgctacgagcgaaacgcacatctaccaagttaggttgactgacgctctagtgtcgcagttgagtttccaaaaggcgaaagaa

SEQ ID NO: 2858 - DNA, 749 bp, Psylliodes chrysocephala
aaggaggtgatgataatcgcgttcaggatatggaggaagaaagttctgatgaagatgaaaatgaaggcaagacacctagagcacctcccccgccgtcaattcaaccccctctaccacctgctccagataaagtgcttgtgaagaaatatgatcctaaacaagccgttaaagtcgcaagacctacagtaggagacgattatctagtctctcccatcactggtgagaaaattccagctagcaaggtccaggaacacatgcgcatcgggcttttggatccccgttgggtggaacagcgggacaaacaaattacagacaagatgaaccaagatacggtttatgcagccggtagcgccatcgatgcatctcttaaactcctcgccgaaagacgtaccgatattttcggtgtcggagatgaagaaactgctattggtaaaaagattggagaagaggatgtcagaaaagacgagaaagtgacatgggatgggcatacgagcagcgtggaagcagcgacaagagccgcgagggctaatattactttagaggaacaaattcatcaaatacacaaagtaaaaggtctacttcctgacgaagagaaagaaaaaattggtcccaaaaatattggatctaagaagataaacattcagagtattattactacaaaacctcctaatccacctgttcagcccccaaagccgccagtatctcttatacaaacccctgctccacaaatgattccagttccaactcag

SEQ ID NO: 2859 - DNA, 740 bp, Psylliodes chrysocephala
atgggaaaaatcggtaaccaaaaacgcgtcgtcggtgtcttactcggttgttggagggctaaaggagtcttggatgtttcgaatagtttcgcagttccttttgatgaggatgacaaagatcaatctgtgtggtttttggaccatgattacttagaaaatatgtacggcatgtttaaaaaagtcaatgctagagaacgtgtagtgggctggtaccacaccggacccaaattacaccaaaacgacattgctattaatgaactagtaagaagatactgtccaaattcagtattggtaattattgatgccaaaccaaaagacttaggccttcccacagaagcgtatcaagccgttgaggaagtacatgatgatggttcaccaacatccaaaacttttgaacacgtaccaagcgaaattggagcagaagaggctgaagaagtgggtgtagaacatttattacgtgatatcaaagatactactgttggcacactttctcaaagaattacaaatcaattgttgggtctgaagggactgcattcacagttgaaagacattagagactatttgttaaatgtttgtgacaatacgctacctattaatcatcaaattatctatcagttacaagatattttcaatttgttgcctgatataaaccaagatgcttttaacaattcattttatgttaaaaacaatgatcagatgcttgtagtctacttagcagctctggttagatccatagtggc

SEQ ID NO: 2860 - DNA, 793 bp, Psylliodes chrysocephala
aactccttgagcttgaagaggaacatgttaagcgccaatgtgatgaaatcatagcttttaagccagacgttgtctttacagaaaagggtgtttcagatctagcccaacactttttattaaaagctggaatcagtgctgtgagacgtgttaggaaatctgacaataacagaattgccagagcatgtggtggtacaattgtgaatcgaacagaagaattacaagagacagatgttggtaccggagctggtctctttgaaattaaaaaaataggcgatgagtacttctgttttgtcgatgaatgtaaaaatccaaaggcttgcactattttgctccgaggagctagtaaagacatccttaatgaaattgaaagaaatctccaagatgcccttcaagttgcaagaaacatagttctctcaccccgtctagtgccaggaggtggtgctattgaaatggccatagctcaacgtctaatgcaaaaagcaacacatggaccttacagagctcttgcacatgcactagaaattattcctagaactttagctcagaactgtggagctaacacaatcagaaccttgacagctttgagggcaaaacatgctaaccatactgatgctgagaaaccttgtacttggggtatagatggagaaactggcgagattgttgacatggagactaaaggattgtgggaaccactttcagtgaaactacaaacttacaaaacggctattgaaactgctattcttctattgcgtatcgacggtattgtgtctggatccaaaaagaagggtgacaa

SEQ ID NO: 2861 - DNA, 555 bp, Psylliodes chrysocephala
ccaacgacaaattaacccctatgctgataatggagggagtgttgtagcgatagcaggaaatgatttcgtagttgtgggagctgatactcgtctcagttcaggtttttcaatttacacaagaaaccaaaataaattatttcctatgtccgatacaactgtattaggttgtgcaggatgttggtgcgacactttaactttaacccgaattttgaaatctcgtatgcagatgtaccagcaggaacataacaaacaaatgtctacaacagcatgtgcacagatgttatccaccatgctgtattataagagatttttcccttactatatatccaatatacttgttggattggataatgaaggaaaaggttgtgtttatagctatgatccaattgggcattgtgaaaaggccacctacagagcaggtggctctgcaggtgcattacttcaacctcttttggacaaccagattggacaaaaaaatctggtgaaaccatcatctgaagatctttctcaagagaaagctcttgctatattgaaagatgtattcattgctgctgc

SEQ ID NO: 2862 - DNA, 660 bp, Psylliodes chrysocephala
tctagagcaattaacgaggctaaacatcaactatcctatgttatttaagcttgtaaataaaaaaacaaatcgtactacacactgtggtgtgttagaattcgtcgctgatgaaggaaaagtatatcttcccttatggatgatgcataatttggtcctttctgagggcgatttggttcaaatggaaagcatttcgcttccagttggaactttttccaaatttcaacctttgaatcctgattttttggatattactaatccgaaagctgttttggagaattgtttaagatcttatgcttgtcttacgactggggacgttatagctgttaaatataatcaaaaggcttatgagctgtgtgttttggaaacaaagcctgggaatgctataagtatcatagaatgcgacatgaatgtggaattcgcagccccagtgggctacaaggaaccggaaagatttaaaaaagaagaagaggaaatgtctatcgatcctgctgacttaatgccagaaccatcaggttttgtagcattcagaggcgccgggaatcgtctggatggcaaaaaacgtaaagattcttcttcgagcgacagtcacgtatctaaaccaacttacgttaagggaatccccgattacgattacgagatcggcaccttgaatttcatcag

SEQ ID NO: 2863 - DNA, 783 bp, Psylliodes chrysocephala
attgccgaagtatttccagtttctgctgaaaatactgagcctctagttaaagttgcaatgaccacattaggatctaaaatcattaataaatgtcacagacaaatggcagaaatcgcagttaatgctgttttagctgtggctgatttagaacaaaaagatgttaattttgaattaatcaaagttgaaggaaaggtcggtggtaaattagaagacacaacaatggtccgtggcgtagtcatagacaaaacaatgtctcatccccaaatgccaaaagagcttagaaatgtcaaactggccattctcacctgcccctttgaaccaccaaagcccaaaaccaaacataagttggatgttgccagtgtagaggattacaaagaattgaggcagtatgaacaagacaagttcaaagaaatcgttagtctggttaagaacgccggcgccacattggccatctgtcaatggggttttgatgatgaagccaaccatttgcttttgcaacaggagttgccggccgtcagatgggtgggcggtcccgaaatagaacttatcgctatcgcgaccggcggtaggattgtgccgcgatttgaggaacttagtcctgaaaaacttggttatgcaggtttggtaagggaaatatcctttggtaccaccaaagataagatgatggtgatagaagaatgcaagaattcccgtgccgtgactattctagttagaggcggtaatcaaatgctggtagctgaggctaagaggagtctacacgatgcgttatgtgtcgttaggagt

SEQ ID NO: 2864 - DNA, 208 bp, Psylliodes chrysocephala
ctcgaagggagagaagaaacgatttgaagttaaaaagtggaatgccgttgcactttgggcttgggatattgttgtggacaactgtgctatttgccgcaatcatataatggatttatgtattgaatgtcaagctaatcaagcttctgccactagcgaagaatgtacagtagcctggggagtatgtaatcatgcctttcactttcattgc

SEQ ID NO: 2865 - DNA, 782 bp, Psylliodes chrysocephala
gaggcagaaaggttagttgaacagaaaattcatcctcagactataattgctggatggagaaaagcagttgatgctgcaagaaaggccttattagatgcttccaaagacaatagtgctaacctggaagcattcaaagaagatctgatgaatatagcaaggaccacattaagttcaaaaatcctctcacaacacaaggaacactttgccaaacttactgtagatgcagtattgagattaaagggttctgctgaactgcaatccatccagctgattaaaaaaactggaggtactttgcaagattcttttttggatgagggtttccttttagataaacggcctggtgttcatcagcccaagagagtagaaaatgcaagaattttgattgccaatacacccatggacactgacaaaattaaagtatttgggtcacacattaaagtcgactctatggcaaaagtagcagagctggaatctgcagagaaggacaaaatgaaagataaagttaacaaaatcttgaaacacaatgcaaatgtattcattaatagacaacttatttacaactatcctgaacagctgtttgctgatgctggagtaatggctattgagcatgcagattttgatggtattgaaagattagcacttgttacaggaggagaaatagtctcaacttttgaccacccagagcttgtcaaattaggcacttgcaacttaatcgaacaaattatgattggagaagatactcttctacgttttagtggagttgctctaggagaagcttgtac

SEQ ID NO: 2866 - DNA, 667 bp, Psylliodes chrysocephala
ccaccaagtagaatatgccatggaagctgttaacctaggttcagcaacagtaggtctcaaaagtgataattatgccgttataattgctttaaaaagagcttcttcggaactctcggcgtaccagaagaaaattatcaatatcgacgatcatatcggtataactatatctggacttacagccgatgctagaattttgagtagatacatgaggaacgaatgtttaaattataagtactcattggatgcttatatgcccctcaacaggctgattagtatcttaggtaataaaatgcaacattgcacccaacggtacgaccgtagaccattcggcgtcggcctactcgtcgcaggtttcgatgatactggtgctcatatttaccaaacctgtccctcagctaacttctacaactgcaaagccatgtctatcggggctagatctcaaagtgctaggacttacttggagaagaagctcgatgaattatcttcagcctctttggaagagttgattaaacatggtttgagggctttgagggatactttacctccagaggtagacctaaccaccaaaaacgtctcaataggctatgtaggcaaaggtcaaaacttcaagatcttagaagaggaagaaactgctccctacctctcgctcattgaaggtgaagaacgt

SEQ ID NO: 2867 - DNA, 688 bp, Psylliodes chrysocephala
acagtgtttagatgggtgtccgccgcaatttgctaaacatctgtacttgctgtacgccaaattagaagaggaacacggaatggcccggcacgccatggctgtttacgaaagatctacaacagcggttccggaaaacgagatgttcgatattttcaacatttatatcaaaagagccgccgaaatttacggtatacctaagacgcgacaaatttatgaaaaggccatcgaagtactgccggaggataaaacaagagaaatgtgccttcgattcgccgatatggaaaccaaattgggcgaaatcgatagagcgcgagcgatatacgctcattgcagtcaaatttgcgatccgcgaataacggcggagttttggcagatctggaaagaattcgaggtgaggcacggcaacgaggataccatgcgagaaatgttgaggatcaagcgcagcgtccaagctgtctacaatacacaggtgaacatgatgtcggcacaaatgttgagctccgcgggcagcatgagcggcaccattgccgatttagcgcccggtgtaaaagacggtatgcgattgttagaggccaaagctgcagaaatggcggggattccgcagagctcgaccaaacccgggaatattatgttcgtcagaggggaaacccagggcgctaataaggatagagtcgttaatcccgatgaa

SEQ ID NO: 2868 - DNA, 692 bp, Psylliodes chrysocephala
attatgggagctctttgtccaagcagggcctttagtaaatgtacatatgcccaaggatcgtgtaaccatgatgcaccagggttacggctttgtagaattcatgggcgaagaagatgcggattacgctataaaaataatgaacatgataaagttatatggaaagccaataagggttaataaggcatctgcacatcaaaaaaatttagatgtgggagctaatatcttcataggaaatttagaccctgaagtagatgaaaagttgctatatgatacattttcagcctttggggtaatattgcagacaccaaagataatgagagatcctgagactggcaactccaaagggtttgctttcataaactttgcaagttttgaagcatctgatgcttcaattgaggccatgaatggtcagtatctctgtaacagaccaatttctgtatcatatgcatttaagaaagactcaaaaggtgaaagacatggatctgcagcagaacgtcttctagcagcacaaaatccattgtctcaagctgacagacctcatcaattgtttgccgatgcaccacccataggaatgatgccaatgaccatagcacctccaccaccacctttaatcacaggaatgatgccacctcctccacctactcctggaggcatgccaccacctcctcccccagttccaccaccaaattctt

SEQ ID NO: 2869 - DNA, 628 bp, Psylliodes chrysocephala
aaaaaggaggaaaggagcaccaaaactgcgttatttagatttctcagaacgacatggttacatcaagggggtagttaaagatatccttcatgacccaggtcgcggtgccccgttggctgttgtacatttcagagacccttacaagttccaaactagaaaggagctgttcattgctcccgaaggaatgtacacaggacaatttttatactgtggaaagaaagctaacctccaaattggaaatgtactacctgtaggaactatgcctgaaggtaccattgtgtgtaatttggaagaaaaaactggtgaccgtggtcgattggcccgtgcatcaggcaactatgcaacagtaattgcacacaaccatgatacaagaaaaactagggttaagttgccatcaggagccaagaaggtcattccatccaacaacagggctatggttggtatcgttgctggaggcggtcgtatcgacaaacccatattgaaagccggtcgtgcttaccacaaatacaaggtgaagcgtaactgctggcccaaggttcgtggtgttgctatgaaccccgtcgagcatcctcacggaggtggtaaccatcaacacatcggtaaggcttctactgtcaagagaggaacg

SEQ ID NO: 2870 - DNA, 310 bp, Psylliodes chrysocephala
cgaaaacaattggccactaaggcggctcgtaagagcgcaccggctaccggtggtgttaaaaaaccacatcgttacaggcctggtacggtggctcttcgagaaattcgtcgttaccaaaagagtaccgaattgttgattagaaaattacctttccaacggttagtacgtgaaattgcccaagattttaaaactgatttaagatttcagagttctgcagtgatggcgcttcaagaagccagcgaagcctacttggtaggtttattcgaagacactaacttgtgtgccattcacgccaaacgagtaacaatta

SEQ ID NO: 2871 - DNA, 661 bp, Psylliodes chrysocephala
tgttacatactgacgtgcaacgttagcatggaatacgaaaaaagcgaagtcaattcgggtttcttctacaaaaccgcagaagagagagaaaagttggtttcggccgaacgagaatttatcgaacaaagggttaagaaagttgtcgaattgaagaaatctctttgcaacggtacagataagacgttcgttgtcattaatcaaaaaggcattgaccccatgagcttggacatgctcgccaaggaaggaataatcgctcttagaagagctaaaagacgtaacatggggcgcttggctttggcgtgcggcggtatagccatgaacagtttcgatgatttacaggaatctcatctcggacgtgccggacacgtttatgaacacgttttgggcgagaacaactacacgttcgtcgaggattgcaaagtgccccagtcggttactattttgatgaaaggacccaacaagcacacactgctgcagatcaaggacgccgttagggacggattgagtgccatcaacaatactatcgaagataaagcggttattccaggtggtggtgccttcgaagtgactgccaacaaggaactgttggcctacaaagacgagatcaaaggcaaagctcgtctgggcgtggcagcttatgccgaagctcttttggtgattc

SEQ ID NO: 2872 - DNA, 782 bp, Psylliodes chrysocephala
ggtgtcaaatcagtgactctgcatgacgatgctctttgcaccgtgcaggatttatcgtcccaattttatctaacggaatccgatgtaggcaaaaaccgcgctgaagcttgctgcaagcagctttcagaacttaacacttacgtcccgaccaaagcttacacggggcccttagatgagaaaatcataaagaaattcagggttgtggttttaactacgagtactcgtgccgaacagatacgtatcagcgaaataactcacgctaatgatattgctttaatcatcgctgatacgaaaggtctttttgctcaggttttctgcgattttggtaaatctttctccgtggtggacgtaaacggtgaaacaccggtatctacgatgatagcagacatctccagtgataaagacagcgttgtaacttgcatagacgacacgagacacggtatggaagaaggagactatgtaactttctctgaaatacaaggtatgactgaattaaaccactgtaaaccaataaaaatcaaagtattaggcccttacacgttcagcattggtgataccactaatttcacaaaatacgtacgtggcggtatcgtttctcaagtcaagatgccgaaagaattgaatttcaaacctttaaaagaatccttacagaatcctgaattcgttataaccgattatgctaagtttgatcaccctgtgcagttacacttggcttatacaactctgcacaagtatgtagaaaagacaggcagattgcctaaaccttggaacaatgatgatgc

SEQ ID NO: 2873 - DNA, 759 bp, Psylliodes chrysocephala
aaaccgccgtattcgtattagccactctccaacaactagacccgaccgaaaatgccgtctacgtcctcgtcatgtgccatacgcgtgagttggctttccaaattagcaaagaatacgaacgtttcagtaaatacatgctcaacatcaaggtcggtgtatttttcggaggtctgcccattcaaaaagacgaggaagtattaaaagccagctgtccccatattgtcgttggcacgcctggacgtattttggctcttgtcagatctaagaaactcaatctcaagcatttaaagcattttattcttgatgagtgcgataaaatgttggaactattagatatgagacgcgacgtccaagaaatataccgtaacactccgcacggcaaacaagtaatgatgttcagtgcgaccctcagcaaagaaatccggccagtttgcaagaaattcatgcaagatcccatggaagtgtacgttgatgacgaagccaaattgacccttcacggtttacagcagcattatgtaaaactaaaagagaacgaaaagaataaaaagttgtttgagttactagatgtcttggaatttaaccaggtcgttatatttgtaaagtcggtgcaaaggtgtgtagccttagcgcaattgttaacagagcaaaactttccagcaattggaattcacagaggcatggaccagaaagagagattgtctcggtatgagcagtttaaagatttccaaaagagaattttggtagcaaccaatcttttcg

SEQ ID NO: 2874 - DNA, 787 bp, Psylliodes chrysocephala
ggattggaagctggagatagcaaaaaagacactgacatgcaaagtgtaatagaaattcgagaacatgcaagacagattgaaaaagccgtaagcagcaaggaaaatcgatttattttaagagttttgcgttgtttgcccaacactagacgaaagcttaatggagtagttctcagaagtcttataaaccaaatatatcctgtagccgagagagacgtcctacttggttttactgaagaggctgcaactgaacttgacactacgcaatctagagctagatcagcttcaaaaactcctgttccagaagttgatgcttatattaacttgttaattttggttcgtttgattgacactaataaactaccagaagcagaacgttgttctcaagcactcatgaataaaattactagtcaaaatcgccgttccatagatcttgtagcagctaagtgctacttttatcactcaagggtttctgaacttactgataaacttgattcaattagaggttttctacattctcgtcttcgtactgctactcttagaaatgattttgaaggacaagctgtacttataaattgcttattgagaaactatttgcattattcattatatgatcaagctgacaagttagtaagtaaatgtgtctttcctgaaacggctagtaataatgaatgggccagatttttgtattatttgggtcgaattaaagctgctagattagaatacagtgtagcccataagcaccttgttcaagccatgagaaaagcacctcagaatgctgcaataggtt

SEQ ID NO: 2875 - DNA, 786 bp, Psylliodes chrysocephala
gcctggtacaaaagtagacagtaaacaaagaattactgtcagaaatttaagaataagagaagacactgcgaaatatttaagaaatttagaccctgcttcagcttattatgatccaaaaacaagatcaatgagagagaatccgaatcctgaaagagatgaaacatatcatggtgaaaactttgtgcgtttctctggtgacacaacgaatcacgcaagagctcaactatttgcttgggaagctcacgaaaaaggtgtagatgttcatctactagcagagcccactaaattggagttactgcaaaaagaatacgaaaagaaaaaagatgaagttaaatctaatattcagagtacggttttggagaaatatgggggccaggagcatttggaagctccacctaaaagtttattgttagctcagactgaacagtatgtggaatattcaagggctggaagagtcattaaaggagccgaaaaagaagttattctatctaaatatgaagaagatgtttatataaataaccacacttcagtttggggttctcattggagaggaggacagtggggatatcggtgttgccattctttcattaaaaattcgtactgtttgggagaagcaggaaaatccgttaatgtacaacccatagtggaatcgatttccaatgaagaggaaattggaaaacctgttggagatgtgcaagaaaaggaaaagagcaaagaaaaggacgaggaaagtgaagaaagcgattcgagcagttcgtcagaagataattcaaaagtgaaagcgca

SEQ ID NO: 2876 - DNA, 471 bp, Psylliodes chrysocephala
cacgaaactaggaaccagaaggatccattatgttcgtacgaggggaggcaacttgaagtaccgcgccctaagattagacaccggaaacttttcttggggtagcgaaggtactgcccgtcaaacacgtattatcgatgtcgtttacaacgctagtaataacgaattggtccgtaccaagacgttggtaaagaatgctattgttgtcattgacgccaccccgttcaggcaatggtacgaaaatcactacatcttaccattgggacgcaagaagggtgccaaaatgacgcctgaagaggaggagattttcaataaaaagcgtagcaaaaaagtacagaagaagtacgagactaggcaaaaaaccgctaaagtagaacccgcgatcgaagaacagttccacaccggaagattgttggcatgccttgcatctaggcccggacaatgcggcagggccgatggttatgtcctcgaagg

SEQ ID NO: 2877 - DNA, 662 bp, Psylliodes chrysocephala
accaatggaagtaatgggacttatgttaggtgaatttgtggatgactacacagtccgtgtaatagatgtttttgcaatgcctcagactggtactggggtcagtgtagaagcagttgatccagtatttcaagctaaaatgttggatatgttgaggcaaactggtaggccagaaatggtagtgggatggtatcactctcatccaggttttggatgctggttgtcaggagttgatattaacacacaacagagttttgaagcactttctgagagggctgttgcagtggtagtagacccaatacaatcagttaaaggaaaagtcgtcattgatgcatttaggttgatcaatcccaacatgatggttttgggacaagaacctcgccaaacaacatctaatttaggacacctgcagaaaccttcagtgcaagcactgatccatggtttaaatcgccattattattctataagtattaattacaggaaaaacgaacttgagcaaaaaatgctgcttaatctacataaaaagtcctggatggacggtctaactttagctgactattcagagaactgcagtgttaatgaaaaaactgttgctgacatgttggaattagctaagaactacaataaggcattagaagatgaagaaaaaatgacaccagagcaac

SEQ ID NO: 2878 - DNA, 658 bp, Psylliodes chrysocephala
agaacagggaagctatgttggtgaagttgtaaaacccatggacaagaaaaaagtacttgtcaaagtacaccctgaaggaaaatttgttgttgatatcgataaaaacattgacattaatgatgtcacaccaaattgtagagtagcccttagaaatgaatcatacacattgcataagattttacccaataaggttgacccattagtatcacttatgatggtagaaaaagtacctgattctacatacgaaatggttggaggtttagataaacaaattaaagaaatcaaagaggttattgagctgccagtaaagcatccagagctttttgatgctttgggtattgcccaacccaagggtgtattgttgtatggccctccaggaactggaaaaactctgttggccagagcagtagctcatcatacagaatgtacattcattcgagtatctggttcagaattggttcaaaaattcattggagagggctccagaatggtcagggagctcttcgttatggccagagagcatgcaccttccatcattttcatggacgaaattgattctataggatcttctcgtattgaatctggctctggtggtgattctgaagtccaaagaaccatgttggagttgttaaatcagcttgatggttttgaagcaacc

SEQ ID NO: 2879 - DNA, 532 bp, Psylliodes chrysocephala
gctggaaattttggtgaagttacagaacaaattatagcaaaaattccgcctcacaatgataaacttacctattctcatggaaactatctttttcactacgttttagaaaatcgtattctgtacatgtgcataacagatgatgaatttgagagaagtcgagcatttttatttctcaatgaaattaaaagacggtttcaagctacttatggagctagtgctgatacagctattgcttatgcaatgaattcagaattttccacaatattggctacagaaatgaaacattattccgaatctcacgatcttgatacaatatccagggtccacagtgaattagatgaattgaagaatattatggttaaaaatattgataatattgcaatgagaggtgaaagactagaacttctggtcaacaaagcagataatctaaataatggatcgatgacatttaggaccacaagtagaaacctagctcgttcgttattttggaaaaacatcaaactctacgttattattggtgtcgtcgtaactg

SEQ ID NO: 2880 - DNA, 586 bp, Psylliodes chrysocephala
gtcgaatatgccattgaagcgattaaactgggatcaaccgctattggaatatgcacaagcgagggtgtcgttttagcagttgaaaaacgtataacttcccctctgatggaacccactactatcgagaagattgtagaagtcgacaaacatattggatgtgctgtttcaggtcttatggcagattcacgtaccatgatcgacagagctagaatagaatgccaaaaccactggttcgtttacaatgaaaatattagcattgaatcatgtgcacagggtgtttcaaatttagcaatccagtttggcgattcagatgatgacggtgctgcaatgtccagaccttttggagtggctattttgtttgctggtattgacgagaaaggacctcagctataccatatggatccatcgggtacttttgttcagtttgatgcaaaagccatcgggtccggttcagaaggagcgcaacagagtctacaagaagtataccatcgcagtatgactttggaggaagcgacgactgcagcgttgaccattctcaagcaggttatggaagaaaaattgaattctgcgaatgtagaagtcatga

SEQ ID NO: 2881 - DNA, 760 bp, Psylliodes chrysocephala
actcgaagatcagagagacaagttgcaggagaacttgatggctaataacaccgatttgccaagttatttaaccagatttcaatgggacatcgccaaatacccgatcaagcaatccctgcgaaacattgccgatataataagtaaacaagttggccaaatcgacgctgatctcaagaccaagtcgtcagcgtacaataatttaaagggaagtcttcagaatttggagaagaaacaaactggaagtttgctaacacgtaacttggcagacctagtcaagaaagaacattttattttagattcggattatttgcagactttgctggtcatcgttccaaagtctcaattcaatgaatggaacgctacttacgaaaaaattacagatatgattgtaccgcgctcgtcagagctcattactcaagatcacgaatacggtctattcaccgtttcgctcttcaaaaaggtcgttgaagaatttaagttgcacgcaagagaaaagaagtttattgtcagagatttcacttataacgaggaggaactggcagctggtaaaaatgaaattaccaaactcgttactgataaaaaaaagcaatttggaccgttggtgaggtggttgaaagtcaacttcagcgaatgcttttgtgcttggatacatgtaaaggcgttaagggtgtttgttgagtccgtattaagatatgggctaccagtcaattttcaagctatcctaatccatccaaataagaagacactgaaacgtttacga

SEQ ID NO: 2882 - DNA, 774 bp, Psylliodes chrysocephala
tgcccaagaagatccttaacgccaaaatcgcctgtttagatttttctttgcagaaggctaagatgaagatgggtgtacaagtcttgatcaccgatcccaatcacctggaagggatccgctccagggagctggacatcaccaaggagcgcatccagaagatcctggcgacgggagtgaacgtcatcctatgttccgggggtattgacgatctgtgtctcaagtattttgtagaaaacggcgccatgggggtgcgtagggttaaaaaagctgatttgaaacgtatcgctaaagctacgggcgccgcttttgtcacttcactcagcaacatggaaggggacgaaacattcgatgccaatatggtcggcgaggcagctgaggtcgtacaagaaagaatatccgatgacgaacttatcattattaaaggccccaaagcccgcacagccgcttcaatcatccttcgcggacccaacgacttttactgtgacgaaatggagcgctcagtgcacgacgcactctgcgtcgtcaaacgcgtcctcgaatcaaaaagcgtcgtcgtgggaggcggtagcgtcgaagcggcattgtcaatctatctggagaactttgcaacaacgctcagctccagggagcaacttgccatcgctgaattcgccagaagcttgctggtaattcccaagacgttggccgttaacgctgcccaagacgcgactgatctagtggccaagttgagggcataccagaactccagccagaccaaaaaggaccatgcacatt

SEQ ID NO: 2883 - DNA, 642 bp, Psylliodes chrysocephala
ttccaggcactcaaagaattcctgctgccaacccgataacccatactcaatctcctgtaactacatcaacttctataatagctattacttatgataaaggtgtattaattgctggagatttagtcgcctcttatggatctttagccaggtacagaaattgtcccagggtaattgaagttaatcctaatataatattaggagctggtggagattatgcagattttcagtacgtgaaaagctttattgagcagaaaataattgatgaagactgtttagatgatggtttaaaaatgaaaccaaaatctctgtattgttggcttacaagaatcatgtatcaacgtagaagtaaacttgaccccttctggaataatcttgtagtaggaggactgcaggatggtgtacctttcttgggaaccatagataaacttggcacagcttacacagataaagttatttgtactgggtatggagctcacattgctctccctattcttcgggatgctcttgataagaaaaccaacttgaatctgaatgacgccaaagctcttataaagcggtgcatggaagtgcttttttacagagatgcaagaagttttccaaaatatcagttaggtattattgataaggatgatggcgtgaaaa

SEQ ID NO: 2884 - DNA, 799 bp, Psylliodes chrysocephala
ttgggaaatgtcaaacatgcctttaaacttctaatttttcctgacactagagtgtttcagtgttcttccaactctaataaaaaagaatggttggataaattcgatcaagctaagaaaacaaggctagctcaggaacagcaaaaacgagaatcaattactgaaaaatccccatctcgctcagcatctattgagtcgcccacttataacccatttgaagaagatatgggtaccattcacccggaatggtttttagatattcctgaagaacttgacgtttgtgtagcccaaagacattttgaagaagccttgtctttattacagaaagccaaagattatataaatcagactgcttcttccagtgagaaacatgatcacgttctcattgatattcaaagaaaggtggaacaaagacagaacagtctaactgaagtgctaatgaaagaactagaagttaatcctgacaaatctctgcaaggtggtttgagagcagcacgtagagctgttaggttgctgaatcaattaggaagggaaactcaatcatgcaacctgtttctgaaattgtgcagtagtatgttgagaactcaatgtaaacgagtaaaacgagaaggttcgaccacaacttatataagacatttatctagtgtagtttttactaatatgtgtcacatgtctgatgagtttttacgagcctttcccgattcgccagcttgtgcttcagcttatgttgtgtgggccagcaatgaactgttacaatttacaacccatttgattaaacaagtttttatgcctcagacttccc

SEQ ID NO: 2885 - DNA, 750 bp, Psylliodes chrysocephala
gacgcagatcactcagtatttggctgaagccggtttcacagccaggggaaaaataggatgtactcagccaagaagagtggccgccatgtcggtggctaagcgagtagcggaggagtttggatgtagattgggacaggaagtcggatataccatcagattcgaagattgtactagccctgagacgatgatcaagtacatgacagacggtatgttgcttagagaatgccttatggacttagatctcaaaaattactcggtgattatgttggacgaggctcacgaacgtaccatccacaccgacgtcctattcggtcttctgaaacaagctgtcttgaaacgcgaagaactcaaattgatcgtcacctcggcaacgctggacgccgtcaaattctcgcagtacttcttcaaggcgccgatattcacgatacccggcagaacgtttccggtcgaagttttgtacaccaaagaaccggaaactgattatttggacgccagcttgatcaccgtgatgcagatacacctgagggaaccgcctggcgatattttactgtttttgaccgggcaggaggagatcgatacagcctgcgagattctgtatgaaagaatgaagagtctaggtcccgatgtacctgaactaatcatcctacccgtgtattccgcgttaccatcagaaatgcaaactaggatatttgaaccggcaccgccgggtagccgaaaggtcgttatagctacaaatattgccgaaacgtc

SEQ ID NO: 2886 - DNA, 799 bp, Psylliodes chrysocephala
tagctggtcaagaaagtcactgtcaattatataaagttaacacaaaattagtagaacaagttaaagtggagaacattggaaatgatatacatattaaacaaagaaatacaaatttaaaacctaaagaacaagtagataataataaaaatgttaaaaaagaattatactatactcttaatcctatggacagtgtacagacagattttaatggttctgaaccattatctagagtagttagaattaattatgatggaaaagtattagcaactggaggcactgatggcgatgtaagactgtggaagtttcccagtttacaacccctcttcattctaaaaggccataagaaagaaatagatgatgtagactttagtagacatgacaattatgttatttcaattgctaaagatggtttaggaatattgtgggattgtaaaacgggaaatgaaagatcaaaactgacatggaaacatccagaaggatcaaagtatctgtataaaagatgtaggtttggtgttattgaagaacaaaaaaataaatcagcattatatatgattgctaacgcagtcaatcctaaacacaagtctttccttcaacaatggatacctgaggagaatgacttgaaaaaatattcagaatttgatgaaactcttgcaaccttggcagtgcgagatgatggcagatttgttgcagttggtaccatgtttagtggatctatttctatccatgttgcctttagtttacagaaaatattaactgttgctggtgctcattccatgtttgtgactggtcttgaattcct

SEQ ID NO: 2887 - DNA, 784 bp, Psylliodes chrysocephala
aagtacaaaaaggagggcaaggctaaggaactagcggagctcataaaggctactaggccttttttgagtctaattagtaaagcgaaggctgctaaattagttagatcgttagttgactactttttggatctagaagctggtattggtatcgaggtccaactttgtaaagaatgcatagaatgggcaaaagaagaaagaagaacgttcttgcgccaatccctggaagcccgacttattgccctttatttcgatactggaatgtacgccgaagccctacatttagaatccacattgttaaaggaattaaaaaagcttgatgacaaaaatttgttggtggaagttcagcttctcgaaagcaaaacatatcatgctttgagtaatttaccgaaagcccgagccgctttaacctcggcacgaacaacagccaatgctatatattgccctccaaaaatgcaggctgctttggacttgcaatctggtgtcctacatgcagccgatgagaaagacttcaaaactgcatactcatatttctatgaggcattcgaaggtttcgatagtgtcgagtcccccaaggctctaactgctcttaagtacatgcttctgtccaaaattatgattaacagtcctgaagatgtccagcaaattgttagtggaaaattggctattaaatatgctggacaagatattgatgcaatgaaagcagttgcacaagctgcccacaaaaggtccctcgcagattttcaacttgccgtaaaacaattcaaacacgaactagaagacgatg

SEQ ID NO: 2888 - DNA, 793 bp, Psylliodes chrysocephala
aaaactcctagacgaaacccatcgtgaaaaagcgcgtttggaaattgatgttaagcgacttttagaagaaaatgatgaactgaaagctgatttaggtaagaggaacaaggagttgcaattagccgaaagttctgttagaatctatgaaactagatgtaacgaatcgcagctcaaagctaatcaggcaattgctgatgctaagaaagctatcgccgatgctaaagaactcgaaaaagaacgggacaagttaaggaaacttcttgaagcaacacgtaaacagttggaacaggaatctttggctagagtagatgtcgagaataaaaatcaaagtcttagggaagaactatccttcaatgatcaggtgcaccagcaagagctgacagaaacccgcacccgccgtcaagtcgaaatcagcgaaatcgatggcagactcgccgaaaagtacgaagccaagctccaagaagccctacaagatctcagggatcaatacgaatctcagatggccaacaatcgccacgaaatcgagttgctctatgagcagaagatcaaaaacttgcaggcggccaacgatagaaaccagaattccgcttccgctgctctcgacgagttgagacaaaccaggacgagaatcgacacgatatcgtcgaggatgcaggatttggagaaccaaaacgccggcctggccgccagagcaagggacttggagaagttgctggagaatgaacgaatgcgtcatgctgaagatctagctctattggaaagagagctccaaagacttagggaagaaacagca

SEQ ID NO: 2889 - DNA, 665 bp, Psylliodes chrysocephala
gaagatgatcaaatcgacgccgaggtcctaaactcgctcgctgtaacaatggagaacttccgttacgccatgaccaagagcagcccgagtgctttgcgcgaaactgtcgtcgaagtaccaaacattacttgggacgatatcggcgggctggccaacgttaaaaaggagttacaggaattggtgcagtaccctgtcgaacatcccgacaagttcctcaagttcggtatgcagccgtctagaggcgtgctgttctatggcccaccgggttgcggtaaaactcttttggccaaggccatagcgaacgagtgccaggccaatttcatatccgtaaagggaccggaattgttgacgatgtggtttggagagtcagaagccaatgtcagagatattttcgataaagctagatctgcggcgccttgtgtgctgttcttcgacgagttggattccatcgctaagagtagaggtgggaacgttggagatgcaggcggtgctgcggatagggtgattaaccaaattttgacggaaatggacggcatgggagccaaaaagaacgtgttcataatcggtgctactaacagaccagatattatcgatcccgcaatattacgtcccggccgtttggatcaactgatctacatcccattgccagatgaaaaatccaggga

SEQ ID NO: 2890 - DNA, 650 bp, Psylliodes chrysocephala
tgtgaagatctcctttcgtctgtagatcaacctttaaaaattgctaaagacaaggattctgggaaagatttcctcttatgcgattataatagagatggagattcttacaggtcaccttggtctaacacctattatcccccattggaggatggttctatgccatccgaaaggttaagaaaattagaattagatgcaaatcatgcatttgatcaatatagagaaatgtattttgaaggtggtgtatcttcagtttatttttgggacttagaccatggttttgcaggtgtaattctaataaagaaaactggggatggtagtaaaaaaataaaaggatgttgggactccttacatgtagtagaagttcaagaaaaaagttctggaagaaattcacactacaaaatgacttcaactgccatgttgtggctacagaccaacaaacaaggatctggaacaatgaatttgggtggcagtctaaccagacaaattgagcaagatgcagctgtcaacgaaatcaatcctcacatcgccaacattggtcgcatggtagaagatatggaaaacaaaattcggaacacacttaacgaaatttactttagcaaaactaaggatatcgtgaacagcttgaggtcagtccaacctctgacagaaag

SEQ ID NO: 2891 - DNA, 739 bp, Psylliodes chrysocephala
caatggacctgggaacaataaagaagcgcttagagaacaactattattggtcgggcaaagagtgcatacaggacttcaacacaatgttcacaaattgttatgtgtacaacaaacctggagaagatgtggttgtaatggcccaaacattggagaaagtgtttttgaccaaagtggctgatatgccaaaggaggaatttgtagtcgaaagtcctatcaaagggacaaaaggaaagaagggccgaggaagttccggcggcccaggtaccccctcgacaccggtggtggcggcggttccgccaccaacaccaacggcaactggtagaggcaggccgcctgctactgtttcatctacaagtgcgactccagttgccactaccacaggatcatcaggtttaccattgggtacccaagctccagctacagtaccaggcagcacagcaacaaccacgatagcacctgcaactaccaataatagctctctggcttcccagcagcttactacttcagttggatccacacacggagctggagctcctttggccaattccttagactctagtggagtgctacctggaaatgtaatacctccggcacaaccagcaaaggtaaaaaaaggcgtgaagagaaaggccgacacaacaactcctgcgaccgcctatgattatccgaccgcattagaatcgaaatctgcgaaaatttcaacgcgcagggaatcaggaaggcaaattaaaaagcccac

SEQ ID NO: 2892 - DNA, 762 bp, Psylliodes chrysocephala
caatttcgttcatcagcaggtctcaatgaaccatcgccagccctacagcgtcagcgacaaagctggtcaccaaacctcggccgagtcctgggggaccggtcgcgccgtggcccgtataccccgtgtacgcggcggcggtacccaccgatcgggccagggagccttcggcaacatgtgtcgcggcggtcgcatgttcgcgcccaccaagccgtggcgccgctggcacagacgcgtcaacgtcaaccagcgtcgctacgcgctggcgtcggccgtcgccgccagcggcgtgcccgccctggtcatgagcaagggccacgtggtcgatcagatacccgagctgccgttggtcgtcagcgataaggtgcaggagatgcgcaagaccaaggaggccgtgcagttcctgaggaggatcaaggcttgggctgacatccaaaaggtttacaagagccagcggttccgtgctggtaaaggaaaaatgcgtaacaggagacgtatccaacgtaaaggacctctaatcgtttactacaaagatcaaggtcttcgtcaagctttccgtaacatccctggcattgatctaatcagtgttcaaaagttgaacttgctgaaactggctcctggtggtcacgtaggtcggtttatcatctggaccgaatccgctttccagcgtttagacaaattgttcggtacatggaagaacccgtcgaccgaaaagaagggttacaatttgccccagcccaagatgtccaacaccgatttgtctag

SEQ ID NO: 2893 - DNA, 678 bp, Psylliodes chrysocephala
ttgtcaccagaacaatttgctgaaaatatgagagacaactaccaaagacatgaagttgatcaggaacatgttgaacctgcggaggtagcaaaagattttatttcacctaagtttgctaatggtgatgaagtcttgcaagctgccaaatatatggttgccttgcaaatagctagagaacccttagtgagaaaatgtgtgagggaagttttttttgaaagagccagaattaacgtttatccaaccaaaaaaggtcaaaaagtaattgacgaatctcacaattgttatagtatgaaatatgtaaaaaataagcctgtaagagatctagcgggcgatcagtttttaaaattgtgccttgctgaagaagaaaaccttcttactattacaattaatgaccacatcgaaggtaacacaactaattcgtatattgacgaagttaaacaactttacataaaagacgagtttagtaaaaacgtacaagactggaatgctttgaggatggaatgtgtggagagagccttaacgaaaagtgttttacctgatttaagaactgaattaaaaaggactttgttgactgaagccaaagaatttgtacttaaagcatgttgtaggaaactttataattggataaagattgcaccttactctatcacgtttcccgatgatgacgaggatgattgg

SEQ ID NO: 2894 - DNA, 678 bp, Psylliodes chrysocephala
ttttgggaagcgatagtgaatcaggatctggctctgaaggatcagatgatgaatcagacgaagagggggaagaggaagtaaaagattctggaactattattgacaacacagaaactaatctaatagctcttagaaggacgatatatttgacaatacaatctagtttagattttgaggagtgtgcacataagctattgaaaatggaattgaagcctggacaggaaattgagttgtgtcatatgttcctggattgctgtgcagaacaaagaacatacgaaaaattctatggactgttagcccaaagattctgtcaaatcaacaaaatatacattgaaccctttcaacaaatatttagagacacatatgcaaccacacacagattagatgctaataggttgagaaatgtgagcaaattttttgcacatttgctgtttacggatgctataaattggcaagttcttgacataatgaaattaaacgaagaagataccaatagttctagtaggatttttatcaaaatcttgtttcaagagttggctgaatatatgggattgggaaaattaaacgcaagactgaaagatgagactcttcaagaacatttttctggtttgtttcctagagacaatcctaaaaacaccagattttccattaacttctttacatccattggtttgggag

SEQ ID NO: 2895 - DNA, 783 bp, Psylliodes chrysocephala
ccaaagcgttaccaaaaacttgaagaagtttacagattcaaaacgcatgacgcaaagcgacaaacaatcgatgaaggatttgtcgaccatgatcaagaaaatgccccaatatcagaaggagctgtccaaatacgcgacccacctccatttggccgaagactgcatgaaggcttaccaggggtacatcgacaagttgtgcaaagttgaacaggatttggccatgggcaccgacgcagaaggtgaaaaaatcaaagaccacatgcgcaatatcgtccccattcttctagatccaaaaataactaatgaatatgacaaaatgcgcatcattgccttgtacgctatgaccaagaacggaattactgaagaaaatttatcgaaacttgcgactcacgcacagataaaggacaaacaaaccattgccaacctccaactgttgggcgtcaacgtcattaacgatggagggccgagaaagaagcagtacaatgtgccgcgtaaagaaaggatcacagaacagacttatcaaatgtcaagatggacgcctgttattaaagacattatggaagattgtatcgacgataagttggatcaaaagcactacccatacttgagcggccgggcgcagactactggatatcacgcagcgccctctagcgcgcgctatggacagtggcacaaagatagaggccagcaagccgttaagaacgttccgcgcattttggtctttgtggtaggaggcatcagtttctcggaaatacgatgcgcctatgaagtgacaaacgctca

SEQ ID NO: 2896 - DNA, 772 bp, Psylliodes chrysocephala
actctcaatgtgttgatgcttatatagatcacagtcaaatgggctgtttgtccagcaaagacgtttttattagttttctgaatctgtgtaaatacaacaatgaaattatccagaaagtttttaataatccagaacaagttatggctaaatttgtattaaacatatatcaattaaaattggtggaatacattgatgacaaactgaattctaaattaggaacttataattacttacagacattatatgaattgtattcaaagactaatcagttatcaaatgatttaagtgtgtttaatatgggaaatgataaaaattatttgagaaagttaacaactaatatttttaataaatatataaatgactatattacaatggaactcaaatgcctgaaagacagatgttcggcaaatttacaaaagtactatgagtcaaaaaatcatcaaaagaagcagattcaatctggcggtttccaagaccttagaagagatttacaagcagtgataggtacaagagcaaatattaatatagcccaaatagaaaattatggtggcgaaactttcttgtctgaggaattggctataacaattttccaagacactaaacaggcttttcaacgttgtcagttgttatcgaaaaacaatgacagagcatcaaatgcaactcaaatcttagacagactgataaatagtttacttatagagcatgtcgattatgccgtagaactaggtttgcaagctgtacctgttggggaaggatccaaaaatcctcctgt

SEQ ID NO: 2897 - DNA, 659 bp, Psylliodes chrysocephala
tcgctttagaaaccatcgatttacaaaaagatccctattttatgaaaaaccacttaggttcttatgaatgcaagctttgtttaaccttacacaacaacgaaggtagttatttagctcatacgcaaggaaaaaagcatcaagctaatttagctagacgagcggccaaagaagctaaagacgcaccctccctattgcaaccagagaagcctcgagtcgaacctaagaaattcgtgaaaatcggtagacctggttatagagttacgaagcagagggacccagaaaatggccaccagagtttactgtttcaaattgattatccagaaatcagtgatgtagtccttcctcgacatcgctttatgtcagcttatgaacaaaaaatagaacctccagaccgcaaatggcagtaccttttgtttgcagctgagccatatgaaaccattgcctttaaagtaccatcaagggaagtggaaaaaactgacaataagttttggactcattggaataaggatacaaagcagtttttcctgcagtttgcgttcaaaaatgagaacaaacgtactgctaatactgttgtgacaagacatcagttggtcagtggagtgccacctcctccgatgttgccagtgcctccacctcctaggcctcctatgtttaatcca

SEQ ID NO: 2898 - DNA, 252 bp, Psylliodes chrysocephala
acctgtgaaactattaccggcgaagtttacagaggaaaacttatagaagctgaagataatatgaattgccaaatgactcaaattactgtaacttacagagacggaagagtagcacaattagagaatgtttacattagaggatctaaaattaggtttctaatattaccagatatgttgaagaatgctcctatgttcaaaaagcaaactaaagctgggactgcaggtagagggaaatcagcaattcttcgagct

SEQ ID NO: 2899 - DNA, 661 bp, Psylliodes chrysocephala
aagaaactgacaacttgggtgtaacgcatgttttgagaactgcagcaggtttaagcactaaaaatgcttcacaatttgccattattcgtaatattcaacaagttggtgctaatttaacagctacttctgatcgtgaaactatttcttatactttagaaggtactaaagaagctgttgaacgagctttgccatttttaacagaagtagccactcaacaagaatttaggccatgggaagtttctgaattatcaaacagactattgttggatattgcaaccaggccacttcagctaagggcagttgatttgctgcacaatgctgctttcagaggtcgtggattaggcaattccctctttattcctaagccacaaattggaaaaatatcttctgaaaccttgcagcactatgttgccagcaattttttgagtggtcgcactgctgttataggatcaggaatcagtgaaagagagttggcacagtatgcaaactccttgaaaattggaaatggtgaaggtaatactagtcccagcccttacaaaggtggcgaacttagatcaaacaaaggtggaccacttgcctttgttgctgtagcaggagaaggaactgctcttaaaaacacccaagaagctcttgcttttgctgtcctacaaagagccatagg

SEQ ID NO: 2900 - DNA, 202 bp, Psylliodes chrysocephala
gacgaaaatgatcgaatgactaatgaactccaagaaaaaattggggttctaaaatctttgactatagacattggaaatgaagttaaatatcaagataaacttttgagagatgtggacgatgatttagataaaactggaggctttttaggaacaacgatgaataaagtattaaaattatccaaaggtggtcagcattatatca

SEQ ID NO: 2901 - DNA, 663 bp, Psylliodes chrysocephala
caattgataaaggtcccccaattttggcagaagattacttagatatccaaggtcaacctatcaacccatggtcacgtatttatcctgaagaaatgatccaaactggtatctccgccatcgacgtaatgaactccattgcccgtggccaaaaaattcccattttctcggccgctggtctgcctcacaacgaaattgctgctcaaatttgtcgacaagccggtcttgtcaaaattcccggcaaatctgtattggatgaccatgaagataactttgctattgtgtttgctgctatgggagttaacatggaaactgctaggtttttcaaacaagatttcgaagaaaatggttccatggaaaatgtatgtctgtttttgaacttggctaatgatcccactattgaaagaattattacaccacgtttggctcttacagcagctgaatttttggcctaccaatgcgaaaaacacgtcctggtcatattgactgatatgtcttcatatgctgaagctttgcgtgaggtatccgccgccagagaagaagtgcccggtcgtcgtggtttcccaggttacatgtacaccgatttggccaccatttacgaacgtgccggtcgtgtcgaaggtcgtaacggttccattacgcagattcccatcttgactatgccta

SEQ ID NO: 2902 - DNA, 752 bp, Psylliodes chrysocephala
gaacttttatctccggacgagtctgtcatatcccgggacgaagaaccttccataacccgcttttccggtcgacgcaaatcggtgttcgccgaaacgtacgatcccgaagaagatgacgacgaggacgccaacaaaatcgtctatccgaaatcggacgagcaacgccaaagactgtcgtccgccgtcggcaatattttgctcttcagatcgctggacagcgaacaaatgaacgaagtattggacgccatgttcgagaggatcgtcaagaaggacgaattggtcatacggcaaggagacgacggggataatttttacgttattcaaaatggaacttaccacgttttggtcagcaccgataactcgccggagccgaaacacatccacacctacgaagacagcggcagcttcggcgaattggcgttgctgtacaacatgccgcgcgcggctaccgtaaaggccgtttcggaaggctccctctgggcgatggacagacacacgtttaggcgtatcgttctcaaatcggcgttcaaaaagaggaagatgtacgaaacgttgatagagagcgtaccgatgctcaagactttgcagccgtacgaacgtatgaatcttgccgatgcgcttgttcccagagtgttcaaagacggggacagaatcataaaacagggcgacgcggcggacggaatgtatttcgtggagcaaggccagatcatcatcagcgttttagacgatagcggcaaagaggtggagataaa

SEQ ID NO: 2903 - DNA, 698 bp, Psylliodes chrysocephala
atctgttgttgcatcaggatggatcaaaaatggcagtgagacttgctggtggtctccaaaaaatggtagcactgttgcaaaggaacaatgtcaaatttttggctatcgtgactgattgcttgcaaattttggcttatggtaatcaagaaagtaaactgatcattttggcttcacaaggacccatcgaattggtcagaattatgagatcttatgattatgagaagttgctatggaccacttcaagagttttgaaggttttatcagtttgttccagtaataaaccagcaattgtagaagctggtggaatgcaagctcttgctatgcatttgggcaacccaagcaccagactggtgcaaaattgcctttggactctaagaaacttatcagatgctgctactaaggttgatggtctagaaagcttgttgcagtccttggtgcaggtaaatgtactggcttcatctgatgtcaatgttgtaacatgtgcagctggtattctttctaacttgacctgcaataaccaacgtaacaaagtgacagtttgtcaagtaggaggggtcgacgctttggtacgcactatagtcacagctggagatcgtgaagagatcacagaaccggctgtatgtgctttacgtcatttaacatccagacatgttgaatctgaaatggcacagaatgccgtcaggctcaactatgggata

SEQ ID NO: 2904 - DNA, 665 bp, Psylliodes chrysocephala
taaacataaaaagcgccgaccatatttggcttctgaatgcaaaagcttacacgcctgtgaaaaatggagaatgcaaatcataagggagatagcaaaaaaagtggcacaaatacaaaatgctggtttaggagaattcagaattagggatttaaatgatgaaattaataaattgcttagggaaaagagacattgggaagatcaaatcaaagaactgggaggtccagattatcaaagagttggacctaggatgttggatcatgaaggaaaagaggtgccaggaaatagaggttataaatattttggagctgctaaagaattgccaggtgtaagagagctttttgagcaagaaccaccccctcctcccagaaagagcagagctgaactgatgaaagacatagacgccgattactatgggtacatggacgatgatgacggcattcttattccgctggaagtaaaagctgaaaaaatagctattcaaacttctatcactgaatgggtaaataataaagagaagaatttgggagataatgaggaagtggaagaaaatatttatgctgtagaaggttcggaggatgaagaggaaacagttcaacaaattgacggatcccaacaaagattcgtcgcgcacgtaccggtcccatcgcagcaagacatagaacaag

SEQ ID NO: 2905 - DNA, 532 bp, Psylliodes chrysocephala
gtaccggcaaaactactttcgttaaacgtcatatgactggagaatttgaaaaaaaatatgtagccactttgggcgtggaggttcatcccctagtgttccacacaaaccgaggcaaaatccgttttaacgtatgggataccgctggtcaagaaaaattcggaggcctacgagatggatactacattcagggacagtgtgccatcataatgtttgatgtgacttccagagtaacatataaaaatgtaccaaattggcatagagaccttgtaagagtgtgcgaaaacattcctattgttttgtgtggaaacaaagttgacatcaaggatagaaaagttaaagcaaaaagtatcgttttccataggaagaagaatttgcagtattatgacatctctgctaaatcaaattacaatttcgaaaaacccttcttgtggttggcaaggaaactcattggagatcccaacttagatttcgtcgccgctccagctctactgcccccagaagtccagatggatcctcaatggcaacaacaaat

SEQ ID NO: 2906 - DNA, 727 bp, Psylliodes chrysocephala
cagttgacgatcctaggaagcttaaacctggggaaattgatcccaaccctgaaactaaaccagctaggccagatcctaaggatatggatgaggatgagttagaaatgctgtctgaagctagagctagattagctaacactcaaggcaagaaagccaaacgcaaggcccgcgagaagcagctggaagaagcccgacgtttggcagccttgcaaaaacgtagagaattgagagccgctggtatcgaagtaacatcaagacgcaagaaaaagcggggagtcgattacaacgcggagattccgttcgaaaaacgtccggcgatcggattctatgacacatcgaacgaggctctagacccgatggctccggatttctccaaaatgagacagcaacatttggacggggagctccgaagcgaacaagaagagagggagcgcaaaaaagacaagcagaagttgaagcaaaggaaggagaacgatataccgcaagcgatgcttcaaaaccaggaaccggcgaagaagcggtcgaaattggttttgcctgaaccgcaaatttccgatcaagagatgcatcaggttgtcaaattgggtaaagctagtgaaactgccagagaaatagccacagaaagtggaatagaaactacggatacgcttttgaatgattacatgtttaccccgcaagctgccgccactcctaggactccggcaccccaaactgacaggattctcca

SEQ ID NO: 2907 - DNA, 429 bp, Psylliodes chrysocephala
ccagaagatatgcaacaacagattattaaagaaacgtttcagttagtttcaaaaagagatgataacgtatgtaatttcttagaaggtggaagtttaatcggaggcagcgattataaattaatatacagacactacgccacattatactttgtattctgcgtggattcctctgaaagcgaattaggcattttagatctaattcaagtttttgttgaaacattagacaaatgtttcgaaaatgtatgtgaactcgatttgattttccacgtcgataaagttcattacatacttaacgaactcgttatgggtgggatggtattagaaacgaatatgaccgaaattttaacaaggatagaggatcaaaataaaatggaaaaacaagaagccggtatagctgcagctccagctcgagcggtttcagctgtaaaa

SEQ ID NO: 2908 - DNA, 718 bp, Psylliodes chrysocephala
aaggaagattaaagcctgggttaaataaagtagagaaggtgccaaaaaaattcataaataatgtaagtggtcttaaacaaaaagttgaagaattaaaacttaatctgccttggattgaaagacttgactgtacaagttcacaagccccattagcaccagaattcgcagctcaaatgttaattcatgaagaaaaaaggagtaaccaattgaaaaataataagaaacttccccaatttagtccatctgaagacccagtacttaacgattttaaaagagaaattatgtttcaaaggcaggcacaggctacgattctagaagctatacctaaactaaaagcaatgggaatttctacgaaacgaccagatgactactttgcagaaatggcaaaaacagatgcacatatgcataaaattcgagaacaactacagaaaaaacaagaacaacaaaaaagaattgaaagagtaaaacagctaaggcaacaaagaaaagatggaaagatgttacaaattcaaacaaaattacaaaggtctcaagaaaagaaagaaatgcttgcacaggtgaagaaagtccggaaaggcgtgagcaaaaatctcgattttcttgatggtaagaataaaccttccaaaaagattattgaaaaacgcaaaatgaaagataaaaaatttggttttgggggtaaaaaaagaggtatgaagaaaaatactagagaaagcgcagg

SEQ ID NO: 2909 - DNA, 750 bp, Psylliodes chrysocephala
gacgcagatcactcagtatttggctgaagccggtttcacagccaggggaaaaataggatgtactcagccaagaagagtggccgccatgtcggtggctaagcgagtagcggaggagtttggatgtagattgggacaggaagttggatataccatcagattcgaggattgtactagccctgagacgatgatcaagtacatgacagatggtatgttgcttagagaatgtcttatggacttagatctcaaaaattactcggtgattatgttggacgaggctcacgaacgtaccatccacaccgacgtcctattcggtcttctgaaacaagctgtcttgaaacgcgaagaactcaaattgatcgtcacctcggcaacgctggacgccgtcaaattctcgcagtacttcttcaaggcgccgatattcacgatacccggcagaacgtttccggtcgaagttttgtacaccaaagaaccggaaactgattatttggacgccagcttgatcaccgtgatgcagatacacctgagggaaccgcccggcgatattttactgtttttgaccgggcaggaggagatcgatacagcctgcgagattctgtatgaaagaatgaagagtctaggtcccgatgtacctgaactaatcatcctacccgtgtattccgcgttaccatcagaaatgcaaactaggatatttgaaccggcaccgccgggtagccgaaaggtcgttatagctacaaatattgccgaaacgtc

SEQ ID NO: 2910 - DNA, 727 bp, Psylliodes chrysocephala
cgacccttctctacgaaaatccggagtcggcaacgttttcatcaagaacttggaccgatccatcgacaacaaggccatgtacgacaccttctcggccttcgggaacattctcagctgcaaagtggctcaagacgagagcggagtcagcaagggctacggtttcgtccactttgaaaccgaagaggctgccaataaatccatcgaaaaggtaaatggtatgctgttgaacggcaagaaggtctacgttggtcgattcatcccgcgcaaagaaagggaaaaggaactgggcgaaaaggccaagctcttcacgaacgtttacgtgaagaatttcggagaggacttgtccgaggagcagctgcgaacgatgttcgagaagtacggcaagataaccagctacaaaataatgagcaaggatgacggcaaatccaaagggttcggattcgtcgctttcgagagccccgaggcagccgaatcagctgtcgaggccctaaatggcaaagagttactggaaggcaagcctttgtacgtgggaagagcccagaagaaggccgagcgccaacaggagctgaagcggcgcttcgaagccctgaaaatggaacggctgaaccgctaccaaggcgtaaatctctacgtgaaaaacttggatgacaccatagacgacgaacgcctgcgcaaagaattttccccgttcggcaccatcacctcggccaaggtgatgatggaagaa

SEQ ID NO: 2911 - DNA, 717 bp, Psylliodes chrysocephala
tgtgcaatcaaagttgaaccttctgcagaaaggtgtgttgccacattattggaccttattcagacaaaagtcaactatgtcgttcaggaagccattgtggtgattaaggatattttcaggaaatatccaaacaaatatgaaagtattatcagtacattatgcgaaaatttggatactcttgatgaaccagaagccagggctagcatggtgtggattataggagagtacgcagagagaatcgataatgctgacgaacttttggatagttttctggaaggttttggcgatgagaatgctcaagtacaacttcaattgttgactgctgtagtgaaattattcttgaaacgacctcaacacactcagggcttagttcagcacgtactaagtttagcaactcaagattctgataatcccgatttgagagacagaggttttatctattggagattattaagtaccgatcccgctgcagctaaggaagtggtgcttgcagacaagcccctcatttccgaagaaactgatctcttagaaccgacccttcttgatgaactgatttgtcacatatcatcactggctagcgtttatcacaaaccacccacagcatttgtagagggtagaagtgctggaatacgaaaaacattgccagctagacaaggttctgcagatgatagtgctagcgctccggagaccactgtcataccgaaccaagaaagtctg

SEQ ID NO: 2912 - DNA, 355 bp, Psylliodes chrysocephala
ttcatctttggcccctaaaattggtccactagggttgtctccaaagaaagttggtgacgatatcgctaaaggaaccgccgactggaaaggtttgaaaataaccgttcaattgaaaatccaaaatcgtcaggctacaatttctgtcgtaccatcagccgcctctcttattattaaggctgtaaaagaaccaccacgtgatagaaagaagcaaaagaacattaaacacagtggcaacattaccttcgatgaaataatcacaattgcaaagcaaatgaggccccggtctatggccaaacaactttctggttgtgtcaaggaagtattgggtaccgcacaatctgtaggttgcaccatc

SEQ ID NO: 2913 - DNA, 652 bp, Psylliodes chrysocephala
gcaaaagagcactgattctcgttggaggatatggtacaagactgagacctctcaccttgagtagaccaaaacctcttgtagaatttgccaataaaccaatcttgttgcatcagattgaagcattagtagatgctggagtcacagaagtaattctagcagtatcatatcgtgccaaacaaatggaagaagaactaaccatagaagctacaaaactaggtgttaacataatctattctcatgagactgagcctctaggtactgcaggaccaatagccttagccaaagagcatctttccaaaagcacaaagccattttttgtacttaattcagatataatctgtgactttccatttagagaactagccaagttccatgaagatcatggtaaagaaggtacaatagtggttacaaaggtcgaagagccttctaaatatggtgtagtggtttatgataaaactaattgtatacaaagctttattgaaaagccccaggaatttatctcgaacaaaataaatgctggcttgtacattctaaaccccagtgtaatcaacagaattgaccttaaaccaacttctattgaaaaggaagttttcccaaatatggcttctgacaaacagttgtatgcatttgaattgaaagggttttggatgga

SEQ ID NO: 2914 - DNA, 651 bp, Psylliodes chrysocephala
gcccagtacaataaagaccaactcaccccagttaggatagaaaatgccgatcacttggtgctgattacagaatacaacgatttaggtaacaacagattcttcgatccccgtagtaaacaaagtttcaaatacgaacatttaagaaaagaggcttccgattaccagccctataccccagattctgctacggagccttggcgggctgccctagatgcggagtttgtccaatacacgaggaaccattacaaggacggcgtttgcagcgtcgtggggcgcaaccaaggtggtgctattacacttacagcttgcatagaagatcaccagtttcaacctaagaatttttggaacggtaggtggaggtctcagtggtctgttagcttaacggatgagtctacggccgaagtaagaggtgtgttgaaggttcaagtccattattatgaagaaggaaatgtccagctggtaagcactaaagaaataaaagaaactattccggtttccaatgaaactcaaacagcaaaagaaatcatccaagtgattgagaatgccgaaaacctgtaccagacggccatctctgagaattatcaaaccatgtctgacaccacattcaaggcgctcaggagactcctgcctgtcaccaggacaaaaatcgat

SEQ ID NO: 2915 - DNA, 730 bp, Psylliodes chrysocephala
gagtttatggtgacccacatgtcgttactttcgatgacgtagagtatacttttaatggcaaaggagaattttctttggtaaaatcagttactaaattagataatttagaagtacaaggtagatttgaacaaatggaccctaatgcttacggtgaagtcagagctacacagttgacatcaattgttgctaaaggaaacaacactatctctgtggagattagaagaaggcctttggattctaggtggagataccgattggatgtaatagctgataatagaaggttatattttgacaggccttccttgaagttccaacattttcaaggtgtaactatttataccccaacttatatactgaatcagtctgaagtgttgattatgtttgataacggagccggtgttgaagtattagataatcaaggttacatgagtgcaagagtctttttaccatggtcatttataaacaaaacagttggtttatttggaaactggagtttcaacaaagaagatgactttgctttaccagacggcactaaggctgctgtagtaagtaatattaacgatatggaaagagtgtacaatgacttcggttcaaaatggatgttggatgacgtattagatccacaaaaaggacgcgcattgttctatagagagttcggacgaagttcttctacatataataataaaactttcaaaccacagtttttaatgatgccggaagacattatacc

SEQ ID NO: 2916 - DNA, 188 bp, Psylliodes chrysocephala
tggttcagtaggagttgaagccgagggtgaaaaacttaaaaaagtcatcggcgaacgtaatggaatgtgcgttgaagaacttatcactcaaggtcgtgaaaaattgagttccctgcccgttggtggaggtgcacctgcagctgctgttgcttcagctgccccagctgctgccgcagagcagaagaaag

SEQ ID NO: 2917 - DNA, 793 bp, Psylliodes chrysocephala
attgtagctgaatgcaatgctgttaggcaagctcttcaagatttactttcagaatacataacaaatattggcaataaagacaaaagtgagagtcttaacagggctattgacaatatgggcagaaagacccgtgacctcagaagacagctcagaaaagccgtagttgatcatgtttctgacagtttcttggaaaccaacgtacctctattggttctaataaaagcagctcaaaacggcaatgaaaaagaagtagaggaatatgcggtcgtctttactgaacattccaataaacttgtagaagtagctaacctcgtctgcagcatgtcaaacaatgaagatggtgtcaaaatggttcgatatgcagctgctcagatagacaatctttgcccggaagtaataaacgcagctagaatcttagctgccagacctcgcagtaaagttgctcaagagaatatggaagcttttaaacaatcttgggaacaccaagtacgaattttgacagaagctgttgatgatatcactactattgatgactttttggctgtttccgagaaccatattcttgaagatgttaataaatgcgtcctagcacttcaagaaggtgaggctgatacattagatcgcactgctagcggaatcaagggtagatctaacagggtatgcaatgttgtaacagccgaaatggataactatgaaccttgcatttataccaaacgtgttctggaagcagttaaagtgctgaacgatcaagtaatgcccaagtttactcaaagagtacaggttgcagtacaag

SEQ ID NO: 2918 - DNA, 672 bp, Psylliodes chrysocephala
tgcttctctcttcggtagtacgtctacaagtgttgctacaattgctccaggtttgggtttgtcaacagcagcacctacagctttttctacagcagcatccaccgctttaagtactaccacagtagctccaacttattcaactactacacttccatctactggttccttgactttcggtcaattggaagactctataaacaaatggacgatcgatttagaagaacaaggcaaattcttcatcaaccaagcaaagcaacttaatgcatgggactctctgcttattaccaacggagagaagattcttaatttgaatggcagtattgagcgggttaagcaacaacaacagcagttggatcaagaactagatttcgtattggcacaacagaaagaattggaagagctaattacacctttggaaaaggaattgttggaaattcctgtcactgatatagataggaatcaaatgtatcaattctcagaaattattgactctcagttgaaacaaatgtcagatgatttgaaggaaattatcgaaaatattaatgaatctaacaagaatgaagaaatatcaaatcctattacccaaatcagtcgaatactgaatgcccatatgaattctctacaatggttagatagaaatacatcccaaattagctcacatctcgaacaaat

SEQ ID NO: 2919 - DNA, 446 bp, Psylliodes chrysocephala
ttcctcggtctcgacaatgccggaaagacgaccctcctgcacatgctaaagaacgaccgcgttgccgttttgcagcccacgctccaccctacctctgaggagcttgccattggcaacgtccgcttcaccacattcgatctcggtggccatccccaagcccgccgcatctggagagactacttccccgaggtcaatggtgtcgtgttcctcgtcgacgccaaggacgaggagcgattcgccgaggccaaagccgagctcgacgccctgctcgccatggaggagctcgccaaggtcccctttgtcatcctcggaaacaagatcgatcaccccagcgcggtccccgaggacagacttcgtcacgagctcggcctttaccagacgactggcaagggcaaggtgcctctggagggcatccgcccgatcgaggtattcatgtgctcggtagt

SEQ ID NO: 2920 - DNA, 417 bp, Psylliodes chrysocephala
agtttttccattaggagaccattctcaaatttcaaataaaacccaaactattaccgacttattgtcggaaactcaaacaatgatcaaatcagccctacattgtcgggaatcgatcacttcaatgttgcaacatttagtaatcattaatgattatttgaaccctgccggcgatgctgacgagttagaagtggaagcaaaacgacaatgtttgcttgaattgtatcctgaattgaaagacactgtacaaaccattagtactctagagtctctgttgccctttattgattctattaacatctctaaagtagtcgaattttctggaaaattggaagaaatagctttaagtaaccttaaactttatggagaatgtcgagatataactaaaaaagtactggtagctctacaaaattataatga

SEQ ID NO: 2921 - DNA, 737 bp, Psylliodes chrysocephala
ggagactggttaaagctgaattaattccatttagaagtgcattgcatttacctccagaaaaacaagctgataatgaaatatatttagctatggtagagtctgtattatctacccctttcctatatttttgttatgattatgatcttacacattccttacaacgattacatggaataagtcctgatttctggaaccaatcaatatgggatagagctgatcaaagatttgtttggaatggaaacttattaactccatttaagggcttgtatattcaaaaattttgcttacctttaattcatggttttatttccataaacttctgtgttataaatggccacagtttgaactggtcaattgtatctcgtagaagtgttcagcgtgctggtaccagattacatagaagaggcatagacaaagatggaaatgttgctaattttgttgaaactgaacagattgttgaatatcaaggggaccatgcaagttttgtacaaataagaggttcaattccactattttggcatcaaaatcctgatttacgttacaagcctcctcccaccctattagaagttgatccacaagatcatcattccacttgtttaagacatatgaatgatttgatgaccatgtatggaaaagttgtttgtgtgaatcttgttgatcaaaaaggagctgaagggaatatggaaatagctttccaaaatgctataaacaatatgtcgtctccttccattcgttat

SEQ ID NO: 2922 - DNA, 700 bp, Psylliodes chrysocephala
cagaccagatttcaacctcaaaccatggacaaagtggaagcaaaagttggttacagtattaaaaagtcacttaacaatgaaactttgtatatggacagagattctcaaattaaagccattgaaaaaacattcgatgatactaaattggttatcgataagcattatagcaaaccgaatgttgtaccagttgatattttgcctgtatatgcagattttagcttatggaaatatccttgtgctcaagttattttcgactctgatccatccccgagtggcaaacaaacgcctgcccagattgaggagatgtctcaagctatgatcagaggtgtgatggacgaaagtggagaacaattcgtggcatatttcctacctacagaagaaactcttcaaaaacgtcgagaagatttcatcaaacaaatcccgtatcaagacgacgaggaatacgaatataaaatggcgagagaatacaattggaatgtcaaaagtaaagccagcaagggatacgaagaaaattacttcttcgtcgttcgtcccgacggaatctactataacgaattggagaccagagtcagacttagtaagagaagacagaaaatcggtcaagctcccagcaacactaggcttatcgttaaacatagggttatggatgcaaacgagttcaggatgcaaagatacagggagaaacaacttgaaccaccag

SEQ ID NO: 2923 - DNA, 757 bp, Psylliodes chrysocephala
gttgaagaccctgaaagctaaaaatgacgaaaagatcaagcttttggatgaagctatcgaagatgctgaaaagaatttgggagaaatggaagtaagggaagcctacttgaggaaatccgaatattatagtagaattggagataaagacaacgctgtaattacatttagacaaacttatgataaaactgtgtctctcgggcatcgcttagatatcatctttcatctcattagaattggtttgttctttatggatcacgaccttataacaagaaatatcgataaagcaaagactttaatagaagagggtggagattgggatagaagaaatcgtttgaaagtatatcaaggtgcttactgcatgtcagtgcgagattttaaaactgctgccaacttattcttggacactgtcagtacttttacctcatatgagcttatggattacaaagcttttgtcagatataccgtttatacttcaataataagcctaccaaggaatcaacttagagataaagtggtgaaagggtctgaaattctagaagtgctacattctgaaccatttgttaaagattacttattttctttatataactgccagtatgctgaatttttcacaaatctcgctgaagttgagagtatattgagaaaagattatttcttgaatccacattaccgctactatgtcagagaaatgaaaatatcagcctacactcaactcttagaatcatacagatctcttactttgcaatacatggctgag

SEQ ID NO: 2924 - DNA, 664 bp, Psylliodes chrysocephala
gaagcccgtttgatactttgcgatgactgtgacgtctcgtttcatatttattgcatggaccctcctttagattacgttccgcacggaaattggaaatgtaaatggtgtgccatatgcctgtcctgtggatctaccgatccaggttttaactgtacgtggatgaatagtaccactcaatgtggaccttgcgcttcgcatattaattgcccgagttgcaatgacccttacagtgaaggtgacctcatcattcagtgtgttcaatgcgaacgatggctacacggttcgtgcgattacataaagagcgaagaagatgccgaaaaatgcgctgaagaaggttataattgtattttgtgtcggccaagagacgtaccgcctccgcatttaataccgccaccaattacgcctaagcctccgacgccaacgaaaagtcctgaagttggaaggagtacaagtttttatatggacggagtttatctcagcgaattcggaaataatctaataaaatctttggctttagaatatcatggatctaggaaaaagcggaagaaaattcctaccgttcaggataaagaagctggtatcatggctacaattgagtcggttgttgcaggtggaaatattggtcctaccaatttggacgacagtgcgaaactcgagttagtag

SEQ ID NO: 2925 - DNA, 710 bp, Psylliodes chrysocephala
tccgaaagaaacgaattcctattgctgcacgctttctccgaaaaaggattcatattgcccgataaggagtacaagaagaaaattccgggtcagaagggttccaagaagaaacctacttacgccggaggtttggtcctggatcccaaggtaggtttctacgacaagctcatcctcctcatggacttcaattccttatatcccagtataattcaggaatacaatatatgctttaccacattacctgtcacagaggaagacgataatctgtacttaccggacagcagtctgccgcctggcattttaccgacagaaatcagaaaactagtagagagtcgacgtcaagtcaaaggtctgatgaagagaccggatctatctaatgatctgcgagtgcagtacgatatcaggcagatggctctgaagttgacagctaactccatgtacggttgtttgggtttcgcgaattccaggttctacgccaaaaatttggccgctttggtcacgcagaaaggtcgagaaatcttgaccaacaccagggatatgatcgagaaaatgagctacaatgtcgtgtacggagataccgacagtattatgattaatactaatattttggagtatgaacaggtattcaaaatcggcgtgaaaatcaaacaggaagtcaacaaactgtacaaacaagtcgagttggacatagacggcgtgttcaaatattt

SEQ ID NO: 2926 - DNA, 714 bp, Psylliodes chrysocephala
gaaaaattacgcgattgggtagatctttcgccagagccagagattacgacgcgacaggtcaacagaccaggttcgttcaatgccccgaaggggaattgcaaaaaaggaaggaagtcgtgcatacggtgacgcttcacgagatcgacgtcatcaatagtcgtacgcacggatttctcgccctattttcaggcgacaccggcgaaattaaaccggaagtaagagaacaaattaacggaaaagtggcggaatggcgggaagagggcaaagcggaaataataccgggtgtcctttttatcgatgaggttcacatgttggatatcgaatgcttctcgtttctaaatagagcgctcgaaaatgaaatgtctccgatcgtcataatggctaccaatcgaggcatcaccaaaatcagaggtaccacttataaatctccgcacggtattcccctagatttgttggacagaaccatcatcgtaccgactcaaccctacgacgagaaggaattgagggaaattttgagcatccgatgcgaagaagaagactgtcaaatgtcggacaacgctttggccgttttaacgaggatctgcaaggagacttcgttgcgatacggtatgcaattgattatgacatctagcttgatagctagaaaacgtaaagctcacgaagtcgatgttgaagacataaagagagcttacacactgttttacgacgaaggaa

SEQ ID NO: 2927 - DNA, 653 bp, Psylliodes chrysocephala
gcgactattcagaggatctctatataaaaaataccctggaatgtttagaagatctataactaatgaagaaagaagaagattaatcgaacttggtttgagccagcacgtattggccagcagtgtatctctacttagagctggtgaagttgaagatatcattgatggaaatgatgataagtgttccagatacaaagcggtatctgtgcacacttcagaacctccgatgccaagagagagcaaatcgaagaagaacatgcaatgggtaccgtctctacccaactccagtcatctggatgccgttcctcaagccacgcctatcaacagaaacagagtggccgccaaaaaggttagaacgtttcctctatgtttggacgatacggatccacaattgaacatcgaaaacgcgtgccaggcagaggtattggtacctataaggctcgatatggaaatcgagggacagaaactcagagatacttttacttggaacaaaaatgagagtttgattacacctgaacaattcgctgaagtactttgcgatgatctcgatttgaatccattgacgttcgtgccggctatcgcccaagcgatcagacaacaactcgaggcttttcccgccgatccgccgagcattatcgaagagtctagcgatcaaa

SEQ ID NO: 2928 - DNA, 162 bp, Psylliodes chrysocephala
cggacgtgattttaatgtgtttctcggtcgactcgcccgactccctagaaaacatcccggaaaagtggacgccggaggtgaaacatttttgtccgaacgtgccaattatcctggtaggcaataagaaggatctgcgtaacgatcccactaccattaacgaac

SEQ ID NO: 2929 - DNA, 779 bp, Psylliodes chrysocephala
gcatgtgtcccactatagagacaggaatttggtgttgatatctacagtaaatgaaaaagatgttctgtggtgtatgagttctgatttatttccgtttagtcagacattgatggaagcgtactcggctgtaaatttagatggtccagctttggctatatcagaggtgcgaaatatcaatcccctacaaatacacgatttacatgaagcccctccattggtcgtcagacaacatgcagaacctccgaagaaatatgtagtactaacttcgcatagtgttcaaattttcataaaattgagaccagttgatttgcttaaacaaattttaaaagatagccacggtcaagatactggagcattgaaagctttcttcaccattcaaaaggaagatcaagcttgtgctaccagtttgatactggcttctttggaaaatgaggacaacatggaagtagcagaatatgcaacgagagctttctttttgtttggaggcgaacctaagctggcacacggaaatatttattctggtcaatctgtatttgcaccgcccataatttctactccagctccacatcaatatcagcaacaacagtttcaatctcagcaatatcatagtttttcacaaactatgtctcctacaggctctgcatatgatttatccagtccatttattttttcgcctaaacacaatggtctttacttgtacttaagcagaatattgagaccgatttggaatagaagaacagttgataaactttgtttagatggcaaaactataacgacca

SEQ ID NO: 2930 - DNA, 656 bp, Psylliodes chrysocephala
ggttgtcaattccacgttttaaatcccgttattaaaggacaagaaattacaatcgaccgagtggcgactgtttattcacccgagaacgaccttatagattttgctcttcaaaccaatcgtttgtggtctttatggagatccgaagatggcgatagtgtcgtatatacggcttcgctaccgttgtgcaagcaatcgggtacttttaagtcgaccagttggacgccggtgattttggaaactatccctgacgccaatcaagctcccgctaatgatggcgattccgattcaagacagatttatttgcaacatattttccatcctggaaggtttcccttgcatattatcagtaaagcgttatcgatttacaaaagatcaacaattttgtcagatgcccaaatatcagcatcggcgttaaaacaaagaatatgtttagcggttgataacgaaatacagaatatgctgaacggagaaaacgtcaacgatgatgaatatatcgattgcgctgattggtgctggcaaaaattttattcttgttgcgttcaataccacatcgcgagtctaaagccgttgggattgatgctcttaccgtccgtatctggcgcggtatttttgaaaaaatctgctttttcgtttttaagacctcttgacggattaga

SEQ ID NO: 2931 - DNA, 791 bp, Psylliodes chrysocephala
tgctgttgttgaatttggtccacaaaccggaagcagacatgactattagagtagccggagctgtggcttttaaaaattatataaaaagaaattggtttgtggaggaagatcaaacggatcgtatacatgcaactgatcgtttagcaatcaagaatctgattgttacgttaatgttgagttctccagaatctattcagaagcagttaagtgatgctataagcataatcggaaaaactgattttccattaaaatggcctgaactcataactcaaatggtagaaaaattttccacaggtgattttaatgttataaacggagttttaagaacagcacattctctgtttaaaaaatatagatacgaattcaagtcaaacgagttatggacggaaataaagtacgttttgcaaaaaatagctcaacctttaacggatctattagtggccactataaatttatcgcaaacccacacaaacgatgtgaatgctttgaaagtaatctatagctctttggtgttgatttgcaaagtattctattcgttgaatttccaagatctcccggaatttttcgaggataatattcagatttggatgacgaatttccacactcttctcactgtcgaagtgccaagtttacaaaagaatgatagtgatgaagctggtgtaatagaacaactaaaatcacaagtttgtgataatgtggctctatacgctcaaaaatatgacgaagagttccaaccgtatttgccgcagttcgttacagacgtttggagccttttagttgcaactggcttg

SEQ ID NO: 2932 - DNA, 655 bp, Psylliodes chrysocephala
catcaaccagaagaagaccaattaattttaccaaatgctcttcaacaacagcaacaacaaaaccaactccctactagcagttcgcaagtccctccattagcccctatgggtggtacaacacctactctcggtcttggtatgggccatgctatgtctatgcctcataccaaatacgtaacaggctttactttgcctatgagttctatgacacctcaaacaccacaacacaccatgatgagtcctatggttaatttgggtggttctggaccaacaggttctggtgtgacacccaccatgggaccctcgacaccttcgccaatgactcccatgacccctcattcagcagatccaggcataattccacaattacaaaacatcgtgtcaactgtaaacctcagctgcaaattggacttgaaaaaaattgccctacacgcaagaaatgcggaatataatcccaaacgtttcgctgccgtcatcatgaggattcgagagccgcgtacaacagctctgattttttcttcgggtaaaatggtgtgcacgggagcaaaaagtgaagaagattccaggctggctgctagaaaatacgcccggatcatccaaaaactgggattccccgccaaattcttggatttcaagatacagaacatggtcggaa

SEQ ID NO: 2933 - DNA, 329 bp, Psylliodes chrysocephala
actgcaagaagaggatatgcagaccaaatgaattttacctttgctgctggaaaccaggtcttttacaatgcaatgtctgttaaacaagtagatgttccatccttctcaggtagttttggtatcttacctgcgcatgttcctactcttgctgttctcaaacctggagtagttaccgtttatgaagacagtggcaaagttaataaaatatttgtatccagtggaacagtcacaatcaatgatgactcatcagttcagattttagcagaagaagctcatcctgtagaaaatttagatgttaatgcagccagagatatccgcactaaagctca

SEQ ID NO: 2934 - DNA, 733 bp, Psylliodes chrysocephala
tacgaaaaattgagcagggaaaatcacgaggcggaactaaaagaaaaacgggaacaagaagcccgtaaaaaagcggcggctgccaaaaaagcacaagccgaaaccgttaaacctgctcaaattacagaactgacagaggaagaggctgctaagcttcaagctgagcttgatgctaagaataacgtctcttctgctagttcttcgagcacgcctgtaccaactcctccggccccccaaaagattgaggaagacgaggacgaatctgaaaagggcaaattgctgcctaacaaaggaaatggatgcgatctagagaagtatacctggactcaaaatttaggcgacattgagttacgggtacctttaaatgcgagcttcagagtaaaacagaaggatctgattgtgaatatgacgaagaaacacttgacttgcggcattaagggtcaaccgccgatcatagacgatgattttctacacgaaatcaagttggaggagtccagttgggtgatagaggatgggaaaatgttgctattcacttttgaaaaggtgaacaagatgaactggtggagcaaaatagtgaagtccgatcctgagattagcacgaaaaaaatcaacccggaaccgtcgaagttgagcgatttggacggagaaaccagaggcatggtggaaaaaatgatgtacgatcaaagacagaaggagctgggtctccccactagcgacgaacagaagaaacaag

SEQ ID NO: 2935 - DNA, 356 bp, Psylliodes chrysocephala
taagaagcacagtgatcgagagagatggatttgcatttatcctgcttatattaacagtaaaaaaaccatagcccaaggaaggaaaattaacaaagaaaagtgtgtggaaaatcccacccatcaagaaataagggacgtattagtcgcagctggtttaaaggttggtgtagaaaataaattgtacagcagagaaaaaagcaaggagctgttgtatcgcggtagaatacgggttcagttgaaaaacgatgataacagtttgtgcaatcccaatttccctactagagacagtcttatgttacatttaggggacatgattcccaaacttaaaagtagactgaataagggaagtggagacc

SEQ ID NO: 2936 - DNA, 672 bp, Psylliodes chrysocephala
acttacacgatccacgaaaagaaatatggagacaggagtggcattgaagaggtcataatgtccaagaggaaattgcaatatgaacaggaaattttacagaatcctacaaactatgatgcctggtttgattatctaagattagtagaaggcgaaggtgacattgatgttactagggagacatatgaaagagccatagctaatattcctccatcaaaaaacaaacaattttggaggagatacatctatttgtggatcaactatgctttatttgaagaacttgaagctaaagattatgaaagaacacgacaggtttacaaagcttgtctggaagttctacctcacaaaatattcactttctcaaagatttggctgctttttgctcaattcgaaatacgccagaaaaatttaacctccgccagaaagatcctgggcatgtctataggaatgtgtcccagagacaagctatttcgaggttacatagatatagaaatacaacttagggaatttgacagatgcagaaagctctatgaaaaattcttagaattcggtccggaaaattgcgtcacttggatgaaatttgcggaattagaaacgttgttaggcgatgcagacagagctagaggtatatacgagctagctattaaccaaaccagattggacatgccagaattg

SEQ ID NO: 2937 - DNA, 744 bp, Psylliodes chrysocephala
tcatcgctacaaacatttgcgaaaccatcatctggaaagccttctcgccggctacggtcaacaccggaagaggaactgaattcgaaggagccgtcatcgcgttattccacttactcactactagacaagacaaaatcagaggattacgtgaagctttctacagacaaaatctacctaatcttatgaacctcttatccactgttctcgtttttgctatagtgatatacttccaaggatttagagtggatttaccaatcaagagtgcaagatatcgtggacagcattccagttatccaattaaacttttttacacctcaaacattcctattatcctgcagtcggctttagtgtcgaatttgtacgttatatctcagatgttggcagtgaaattccatgggaactttttgattaatctgttaggagtttgggctgatgtaggtggcggcggtccagctagatcctaccccattggcgggttgtgttactatttatctccaccagaaagtgttagtcacattctcgaagatcccgttcacgcatgcctttatatcgttttcatgttgggatcatgtgctttcttctcgaagacgtggattgaagtatctggaagttccgctaaagacgtagctaagcaacttaaggaacaacagatggtgatgagaggtcacagggataactcgatgattcacgagttgaatcgttacattcccactgccgccgcgtttggtggattgtgtattggag

SEQ ID NO: 2938 - DNA, 361 bp, Psylliodes chrysocephala
agccgaacaagacaaactattaagactttcaacaactttatacgtaggaaatttatctttttatacaactgaagaacagatttatgaactgtttaccaaatgtggtgatattagacgtattgtgatgggcctggataaatacaagaaaactccatgtggattctgttttgtagaatactataatagagaggatgcagaaaattgtttaagatatataaatggtaccagacttgatgacagaattgtaaggacagattgggatgcaggttttctagaggggagacagtatggaagaggcaaaactgggggacaggtgagagatgaatacagaactgattatgattctggtcgaggaggatat

SEQ ID NO: 2939 - DNA, 790 bp, Psylliodes chrysocephala
tgacgacaattagccagaaaagttcatattccacggccaaagactggacatggggcaaaaaagcgcttttagggagcttaggtttggtggcaggtggtacaggagccatactatttgctctcgaccaatctgttaaggcttcggatctagaattacatccaccaaagaatatttggagtcatacagggcttttcagcgcctttgatcatgccagcataagacgaggatatgaagtatataaacaggtgtgcgcagcatgccactcgatgcgtttcatcgcctaccgtaatttggtaggcgtatcgcacacagagttggaagcgaaggctgaagccgaggagcaaatggtagaagacggaccagacgaccaaggcaacatgttcaaacgtcctggaaagctatcggactatttccctagtccttatcccaacgaggaagccgcccgtgcagccaacaatggtgcttaccctccggatttgagttacatcgtctctgctagacatggaggagaagattatattttcgctcttctaactgggtactgcgacgcccctgctggtgtcgttcttcgagaaggtcaatactacaacccgtacttccccggcggcgccatttccatggcgcaagcgctgtacaatgaggtcattgagtatcaagatggcaccccacccactgccagccaaatagccaaggacgtgtccacgttcttgaaatggaccgccgagcccgagcacgacgacaggaagaaaatgctgatcaaagctatcggcatcttcaccttccttatcgc

SEQ ID NO: 2940 - DNA, 731 bp, Psylliodes chrysocephala
gaatggattgccgcattaaaatttgggaggtttataatgaaaggcgatgtattagaacttattatggacatagacaggctgttagagatattaattttaataattctgggaaacagtttctttctgctggatatgatagatatatcaaattatgggacacagaaactggccaggttgtatcacgttttacaagtagaaaaatcccttattgtgttaagtttaatcctgacaaaaataaacaacatttatttgtcgctggtacttctgataagaaaattatttgctgggatacaagatctggtgatattgtacaagagtatgataggcatttaggagctgtgaatagtattacttttgttgatgaaaatagaaggtttgtgacgacctctgatgataagtcattgagagtgtgggaatgggatattcctgttgacatgaagtatattgctgatccaactatgcacagtatgccttcagttacacctgcaccaaatggaaaatggttggcctgtcaaagtatggataacaaaatagtgatattttcggccatgaataggtttaaaataaaccgaaaaaaaaccttcacagggcatatggttgctggttatgcatgttctttagatttttctcctgatatgagttacataacatcgggagatgcagatggtaaagtgtacatatgggactggaaatcaactaagctgtttaaaaaatggaaggctcatgacaat

SEQ ID NO: 2941 - DNA, 651 bp, Psylliodes chrysocephala
tcccttattcgaaaagagacccaggaattttggaataggtcaagacatccaaccccctagggacttatcgaggttcgtgaaatggcccaaatacatccgcatccaaaggcagaaagccgtcttgcagaaacgtttgaaagtgccgccgccgatcaaccagttctcccaaaccatcgacaaacaaacagccacccaattattcaaagtgttggagaaataccgaccggaaaccgccttgcagaaaaagaaccgactgaaggccaaagccgaagctaaagtggccaaaaaggaagaggccccgaccaaaagacccaacaccttaagagccggtactaacacagtcaccaagttgattgaacagaaaaaagcccaattggtggtcatcgcccatgacgtagaccctattgaattggtgctcttccttcccgccctgtgcagaaaaatgggagtcccctactgcatagtcaagggcaaagccaggttagggctgctggtcaggcgtaaaacttgtgcgactgtcgcccttacccaagtcgattccggagacaggtcgaacttcaacaaactcctggaggtcgtcaagaccaacttcaacgaccgcgccgatgagatcaggaggcactggggaggcggtatcctcggttccaaatc

SEQ ID NO: 2942 - DNA, 655 bp, Psylliodes chrysocephala
gtttctggtatgtactggggcctaacagctttagaattaatgaatgcctcaccgccacatagcatagaagagattttagagtatataaaaaagtgtcaagatgccgaaactggtggaataagtgcatgtgttaaccacgaccctcatattcttcacaccttaagtgcagttcaaattctttgtatctacgacagtctaaaagccattgatgtggaaggagttgtgaaatatataaaaaaattacagttgcctgatggtagttttatgggtgataaatggggcgaaatagataccagattctcgttttgtgctgttgcaacattgtcattattaaatagaatggatgctatcgatgttaacaaggctgttgattttgtagcttcatgtaaaaattttgatggtggttttggttcaagaccactttctgaaagccatgcaggcttaatttattgctgtgttggatttctatctgttacaaataggttagacattgtagatcgtgatacccttgcttggtggttatgtgagagacaattaccctctggtggtttgaatggtcgtccagaaaaattaccagatgtttgctattcatggtgggtgttatcatctctaacaatcttaggaagattacattggattgatggcaatgctttga

SEQ ID NO: 2943 - DNA, 724 bp, Psylliodes chrysocephala
tatggaggttgtgtgtgaagctacccaatcaccggattcacaaatcaaagtagcggctttgcaatgtttagttaaaattatgtctctgtactaccaacacatggaaccttacatggcaccggcactattcccgattacgttggaggccatgaaatcagaaaatgatgctgtagctttgcaaggtatagaattctggtcgaatgttagtgatgaagaagtcgatttggccatcgaagatacggaagctactgaggctggcaggccacccacacgagtttccagacattacgcaaaaggcgccctacagtacattattcccattctccttcaaaagcttactaaacaggaagagttagacgacgaagacgattggaatcctagcaaagctgccggtgtttgtctcatgcttctcgccacatgttgcgaagatgaaatagttccacacgtgctgccatttattaaagaaaatattaaatccgacaactggcgtttccgggatgcttctctaatggctttcggttcgattttaggcggattggaaaataacactttgagacctcttgttgaacaggcaatgccaactttaatagaactaatgtacgacagcagcgtaattgtgagagacactgcagcgtggacgttcggaagaatatgcgaaattattcccgaagcggcgatcaacgaaactttccttaaaccccttctggagagtctaataaccggt

SEQ ID NO: 2944 - DNA, 678 bp, Psylliodes chrysocephala
ttacaggagacacccaaatgagataagtgttccaatgtcagtagaatttgatgaatttgcaaaagctagagaaaatcctaatgaagatatggctaatttcgtagaattcactgatgaagaaggttatggaaaatatttagatctgcatgaatgctatgaaaaatatataaatctgaagggaatagagaaactcgactacattacttacttgggcatgtttgatcaactgtatgacattcctaaagaaagaaaaactggtgaatacagaaaatacctgttatgtctcattgaatatctaacttggtttgttcaacgtattagacctttaatggatcttgatgctgatttagaagaacaaattgatcaggttttgtctaattgggatactggtactgttccaggatggccaaaagaaactggttctgctttaacaaatgttggggcccatttggatctttctgcattttcaagttgggaagaattagcttctttaggcttggatagattaaaatctgcccttatggcattgggactcaaatgtggagggactttggaagaaagagctcaaaggttattttcaaccaaaggaaagggttcactggatccctcacttatgacaaagaatagtaaaaataggattactaaagaaaaagaaatctcaagacacagagaattggg

SEQ ID NO: 2945 - DNA, 521 bp, Psylliodes chrysocephala
ctctaggacgtttattggcacttttaaagcatttgataaacatatgaatatgattcttggagattgtgaagaatttcgtaaaataaaaccaaaaaattcaaaagttgaaagagaagaaaagcgagtgttagggtttgttttattaagaggagagagcatagtgtctttaactgtagaaggccctcctccaccagaagaaggacttcctagggtacctattcccggagcagcaccaggtccaggtattggaagagctggaggtaggggaatgcctccaggtatgacaggtgtccctgtaggtcttcaaggacctgtaagaggagtaggtggcccatctcaacaggtaatgacgcctggaggtaggggacaagtctcagcaccaccacaaatgaaccaaggtccacctagaatgggtgggccaccacctggcatgatgggtccacctcctggtatgatgggaatgccgcctcaaatgggaatgggacgtggtggaccgcctccaatgggtatgagaggacctc

SEQ ID NO: 2946 - DNA, 653 bp, Psylliodes chrysocephala
gtacatagcgactggatgttctctaactgatttacattacacctacagagtgggaatttcaacagcaagtgaaataatacagcacacatgcaagctaatttggaccaaaatgaaagagcaatgtatgccaaagcccacaagagaaaactggttggaaatagcacatggtttttttcgaaacgccaattttccccattgcgtgggtactattgacggtaaacatattcgagtgataaaaccacaacaaagtggatctttgtattttaattataaacattttttttcaattcaactcttggcaatgtgcgattcaaactattgttttacgtttgtggatattggggattacggcaaaaacagtgattcaagtatttttaaaaattcggatctttacaaaaagttatcgacaaaaaaactaaaccttcctgatcccgactttttaccagaaaaggatgactgtaaaatcccctatgttattattggagacgaagcgtttggcttatcgtttaatgtaatgcgtccatatggtggaaaatttttgccaatacagaaaagaatttataattacagactatctagagcacgaaggtatattgaatgtactttcgggatttttgctaacaagtggagaatattccatcgtcctcttaacg

SEQ ID NO: 2947 - DNA, 664 bp, Psylliodes chrysocephala; identical to SEQ ID NO: 2924

SEQ ID NO: 2948 - DNA, 656 bp, Meligethes aeneus
cagatcaaggaacagacacaaaaagtctaaaaacagacgcgattctcatagcagcagcagctcggattcatccaacagcagtagcagcagtagttcagataacagtttaaaattattggagaaattaaaggaagaacgtctaaagcaagtagatgccaaaaagaagcaaaaagagttgcttaaagccacagaaacagcaggggaaaaaagattgagacggttgttaaaaaagcaagcgaaagaaagaagcagaaaggagaaaatgggctgggacaatgaatatttgcactacaccaacagtgataacccctttggagatggcaatctactctctacttttgtgtggaacaaaaaattgtccaaagaaggcctcacaggggtcagtcatgaagaattggagactagaaataggttcaaacaggaagaaaacaaaagggagctggaaaaggttaagaagaggaggttggagagggaattggaaaggcagaaaagggaggaggaaatgggaatgttgcagaggagcaaagaggcagcacaatttgaagagtgggagaggcaagaggataactttcacttggaacaagccagactaagatcacatataagaatacaagatggcagagccaaacccatagacctcctcgccaaatacataa

SEQ ID NO: 2949 - DNA, 737 bp, Meligethes aeneus
cctccagaacagatgtttgagttgatgaagcaaatgaaacaaaccatacaaaacaatccaactgaagccagacaaatgcttctgcaaaaccctcaattagcttacgctctactccaagctcaagtggtaatgaaaataatcgacccccactcagcagtgactctactgcacccttcaaaccaagtaccgcaaactttgatgcctggagataagataccgcacattcccataaaccaaagttacgcgacgcctttaccgacccctgtacaggctcccaggcaggattttcaacctgtaccacctccgattatgcatcaaaacaatcaacctgtctttacaggtcaagatgtggacttgagatcgctggatccaaggggcggttcagatccaagactaacaagagggatgggggatcaagacatgaggactttgcctgctccattggccaatccattgcctccggtgggcgaaggatttaacagggatcccagggggtccacagccagttttccgaacgaccccaggcagcaatctcaaagggtcgaccccaggcaaaaaaatataccacccccacaaatgccaccccaaccaatcagaccgcctccacaggcagtgccagctccgcctccagtcccatcaagggcacaaatttcccatgctgccaacagtccaaatattgggcctgctggggcgtcagaccaagaaaaggctgccctcatcatgcaagtcctccaatt

SEQ ID NO: 2950 - DNA, 660 bp, Meligethes aeneus
taaattaaaggcagggacccgtgtagctttggatatgaccactttaaccattatgagatacttgccaagagaagttgatccgctagtctacaacatgagtcacgaagatccaggagatgtaacttattctgctattggtggtttatcagaacaaatcagggaattgagagaagtcattgaacttcctttgttgaaccctgaattgtttatgagagttgggattactcctccaaaaggttgtttattatatggaccaccaggtactggtaaaactcttttggccagggctgtagcctctcaattagatgcaaacttccttaaagttgtatctagtgcaattgttgacaaatacattggagaatctgccaggcttatcagagaaatgtttaactatgccaaagaccatcaaccttgcattattttcatggatgaaattgatgctattggtggaagaagattctctgagggaacatctgccgatcgtgagatccaacgtaccctcatggagctgttgaaccagatggatggttttgattctcttggtcaggttaaaatgatcatggctacaaatagacctgacactttggaccctgctcttttgcgtccaggccgtttggacagaaaaattgaaattccacttcccaatgaacaggctagatt

SEQ ID NO: 2951 - DNA, 455 bp, Meligethes aeneus
aatgagctccgtttgataggccaaaggtatttgtttcaatatggagaatcgattccctgtgagcaattggtatcgtggttgtgtgatgtaaaacaagcttacactcagtatggtggaaaacgcccatttggagtctcaatcttgtacatgggatgggacaaacattatggatatcagttgtatcagtcagaccccagtggaaattacagtggatggaaagcaacttgcattggaaataacagtgctgctgccatatccagcttaaaacaagaatacaaggaaggagaaatgaccttaaaagatgctaaatcattggctgttaaagttttaagcaaaacactggatatgaccaaacttacttcagaaaaagttgagatgtcaactctaacaagaaaagatggcaaaacttttattaatatcctagcaggcacagaagttgaggctcttataagcga

SEQ ID NO: 2952 - DNA, 727 bp, Meligethes aeneus
gaaattgctagtgaatgggctgaaactgatttaactttcgataaaggtttaagggagaatttaattttactagcaaagcaaattgtgccttacaatatggcgcataatgctgaggctgaagcatgtgatttgctgatggaaattgaacgtttagatcttctcgacgaatatgttgatgataatatctatcctagagtttgcttgtatttaactagttgtgtgccctatgtggctgatccagaaaatacaactttattacaaactgcattgttattgttccgtaaatttaaacaatatccacaagctttaagattggctatgcagttaaatgatcattctttgattgaagacatctttattacctgtcctgatactgctgtccaaaagcagttggcctacatgctgggcagacagcaaatctacatcgaaatccccgataccactcccgaatacgaggaccttatcgaaataatggcgaattgtcacttgaacaatcatttcctgaatctggccagagagctggacataatggagccgaaaactcccgaggacgtgtacaagtcgcacctggagaacagccgaccgcaattcggcggcagtcaagtggactcggcccggcaaaacttggcggccagtttcgtgaatggtttcgtgaacgctgccttcggtcaggataaattgttgatggaggacggtaacaagtggttgtacaagaacaaagagcacg

SEQ ID NO: 2953 - DNA, 750 bp, Meligethes aeneus
ttggttggcaattctgaaaccatcaatgaattaccaacaaatgtttacgtgaatttggaaagtgtcaacggaaatatggattacagtgcgaattacatcattccaaataactacgatgaatacagtatagagaattcttcatcccctcaagcttcgtacttgttgaatagagatccaaacatggctgcagcttcaatcagatattgcactgaacctgaaggtccatatgcaggtggtgctgtagtgcaaaacccaggtggccacatcgcgcaatacagcggtcagcaaaactaccacatcagctacgctcagaactggactcctcagtcgcagtcagcttcagtttacaacggtccgggtcagatgctggcgcaagccgacagcacgcagttcaacggttacgccaatggcggcggaagcagtggcggcctaaacgagggggcagggacatcgtcaaacccacaggaattaatatcaccaaatagcaacagaagaagtggagtaaattgtgcgaattgtaagaccacaaatacaacgttgtggagaagaaataatcaaggggaaccagtatgtaacgcatgtggactttacttcaaacttcacggggttgtaaggccactaagtatgaagaaggagggcatccaaacaagaaaaaggagaccaaagaatacctccagctctgggccgagctcttctatagttcaccattcttctaggctgggcacacccgcacaacactacacatctcca

SEQ ID NO: 2954 - DNA, 795 bp, Meligethes aeneus
cgtttgtcgaagctagtctacacggatgcaaacacaacaaaaaaagtcgcgagggaagaccgcgacggaaaaacccgaacaggaaacgccaggacctgtacaaatcccggaaaagcccgaccagcagtccggaggaggaggaagaagaggcgagcgacgacgacgccctacccaccggctaccatcaaatatccatccagctgctggacctgatgcacacgttgcacacgaggaccgcgcagattttcaagtggtgggccgaggagggcggcgagatcgcccaggagacgtcgctgtggacgcagggctggtgccccttactgcagggcatcgcgcggttgtgctgcgacgtccggaaaccggtcaggatgagcgccatcacgtatctgcagagggcgctgttggtgcacgatttgcagacgctgagcgggccggagtgggaggcgtgcttccacagggtgctgtttccactactgagatatctattgcaaccactcactcctaaagagcccatggctatggaggagaccaggatgagagccgcgactgttttatctaaagtttttctgcaccacctaacaccactgctatcccttccaacattcttcaatctttggctggtaatcttggactttatggagaaatacatgcacgcagacaagagcgatctgctctacgaagccataccggaatccttgaagaacatgctgctcgtaatggactccgcgaaagttttcgacgcgccggacggccacaagagtcacctttgggcggccacttgggagaagatcaaca

SEQ ID NO: 2955 - DNA, 271 bp, Meligethes aeneus
atgctctatgagaagcgtttcgggcccttcttcgtcgagcctgtgatagcagggttgcatccgacgactaatgaaccgtttatttgcaacatggatttaattgggtgtattaatcaacctgatgattttgttgtcggtggtacagcctcggcacaactttacggtatgtgtgaagctctgtgggagcctaatttaggccctgaagatttatttgaaacgactgcacaggctttaattaatgcttttgatagagatgctatttctggttggg

SEQ ID NO: 2956 - DNA, 768 bp, Meligethes aeneus
atcaccaagttctcttccaccaacatgtggccgcttttagaaattttgactgtgttacctgaagaattagaaaatagatctgtgaggctaggcgagaacaggcgactagacgtcctgaacgacttcaaaagttgctcgacaacaattttagagtttttaaagcattgcgctaacacctacacggataactcgcaagaaaacgtgcaggtgaacattaaaatcctacggtgtttcacttcgtgggtttccgtcggcgccttcgagctctccgagttgggaaacaacatcgtgatcaacagagcgttcggtattttaacctacaaacctgagggggagaaacagactgttgggggcgcgctgcacagcgccgctactgattgcatttgcactctattgcaatgtttggaggataataataaccagcagatactggagacgtacttgtttaataacgttattaatttagaggtggcataccacatgtctgtagccaacgaagatcaggataagtccattaattactgtagggttttcaccgagttggccgagtcgtttctggaaaaaatcataatgaatagcaacaataaatcgcaacattacgcgatgaaagttctagatttagtgctaatttgcgtggggcaccacgattacgaggtagcagaaataactttcaacttgtggtacgttttgagcgaggatttataccagaaaaacaacaaggaaattaccgaaatgtttcgaccttacgtcgaacgattaataacggct

SEQ ID NO: 2957 - DNA, 648 bp, Meligethes aeneus
tcttgttgctcgactatcagccgttgcagttcaagctggaccccagattggcccggcttctgggcgtgcacacccaaaccagacccgtgatcatttccgccttgtggcagtacatcaaaacgcaccgattgcaggacgcgcacgaaagagagtacatcgtgtgcgacaagtacttggagcagattttcaactgctcgcgcatgaagttcgccgagattccgtcccgcttgaacccgctgctgcacccgccggatccgatcgtcatcaaccacgtgatttcggtcgaaggcggcgccgagagcaagcagaccgcctgctacgacatcgacgtcgaggtcgacgacacgctcaaaacgcagatgaacaacttcttgctgagcaccgcgagtcagcaggagattcaagggttggattcgaagattcacgagactgtcgacaccataaatcagctcaaaaccaacagggagttcttccttagttttgccaaggatcctcagcaattcatacacaagtggatcgtctcgcagaccagggatcttaagaccatgacagacgttgttggtaaccctgaagaggagcgcagagcagacttcttctatcaaccttgggcccaagaagcagtttgtcgttacttctacaccaaggtgc

SEQ ID NO: 2958 - DNA, 330 bp, Meligethes aeneus
agagggttgggagttaatagaaccaactttggacgagctggaacagaaaatgcgcgaagctgagactgaaactcatgagggaaaacgtaaaaatgagtcgctgtggccgatattcaaaatacaccatcaaaaatcgcgttatatattcgatttgttctacagaagaaaggctataagtagggagttgtacgattattgtttgaatgaaaatatagcggataaaaatttgattgcaaagtggaagaagcagggatatgaaaatttgtgttgcttgaggtgtatacaaaccagggataccaatttcgggacgaattgcatctgtagggttcc

SEQ ID NO: 2959 - DNA, 718 bp, Meligethes aeneus
taacgaattgcagcgagatatgccggcagctacactagacattttaggtagcatacaacatcccaataatgaggagtgtggcatcagggatgtttgggcacataacttggaggatgaatttcgaaccattagacagattgtacaaaaataccaatatgtagccatggatactgaatttcctggggttgtagcaagacctataggtgaatttagaagttctgccgattaccaatatcagatgttaagatgtaacgttgatttgctcagaatcatacaactggggctcacatttcttgacgataatggcaaaacgcctggaggctcttacaccacgtggcagtttaactttaaatttaacctgcaggaagacatgtatgcccaagacagtattgatctgctaacaaactccggtatccagttcaaaaagcacgaggatgaaggcatcgagccgctggaattcgccgaactactcatgacatcgggtatagttctgatggacaacattaaatggttgtcgtttcattcgggttacgattttggttacctgatcaagttgttaactgataacactttgccccaagatgaaaacgaattttttgatctcttgaaactgtactttcccaccatatatgatgtgaagtacctgatgaagtcttgtaagaatttaaaaggaggtttgcaagaagttgcagagcaactggaccttgaaagaataggc

SEQ ID NO: 2960 - DNA, 693 bp, Meligethes aeneus
tttccatttccatcctccagcaaatcgacacctatgtgagggaatgccaggctcttatcttggcccccacaagagaattggcccaacaaatccaaaaggttgtcattgctttgggagacttcatgtccgcgcaatgccacgcctgcatcggcggcacgaatgtcagggaagacatgaggaaattagagactggagtgcacgtggtggtgggaacccccggcagggtgttcgacatgataacgcgaagggcgctgcgcacgagccacatcaagatgttcgttctcgacgaggccgacgagatgttatcgagaggtttcaaagaccagattcacgacgtttttagaacgctaaactcggacgtgcaggtgatcctgctgtccgccactatgccgcaggacgtgctcgacgtcaccaagtcgttcatgaggaacccgatccgtatcttagtcaagaaggaggagctcaccttggagggtatcaagcagttcttcgtgttcgtcgagcgtgaagattggaagttggagactttgtgcgatttatacgacacgctgtcgatcacgcaggccgtcatcttctgcaacacgcgccgcaaggtggactggctcaccgagaacatgcacaagaaggacttcaccgtgtcggcgatgcacggagacatggagcagagggagagggacgttattatgaggcagt

SEQ ID NO: 2961 - DNA, 525 bp, Meligethes aeneus
aatattaatgccgccaaagctgtttgtgatgccatcagaacaagtttgggccccagaggaatggataaaatgatccaatcagcaaacggcgaagttacaatcacaaatgatggggcaacaatcttaaaacaaataaatgtcattcaccctgctgcaaaaatgttggtagaattgtccagagcccaagatgttgaggctggtgacggtaccaccacagtagttgttatcgcaggagctcttttaaatgcagcagaaaaactgcttagcaggggtattcaccctactgttatttcagataacttccagaaagctgctgttcatgcagtgaatatcctaaacgaaatctctatcccggtggtactaaaaaaccgcgaccaactgctgcaaagcgcctccacctcgctaaactccaaagtggtgtcgcaacaatcctcctctctggcgcccatagccgtcgacgcggtgctaaaaatcgtcgagacgggtcgcgagcaggcttgcaacctgtccgacataaaggtgatc

SEQ ID NO: 2962 - DNA, 740 bp, Meligethes aeneus
aaaaccatcagcaagtgttgccttgcataaacatagtaatgctttggtcgatgttttgcctcctgaagcagattcctccatcagcatgttgtcggctgatgaaaaaccagatgttcaatacagcgacattggaggtatggacatgcaaaaacaagaaatcagagaggctgttgaattgcctctgacacactttgagttgtacaagcagattggtatcgacccacccagaggtgtgttgatgtatgggccccccggttgcggtaaaaccatgttggccaaggcagtggcccaccataccacggctgctttcataagagtagtaggttcggaattcgtacagaaatatttgggcgagggccccagaatggtgcgcgacgtgttcaggctcgccaaagaaaactcgcccgccattattttcatcgacgagatcgatgccatcgccaccaaacgtttcgacgctcaaactggagcggatagggaagtgcagagaattctgctcgagttgttgaaccaaatggatggtttcgatcagactaccaacgtcaaggttatcatggctaccaacagggctgacacgttggaccctgctctattgcgtcccggccgtttggacagaaagatcgagtttccattgcctgatcgtagacagaagagattggtgttcactactattacatctaggatgaacttgtctgaagaggttgatttggaagattatgtagctagacctgacagaatct

SEQ ID NO: 2963 - DNA, 461 bp, Meligethes aeneus
cgttatttatcgtgtgtttttcgtatattttaactggaataagatgtctaaaataaagctacagagttccgatggagaaacctttgaggttgagatcgaaattgcaaaatgttctgtaacaataaaaactatgttggaagatcttggaatggatgaagatgaggaggaagttgttccattaccaaatgtcaactctgctatattaagaaaggtcattcaatgggccacatatcacaaagatgaccctccaccaccagaagatgacgaaaacaaagaaaaaagaactgatgatatatcttcctgggatgcagactttttaaaagtcgaccagggaactttatttgaactaattttggctgccaactacctagacatcaaaggtttgttggatgtaacttgcaaaactgtggccaacatgataaaaggaaaagccccagaagaaatccgcaaaactttcaaca

SEQ ID NO: 2964 - DNA, 651 bp, Meligethes aeneus
tggattgagcagttaaacgattgcaagcaacttacagaaaaccaagtcaaaactttatgcgataaggccaaggaaatcctttccaaagaaagcaacgtacaggaagtaaaatgccccgtgaccgtttgcggggacgtgcacggccagttccacgacctgatggagctgttcagaataggcggacgcagccccgacacaaactaccttttcatgggtgattacgttgaccgtggttactattccgtggaaacggtcacattactggtcgccctgaaggtgcggtacaaagagagaatcacgattctcagaggcaaccacgaatccagacagatcacacaggtttacggtttttacgatgaatgtctgaggaagtacggtaacgcgaatgtctggaagtttttcacggacttgttcgattatttgccattaactgccctcgtcgatagtcagattttctgtttacatggaggcttgagccccagtatcgatactttagatcacattagagctttggatcgtctacaagaagttcctcacgagggtcctatgtgcgacctgctgtggtccgatccggacgaccgcggcggctggggcatatcgcctcgcggcgccggctacaccttcggccaggacatctccgagacgttcaac

SEQ ID NO: 2965 - DNA, 515 bp, Meligethes aeneus
aaactttgaccggaaaaaccatcaccttggaagttgaaccttctgataccattgaaaatgtgaaagccaaaatccaagacaaagaaggtatccccccagatcagcaacgtttaatcttcgcaggaaagcaattggaagatggaagaaccctctcagactataacatccaaaaggaatccaccctccatttagtactccgtttgagaggtggtatgcaaatctttgtcaaaaccttgacaggaaagaccatcaccttggaagtagaaccctctgacaccatcgaaaacgttaaagctaaaatccaagataaggaaggtatcccaccagaccagcaacgtttaatctttgccggtaaacaattggaagatggtcgtaccttgtctgactacaacatccagaaagaatccaccctccatttggtactccgtttgagaggtggtatgcaaattttcgtcaaaactttgactggaaaaactatcaccttggaagttgaaccctccgataccattgagaat

SEQ ID NO: 2966 - DNA, 735 bp, Meligethes aeneus
gataacgttcgggaataccagaaaattgtcgacgccgaatggaatattctgtatgaaaagttaagaaaagtccacgaatcgggcgccaatgtggttctttccaaactccctattggcgacgttgcaacgcagtacttcgcagatagggacatgttctgcgcgggccgcgtccccgacgaagacatgaagcgcaccctgaaggcgtgcggcggcgccgtgatgacgaccgcgcacgacctcaaggacgccgtgctcggcaggtgcgacctgttcgaggagcgccagatcggcggcgagcgcttcaacttcttcaacggctgcccgaacgccaagacgtgcacgttgatcctgcgcggcggcgccgagcagttcctcgaggagaccgagcgctcgctgcacgacgccatcatgatcgtccgaaggacgatcaagaacgacgcgatcgtcgcgggcggcggcgccatcgagatggagctgtcgaagatgctgcgcgaccactcgcgcaccatcgccggcaaggagcagctgctcataggggcgatcgccaagtcgatggagatcatcccgaggcagctgtgcgacaacgccggcttcgacgccaccaacatcctgaacaagctgaggcagaagcacgcgcagggccactgctggtacggcgtcgacatcagcaaggaggacgtcagcgacaatctggacgcttgcgtgtgggaaccggccattatcaagatcaacgcg

SEQ ID NO: 2967 - DNA, 717 bp, Meligethes aeneus
gcattacccgatatggaagtagtaggtcttaacttttcatcagccacaactccagagttgctgttaaaaactttcgatcattattgcgaatacagaaaaacacccaacggtgttgtgttagccccagtacagctcggtaaatggttggtattattctgcgacgaaatcaacttaccagatatggacaactacggaacccaacgcgtaataatgttcctacgtcaaatagtcgaacaaaaaggtttctaccgcgcttccgatcaaacctgggtatctctcgaacgtattcaatttgtgggcgcttgtaatccgcctacagatccaggcagaaagcctttatcgcacagatttcttcgtcatgtaccagtagtatacgtggattaccctggtgaaacttctttgaagcagatctacggtacttttacgagagcgatgttaaggttaacaccaggtttaagaggttattcggaaccgttgacaaacgccatggtggagttttatttggcgtcacaagacagatttactcaagatatgcagcctcactacgtgtactcacctcgtgagatgactcgatgggttagaggaatttgcgaggctatcagacctctggataatttgccagttgaaggtttggtgaggttgtgggctcatgaagccttaaggcttttccaggacaggcttgttgaagatactgaacgtcgatggaccaatgaaaac

SEQ ID NO: 2968 - DNA, 660 bp, Meligethes aeneus
gccatacgttttgaagactgtacctcggaaagaaccgtcatcaagtacatgacggatggtacgttgcatagagagtttttgtctgagccggacttgcagtcttatagcgtcatgattatcgatgaagctcatgagagaactttacataccgacattctttttggtttggttaaagatatcgcccgattcagacctgatttgaagctgctgatatccagtgcaactctggatgcgcagaagttttccgagtttttcgatggagcgccgatatttagaatacccggtagacgatttccagtcgatatctattacactaaagctcccgaagctgattacatagacgcttgtgttgtttccgtacttcaaatacatgccacacaacccctgggggatattttggtatttcttacaggtcaagaagaaatcgaaacttgccaagagctgctcaccgaccgtgtgagacgtttgggctctaaagttaaagaactcttgattctaccggtatacgctaaccttcccagcgatatgcaggcgaaaattttcgaacccacaccaccaggtgcaagaaaagtcgttttggccaccaacattgcggaaacttcgctgaccatagacaacatcatctacgttatcgatccagggtttgcaaaacaaaaccac

SEQ ID NO: 2969 - DNA, 683 bp, Meligethes aeneus
ctccgaaatcaaaaagaccgaagttttaatggagaactttcggagagccatcgggttaagaatcagggaaacaaaggaagtctatgaaggtgaagtgagcgagttgacccctgtcgaaacagagaatcctgctggaggttatggtaaaacagtgagtcatgttataatcggtttaagaactgcaaagggcagtaaacagttgaagttggatcccagcatctacgaggctcttcagaaggagaaagttgaggttggagatgtaatttatattgaagcaaacagtggggctgttaaacgacaaggtagatctgatgcatatgcaactgaatttgatttggaggcagaagaatatgttccattacccaaaggagatgtacataaaaagaaagaagttgtgcaggacgtaactttgcacgatttagacgcagcaaacgcaaaaccgcaaggggggcaggacgtgttatcgatgatggggcaattattgaaacccaaaaaaacggaaatcaccgataaactgcgtaaggaaatcaacaaaatcgtcgacaaatacatcgaccaggggatcgcggagctggttccgggcgttttgttcatcgacgaggtccacatgctcgacattgaaaccttcacgtacctgcacagggctctggaaagcacaatagcccccatagtgattttcgcta

SEQ ID NO: 2970 - DNA, 684 bp, Meligethes aeneus
ggaattttgaaggggctagaaataatccatttcaatttaaacatttgcaattatgccacagtttgcatgagttggctaaagtgtcaagtccaaaagtggttttggccagttcagctgacatggaaagtggttattccagggaattatttttacagtggtgttccaatcccaataatagtttaataattacttcaaggacttctcctggaactttggcaagggaactagttgataatggaggaaatagggaaattgaaatgaatgtggaaaaaagagttaagttggaaggggctgagttggaagaatatgaaaaaaagatgaaggagttaaggaatgttaaaaaagaaagtgacaacgaatcagactctgacgacgacatcgagatgagcgttatctccaagggccgtcacgacatcgtgatcaaacaggagggcaaagtgtcgggcggttttttcaaggtcaccaaaaaacagtaccccatgtacccgttcagcgaagagaaaatcaagtgcgacgaatatggagaaataatcaagcctgaagactacaagctggcggatgtggtgcctgaggaggacaacaaggagaacattgtgatcaagaaggaggaggaggatataactgaaatcccggaaatccccacaaaatgcatcattctaaaccgtacagtccaagtaaactgcc

SEQ ID NO: 2971 - DNA, 687 bp, Meligethes aeneus
atacagagcagaatggcaaaggtaccaggagcaacaaaaagctaaagaggaggaaatattggaaagagaaagagttgcttatgcacaaattgattggcatgactttgttgtggtcgaaactgtagattatcaaccgtttgaaatcggtaatttcccgccgccaactactccagaagaagtgggagcacgtttgcttattcaagagagaattgaagaaggagaggacattgaaatgcaacttgagagcgatgatgaggaatctgcaccacccactgatgaaggtttaagtcatatgcaagacaggacgcacggtcgcaaaggtagagatgataatcgcgtacaagacatggaagaggatagttccgatgaggactctcgcggaccatcaaagccttctcagccttcaattcaaccaccaatgccgccaatacctgataaggttgtcgtcaagaaatatgatcccaaacaagctgttaaagtcaccagaccaaccgtgggtgatgactttttggtatcgcctatcaccggcgagaaaatccccgccagcaaagtgcaggagcacatgcgcatcggcctgctggatccaaggtgggtcgagcaaagagacaagcaggtgatggacaagatgaaccaggaaaccgtctacgccgccggttctgcaattgacgctagtctgaaattgttggc

SEQ ID NO: 2972 - DNA, 769 bp, Meligethes aeneus
acaacaactaaagtggtggttcaccctttagttttattgagtgtcgtggaccattttaatcgtatgggcaaaattggcaaccaaaaacgtgtggttggtgttcttttaggttgctggcgggctaaaggtgtcctagatgtttccaacagttttgcagttccttttgatgaagatgacaaagataagtcagtgtggtttctggaccacgattacctagaaaacatgtatggaatgttcaaaaaggtgaacgcacgtgaacgggtagtcggttggtatcacacagggccaaaattgaaccagaatgacattcaaataaacgaactgatcagaaggtattgtccaaattcggtattagtaattattgatgcgaaacctaaggatctcggtcttcccactgaagcctaccaggctgtagaagaggtacacgatgatggttcaccaacatcgaagacttttgagcatgttcctagtgaaattggggcagaagaggctgaagaagttggtgttgagcatttgctaagagatattaaggataccacagtgggtacattgtctcaaagaataacgaatcaattgttgggggtgaaggggctgcattgtcagctgagagaaattagagactatctcatacaagttagtgaagaaaagttgcctattaatcatcagattatctatcagctgcaagatatcttcaatcttttgcctgatattaatcaggagaactttaataaagcattttatgttaaaaacaacgatcagatgttggttg

SEQ ID NO: 2973 - DNA, 398 bp, Meligethes aeneus
gtggaagaaaagttcagctggagaatataaatgccggaaagcaaatcgccgacgtgataaggacatgtttggggccacaagccatgctgaaaatgttgatggacccgatggggggtatcgtgatgacgaacgacggtaacgccatcttgcgtgagattactgtacaacacccggccgcgaaaagtatgatcgaaatcgcacgcacacaagacgaagaagtgggcgacggtaccacttcagtcatcgtactggccggggaaatgttagtggccgccgaacaatttttagagcaacagatgcaccccacagtcatcatcagggagtacaagaaagctttagaagacattgttacgttgttagaggggcccttaagtgtgcctgtggacaggaacgataag

SEQ ID NO: 2974 - DNA, 570 bp, Meligethes aeneus
tcatttcagcccatacgccgacaacggagggagcgttgttgcgatagccggagatgactttgtagttatcggagccgatactcgtttgagtgctggcttctcaatttacaccagagatcaaaacaagttgtttcctctgtcgaaaaccactgttttgggttgcgctggttgttggtgtgacaccttaaccctaactcgcattctgacctctcgcatgcagatgtaccagcaggagcacaacaaaacaatgtccacggtggcttgcgctcaaatgttgtccaccatgttgtactacaagaggtttttcccctactacatttccaacgtcttggttgggttggataacgagggaaaaggctgcgtttacagctacgatcccattggacattgcgagaaggccacctacaaagccggaggttctgcaggggctctgttgcagccccttttggataaccagattggtttgaagaatatggagataatcggggattcaaagctgacgattgagaaagctaccaatatcattaaggatgtttttatttctgcagccgagagggacatttacactgg

SEQ ID NO: 2975 - DNA, 688 bp, Meligethes aeneus
agctttagaacagctgacaaggttgaatattaattacccaatgttgtttaagctggtcaataagaaaacaaatcgtacaactcactgtggtgtccttgagtttgtggccgatgaaggaaaggtttatttaccactatggatgatgcataatatggtgttggacgaaggagattttgtacaaatggaaagtgtttctttacctgtgggaacgttttccaaatttcaacccttatctccagaatttttggacattaccaacccaaaagcggttttggaaaactgtttaagatcatttgcgtgcctaacgtcgggagatatcatagctgtgaaatataattcaaaagtttatgaattatgtgtactggaaacaaagcctggtgatgccataagcattattgagtgtgatatgaatgttgaatttgaagccccggtgggttacaaagagcccgaacatgttaaaaaagaggacgaagacatgcaaatcgatccttcggaattaatgcccgaacccgcaggtttcatagcatttaaaggggcgggcaatagacttgacggtaaaaaaagaaaagattccacgtcaagcgactcgacgatgttgccgaccaaaaccgcctatgttaggggaatccccgattatgattacgaaattggtacgttgaaatttataagaaggaattttaaaccggcc

SEQ ID NO: 2976 - DNA, 534 bp, Meligethes aeneus
ttgaagaacgtcaaaatggccatcttgacctgcccgttcgagcccccgaaacccaagaccaagcacaagttggacgtcaccagcgtggaggagttcaaggagttgcggcagtacgagcaggacaaattcaaggaaatggttgatttggtcaagaaggctggcgcaaatttggccatttgtcaatggggttttgacgatgaagccaatcatttactgtactcgcaaggtttaccagctgtcagatgggtcggcggtccggagatcgaactgatcgccatagcgacgggcggcaggatcgtcccgcgcttcgaggagctcacccccgacaagctgggttcggcggggctcgtgcgcgagctggccttcggcaccaccaaagacaagatgctggtgatcgaggactgctccaactctcgcgccgtcaccatcctggtgcgcggcggcaaccagatgctggtggccgaggccaagaggtctctgcacgacgccttgtgcgtcgtcaggagcctggttctggaaccgagggttgtttac

SEQ ID NO: 2977 - DNA, 207 bp, Meligethes aeneus
aagtcaaaaagtggaatgccgttgctttatgggcttgggacattgttgtggataattgcgctatttgccgcaatcatataatggatttgtgtatagaatgtcaggcaaatcaggcctctgccacttcagaggaatgcactgtagcttggggcgtttgtaatcacgcctttcattttcactgtatttcaagatggttaaagactcggc

SEQ ID NO: 2978 - DNA, 535 bp, Meligethes aeneus
ggctaaaatcgccgaattagaatcggctgaaaaggagaaaatgaaggagaaggtcgataagatactgaaacacaaaccgacggtgtttattaaccggcagttgatctacaactacccggagcagttgtttgccgatgcgggggttatggccatcgaacatgccgattttgacggtattgagcgattagctttggtgacaggaggcgagatagcttcgatgtttgataaccccggggatatcaaattggggacttgcgatttgattgagcaaattatgatcggggaggatattttgctgcgtttttcgggtgttgctttgggggaagcttgcactgtggtgattagaggcgcgactcaacagattatagacgaagctgatcgtagtatccacgatgcactttgtgtgctagctgcaactgtaaaagagagccgcgttgtttacggtggcggttgcagcgagactttgatggcctgcgcggtgcgcaaagccgccgccagtactccgggcaaggaggccgtagctatggaggcttac

SEQ ID NO: 2979 - DNA, 661 bp, Meligethes aeneus
cctccaccaagtcgaatacgccatggaggccgtaaatctgggctctgcaacagttggccttaaaagcaaaactcacgctgtcctgatagccctcaaaagggcctcctccgaattgtcggcctaccagaaaaaggtgatcaacatcgatgaacatattggaatcaccatttccggtttaactgcagatgcaaggattttgagcagatacatgaggactgagtgtttgaattacaagtattctcatgatactgtgttgcccttaaataggcttatttccactttggggaataagatgcaggtttgcacgcagagatatgatagaaggccctatggggttggattgttggttgctggttttgacgataaaggtgctcatatctaccaaacttgcccatctgcaaactactacgattgcaaggccatgtccattggtgctagatctcaaagtgccaggacttacttggagaaaaaaatcgacgaactccataatgctcctctggaagatttgattaaacatggtttaagggcgttgagagatacccttcccccagaggtggatttgaacaccaaaaatgtttctattggatttgtgggcgacaaacagccgtttaaaatcctggatgaggatgaaaccgctcccttcttggctttgattgaagga

SEQ ID NO: 2980 - DNA, 655 bp, Meligethes aeneus
ggaatggcataaaagagtgcagttgtatgaaggaaaaccccatgaaattattaatacttatactgaagcagtacaaacagttgacccaaaattggctgttgggaaactacacacattatgggttgagtttgcaaaattttatgaaagcaatgtccaaattgatgatgcaagattgatttttgaaaaggggacccaagttccctatgtaaaagtagatgatttagcaaatgtgtggtgcgaatggactgaaatggaaattcgtaatgaaaattatgatgatgcattaaagttaatgcacaaggcaacagtaatgccagctaaaaaagtagcttaccatgatgacacagagtctgtgcaagcaagactgtataaatctttaaaagtttggtctatgtatgctgatttggaagaaagttttggaacctataaatcctgtaaggctgtttatgacagaattattgatttaaaaattgccactccacaaatcattattaattatggggtatttttggaagaaaataactattttgaggaagcatttcgcgcttatgaaaaaggtatatcattgtttaaatggccaaatgtttatgatatttggaatacatatttgacaaagtttttgaaaagatatggtggtagtaagttggagagagcg

SEQ ID NO: 2981 - DNA, 694 bp, Meligethes aeneus
tgggggtttagatgacaaagtttccgaatcattattatgggagctttttgtgcaagccggacccttagtgaatgttcacatgcctaaagacagagttacaatgatgcaccagggttacgggtttgtagaatttatgggagaagaagatgcagattatgctataaaaattatgaacatgataaagctgtatggaaaaccgataagggttaataaagcatcagcccatcaaaagaatctggatgtgggagcaaacatatttataggaaatttggatgcagaagtggatgaaaagttattgtatgatactttttccgcgtttggagtcatattacaaactccaaagataatgagggatcctgaaacgggcaactccaaaggttttgcttttattaattttgcaagttttgaagcctctgatgcatctatagaagctatgaatgggcaatatctgtgtaaccgaccaatttctgtatcatatgcattcaaaaaagattctaaaggagaacggcatggttctgctgccgagagattattggctgcccagaacccattatctcaagctgatagacctcatcaactgtttgctgatgctccaccaatgggtatgatgcctcctggaatgtcaatggcaccaccaccacccccagtattgataatgccgcccccacctccaacccctacaaatatgcaacct

SEQ ID NO: 2982 - DNA, 625 bp, Meligethes aeneus
ctacttggatttcagcgaacgtcatggatacatcaagggggtggtaaaggagatcatccacgaccccggtcgcggcgcccccttggccatggtcaacttcagggacccctacaagttccagaccaggaaggagcttttcattgccccagaaggcatgtacaccggacagtttgtttactgtggaaagaaagccaacttgcaaatcggtaacgttttgccaattggagccatgcctgaaggtaccatcgtgtgcaacttggaagagaaaactggtgaccgtggtcgtttggcccgtgcatctggtaactatgccaccgtaattgcccacaaccacgacacaaaaaaaactagggttaagttgccatctggagcaaaaaaagtcattccctccaacaacagagccatggttggtattgtagctggtgggggtcgtattgacaagccaatcttgaaggctggtcgtgcctaccacaaatacaaggttaagcgtaactgctggcctaaggtgagaggtgtgtgcatgaaccccgttgagcatcctcacggaggtggtaaccatcaacatattggtaaggcttcgacggtcaagaggggaaccagcgctggtcgtaaagtcggtctcatc

SEQ ID NO: 2983 - DNA, 270 bp, Meligethes aeneus
gtaaacagttggcaaccaaagccgcacgtaaaagtgcaccagccaccggaggtgtcaagaaaccacatcgttacaggcctggaacagtagctcttcgtgagatccgtcgttaccagaaaagtaccgaattgctcatcaggaaattgcctttccaacgtttggttcgtgaaatcgctcaagatttcaaaactgacttgcgtttccagagctccgccgtcatggcattgcaagaagccagcgaagcatacttggtcggtcttttcgaagata

SEQ ID NO: 2984 - DNA, 644 bp, Meligethes aeneus
cagagcttcttcttgagctcgaccaccttgcgcacgcgctgcatgatgaagtcgcgctccgccgtcaccatcttctcgcgctcctcggccgttttgtagaagaagcccgagttcacttcgctcttctcgtactccatgctcacgttgcaggtgaggatgtacgcgtttttcagctgtttgggcatgtcggggtggcggcacccgtggtccatcacgatacctttgaccaaagaagtgtcagcttcagttttgtgctgcatctccatcaactcaaccatgtgcaagtcgacgggtttgtcgccctgcttgatggccaaaatcccgtcgacgcacacctcggccagaacgtcggccaacttccggtgcaccttggtcctcaagctggtcttgcacacgtccatcaggctctctctggacgcctcgacggggatcttgatcttctccaagacctccagcgccttggctctggctttgtcgaagccctcggccaggatcctcgggtgcaaaccttcggatatgtagatgtcggcctgcttgaggagctcgccgatcaccaggacggtggaggtggtgccgtcgcctgtcatgtcgtcctgcgcggtggaagccctggctatcaaggaggcggtagggtgctggatttg

SEQ ID NO: 2985 - DNA, 785 bp, Meligethes aeneus
aagtatttcgtagtcggagctggagcaattggatgtgaattattgaaaaattttgcaatggttggtttaggaacccaaggaggagaaattactgtcactgatatggatcttattgaaaaatcaaatctcaaccgacaatttttatttagacctcatgatgttcaacagtcaaaatctgttacagcagcaaaggtcatcaaaaaaatgaacccagatgtaaacattgcagctcatgagaatagagttggagtggacactgaaaatgtgtatgatgataagttttttgaaagtttagacggtgttgctaatgcattggacaatgttgatgcaagaatgtatatggatcgtagatgtgtttattatcgcaaacctttacttgaatctggtactttgggcactaagggaaatacccaagtggttgtacctttcttaactgaatcatatagttcttctcaagacccaccagaaaaaagcatccccatatgtactttaaagcatttccctaatgccattgaacacactttacagtgggcaagagaaacgtttgaaggactttttaaacaaaatgcagaaaacgcatctttgtatctaaaagatcctgaatttgttgaacgcactctaaaactacctggcgttcaaccgcttgacacgttgcagtctgttaaggcagctttgattgatgaacgcccaaaatcttttgaagattgcattcattgggctagacttcattggcaagaacaatatagcaatcaaataaagcaacttttgtttaactttccgccaac

SEQ ID NO: 2986 - DNA, 791 bp, Meligethes aeneus
tattgtcgattgcggttttgaacatccatcggaagtacagcatgaatgtattccacaagccgttctcggcatggacatcttgtgccaagcaaaatccggtatgggtaaaaccgccgtgttcgtgttggcaacgttgcaacaactcgagcctaccgaaaacgtggtctacgtactggtaatgtgccacacgagagagttggccttccaaatcagcaaagaatatgaacgattcagcaagtacatgtccaacatcaaagttggcgtgttctttggtgggttacctattcaaaaggatgaagagctgttaaaaaacaattgcccacacattgtggttggtactcctggcagaatattggcgttggtccgttcgaagaagttgaatctcaaacacctcaagcattttattcttgacgagtgcgacaaaatgctggaactattagatatgagaagggacgttcaagaaatatacagaaacacacctcacggaaagcaagtaatgatgttcagcgccactctcagcaaagaaattcgtcccgtctgcaagaagtttatgcaagatccaatggaagtttacgttgacgacgaagccaaacttaccctccacggtctccaacaacattacgttaaactaaaagagaacgaaaaaaacaaaaaattatttgaattgctcgatgttcttgaatttaatcaagtcgtcattttcgttaaatcagtacaaagatgcgttgcactggcccaattattgactgaacaaaatttcccagccattggaattcacagaggaatggacc

SEQ ID NO: 2987 - DNA, 627 bp, Meligethes aeneus
cgagcaagcaagacaaatcgaaaaagcggtggcgaataaggaaaaccgctttattttgagggttttgaggtgcttgccgaacacgagacgtaaattgaacggtatagtgctgagaagtttgatctcgcagatatatcctttgtctgaacgggaagctttgttgtcttttgttgaagaggctgtagggtctgagattgattctcagacgagggcgagatcagcaactaaaacccccgtgtcggaagttgacttgtacatccatctcatcattctggtacgtttgattgatacaaacaaactagaagaagccttacgttgctcccaggctttaatgggtaaaatcaccagtcaaaacagacgtacttcggatcatattgccgctaaatgctatttctaccactcccgcgtcgccgaattaaccgacaaacttgatacaattcgtgcgttcctacatgcacggttaagaacagccacactgagaaatgactttgaagggcaagctgtacttataaactgcctattaagaaactatctgcattactctctatacgatcaatcagataaattggtgagcaaatgcgtttttcctgaaacagcaagtaacaatgagtgggcaagatttctgta

SEQ ID NO: 2988 - DNA, 712 bp, Meligethes aeneus
agtggatatgacccatcagagcacaaagctgtaatagaagaattccaaaaagttgaagaagccaaaagacaattaaaagctgacaaattggatgctaatgaagatagtgaggaagaaggtgaaaaagatgaggataaatatgtggatgaagttgatatgcctggtactaaagtagatagtaagcaaaggattactgtaagaaatttaaggataagggaagatacagccaaatatttaaggaatttagatccaaattcagcttactatgaccctaaaacaagatctatgagagaaaatccaaatccaagtaaggatgatccttactctggtgaaaattttgtgagattcactggagatacaacgaaacatttaaatgcacagttgtttgcatgggatgcttacgaaaaaggtgttgatgtacacttactagcagaacccacaaaattggagcttttacaaaaagaatatgaacagaagaaagaacaatttaaaggcaaaattcaaaacaacatcctggaaaaatatggaggtgaagaacacttggatgcacctccaaaaacattacttttagctcaaacagaagactatgttgaatactcaagatcaggaaaaattgttaagggacaggaaaaagaaatcataaaatccaaatatgaagaggatgtttacattaacaaccacacatctgtatggggttcattttggaaaggtg

SEQ ID NO: 2989 - DNA, 388 bp, Meligethes aeneus
agataccggaaatttcgcatggggtagcgaaggcacagcccgcaaaacccgtatcatcgacgttgtttacaatgccagtaacaatgaattggttcgtaccaagaccttggtaaagaacgccatcgttgtcattgatgccacaccattcaggcaatggtatgaaaatcattacattttacctttgggacgcaagaagggagccaaattgactgccgatgaagaagctattttaagcaaaaaacgcagcaaaaaagtgcaaaagaaatacgaaacaagacaaaaaacatctaaagttgaacctgctattgaagaacagttccaaactggtagactattagcatgcttggcttccaggcctggacaatgtggaagggctgatggatatgtt

SEQ ID NO: 2990 - DNA, 198 bp, Meligethes aeneus
tgaggctctctctgaaagggctgtggctgtcgtagtcgatcctattcagtctgttaaagggaaggttgtgattgacgcttttaggctgataaatcctaatatgatggtcttagggcaggaacccagacagaccacatcaaatttggggcatttacagaaaccttctgtgcaagccttgattcatggactaaacaggca

SEQ ID NO: 2991 - DNA, 674 bp, Meligethes aeneus
ccacttatgaaatggtgggaggtctggacaaacaaattaaggaaatcaaagaggttattgagttgcctgtgaaacatcccgaattgtttgatgctcttggaattgcacaacctaaaggtgtactgttgtacggcccacctggtactggtaaaactctgttggctcgtgcggtggcccatcacactgagtgcacctttattcgcgtctccggttccgagttggtgcagaaattcattggcgaaggttcgcgaatggtgcgcgaactgttcgtcatggctcgcgagcacgcgccctccatcattttcatggacgaaatcgattccatcggttcttctcgcattgagtctggttcaggtggagactcagaagtacaaagaaccatgctggaacttttgaaccagttggacggttttgaggcaaccaaaaatatcaaggtgatcatggccaccaacagaatagatattttggaccctgctctcttaagacccggcagaattgaccgtaaaatcgaattccccccaccaaatgaagaagccagattggacatcctgaaaattcactcgagaaaaatgaacttaaccagaggaatcaatcttaggaaaatcgccgagctaatgcctggagctagcggagctgaagtcaagggtgtatgcactgaagcaggtatgtatgct

SEQ ID NO: 2992 - DNA, 459 bp, Meligethes aeneus
tggttgaaatcggccttcgagctgcaaagcttcagcttctttcagcgcggctccgtgcaggagttcatgtcgtttttctgcaaaaccatagtggaacgaaccattccagcttccaggcaatctgtcaacgaaggagagtatttgtgtcacgtgtacgtgagaggcgataatttagctggcgttgtgataaccgatcatgagtatccatcgagagtgtcacacactttaattacaaagattttagacgagttttctgttaaatttcctgtggagagttggccccaattgcaagaaagagacgtggcgttcccacagttaaatacttacttagcgaaataccaaaatcccagtgaggcagatgcaatgactaaaatacaagaagatctggatgaaacaaagattattctacataacaccataacagctgtccttcaacgaggcgaaaaactggacgattta

SEQ ID NO: 2993 - DNA, 293 bp, Meligethes aeneus
gatagggcaagaatagaatgccaaaaccattggtttgtttacaacgaaaacatgagcgttgaatcttgtgcccaagcggtttcgaatttggccattcagttcggcgattccgacgacgacggggcggccatgtccagaccctttggagttgccattttgttcgccggaattgacgaaaagggtccccagctataccacatggacccttcgggcactttcgttcaattcgacgcgaaagcgattggttccggttcggagggagcgcagcagagccttcaggaggtttaccatcg

SEQ ID NO: 2994 - DNA, 725 bp, Meligethes aeneus
acgcatttgttgaacaagttaccagaaaagtggcctcgtacttgggtgaagttcttgaggatcaacgggacaaacttcaggagaacttgatggccaacaacaccgacttgccaagctatctgacccgattccaatgggacatcgcgaagtacccgatcaagcagtcgcttcgcaacatcgccgacatcatcagcaaacaggtcggccagatcgacacggacttgaagaccaagtctaccgcctacaataacttgaagagcagtcttcagaacatggagaagaagcaaaccggcagcttgttgactcgcaacttggccgatttggtgaaaagggagcattttattttggattcggagtacctcaccacccttttggtgattgttcccaagagctcttttaatgaatggaacgccacatacgaaaagatcaccgatatgatcgtacccaggtccaccaatttgattatccaggacgctgagtatggactctacacggtatctttgttcaaaaaggtcgttgatgagttcaaacttcactccagagaaaagaagttcattgttagggacttcacttacaatgaggaagaattggctgccggtaaaaacgagattaccaagttggttactgataagaagaagcaatttggtcctttggtgaggtggctgaaggtgaacttcagcgaatgtttctgtgcctggattcacgtgaaagccttgagagtgttt

SEQ ID NO: 2995 - DNA, 669 bp, Meligethes aeneus
catctcgtcgcagtagaagtcgttggggccgcgcaggattatagaggccgcggtgcgggcctttggctttttaataatgatcaactcatcatcgcagattctctcctgggttacttcggccgcttcaccaaccatactgctgtcgaaagtttcatcaccgtccatgttggtcaaggatgtgagataagcggctccggtggctttggcgatgcgcttgaggtcgaccttcttgaccctgcgaacggccatggcgttcttctcgacgaaatacttgaggcagaggtcgtcgatgccgccggaaaccaggacgacgttcacgcccgtcgccaggatcttctcgatgcgctccttcgtcatgtccagctcgcggttcctgatgccctccaacttgtccgggtcgctgatcaggacctgcacgcccaacttcatcttggacttttgcagcgaaaagtccaggcacgcgatcttcgcgttggcgatcttcttgggcatggcctggctggcgacggtgcagttcagcgcgtaaccctgcaccaagacgctctccctcgcacttctgccgtgcgccttgaggatgttgaccgccttgatggggtacatggcctggcctttcgggtcctggatcttgaccgcctgagcggcgtccacgaccatggtcgagaacagatc

SEQ ID NO: 2996 - DNA, 654 bp, Meligethes aeneus
ccgggggctttctataatttcccaaacacgaaatccggcccaagcgacgaatttcaacattctcaggctcccataacgacagcaacgtccattgtggctataaagtacgccaccggggttataattgccggtgatttgctgggttcgtatgggtctttagcccgttacaggaattgccccagagttttgcaagtcaatgagaatattattcttggagctggcggagattacggcgatttccagtacataaaaaactttattgagcaaaaaattgttcaagaagaatgtttggatgatggttttaagctaaaaccaaaatccttgtactgttggttaacaagggttatgtacagttgtagaagcaaatttgatcccctgtggaataatttggttataggaggaattcaagatggtgaacctttcttgggtacagtagacaaactaggcactgccttcacagataaaataatctgcacagggtatggggctcacattgctgttcctttgcttagagaggctatggaaaaaaatccaaacatgtctaaagatgaagctaaagctcttgttgaaaaatccatggaagtcttgttttacagagatgccaggagtttccctaaataccaagttgctataattgaccaaaatgaaggttcg

SEQ ID NO: 2997 - DNA, 779 bp, Meligethes aeneus
gaaaatacaggcgttgtcagaggatactaataataatttaaagaagaatgtatatcaaaattatggtcaatttattgatacagccaaagaaatatcccatttggagagtgaaatgtatcaattatcccatctattatctgaacaaaagtcccttttgaactctctggcatcaacttccttaatgggggataatagcaatttaactagaaacaaggaaagatctgaggagaaaattattgaggaacaaaaacagaaaactcaatcaattctagagaaagtggagggatgcaaagatgttttagatatcccaggtagaacgttcttgcatgagggagatcttttggaattagattctttagaaaataaaccaattaaaccagtgcatgtttatttatttaatgatggttttatgattacttcaagaaattccaatagtcgaggattaatgaaatataagtttgaagttatgtatgaattaggcagtttagctgtggttaatgttagagatttaggggatgttaaacatgcttttaagttgctaatatttcctgaaactagaatatttcaatgctcttcaaattcaaataagaaagattggttggataaatttgatcaagccaagaaaaaccagctttcacaggatgtccaaagacgcgaatctataatagaaagatcaccttcaagaaccactatagaatcaggcatacacagcactttaagtgaatctgaagatgacttggttattataacacatccagaatggtttttggatttgcctg

SEQ ID NO: 2998 - DNA, 688 bp, Meligethes aeneus
gtcaagagagcaccatagagatagaagaaacagatctagagatagagatcgaagcaggagacataggtcaagatctagggaaagaagaaggtcaagggacagaagaagcagatcaagagaaagaaagcacgataaacatgatagagttaataataagaataagcatgaacgaagtccagaattggatgatgatccggttccaggaaaaatatacagtggcaaagtagccaatatagtgccatttggatgttttgtgcaaattgaggggttgaaaaggagatgggaggggttggtgcatatatcccaattaagggctgagggtagagttactaatgtttctgaggtcactgctagaggcaacaaagtaaaagtaaaaatcctctcagtaactggccagaaagtatctttgtcgatgaaggatgtttgccagatgagtggtaaggatttaaatccactgtcacatgctccttctgaaagggaagatagggatagaaatccggataggcccacaagtagctccactagtgtgttcagattgcctgtaggtactgatgaaggagaagaggattccaggaagaaaatcaccaaaatgtctagtccagaaagatgggaaatcaagcagatgatttcgtccggttgcatagataaaagtgaactcccagaattcgacgatgaaaccggactttta

SEQ ID NO: 2999 - DNA, 714 bp, Meligethes aeneus
gaggaggttcttcgaaaactggcgtagcaaatggatttgaaatatttgaaatagcccatgatgggaaaaaatttattgctgaagaggtgaccagacacgaaacaggacccagtgttgttatgaattgctcatcgtacagtaacagtaaacattcctacttagtggcaggccaagaaagtcattgtcagttatacagtgttgatagtgttctagtcagagatgaagataatgtggaaaatgttggtgaaaatcacacggaagtgaggcaacgtaaagcaaaacctaaagaacaaacagacaataacagaaatgtgaaaaagagattaaagtttaatatcaagcctatggacagtgtgcagactgattttaatggacaggaacctttgttgagagttatgcggatagggcacaatggaaaaatgctggcaactggtggtacagataatacaattaaactatggaaattccctaacttagagcccctagcaacattaaaagcccacgaaaaagaaattgatgacatagattttagccatcatggtaattttttaataactgttgcaaaagacggtttggcagtattatgggatagtttaaagggtaaagaacttaacaggctggaatggaaacaacctgagggatcaaaatatttatacaaaagatgcaggtttggccttatcgaggggctggacgagaaaaggtctgctctgtaca

SEQ ID NO: 3000 - DNA, 702 bp, Meligethes aeneus
caccacgataaacttctggaaaacctgaaacgcgaacaagaagaacgcgacgatgaagaaaacatcaaaaataaggagcaggacatcctgaatttgggcgagaagtataaaaaagagggtaaggctaaggaactcgcggaactaataaaggccacaagaccgtttttgggggaaataagcaaggccaaagctgctaaactggttagatctttggttgacttcttcttggacttggaggctggcattggtatagaagtgcaactgtgtaaagaatgcatagaatgggcaaaggaggaacgaaggactttccttcgtcagtcacttgaggcgaggttaatagccctatatttcgataccggtatgtttgcagaggctctgctgttaggatcaactctacttaaagaactcaaaaagctagatgacaagaatttgttagttgaagtgcaactgttagaaagcaaaacctatcatgctttaagcaatttacctaaagcccgtgccgctttaacttccgctcgtaccaccgccaacgcaatctattgcccccccaaaatgcaagccgcccttgatttgcaatcaggaattttgcatgctgccgacgagaaggattttaaaactgcctattcatacttttacgaagcgttcgagggttttgacagtgtcgaatcaccgaaagctctaacagccttgaaatacatgctg

SEQ ID NO: 3001 - DNA, 551 bp, Meligethes aeneus
gaaaaacacgacttgcagaacctcaacgatcgtttggccagctacatagataaagtgcggtatttggagcaggaaaactcgcgtttgaccagggaagtgcaaacttcgcaggaatgcactacgcgggagatcaccaacatcaaatccatgtacgatgtggaactcagcgacgcccggaagcttctggacgagacgcacagggaaaaagctcgcctggaaatcgacgtgaaacgtctgctggaagaaaacgacgagttaagggacgatttggcgcgcaaaagcaaagatctgatgatcgctgacaactctgcacgtatcaacgaaaccaaagccaacgagatgcagctgaagtacacccaggccaaccaggacgccaaaaaggccatcaacgatgcccgaaacttggagaaggagcgcgacaagctgcggaagcttctggacgagcaccgcaaacatctggaagaagagagtttggcacgcgtcgaaattgaaaacgcaaaccaaagtttgagggaagagctctccttcaaagatcagatccaccagcagat

SEQ ID NO: 3002 - DNA, 787 bp, Meligethes aeneus
ctcttaactctcatggacggcatgaaaaagagctcgcacgtaatcgtgatggccgccaccaatcgtccgaattcgatcgatcccgctctacgtcgtttcggacgcttcgatcgcgaaatcgacatcggcatccccgacgccaccggccgtctggaagttttacgcatccacaccaaaaacatgaagctcgccgacgacgtcgatttggagcagatcgctgccgagacgcacggccacgtgggcgccgatttggcctcgctatgctccgagagtgctctgcaacagatcagagagaagatggatttgatcgacctggaggacgatcaaatcgacgcggaagtactaaactcgctcgccgtcacgatggagaacttccgctacgcgatgacaaagagcagcccgtccgctctccgcgaaaccgtggtcgaagtacccaacgtcagctgggaagacatcggcggcctgcaaaacgtcaagaaggaactgcaggagttggtgcaataccccgtggaacaccccgacaagttcctgaagttcgggatgcagccgtcgcgcggagttctcttctacggcccgcccggttgcggtaaaacactcctggccaaggccatcgccaacgagtgccaggccaacttcatatcgatcaaagggcccgagttgctgaccatgtggttcggcgagtccgaagccaacgtcagggatattttcgataaggcgcgttcggccgctccttgcgtgctcttcttcgacgagctggattccatcgctaaatccaggggtggaaatg

SEQ ID NO: 3003 - DNA, 655 bp, Meligethes aeneus
tttactgtcatctgtcgaccagcccttgaaagtggctaaagataaggattcaggcaaagattatttgttgtgtgattataatagagatggcgactcatataggtctccgtggtccaacacatactacccacctctagatgatggctccatgccttctgaacgcctacgtaaattagaactcgacgccaaccatgctttcgatcaatatagggaaatgtacttcgaaggcggcgtatcgtcggtgtacttttgggatttggaccacggattcgccggcgttattctaataaaaaaaaccggcgacggcagtaaaaagatcaaggggtgctgggactccctgcatgtggtcgaagtgcaagaaaaaagttccggcaggaattcacactataaaatgacttctactgctatgttgtggctgcagaccaacaaacaggaatccggtacaatgaatttgggcggcagtcttacccgacagatggaacaagacagcgtagtgagcgagtccaacccacacatcgcgaatatagggcgcatggtcgaggatatggaaaataaaattcgcaacactctaaacgaaatctactttagcaaaactaaggacatcgtgaacagtttaaggtcggtgcagccgttgaacgagagtcgtcaacagcag

SEQ ID NO: 3004 - DNA, 679 bp, Meligethes aeneus
atgatactccagtggatccaatcaatggggtggttcagcctcttgttaacccagctccggaaaggccaggtcgtgtcactaatcagctccaatttctacaaaaaactgtgcttaaggctgtcagcaaacatcaatttgcatggccttttgcagcacctgttgatgctaaaaaactcaatttgcctgactaccataaaataattaaacaacctatggacctgggaacaataaaaaagagactggataacaactactattggtcaggcaaagaatgcatacaagattttaacacaatgttttcaaactgttatgtgtacaataaaccaggtgaagatgtggtggttatggcacaaactttggagaaagtatttcttaccaaagtagcagatatacccaaggatgaagtagttgtggaaccaccagcaaaaggtggcaagggcaaaaagggaagaacaagtagtgggtcaggaaccggtggagctacacccacagcagggagaggaagacctccaggtgctgtctcttcaactagcgcgactccagtggcaacaacaacaggatcatcaggtctaccactaggcacacaagctcccaccacagttcctggcagtactgccacaacaacaatcacacctgcatcgacacacagctctcttcctccccaaccaatatcacagaa

SEQ ID NO: 3005 - DNA, 426 bp, Meligethes aeneus
ccaaaaggtgtacaaaagccagcgcttccgcgctggtaaaggtaagatgcgtaacaggaggcgcatccagcgtaaaggaccattggtcgtgtaccatcaagaccaaggattgcgtcgcgctttccgcaacatccccggcatcgacctcatcagcgtcggcaagcttaacttgttaaaattggctcctggtggtcacgttggacgtttcgtcatctggaccgaatccgctttccagagattggacaaattgttcggcacctggaaaactccatccggcgaaaagaagggatacaacttgccgcaacccaagatggccaatacagacctttccaggttgttgaaggccgacgaaattaaacaagttctcagagctccacagaagaagattgtacgtcgccagcgtcgtctcaatccaatcagcaacac

SEQ ID NO: 3006 - DNA, 659 bp, Meligethes aeneus
gaagaagaagaagaagcccatattcagcgacgcagccttgcaagaagcccaggaaacgttcggagtggacttcgactacgacgagttctccaaatacgaacaggacgagtatgaagatgatgaagacgaagaagacgacgattacgaggaggacgacgatggcgaacgcagacgacctccgaagaaagaaagacgcaaaaagcccacgaaaaaatccatattcgaagtgtacgaacccagcgagttaaaaagaggtttcttcaccgatttggacaacgaaattcgtaacaaggacgttcccgagcgcatgcagctccgcgacgttcccataaccccggtcgcggacgattccaccgagctggacgacgaggccgaatggatttacaaacacgcattttgcaaaccaagtgtttccaatatggaagcgaatttgacgtctgaacagagggaaaaattgaaaaagggtccgcaaactgtgacgaaaattcgcaaagctctggattttatgcgaaatcagcagttggaagttccttttatcgctttttacagaaaggaatacgtccaacccgaattgaacatcaacgatttgtggaaagtttataaattcgactccaagtggtgccaactgaaatctcgcaaggagaacctgatgaaactgt

SEQ ID NO: 3007 - DNA, 718 bp, Meligethes aeneus
aatggagatcaaacctggacaagagattgaattgtgtcacatgttccttgattgttgcgctgaacagcgtacctacgaaaaattcttcggcctcctctcgcagcgcttctgccaaataaacaagactttcatcgaaccgttccaacaaattttcaaagatacctattccacaactcacagacttgacgccaatcgattgagaaacgttagcaaattcttcgcgcatttattgttcaccgacgccatcggctgggaagtgctcgatatcatgaaattaaacgaggaagacaccaacagttccagcaggattttcatcaagattttgttccaggagttgtccgaatatatgggattagcgaagttgaataaaaggctaaaggatgaaactttacaggaatatttcgcggggctatttccgagggataacccgaagaacacgcgtttcgccatcaattttttcacgtcgatcggtttaggaggtctaacggacgagttgagggagcacttgaaaaacgtgccaaaacatctggaagtgatggctttgaaagcagattcgagcagctctagcagcagtagcagcagttccagtaacgattccagcagcagttcagattcttccgatgacgagggttccaggaagaagaaaacaaaaaaattgaaaaccccggacaaaaagaagaaacagaaagaagatgaaaaacccaaaaagaaaagcgag

SEQ ID NO: 3008 - DNA, 706 bp, Meligethes aeneus
acccttcagtaagataccgaagtgattgggaacgcaacgtggaactagcgcagatgattcagcaaaagttggatgcctataaagcggatgagcccacaatgggagaggggcctgaaaaagcgagatcgcaacttttgattcttgaccgcggcttcgactgcgtatcacccatgctgcacgaacttacattccaggcaatggcctacgatttgctgccaatcgaaaacgacgtgtacaaatatgaagcttcagcgggagtatttaaggaagtgttgctcgacgaaaacgacgagttatgggtagaattacgacatcagcatatcgctgtagtgtcgcagagtgtgacgaaaaacttgaagaaatttaccgattcaaaacgaatgacccaaagtgataaacaatcaatgaaagatctgtcacaaatgattaagaaaatgccccaatatcaaaaggagttatctaaatatgctacacacttgcatcttgctgaagactgcatgaaatcttaccaaggatatgttgacaaattatgtaaagttgaacaagacctagcaatgggtacagatgcagaaggagaaaaaattaaagaccatatgcgtaacatcgtaccgattttacttgatccaaaaataacaaacgaatatgacaaaatgagaataattgctctatatgcaatgattaaaaatggcataaccgacgaaaattt

SEQ ID NO: 3009 - DNA, 786 bp, Meligethes aeneus
cgcatgtagcatcaaaagttttgcatttgggcgatcaactcgacagtgttaatggccccagggccagagttgtggaggcacaaaaattaatgacacacttaaacgagttttttaccactggccctctaacgtcatctttattcacagatcctaaacgagtagatgaggctgcagatgtaatacagaaactatttgttatttctcaagatttacccaatgaaaaatttagcggcgtacttgaaaaaataaaaagaaaatatgcggatattgaaagatctttaattgaagaatttactgatgaattaaaaagggataatgtcgatagaatgaaggaaattgctagtgttatgtaccagtttaagggatattctcgcttaattaatgaatatatcgaatatagtcaagctgggtgtctccacacaaaagaaattttctacagtcaactcttggagttgtgtagaaaaaactacgaaagaataaaggaagttttcataaatcctgaccaggttatgtccaaatttgttctaaacatttatcaactcaaaatccaggaacacattagattaaggctctctgataagttggaaacatataattatttgaagactctctatgaactattatcaaagactaaccaactgtcaaatgatttagctatggtgcatgttagcagtgacaagaattttttgaataagttaacatcaaatatttttagcaaatatattgacaattatatacaattggaattaaaatgtttgagaggtagatgttcgacgaacctacaaa

SEQ ID NO: 3010 - DNA, 650 bp, Meligethes aeneus
ccgcagagaacgtttaagacaacttgcgttggaaactatagatcttcagaaggacccctattttatgaaaaaccatttggggtcatatgagtgtaagttgtgcttgacgctgcataataacgagggcagttacttggcgcatactcagggtaaaaagcatcaagccaatttggctagacgtgctgccaaggaggcaaaagatgcaccttcgctaatccagcctgaaaagccaagagttgaacccaagaagtttgtgaagattggtaggcctggttacagggtcaccaagcagagggatattgagaatgggcagcagagcttgctatttcagattgattatccagaaattggtgacatggtgataccacgtcatcgtttcatgtcagcctatgagcaaaaaattgagccgccagaccgcaaatggcaatacctgctattcgcagccgaaccatacgaaacgattggcttcaaagtaccgagtcgcgaggtggaaaaaaccgacacgaaattctggacgcactggaacagagacacaaagcaatttttcttgcagtttgcatttaaaaacgaagcaaaaaagagcaccaccataataacccgaccagggcacattattgctggagtgccacctcctccaatgatgccagtac

SEQ ID NO: 3011 - DNA, 258 bp, Meligethes aeneus
ggaaaattgattgaagccgaagacaacatgaattgccagatgacgcagatcaccgtcacttatagagacggcagagtcgctcagctagaaaatgtttacattagaggctcgaaaatcagattcctaattctgcccgatatgctgaaaaacgccccaatgttcaagaaacagaccaaagcgggtactgcggggcgaggaaaaagcgccatactgcgagcacaagctcggggcagagggcggggtcagcctcctattcga

SEQ ID NO: 3012 - DNA, 650 bp, Meligethes aeneus
aaaactgtagttgttgctgccgataatgattcccaaattgccagggtttctataattttaagagctgggtcaagaaacgaaaccgccgaaaatttgggtattacccatttattgagaaattgtgcaggactatccaccaaaaatgccagccaatttatcattactcgcaacattcaacaagttggcgccagtttgaccgcaacctcggaccgcgaaaccatttcctacacccttgaaggtaccagatcggctgtcgaaaaagttataccatactttactgaagttgccacacaacaagttttcaagccatgggaagtcgccgagaataccggacgtttgcacctcgacattgccacccgcccattgcaggttagagcaattgatttgttgcacaaagccgctttccgtaccggtcttggtaactcgatgttcattccgaaattccacattggcaaaatttcttcggaatctttgcaacactacgtgtgcgagaacttcaccagcggccgcgccgctgtcgttggtttgggaatggacgaagccgaagtaaccaagatcgctcaatctttgcacttgggatctggggaaggtcaaacaagaccatctccatacaaaggcggtgaagtaagatccgataagggaggagattt

SEQ ID NO: 3013 - DNA, 183 bp, Meligethes aeneus
agaggacgaaaatgatcgaatgactaatgagttaaaagacaaaattggcgttttgaaatctctatcgatagacatcggcaatgaggtgaggtaccaagataaactgcttaacgatgtcgacgacgacttggaaaggactggggggttccttgggaataccatgaatcgagtgatgcgactaac

SEQ ID NO: 3014 - DNA, 640 bp, Meligethes aeneus
atgacgactttatcacccagacaggctcaaagggaacatgttttggcggtatcccgtgacttcgtgtcccagcccagattaacttacaagacagtttctggggtaaacgggcctttggtaattttggaagacgtaaaattccctaaattctacgaaattgtgcaactgaagttggctgatggcagcattcgttcgggacaagttttagaagtaagcggttctaaagccgtagtacaagtttttgagggtacatctggaattgatgccaagcacacggtatgcgagttcaccggagatattttgcgtacctccgtgtcagaagacatgttgggacgtgttttcaacggatctggaaaacccattgacaaaggacccccaatcttggcggaggacttcttggacatccaaggtcagccgatcaacccgtggtcgcgcatctaccccgaggagatgatccagaccggcatcacggccatcgacgtgatgaactcgatcgctcgcggccaaaagatccccatcttctctgccgcggggttgccgcacaacgagatcgccgcgcagatctgccgtcaggccgggctcgtcaaggtgcccggaaaatcggtgctcgacgaccacgaggacaacttcgccatagtgt

SEQ ID NO: 3015 - DNA, 537 bp, Meligethes aeneus
cctagaacaaccaggagatgttgtggcttatgcagctgattattttcaaagattacgggaaaccagaactacttccttaatctatgggggctcagggacacaggatttgatgtctcctgatgagtctacaatatcaggagaagaagaaccaccaatagaacgtttcacgtccagacgtaaatcagtattcgccgagacttacgatcccgaagaggatgacgacgatgatgacggcattaagacggtgtttcccaaatccgacgagcagaggcaaagattgtcagaagctgttcgtaacatattgttatttagatcgttggacaaagagcagatgagcgaggttttggacgccatgttcgagagaaaagttcagcaagatgaattggttattaagcagggagatgatggggacaacttttatgttatacaaagcggaatatttcatgctttggtggctagcgaaccagcccaggttccgacacacatccacacgtacgataacgccggcagttttggcgagctggctttgttgtacaa

SEQ ID NO: 3016 - DNA, 742 bp, Meligethes aeneus
tttggttcagttgttgatgcgggccttccaagacactcagaggcgtgccagcgtggcaagtggtggtagcaatcaaccgggtacttatgctgacggagttcgcatggaggaaatcatagagggcactgtgggtgctttgcatatccttgccagagagtcgcataatcgtgccatcattcgacagcaaatggttgtcccaatattcgttggacttctgttcaacgacatcgaaaacatacagcgcgtcgcagccggcgttctttgcgaacttgccgccgataaagaaggcgccgaaatgatcgagcaagagggcgccacctccccactaaccgaactgctgcattcaagaaacgaaggtgttgccacctatgcggcagcggtgttgttcagaatgagcgaagacaagccgcaagactacaaaaagagactgtccatggagctgaccaactccttgttccgcgaagagaacctctggaaccccgatcttggaatcggttccgaactacaggaaattttgagtcccgagcactacgataacctgtatccacaagatcccccaagtgtacacagcagccatggcagtagaccataccaacagcaagggtatgaccagataccaatagacatgcaaggtttggagatcggttcccacggaggcggcaacggctccacctacagtgcaatagatgcgatggaagtcaccagcggtgaaccggatctcaactttgacggtatcgatcag

SEQ ID NO: 3017 - DNA, 653 bp, Meligethes aeneus
ggagaaagcgaaaaacacaaaaaacgtcgcccctatttagcctctgaatgtaaaagcctctatgcttgtgaaaaatggaggatgcagattattcgggagattgccaaaaaagtggcgcaaattcagaatgctggtttgggggaattcaggatcagggatttaaatgatgagataaataagttgttgagggagaaacggcattgggaggatcagattaaggagttgggtggccctgattatcaacgtgttggaccacgtatgttggatcatgaagggaaagaagttccagggaatagggggtataaatattttggggctgctaaagagttgccaggagttcgagagttgtttgagcaagaacctccgcctcccccaagaaaaactagagctgaactcatgaaggacattgatgctgactattatgggtacatggatgacgacgatggcatcctacttccattggaaacaaaagctgaaaaaacatcaattcagaagaaagtggcagaatggaaagagaaaaaggagaacaggctaaacaaagcttcagatgatgaagatgacgaagaggatgaaaatatttatgcggtggaagaatctgatgaggaagagcaaccccaagtaatagacgggtcccagcaaagatttgttgctca

SEQ ID NO: 3018 - DNA, 499 bp, Meligethes aeneus
cggtgaattcgagaagaagtacgtggccacactgggtgttgaagtgcacccgctggtgtttcacaccaacaggggggctattaggttcaacgtgtgggacaccgcgggccaagagaagttcggtggcctgcgagacggctactacattcagggacagtgtgccataatcatgttcgatgtcacatctcgtgtcacctacaagaatgtgcccaactggcacagggatctcgtgagggtttgcgaaaacatcccaatcgtgctgtgcggcaataaagtcgacataaaagatagaaaagtcaaagccaaaagcatcgttttccacagaaagaagaatctacagtactatgacatctctgccaagtcgaattacaactttgaaaagccgttcttgtggttggctagaaaactgattggcgaccccaacttggagttggttgccgcccctgctttggtgcccccagaagtgcaaatggacccccattggcagcaacaaattgaa

SEQ ID NO: 3019 - DNA, 348 bp, Meligethes aeneus
tatgtacagggtgggttttcaaggttacttcttaggagttggtggaacctggaatttaaatgaagaaaaaaatgcagatgctgaaattgtggcatcgggaatttttgttgggtacatcatatacactgtggtttctctgattagcttttgttttgctgcaggtgatcataaaacaacctttactgatgttttaatgaacgttgttggggttttcatgtgggtagcagttggtgcaactgctttacattactggcatggttatctggctgaacataaatataccgctataaactcagaaagacaggttggtttagtcatgggttctctatgtattataaacggggcagc

SEQ ID NO: 3020 - DNA, 706 bp, Meligethes aeneus
gaagaactaaaagcgaaggcagaacgcgaattggccctgcgttcgcaagtcatccagagagaatttcccagaccgcacgacgttaacttggcagtgttgcggccgccgcacgagtcctactctctaacggacctccagaaggccgaggaactaatcaaaaccgaaatggtcaccatgctgcactacgacaacctaaaaaacccgataccgaccaccaccaccaagcgatcaaacttatcgcaagcgcagcaactggcgttcctcgagcaacatccatacgaaaattataagcccgaggatttggacgttgccaaggttctgcttaagcgagaaatggacgtcgtgaagcacggcatgaaccacggggagcttccgttggatgcctacacccaggtgtgggaagagtgccttggacaagtgttgttcttaccaaatcagaataggtacactcgtgcaaatttggcaagcaaaaaagacaggcttgaatcggcagaaaaaagattggagcaaaatcgatcacacatggctaaagaagcaaaaaaagccgctaaaatggagaaaaaacttaagatcttaactggtggttatcagtctagagctcaggtcttaataaaacagttgcatgatctttttgataatatagatcaagcaaatttggagctaaatacatttaagtttttgcaagaacaagaaaagagtgctttgc

SEQ ID NO: 3021 - DNA, 362 bp, Meligethes aeneus
caatgctcatccagacaaactaaagaaaaaaattacgagggagttaatcacaacgattttggctagaaaaccaaaaatgtgcagctttttggaatggagggacctaaaaattgtctacaaaagatatgccagtttgtatttctgttgtgcaattgagcaagatgataatgagctcctaacattggaaattatacatcgatatgttgaactgttggataaatattttggaagtgtgtgtgagttggatatcatttttaactttgaaaaggcctattttatacttgatgagctactgcttggaggtgagatacaagaaaccagtaagaagaatgtcttaaaggcaatagctgctcaggatttgt

SEQ ID NO: 3022 - DNA, 661 bp, Meligethes aeneus
cttgtattcgaaagagcagcggcggcagactttcatatcgcgtttgtacgacaatttccgcgacgaaatggcgaagaacaaggaaatgaaagagtcgctgaagaaatttcgagaggaggcccaaaaattggagcaaagtgatgcgttgaaagctgccaggcacaaatttgagactgtagagaaggaagctagtgagggaagtaaagtgtttaaggagaagtttgatagtattaaagaaaaagtgcaaggggttgttgacgaagtgggtaaatcagatattgcaaaaaaagctggtaaaatctctgaaggtattggtaaaacaaccacctcattcacggaaaaagcacaagaaatcggcaaaacaagcgcatttcaaagcatatcgcagacagccgaagcagttaaaaaagagattgacactacaagtatggagggcagagtttatgtgagtcccacaaagttaaggaagagaacagagacatctgcagtgcaaaacgtgaagttctatgaacccaatgaggaagcaacaggcatagaactacacaaagactcaaaattctaccagtcgtggcaaagtttcaaagacaacaacccctacgttcacaaagtaatggattggaaattaaagtatgatgaaagtgataacccccttatcagagct

SEQ ID NO: 3023 - DNA, 640 bp, Meligethes aeneus
tcaaaagcctaaacagtttgtaaacaacacaactggtttaaaccagaaactggaagaaataaagtcatctttgccatggattgaattacttgattgtgttaacaaacaagctccacttgcacctgaaatggcagcacagatgttggaacaagagcaaaaaagagagaatcaattaaaaaacaacaaaaagttgcaacaatttgctcccacagatgatcctgtattgaacgatttcaaaagagaaatgatgtttcacagacaagcacaagctgcagtgcaagaggctataccaaaattaaaagcaatggatattgctactaaaagaccagacgattattttgcggaaatggctaaaactgatgctcatatgcaaaaaattagagagcatttaatgcaaaaacaacagcagcaacaaaggagtgaacgggtgaagcagttgagaacacaaaggaaagaagggaaaatgatacaaatccagacgaaacttcaaagacaacaggagaaaaaggaaatgatggatcaagtaaagaaggtaagaaaagggctttccaaagatttggactttttggatggtaagaaaaataaggccatatctagaaagtcgctggaaaaaagaaaaatgagggataagaagtttggc

SEQ ID NO: 3024 - DNA, 688 bp, Meligethes aeneus; identical to SEQ ID NO: 2998

SEQ ID NO: 3025 - DNA, 711 bp, Meligethes aeneus
atcgctccatcgataacaaagctatgtacgatacattctctgcctttggtactattctcagttgcaaagtagctcaagacgagaatggcaccagcaaaggttacggttttgtccactttgaaaccgaagaggcagctaacaaatccattgaaaaagtaaatggtatgttgctcaattccaaaaaggtatacgtaggcagatttatcccacgcaaagaacgcgaaaaggaacttggagaaaaagccaaattgttcaccaacgtgtatgtcaagaactttggtgaagatctaactgaagaacagctgagaataatgttcgagaaatatggtgtcatcaccagctacaagatcatgagcaaagacgacggcaaatccaaaggttttggttttgttgcctttgagagccctgaagctgccgaaactgccgttgaggcgctaaatgcaggtaaagaattggtggagggcaagcctttgtacgttggccgcgctcagaagaaagcagaacgtcaacaggaattgaaacgtcgttttgaggcattgaaaatggagaggttgaaccgttaccagggcgtcaacttgtacgtgaagaacctcgacgacaccatcgacgacgaacgtttgagaaaggaattctccccattcggaacaatcacctcggccaaggtgatgatggaagaaggcagaagcaaaggattcggtttcgtttgctttt

SEQ ID NO: 3026 - DNA, 650 bp, Meligethes aeneus
aaccgaatatttgtgcgaacctttaagaaaatgcctaaaagacgaagatccgtacgtacgaaaaacagctgcagtttgtgtcgccaaactgtacgacatttcatcgggtttggttgaagaccagggtttcttggagcaacttaaagagttgctaagtgattctaaccccatggttgtcgccaatgcggtagcagctctttctgaaataaatgaaagtagtccaactggacaaccattggttgagctcagtacaagtacaataaacaaacttttgactgctttgaacgaatgtacggaatggggacaagttttcatccttgattctttgtcaaattacactcccagagatgaaagggaagctcaaagcatttgcgaaagaattaccccacgattggcccatgcaaatgctgctgtagtcctgtcagctgtcaaggttttaataaaaatgatggagatattggccggtgatgttgagttttgtaatactctgagcaaaaaattggccccacctttggttacactgctcagttctgagcctgaagttcagtatgttgctttgagaaatattaacttgattgtgcaaaagaaacctgacattttgaaacatgaaatgaaggttttcttcgtcaaatacaacgacccaatctacg

SEQ ID NO: 3027 - DNA, 348 bp, Meligethes aeneus
gagaagtaggtgcaacatcatctttggcacctaaaattggtccacttggtttgtctccaaaaaaaattggtgatgatattgccaaaggaactgctgattggaaaggtctcaaaatcaccgttcagctgaaaattcaaaatcgtcaagcagccatttccgtcgtgccttccgcagcatctcttatcataagagctcttaaagaaccaccacgtgataggaaaaagcaaaaaaatattaagcacagtggaaacattacattggatgatatcatttctatcgcaagacaaatgaaaccacgttccatggctaaacaattgtctggcacagttaaagaagttcttgggaccg

SEQ ID NO: 3028 - DNA, 718 bp, Meligethes aeneus
cgagcaaatggaagaagaactaactgcagaagccaccaaattaggtatatcaatagtattttcccatgagactgaaccgttaggtactgctggaccaattgctctagctaagaacattttgcagaaaagtgccaagcctttctttgtactaaactctgatattatctgcgattttccatttaaagaactggctgcttttcacaacagccatggtaaagagggtaccattgttgtgaccaaagttgaagagccctccaaatatggtgtagttgtatacgatgacggtaactgcattgaaagttttgtggagaaaccccaagaatttatttccaacaaaattaatgccggcttgtatattttgaatccaagtattttaaatagaattgaactccgtcccacttctatagagaaagaggttttccctggaatggcctctgataaggaattgtatgcctttgaattgcaaggattctggatggatgtaggccagcccaaggatttcctaactggtatgtgcttgtatctgaagcatttaagatcccagaactctgaaaaattgtacaagggaccaggtgttgttgggaacgtcctagttcacccttcagctaaaattggctcaaactgccaaattgggcctaatgtcactataggaccgggggtagtcattgaagatggtgtttgtgttaagaggtgcacaatcctaagagatgccaccata

SEQ ID NO: 3029 - DNA, 657 bp, Meligethes aeneus
tcaatgaggtgttcaacgatgtgcgaaagttgttgagtaacgatgatttgttaaaagacggggccggcggagctttctcgcagtacaacaaagatcaacttaccccagttaggatcgagaacgctgaccatttggttttaataaccgaatacaacgatctaggaggctgcagattcttcgatccaagatcaaaacagagcttcagatacgaccatttgcgcaaagaagcgtctgattaccaggcattcagtccggacagtgcggcggaaccttggcgcgccgcactagatgccgaatttatccattacacaagaaaccactacaaagatggagtatccagtgttgtttcaaggaaccagggaggtgttataacccttactgcctgcattgaagaccatcagtttcagcccaagaacttctggaatggcaggtggagatcgcaatggtctattttgatcaattcgggggctgccactgctgaagtcaggggcatacttaaagtccaggtgcattattatgaagaaggcaacgtccagctggtgagcacgaaggagatcaaggaatcgatttctgtaacgagtgaggcgcagacagccaaagagatcgtgcaattaattgagacagcagaaaacacttatcaaactgcgatttctgaga

SEQ ID NO: 3030 - DNA, 783 bp, Meligethes aeneus
atagtctccttaccgtccaaagatgaggatcaaaaaaggctgtacgacgattttggtctgaaatggatgctggacgatagcgacgtccccgatgtcggacgcgccatgttttaccgcgaattcggcaggacttcttccacctacaacaacaaaactttcgtacccgagtacaagtttaagcctgaagatatcataccggcgaatcggtccaagtttatcgaagatgcttaccaaatatgcttcacggacaacagagagtgcctctatgattattcggtgacgttgaatagagacgtggctcatttcacgagtaactacaaggcgactatattaaaaatgaaggagataagtcgggacaaaattatatcttgcggtgtcctggaaacgccccggttcggtagaaaaaatacttacctctttactccgggtacgaaggttacttatgaatgtaataccgactttattttggtgggagacccgagaagaacttgcttgccgaatggtagatgggacataccgaattacggatacactgagtgtttacgtcagcaggagtactcctctaggaacgcagctacgacttggggaataattctggcgattctcataccattaattttgttgttgctatacggggcgtggagagtttaccaaaactacatcgacaccgacgatactacgtggaagtacgaccctgcgtctcgtagggcctctagcgtgcaaaaactgaacactaaggcgcctgtggaagaatcggaggagtacgaaaccgattatgacgat

SEQ ID NO: 3031 - DNA, 778 bp, Meligethes aeneus
cgaagacaacctcgaaaaagtgaaaaacgcttcgagcaacaccgaactaatcgacaacatcaaaaacttcggccaaaacgtgaacgacctaatgaaccaagctgccaaacgtcaacaggaactgaaagacccgcagctgcgcgacgatttagccgccgcaagggcagtgctcaaaaaacattccaccatgctgctgacagcttcgaaggtgtacgtgcggcacccggagctggcggccgcaaaagccaacagggactacgtgctcaagcaagtgtgcgaagctgtcaacacgatcaacgacgtttgccaaggacggccgcagcagcccacgtcggggccctacgacgggcccggcgagctcgcagctgcgctcgacgacttcgacgatcacactgttatggagccgctggcctacaacgaggtccacacgagaccttctttggaagaaagactggaaagtattatcagcggggccgccttgatggcggattccagctgcaccagagatgagaggcgtgaaaaaattgtggccgagtgtaacgcggtccgtcaggctctgcaggatcttctttcggagtacatgtctaatatgggaaacaatgagaagagtgaaggtttaggcagagccattgaaaatatgggaagaaaaaccagggatttaagaaggcagctgagaaaggcagttgttgatcatatttctgacagctttttagagacgaacgctccgcttttgatcttgataaaagccgcgcagaacggcaacgaaaaagaggttgaa

SEQ ID NO: 3032 - DNA, 702 bp, Meligethes aeneus
ctagttttggggctacaactgccacatcaacaacaggtactagtgaggctccgccggcttttgatataggtgccagtacagctacattgtctacaactttcacaccaattgtagggagttcggctccaagtacagttggtttgttgtttactgggtctgcacagagcactacatcccctaagttttccagtttggctacaacaacttcagcagcacctagcctaacactagggggcactacatccactgcaggaactgctgtttccatatcagctgcagctgcaactagtgccccagcaggatctctcacatttggccagctggaagattctattaacaaatggacaattgatttagaagaacaaggtaaatttttcatcaatcaagctaaacaattaaatgcttgggattccctattgatttcaaatggtgagaaaattttgaatttaaatggaagcattgaaagagttaaacagcaacaaactcagctgaatcaagagttggattttgttttggcacaacaaaaagagttggaagagttaattgctcccttggaaaaggatttaatggatatacctgttacagatattgaccgcaatcaaatgtaccaaatgtcagaaatgatagattcacagctaaaacaaatgtcagatgacttaaaagaaatcatagaacatataaatgagtcccacaaagatgaag

SEQ ID NO: 3033 - DNA, 433 bp, Meligethes aeneus
atctggcaagctactctttctggggctcgacaatgctggcaaaactacgctgttgcacatgctcaaggacgatagactagcacagcatcttcctacattacatcccacttctgaggaactgtcaataggaaatatgaggtttacaacttttgatttgggcggtcactcgcaagccaggagggtatggaaggattattttccagcggtggacgctattgtgttcttgattgacgccaacgacagatcgagattcgtcgagagcaaacaagaacttgactcgctacttacagacgaaaccttgtccaactgccccgtgctgatcctcggcaacaaaatcgatttgcccggtgcggcgtccgaagacgagctcagaaatttctacgccttgtttggacaaaccacaggaaaaggtaaagtagccaggtcagatttg

SEQ ID NO: 3034 - DNA, 350 bp, Meligethes aeneus
acacacaaacatggatcctttggatatcctagaaaaacgtattacagctctggaactgcaagtattaccgaaaaatggcgaaattaatagcgcccaagctattacagaactattactacaaacccacaacatgttaacatcagccttgagctgcagagaggctatatcatccatattacaacacttatcgacaattaacaactacctggacccaaacaacggagaaacagaacttgaaactgaagccaagcgacaatatctactcgaatgctaccctgagataaaagaaacagtgcaagctatagccacaataggaagtctaacctcattcactgactcagcgaatatca

SEQ ID NO: 3035 - DNA, 716 bp, Meligethes aeneus
agaaggggaatcgataaggacggtaatgtagccaactttgtcgagacagagcaattggtggattatcagggcgataaagctagttttgtgcaggttaggggttctataccgctgttttggcatcagaatcccgatttacgttacaaaccacccccaactttgttggaaatcgatccccaagaacacaatgccgcctgtcagaagcacttggaagctttggcggttttgtacggtaaacaggtcatggttgatttggttgaccaaaaaggatctgagggtagattggagaaggctttcaaagacaccatacacactttggcttacccttcggttaaatatgaaccatttgattttcacgctgagtgcaggaagatgcggtgggatagattgtccattttaattgataggttggctttggaccaggatgagatgggatattttctgttgttaagagatggttcgttgtccttacttcaggagggcatttttaggactaactgtatagattgcctggacagaaccaatgttgtccaaagcatgctggcacatagaaacctggaaatagtcctgaaaaaattaaatgtaatccagacaaatcaacggctggaagagcagtacactttcgagcatttattcaaaaacgtgtgggcagataatgcagacgttataagcactcaatattcgggcactggtgccctgaaaaccgattttacccg

SEQ ID NO: 3036 - DNA, 734 bp, Meligethes aeneus
tgactctcagataagagccattgagaaaacgtttgatgatactaaaattcccattgaaaagcattacagcaaaccaaatgtggtaccagttgaagttttaccgctatatccagatttcagtttgtggaaatatccttgtgcacaggttatttttgattctgatccagctcctgtaggcaaacaggttccagctcaaattgaagaaatgtctcaagctatgattcgtggtgtcatggatgaaagtggtgaacaatttgttgcctacttccttccaactgaagataccctagagaaacgtagacaagatttcatcaacaatgttgcatatcaagatgatgaagagtatgagtacaaaatggccagggagtacaactggaatgtcaagagtaaggctagcaagggctatgaggagaactacttctttgtggtgcgtcaggatggtatttactacaatgagttggagacaagggttaggttaagtaaaagaagacaaaaggttggtcaacctgcaagcaataccagactaattgtgaaacacagaaccatggatggcaacgaatttagaatgcagagatacagggaaagacaactagaaccacctggtgaggatgaagaagaattcgagccggaaccagaagaaatacaacagcaagatgaagaaagtcaagcgggatccgaccaagagaaagaagatgacaaagaggaaaaaggaagcagtgatggggaaagatcaa

SEQ ID NO: 3037 - DNA, 708 bp, Meligethes aeneus
gggaggcttatttgaggaaagccgagtattacagtcgtattggtgataaagacaactgtgtgagcacatttagacagacctatgacaaaactgtttcactgggtcatcgtttggacattatctttcatttaattcgtattgggttgttttttatggatcacgatattattgtgcgcaacatcgataaggctaaaaccttaatcgaagaagggggcgattgggataggcgtaatcgtttaaaagtgtaccagggggcttactgcatggctgtgagggacttcaaaacggccgccactttatttttggacactgtaagcactttcacctcgtacgagttgatggattacaagcaatttgtgaggtataccgtgtacacttcgataatcagtttgcccaggaatcagctgagagataaggttgtgaagggttctgagattttggaggttttgcattctgagccttttgtgaaggattatttgttttccctgtataattgtcaatatgctgagtttttcactaatttggctgaagtcgaaagcgttctacgtaaagactacttcctaaaccctcactaccgctattacgtgagggaaatgcgaattttagcttacacacaacttctagaatcgtacagatctctaacattgcaatacatggccgaagccttcggagtttccaagcaatttatcgaccaggaattatcgactt

SEQ ID NO: 3038 - DNA, 514 bp, Meligethes aeneus
ggaggcaattcccaatatgaatagtaaagatgttgaagacatcttcaagggcgttttgactgacgaatctcaagagtcccaagagagcaacctatttccaatacaatcgaatccagttttcccgccgactccagcgcctcaaaatccaatgcctaatccgatttctatgttgaaccctgtcgttcggccgaccactttgccgaacgtaaatcaaagtgcgctgaactcgcctcacagctttcctccacaatcgccgtatcattctgaatatagcaacagtccgcagtttagtcctgcgttctctgaaccaccacccagtccatgggttggaagcgataactcggaaatggactcttcatccggacagtcgacttacaatcagcgttcttcggaaaagatgaaggcggacgaaagtttgtgtgataaggcgacaatttctgcagttctttacgcgaatgttaaacatcctgaatggaaatctgaatatcccatttggactgatagatacaagcag

SEQ ID NO: 3039 - DNA, 745 bp, Meligethes aeneus
agttcgagataaactgctcgaacccgggcgacatgggcgctgcgcagagccccaagcccattccgccgccccctctggcggtcgccgccgtcaacatgcgctgcgccatcaaccccaagaccctgcagaacgagatcgtcatgatttcctgcctcacgcacaccagatacgccctggacaagcagcctcccaagccgccttttgaacaccatttttgcgtgttgacttgtccgaaaagttccatgatgcctctggactttcacaagcaactgggcaactacaaggccaccaaagtccaaaaaatggactcggaaaaggccctattaaactacttcatcaaccaattcagccgcatagaccccgacttggtcgtgggtcacgatttgcagggctaccaaatcaacgtgctcttcgacagattgaaagcgaacggcaacgccgcggccgacaaaatcggcagaatgcgccgggccgacaagttgaagaacgagcgcgttctttttgtcggtagattagtttgcgacttaaaaagatcggctaaagagttgatcaaatcgcggtcgtacgacttggacgccctctgctcggcggtgttaagagttaaggagggtttaagggtggagttggagcccgaggatgtgcccaagatgtaccaaacctcggagaatatcctcaagttggtatctttcacgatgcaggatacttcgtatatacttcaaattatgtacgacttgaacgtcatacc

SEQ ID NO: 3040 - DNA, 630 bp, Meligethes aeneus
aagtagttcataccgtgacgttgcacgaaatcgacgtcatcaactccagaacgcacggatttttggctttattctccggggacaccggagaaatcaaatctgaggttagggagcaaatcaacggaaaagtggccgaatggcgcgaagaaggcaaggccgaaattataccgggtgttctatttatagacgaggtccacatgttggacatcgagtgtttttcgtttttaaatagggcgttggagaacgatatgtcccccattgttatcatggctaccaacagaggaataaccaagataagaggtactaattatacttcccctcatggtataccgctggatttgttggatagaatgattattgttcccacttctccatacaatgagaaggagatcagggagattttgagcatccgttgcgaagaagaagactgtcagatgtcggagaacgcgctgggcgtgctgacgcgcatagccaaagaaacatctttgcggtacggcatgcaactgatcatgacgtccagcctgatatcgcgcaagcgcaaggcgcaagaaatcgacgtcgaagacatcaaacgggcctaccaactgttcagcgacgattccaggtcggtgcagttcctgagggagtacc

SEQ ID NO: 3041 - DNA, 749 bp, Meligethes aeneus
actaagagccacagaagttgaggatataattgagggaaatgatgataagtataaagctgtctcggtgcacaccagcgatccgccgctggtaagggagggcaaaacaaaaaaaaacatgcagtgggtgccatcgttgcccaattccagccatctggatgcggtaccgcaagcaacacccattaaccgcaaccgcgtggctgcaaaaaaagtacgaacttttccgctttgtttcgacgacactgaccctgaaattaacgctgaaaacgcttgtcagggggagctactggtgccgattaggttggacatggaaatcgagggtcaaaaattgcgcgacactttcacgtggaataaaaacgagagtctgatatccccagagcagtttgctgaagtattatgtgatgacttagatttgaatcctcttactttcgttcctgccatagcccaggctattagacagcaactggaggctttcccccccgaaccccctgccattatggaggagtcttgcgatcagagggttataataaagctgaacatccacgtgggtaatacttctttggtagaccaaatcgaatgggacatgagcgagaaaaaaaacaaccccgaggagtttgctttgaagttgtgcgccgaattggggttggggggggagtttgtcaccgcgattgcttattctgttcgcggtcaaatatcatggcacgccagaacctacgctttttccgaggccccattaccaacagtggaggttc

SEQ ID NO: 3042 - DNA, 499 bp, Meligethes aeneus
aattggtgattgttggtgacggggcatgtggaaaaacgtgccttttgattgtgtttagcaaggaccagtttcctgaggtgtacgtgccgaccgtgttcgaaaattatgttgcggacatcgaagtggacggcaagcaggtcgagttggcgttgtgggatacggccggacaggaggactacgaccgtttgaggcccctttcctacccggacactgacgtcatccttatgtgcttttccgtcgattctcccgactccttagagaacataccggaaaaatggacaccggaagttaagcacttctgcccaaatgtgccaataatcttggtaggcaacaagaaagatctgcgcagcgatccgtcaaccattaacgagttaaaaaagatgaaacaggaacctgtaaaaccacaggacggccgctccatggccgaaaaaattaacgcgttcgcttacttggagtgttcggccaaaagcaaggagggcgtccgagaagttttcgagaa

SEQ ID NO: 3043 - DNA, 753 bp, Meligethes aeneus
ggttaacagtggacagtgatatttatgtttggacctatgaagaaaactctgatttagcttatttcgatgggatcaacgaaaccattttgtgtgtgggattagtaaaacccaaaccaggagtttttcataatttcataaaatatttgttggttcttacgacgtcagtggatattgttgtgttgggagttacttttactgaaggggctgagggggataatgatgagatacagcttatacctgatcctgtgttcacaatttcaacagatggcgccacaatatccaccatttctggcactgactctggaagattgtttttgggttccaaggaagggaatctatttgaaatctcctaccaggctgaaagtggttggtttggaaaaagatgcaaaaaagtcaacttatcgaccagttctctttcatttctggtaccttcatttttaaatgcagcccttagcgaggaggatggcatcgctcaaattgcaatcgataacaccagaaatatactttacattttaactgaaaaaggatccattgaagtttgcgacttgggagaaaaaggaaatacgttttctagagttaccaagttatcgcaggctcaacttgtatctcaagccatgaccactgtcaaaacgttggacagccaaaatttccgccccatcgtgagcatatccgccgtggaggcatgcgactcggccaacgttaacctggtggccgtttctcaaactggcgtgcgattttacatgtccgtggtga

SEQ ID NO: 3044 - DNA, 662 bp, Meligethes aeneus
ggtgctggcaaaagttttattcgtgctgtgtccaatatcacgtggccggactaaaaccgctaggtctgctactacttcctgctgtttcgggagctgttttcctgaaaaaatccactttttcgttcttgcggcctttagaacctttggagcacatgaccttgtgtggcgattacatgtacaaagaccaattcgtggaatatccactattaggcgatgatttggacaacatgggcgacgttatgagcctatttcaggttatcgtttacttggaacagcaaatgagcgacattttcctgacaacgtttgaaaaagaaatggccactcttcaatcccccgatgttataatgtcaaagttactagaaaaaattcacacggaaatggacagtgagttcacaaatcaagtgtccggtatgttgggtcaatgttgcgacctctacaaggcggttcacaaagttctcgaacttctccgctatgaaaatctcaacacatgcgattctgatgttaatcctttcgcgcttcatcacttcagttctcacttgggggtgtcggttgtggccggttgcatacgtcagcaagctgtcacccggttctcgatttgccggaatttattgttgatttgcaacattcttttgtacagaaaagaattggaatggggcattttg

SEQ ID NO: 3045 - DNA, 750 bp, Meligethes aeneus
ttccaaggaatcctacaagctgacattcaagagtttattccctacgttttccaactactatctctgctcatggaaaacacgccccctggtgccgtgcctgaaacgtacatgcagctgttgccatgtttgctggctccagtgttgtgggaaagaccagcaaatatttcccccttggtgcggttattaagcgcttttgcaactcaggccgcgcctcaaattgtcgggcaagataaattgggtggatttttgggagtttttcagaagctgatagcttcaaaatccaatgatcatgaaggtttccatttgatgaggtgtataatacaaaatgttccaactgaagctttacaagcctacatgaaacaagtattctttctacttttccaaaggttatcatcaagcaaaaccacaaagtttgttataaatttaattgttttcttctgtttgtatgctgttaaatattcagcaaacgatttggtcgttactattgacggaattcaggcacagatgtttggtatggttctggaaaaaatccttatcccagatttgcaaaaagttgctggcaacgttgacagaaaaattgtcgcttgtggtatcacaaagttgctgtgtgagtgtccagaaatgtacacagggacgtatcaaaaattctggccccaattattacaggcattaatcgcattctttgaaatgccagtagatgaaacaagtctcccagacgatcatttcattgaaatcgatgacactccaaca

SEQ ID NO: 3046 - DNA, 474 bp, Meligethes aeneus
tgaacccttttcagttcgaaatcacgttcgagtgcattgaggaactgaaagaagatttggaatggaaaatgatttacgttggttcggcagaaagcgaggagtacgatcaagtcttagattccgtattcgtaggccccatacctgaaggaaaacacatgtttgtgtttcaagctgacccaccaaatgtatcaagaattcccgaaaacgatgctattggggttacagttgttctattaacttgttcctacagaagccaagagttcatacgagtgggatattttattaataacgaatatagcgacccagagttgaaagaaaattccccgagcccccctcagtttgataaagtgatgaggaacatattggcttctgagccgagggttacaaggtttaaaattaactgggaggagccgaatcagcaggaaaatggtcagggttcgggggaaaatcaggcacaaacatctagtgtcgagg

SEQ ID NO: 3047 - DNA, 652 bp, Meligethes aeneus
ggactaaccccaactttaggcctaggaatgggtatgtcgatgccaactcgatatgttccaggttatggcagcagtttgcagtctcaaacgccgcaacatacgatgatgtcgcctatgataaacttaggtggtaccagtggaggtccaggggccacacctagtagtaatatggggcctgcgacacctgcaacccctgctacacctcagaccccacattcccaggatccagggattgttccccagttacaaaacattgtttctacagtaaacctaaactgcaaactggacctgaaaaaaatcgcgctgcacgccagaaacgccgaatacaaccccaagcgtttcgcggccgtcataatgcgaatccgggaacctcgaacgacagccctgatcttctcctccggcaagatggtgtgcaccggggccaaaagtgaggaagactcgcggttggccgcgcgaaagtacgcgcgtatcatccaaaagttgggttttaacgccaagtttttggattttaaaatacagaacatggtgggcagttgtgacgttaagttccccataagactggagggtttggtgttgacgcacggctcttttagctcctacgagccggagttgttccccggattgatttaccgtatggtgaaacccaggattg

SEQ ID NO: 3048 - DNA, 332 bp, Meligethes aeneus
gttattccgacgaaatgagcttcactttggcctccggcaaccaggtgttctacgatgccaaatcagttaagcaagtcgacgtgccgtctttctccggcagttttggtattttacccaaacatgtacccactctggctgtattgaaaccaggagtagtttctgttatcgaagatagtggtaatgttaaaaaaatattcgtttccagtggtacagtcacaatcaacgaagattcgtccgtacaaattttggcggaagaagcccatcctgtggaaagtttggaccgttctgctgcccaggaggttttaagtaaagctcagagctctatgtcgtct

SEQ ID NO: 3049 - DNA, 672 bp, Meligethes aeneus
aaaataagcagggatgctcacgaggctgaacttaaactaaaaaaggaaaaagaggcagttaaaaaagctgcatctgccaaaaaacaagaagctgaagttgttaaaccagctgaaattaaggaattgactgatgctgaagctgaacagctgcaggctgagttaaacgctaaaaagggagggtctgaagctgcacctgctaaagctgaagaagggaaaggcaatgatgaagaagaggaggatgaagctgaaaaaggaaaattgaaaccaaatggtggaaatggttgtgatctggaaaaatataaatggacacagactctacaggatgttgaggttaggattccattaaacgtcaactttagggcgaaacaaaaagatctggtcgttaacctaacgaaaaaacatttaaccgtcggtgtcaaaggtcaacctcccatagtggacgatgattttccctacgaaatcaagctggaggagtccacatgggtgatagaagacggtaaaagtttgctaatcaatttagaaaagataaacaaaatgaactggtggaataaattggtcaagtctgatccggaaataagcacgaaaaaaatcaacccggaaccgtcgaaactgagtgatttggatggggaaacccgtggactggttgagaagatgatgtacgatcaaaggcaa

SEQ ID NO: 3050 - DNA, 317 bp, Meligethes aeneus
cgcgaaagatgggtatgtatttatccagcatacatcaacagtaaaaaaactttagctcaaggcagaagaatatcaaaagaaaaatgcgtcgaaaacccaacacatcaagaaataagagatgtgttgctggcagcaaacttgaaagttggagtggaaaataaaatttactcaagagaaagaagtaaggagcttttgtaccgtggtagaataagagtgcaattaaagaatgacgatggttctttattcaatccaagttttccctccagagagagtattatgcttcatttaggagacatgattcctaagctgaagacacg

SEQ ID NO: 3051 - DNA, 662 bp, Meligethes aeneus
aagcccaagactatgaaaggacaagacaagtatacaaagcttgtttagacttactacctcacaaagtattcacattttcaaaagtctggttattatatgcaaaattcgaaataagacaaaagaatttaaccactgctagaaaagtattggggatgtccattggcatgtgcccaagagataaactgtttagaggatacattgagttggaaattcagttgagagagtttgatagatgtagaagattgtatgagaagtttttggaatttggacctgaaaattgtgttacatggatgaaatttgctgaactagaaacattgttgggtgatgtggatagagctagagctatttatgagttagcaattaaccaacctaggttggatatgccagagctcttatggaaagcttatattgactttgaaatatcacaggaagaacctgatcatgccaggcgattgtatgagagattacttgaacgaacaaaccatgtgaaagtctggttatcttatgccaaatttgaattcaacaaccattcagaagatgagataaatataggtctagcaagaagggtgtttgaaagagccaatgaaacactaaaatcttgtgtagataaagaatccagagtgcttcttttagaaaactggaaggagtttgaaaacacccat

SEQ ID NO: 3052 - DNA, 619 bp, Meligethes aeneus
agccagaaagaaagatccaattcagagagaaagtactgtggactgcaatcaccctattcatctttttagtatgttgtcagatcccactttttggaattatgagttcagactcagccgatccattctactggattcgtgtgattctggcttcaaacagaggtacccttatggagttgggtatttcacccattgtaacatctggcctgataatgcaacttttggctggtgccaaaataattgaggtcggtgatacaccaaaagacagggctttgtttaatggagcacagaaattgtttggaatggtgatcacagtgggtcaagcaatcgtctacgtgatgaccggcatgtacggcgacccggccgaaatcggcgccggagtgtgtctcttgattatcatacaacttttcgtcgccggtcttatcgtgctcctcctcgacgagctcctccaaaaaggttacggtttggggtccggcatctctctcttcatcgccacgaacatctgcgaaaccataatctggaaagcgttctctcccgccacggtgaacaccggaagaggcactgagtttgaaggcgcggtcatcgctctattccacctcttgaccaccagacaagacaaaat

SEQ ID NO: 3053 - DNA, 337 bp, Meligethes aeneus
gaccgtttattaaggggtacaactactttatatattggtaatttatcgttctttacaacagaagagcaaatttatgagttgttttcgaaatgcggcgatattcggcgtgttataatggggctggacaaatacaaaaaaacgccctgtgggttctgttttgttgagtattataacagagctgatgctgaaaattgcctaagatacattaacggaacccgattggacgatagaatcgtgagaaccgattgggatgccggttttattgagggaaggcaatatggaagaggtaaaactggaggacaagttagagatgaatatagaactgatttcgatggcg

SEQ ID NO: 3054 - DNA, 651 bp, Meligethes aeneus
tgccctggatagatcagttaaagcttctgatttagaattgcatccaccaaaaaacccatggagtcatgatggaattcttagttcgcttgatcatgcaggtataagaagaggctacgaagtatacaaacaagtgtgcgctgcgtgccactccatgcgcttcatcgcctaccgtaacttgatcggcgtgtcgcacaccgaggccgaggccaaagccgaagccgaagaaatcatggtcacggacggacccgatgagcttggcaacatgttcaaacgcccaggaaaactttccgactacttcccgagcccctaccccaacgaagaggctgcgcgcgcagccaacaacggcgcctatccacccgatcttagctacattgttgatgcacgtcacggaggtgaagattatatctttgccctgttgactggatactgcgatcccccggccggcgcagttatcagagagggtcaatacttcaacccctacttcccgggtggcgccatttccatggctcaagcgctctacaatgaagccatggagtacaccgacggtactccagccactgccagtcaattggccaaggatgtgtccactttccttaaatggacatccgagccagactttgacgaccgcaagaggatgttcattaaagccgt

SEQ ID NO: 3055 - DNA, 752 bp, Meligethes aeneus
tgctagttttgggtatgcattggatccttcagtgagtggcgaaggagagaaacttaaggttgtgggtgctaaagaggttaatagcgagtcaacggaaataacaactgtgtttgagactaccaaagtgagacctttagataagcgaaagcgcaagaaaaacaccgacgcaggcgacatagaagggttccttggcccgtggggcggcttcatagacgagcaacgcatcatgaaaccgaccgaagaggaagccatcgagctcgaagaactcgtatcgaagaaaacgaaacgcggcaaagtcgtcgaagagaagccgatcgaggaaaaatcggtgttgcacatcaaggacgcgctggattaccagggccgctcgttcctgcacgcgccgcaagatgtcggggtcaacctgcgctcggactcgccgcccgagaagtgcttcctgcccaagtcgcacatacacacctggtccgggcactccaagggcatcgcggccctcagatggttccccaggacggcgcatctattcctatcggcttccatggattgcaggattaagttgtgggaggtgtacaacgaacgcagatgcatcagaacctactacggccatcggcaagcggtgagggacataaatttcaacaactccggtaagcacttcctctccgccggttacgacagatacatcaagttgtgggacaccgaaacgggacaagttttgtcccgcttcacggcccgcaaaattccctactgcgtgaaat

SEQ ID NO: 3056 - DNA, 231 bp, Meligethes aeneus
ccagcttgttgaggttagatctgtccccagagtccacctgcgtcagcgcgacggccgagcaagtcttacgtctcaccagcaatcccaagcgggctttgcctttcacgatgcagtacggtacccccatcttcctgcagagggcaggcaagaacaaaaccagctcaattgggtcgacatcgtgggcgatgaccaccaattgggcttttttctgctcaatcagctttgtgaccg

SEQ ID NO: 3057 - DNA, 735 bp, Meligethes aeneus
ggcgctagaattgatgagtattaacactaaaaatcaaaaagtgatagactttatagtaaaatgtcaggaccctgagtctggaggtatcagtgggtgcatcgatcacgacccccatatgctacacacgttaagtgcggtgcaaatcttggttacaatggatgaagtaaatgccatagacgtagagggggttgtaaagtacgttgtgagtaaccaacaggaagacgggagttttacaggggataaatggggggaagttgatacacggttttcttttaccgctgtggcaacactggctttattaaatcgtttggatgccattgatgttaaaaaagctgttgagtttgtacagtcgtgtatgaattttgatggcggttttggctccaggcctttatcggagagtcatgcaggacttatttattgctgtttggggtttttgtccattacaaatagtcttcatattgttgaacaagacactctggcatggtggttatgtgagaggcagctttcatcgggtgggctaaatggcagaccagaaaaactcccagacgtatgttactcttggtgggtgttatcatctctatcaatcttgggaagaatacactggataaatcactctgcaatccaaaattacataaaagcatgtcaagatgttgaaactgggggcttttccgacagacctggaaatgtcactgatccttatcacacattatttggcctggcagggttaggtttatt

SEQ ID NO: 3058 - DNA, 717 bp, Meligethes aeneus
tgggggaaatagtcatgttgcccgaatggctgccggtttgcagctcaaaaaccaacttacatcaaaagatgccaccaacaaggttgtctatcagcagcgctggcttgctttccccgaagaagtgaggagttacatcaaaaagaatgtggtgggtgccctcggaaccgaaacaaatcgtccatcttcggcggcgcagtgcgtcgcgtacatcgccgtcgcggaacttccgcagaaacaatggccggatttaattcaaacgttggtcaacaacgtgtgccatgcaaattctaccgaaatgcagaaagaggccaccctcgaggccatcggctacatctgccaggaaatcgattcggacgtgctcgtgacgcaagcgaacgatattctcaccgctattatacacggtatgcgggtatccgagcagagtaaccacgtcagattggccgccacgcaggctctattaaattcgttggagttcacgaaaggcaactttgatcaacccactgaaagaaatttcattatggaggttgtgtgcgaagccacgcaatcgcccgattcgcagatcaaagttgccgccttgcagtgtctcgtcaagattatgtctctctactaccagtatatggagccttacatggcgcaggctctttttcccatcactctagaagcaatgaaatcggagaatgatgccgtttcgttgcaaggtatcgaattctggtcgaa

SEQ ID NO: 3059 - DNA, 764 bp, Meligethes aeneus
gatggacttggacaaagacttacaagaagaagccgacagtattataaatatttgggagagcggtactgttccaggatggccaaaagagactggttcagcattggcaaatgttggtgcacatttggatctttcagcattttcaagttgggaggaattggcttctttgggtctggatcgtttgaagtcggctttattggctttagggttaaaatgtggaggaaccttggaggagagggcacaaagattgttttcaacaaagggaaaaggttctttggatccatcattgatgactaaaaataataagggaaaagccaataaggaaaaagaacaactgagacatagggaccttgctatgttggaagctcagatttatagactggccgatttagtgtccactcaaaggggagcaacaaaagaaaatgttcaaaggaaacaagccagaactgacggagaaagaaacgacagtgaaaatgaggaaagtgaagaggatagtcccgatgaaggtgacgatgatgtcccatataaccccaaaaatttgccattggggtgggatggaaaacctattccttattggctgtataaattgcatggtttaaatatcagctacaactgcgaaatttgtggtaattttgtttataagggtcctaaagcttttcaacggcatttcgcggaatggagacatgctcatggtatgaggtgtcttggtattccaaacacggctcattttgccaatgttacgcaaattgaggatgctattgctttgt

SEQ ID NO: 3060 - DNA, 499 bp, Meligethes aeneus
gtcactctgcaagactcgcgaacgttcataggaactttcaaagcgttcgacaagcacatgaacatgattctcggcgattgcgaggagttccgcaagataaaagcgaaaaactccaaagtggagcgggaggaaaaaagagttttaggttttgttttgctgagaggggaaagtatcgtctctctgacagtggaaggccccccacccccggaagaaggcctcccgcgcgtccccatacctggagcagccccagggcccggaattggcaaagcagccggccgtggtatgccagcgggcatggctggagtcccggtggggctccagggacccgtgaggggcgttggaggtccctctcagcaggtgatgacgcctggaggcagggggcaggtggcggcacctccacaaatgaatcagggacctccgagaatggggggaccacctccaggcatgatggggccccctcctggtatgatgggtatgcccccaaatatggggatggggc

SEQ ID NO: 3061 - DNA, 724 bp, Meligethes aeneus
acatgctctgctatttggaaagctttaagtgaagaatatttaccatatcccacagaacaaagttggaaaaaaattgctgttgattttgaatcaaagtggaattttcccaattgtgtgggtgcaattgatggaaaacatgtgagaatacaagcacctcaacattctggttcagatttttttaattataaagaattctttagcatgatattgctagcagtttgtgatgcaaattatcgatttactgtggttgacattggtgcaaaagggagacaaagtgatggaggagtttttcgcaacagtacttttggaaaacaatttttctcaaactccattaatttacctgctccaagaaaacttgcagatgatgaagaaccaactccatactgttttgtaggtgatgcagcatttccctttggagttaatttaatgcgaccataccctggaaactttcttccacagaatgaaagaattttcaattatagattaagtcgtgcaagaagaacaattgaaaatacatttggcattcttgttgccagatggagaatattagaaaaaccaattattgcaaagcttgaaactattgaaaaaatgataagtgcacttgtatgtctgcataactttttgaggaaatcagactcagataaggttgacagcaacaggtactgtccttctaattttgtggatagagaaacagaaacaggtgaacttatcgagggagaatgga

SEQ ID NO: 3062 - DNA, 707 bp, Meligethes aeneus
agtccagctttttctcagagcgtcggacagccgcccagcagtcctatgagaagttcgcctatgccaagaagcccaatggtaaaccaaatccaatcaccgatgagtatgcgtagtccagcaatgccggaaagaccaactagcgtggagaatcctggaacaccaagaaccccttataacccccaaaacgtggagaacatgcaggaaaataacgtctccaacaccactacagatggtggcggcggtaacccgcgcaaccccgtaaatccaataccgtttccctttggaaggtttgggtcatttaagttgggtttgaggggtggatctccaatgtggggtggctttggccggggggctaaaagagtcccaacgccacctgtgacttctaccggcgtgggtgcttgcgtatctaaaccgattgctgcaacgaatgcgttggtagattcggcaacttcccaggtgccgcctaaaccaaagaaagaatcccattatagcaaagtatcgattcttaagaaaaaatctgcacccacaataaccaacaggcaatcttttgtggccaataaagtgagctcacttgttagttcagattataacgaattcgatgacagttcgtctactccaccagtaactcctccaccttcatcttcgaccagcaggaatgtcgttcagaaaacgatacataaaaaaattgccgaagaaaccaaagaaaa

SEQ ID NO: 3063 - DNA, 748 bp, Ceutorhynchus assimilis
aggttgagaagccacataagaattcaggatggtagagccaagcctattgatctactagcaaagtatatcagtgcagaagaagaagtagatgctgtagaaatgcacgaaccttacacttatcttaatggactgcaaataaaagatttagaagatcttgtagaagatatcaaagtatataaagagttagagaggggcaagaatttagactactggaacgatattactgtaattgtagaagatgagcttcaaaaattaagaaaactgcaaagagaacaagattttgatgctggaattggtagacgcgaaggcataaatcaagcagtagcccaagacgttacagcagtattcaaaggcaaaacagccatacaacttgaggatcttcaaaagcaaattgaaagcaaaatcagtggcaaatctgatggtattgacataggctattgggagtcgcttttgtctcaattgaaagctcacatggctagagccagacttagagacagacatcaacttagtttgaagagaaaacttcaagtattaaaagctgaacaagctgtaactgtgcctgaaataaatgctgaaaatagtaatcagtcttcacaaagtccacaagaatccaaaccaggaacttcacaagaatcagcagacaatgaaagtcaaagcgatgaggaaggtgaaaataatgaagaagcagccagtgatatactcaatgaatgctttgttgcttaccaaaatggcaactacagtcctaaac

SEQ ID NO: 3064 - DNA, 655 bp, Ceutorhynchus assimilis
tcgtctatgatcgtgaaaccgggaaaccaaaaggttatggattctgtgaataccgtgaccaagaaaccgccctgagcgcaatgagaaatctaaatagctacgaaatcggaggtcgtaacttgcgagtggacaatgcttgtactgaaaaatctcgaatggaaatgcaaaatttactcaaccaaccacccatagagaatccctatggagaaccggttcaatcagaaaaagctcctgaggctatcagtaaagcagttgcctctttgccaccagaacaaatgtttgaattgatgaagcaaatgaaagaaactattcaaaacaatcccactgaagctagacaaatgttattgcaaaatccacaatttgcttatgctttgcttcaagcacaagtagttatgaaaatcatcgatggttatacagctgcatcacttcttcatcctgtaaatcaagttccagcaacgcttatgcctggagacaaaaacgttcctgttcaagtgcctataaatagagagtttcaagctgctccagctccagttgctccacccaggcaagagtttcaacctgttccagctccaattattattccaaacaccaatcatagtgcaccagtgtttactagtatgaatgatgttgatttcagagctatggatccaagagt

SEQ ID NO: 3065 - DNA, 668 bp, Ceutorhynchus assimilis
gtctttctgagcaaattcgggaattacgtgaagtaattgaattgcctctaatgaatcctgaattgtttatgagagtaggcattaccccacctaaaggttgtcttttatatgggcctcctggtactggtaagactttactagctagagctgtcgcctctcagttggatgcaaactttttaaaagtagtctccagcgctattgttgacaagtacattggagagtcggcaagattaatcagagaaatgttcaattatgccaaagaccatcagccttgtataattttcatggacgaaatcgatgctattggtggacgaagattttcagaaggtacttctgctgatcgtgaaattcagcgtaccctaatggaactgctaaaccaaatggatggattcgactctctgggacaagttaaaatgattatggcaactaaccgtcccgatactttagatccagctctattgaggcctggtcgtttggacaggaaaattgaaattcctttgcccaacgaacaagccaggcttgaaattttaaaaatccatgcagggcccattgctaagcatggagagattgattatgaggcaattgtaaagctttcagataattttaatggggctgatttgaggaacgtttgcactgaagctggtctctttgctatcagatctgaacgg

SEQ ID NO: 3066 - DNA, 653 bp, Ceutorhynchus assimilis
taccaggtcgaatacgctatggaagccatttccttggccggtacctgcttgggaatattagccaacgatggcattttattggctgcagaaaggcgtaataccaataagcttttggatgaagttttcacttcagagaagatttataagctaaacgaagatatggtctgtagtgtagctggtataacttcagacgccaatgtcttaaccaatgagctgcgcctcattggccaaagatatctgttccaatacggacagtcaatcccttgtgaacaattagtttcttggctgtgcgacgtcaaacaagcttacacccaatatggtggcaagaggccttttggagtatcaattttgtacatgggctgggacaaacattatggctaccaattgtaccaatctgaccctagtggcaactacagcggttggaaggccacttgcattggcaacaatagttctgcagcaatttccagtctcaagcaggaatacaaagaaggcggcatgacattaaaagatgccaaaactttggccatcaaagttttgagtaaaactttggacatgaccaagctgacatcggagaaagttgaaatggccactttgaccaggagcaacgataaaacagtcactagtattctgactggcaaagaagttgaagcatt

SEQ ID NO: 3067 - DNA, 668 bp, Ceutorhynchus assimilis
aaccaaaaacccctgaagatgtttacaaatctcatttggaaaataccagaccttcttttggaggtagtcaagtagattccgcaaaacaaaatcttgctgctagttttgtcaatggtttcgtaaatgctgcttttggccaagacaaacttctcatggaagatggtaataagtggctctacaaaaacaaagatcatggcatgttgagtgcaacagcttcacttggattagtacttttatgggatgttgatgggggtttgactccaattgacaagtacttatactcttcagaagatcatattaaatctggagcacttctagcatgtggtatagtcaactgtggtgtcagaaatgaatgtgaccctgctcttgccttattaagtgactatgttatgcatagcgctccgatcataagaattggtgcaatattaggtctgggattagcgtatgtgggctctaacagggaagcagtactcggcctactgtacccagtattttccgataaaagttctaatatggaagttattggaatggctgctttggcttgtggaatgatttcagttggttctgaaaattcccaagtaactacgatcctcatgcagacattgatggacagatctgaagatgacttgaaggatacttatgctagatttatacctttgggagttggc

SEQ ID NO: 3068 - DNA, 730 bp, Ceutorhynchus assimilis
aaactgcacagtactcgaataacggacagtatccaccggatggttctcagtatttgcagcaacatcagtacagtaccatgcagtatcagttggaacggaatagcggggaaagtcctccgattttgaataataatgtgttagtgaggaataatgatcccactttggcgtcttccagatatcatcaggatctccggttttcagcaagcaactacgaacaacaattaaaccaaatcaccctgacagcaccccaaacgggccaaacgtaccaaatcagtccagcgagcgctggatcagattcctggtcgacgtccagtaccgccacaacgcagtaccagcaaacctatcaaggtgctgccaacgtgagcgtccaccaagctgacagcagtacagctcatcagtactacttgaacagcaactggccagcgggcgctttggaggatggaggcaacaacgtttcggcgcagaggtcgccgtcctcagaggctaacaatagaaggaatggggtggcatgtgccaactgtaaaactttgaacaccactctatggagaaggaacaaccaaggagaacctgtttgcaatgcttgcgggctttatttcaaattgcatggggtaaatcggccaataagtatgaaaaaagaaggaatccagactaggaagagacgaccgaaaaacaattcttctgttcataatggagctggagtttctggcatgcctcaacgattaagcaacac

SEQ ID NO: 3069 - DNA, 698 bp, Ceutorhynchus assimilis
caccacaacagattggactataattttcactttattagagtgcgtaggggcaggcgctcagcctccaaaacctgtagcagacgatggcagcacttgcgcagaccaatcaaagtcagatggcgaaaatcaaataaacagcgacgaagaaagtgtagtatcagacagaggctacacctcagattctgaactaacaaaaaaacaaaaagcaattctggcaacttctccctgtggcactccaaacacaggaggctggattttggtgggcaacgaaggcgaaattgttggtcgaacagtgcctccgacacaatacggcattgctttggaaagaaatttaggcccacacgattcaatgagtttgataaaatgctgcgaaagcttggcatttttagttagagacgtggcccacataacaccgtacaatttcgacatttgcgtacaatgtataaggacttttgttgaggcaagcctacaaactgacaacaaaaaacgcaaaagaaaagtcgcctctcgtaggaaatccgaattaagaagtcctgcggctagtagtccaagctgtagtgaagatgacgattttcctagtggttatcatcacttgcttttagacttgatgcatacgttgcacacgaggactgcccaaattttcaaatggtgggcggaggaaggcggcgaaatcgctcaagaaatgtcactgtggactc

SEQ ID NO: 3070 - DNA, 468 bp, Ceutorhynchus assimilis
gaagattcggtatccaagctcaaaccctagcaacaaatttcgaaaaagtcttcgaaatggggccccatctctacgtcggtctgcccggcttagccaccgatacccaaacagtcagagaaaaactgcggttcagaaaaaacttgtacgaactcaaagaaaacaggctgatgtcgcccaaagtattcagcgctatgctgtctcatatgctgtacgaaaaacgctttgggccgttctttgtagaacctgtagtagctggtttagacccgaaaacctacgagccatttatttgcaatatggatcttattggttgcatcaatcagcctaaagattttgttgtaggaggtaccgcttctgcacaattgtacggtatgtgcgaggctttgtgggaacccaatctagggcctgaggatttattcgagactatttcgcaagctttgattaatgcttttgatagggatgctgtttctg

SEQ ID NO: 3071 - DNA, 676 bp, Ceutorhynchus assimilis
gcaaacctgtagtactggaaatatggcccattttattgaaagctacagataagtaccaaaaggatactagaaccatggaaaggtgttgtaggagtattaggtttatgcttagatgtgctagtcaacaagtatgtgaaatattggaaagtttagttagacaaataataaggctttataacgagcacaaacattcttgcctgctctatgttggcagtattctagtggacgaatatgctccaaattcccaatgtgtgaacgggcttttagatatgttacaggtatttattgaacccacatttcacatgttgcaacaagaagacggtcttcgaaatcatccggatactgttgatgactttttcagattgtgtgctcgtttcatccaacgagctccagttccactactccgttgcaacgtcttggttcccataatccagtgtgcaatgttagctgcctcgttggaccataaagaggccaacatgtccgtaatgaagttttttaacgacctcattaaccaaggtttgactggacattctttgcccgattttgccgagagacaccagctggtcaaagcgattttggaccaattaggacagcaattggttaacgctttagtgcaggcttgcgtgttttatttgcacacttatatgctaagcgaagttggagatgtttttgtgca

SEQ ID NO: 3072 - DNA, 662 bp, Ceutorhynchus assimilis
ccatttagttgaatggcaccgaacacttacaacacaagaaacagatggtttccaggtcaagaggccaggtgataaaaatgtccgatgtacgatacttctgcttttggattaccagcctttgcagtttaaactcgatcctaggcttgccaggctacttggagtacatacgcaaacccggccagttattatttctgctttgtggcagtatatcaaaacccacaagttgcaggatactcacgagcgggaatatatcatttgcgacaaatatttggaacagatttttaattgttccaaaatgaaattcgctgaaattccacaaagattaaatcctttattacatccaccggatccaattgtaataaatcacgtaatttcagtggagggaggagccgaaagtaagcaaactgcttgttatgatattgatgtggaagttgatgatacattaaaaacgcaaatgaataatttcttgttgagcactgcgagtcagcaagaaattcaaggattagattcgaaaattcatgaaactgttgacacaatcaatcagttgaaaacaaatagagaattcttcttgagttttgctaaggatccgcaacaatttattcataagtggatcgtttcgcaaactagagacctaaaaactatgacggatgttgttggaaatc

SEQ ID NO: 3073 - DNA, 749 bp, Ceutorhynchus assimilis
gtttgggctcataatctggaagatgaattccgaactattagacagattgtccagaagtaccattacgtggctatggacactgagtttcctggtgtagtggctcgtcccataggagaatttcgtagttcagctgattatcagtaccaaatgttgcgttgtaacgttgacttattacgcatcattcagttgggactgacattcttggacgataatggaaaaacgcctgggggcagttatactacatggcaattcaatttcaagttcaacttgcaggaagatatgtatgcccaagacagtatcgacctgctcacaaattccggtatacagttcaagaagcatgaagatgatggtattcaacctttggaatttgcagaactccttatgtcatctggcattgtactaatggacaatattaaatggctgagctttcactctggatatgatttcggatacctgatcaaactcctaacagatagtaacctaccccctgacgagaatgactttttcgatttgctgaaactgtattttcccgcgatttatgatgttaaatacctaatgaaatcatgcaaaacacttaaaggtggccttcaagaagtggcggaacaattagaactagaaagagtgggaccccaacatcaggctggttcagactcgcttttaactggaatggcctttttcaaaatgaaagaaatgttctttgaagatactattgacgactcaaaattttctggacatctatatggcttggg

SEQ ID NO: 3074 - DNA, 800 bp, Ceutorhynchus assimilis
ttctccatttcgattctgcagtctatagatttaaccatgcgggaaacgcaagtactttgcctgtcgcccacaagagaattggctgtacaaattcaaaaagtcattctggctctcggcgattttatgaacgtgcagtgccatgcttgtatcggtggtactaatcttggtgaagatatcaggaaattggattatggacaacatgttgttagtgggactccaggaagagtctatgatatgattcgtagaagagctttacgtacaagaggggtaaaaatgttagtccttgacgaagcagatgaaatgttgaataaaggcttcaaagaacaaatttacgatgtgtaccgatttttaccaccatccacacaagttgtacttatttctgctaccctacctcacgaaattctggaaatcacatcaaaattcatgacagatccaattcgtattttagtaaaacgtgatgaattgacattggaaggaatcaaacaattctttgtggctgtagaaagagaagaatggaaatttgacacattgtgtgacttgtatgatactttgactataacacaagctgttattttttgcaataccaaaaggaaggtcgattggctgactgaaaaaatgagggaaaacaattttactgttagtgctatgcacggtgacatgcctcaaaaagagagagataatattatgaaggagtttagatcaggacagagtcgtgttttgattactactgatgtatgggcaagaggtattgatgtacagcaagtcagtttggtaatcaactacgatttgccaaacaatcg

SEQ ID NO: 3075 - DNA, 766 bp, Ceutorhynchus assimilis
ggtaccacctcagtagtagtcattgccggagctctcctagatgccgctgaaagattactgaaccgtggcattcatcccacagcgatttctgaatctttccagcgagcagccgtgcatgctttgcagattttaaacaacattgccaccccagtggaactaaacaaccgagaacaactaatcaaaactgcagcaacttccttaaattcaaaagtagtctctcaacaatctagccagcttgctccattagctgtagatgctgtactaagaattgttgaaccaggtcgtgaagctgcctgtaatctcagtgacataaaagtcctcaaacaacttggcggtacagtggaagacaccgaacttatcaacggtttagtgtttccgcaaaagttggccaacgtttctggtccaaaaaggatggaaaaggccaaaattggtcttatccaattttgtatttcacctcctaaaaccgatatggaccataacattgttgtttcggattattccgccatggatagagttctgaaggaggaacgtgcttacattttgaatattgttaagcaaattaaaaaggctggatgtaatgttttattggtccaaaaatccatcctcagagatgcagtctctgacttggccatccactttttggacaaaatcaagtgcatggtcatcaaggacattgaaagggaagacattgaattcgtttgcaaaaccttgagttgccgtcccattgcttctcttgatcattttgtcgccgaaaatttagtatccg

SEQ ID NO: 3076 - DNA, 653 bp, Ceutorhynchus assimilis
ggtcatcggccaatttttagaggctgtagaccaaaacactggcatagtgggatccactacaggctcaaactattacgtcagaattctatcgactattgacagggaattgctgaaacccagcgccagcgtggctctgcataaacacagcaatgcgctggtcgacgtcttaccacctgaagctgattcttccataagcatgcttcaagccgacgaaaaacccgatgtcagctacggtgatatcggtggcatggacatgcagaaacaagaaatcagagaagctgtagaactgcctttgacgcactttgaactttacaagcagattggaattgatcctccaagaggtgttttgatgtacgggccacctggatgtggaaagactatgttggctaaagctgtagctcatcatacaactgctgcttttatcagagtagtaggatctgaattcgtccaaaaatacttgggagaaggacctagaatggtcagagacgtatttaggttagctaaggaaaactctccagcaattatattcattgacgaaatcgacgctatcgctacaaaacgtttcgatgctcaaaccggtgctgatcgtgaagtacagagaatcctgctggaattgttgaatcaaatggatggttttgatcaaaccaccaacg

SEQ ID NO: 3077 - DNA, 286 bp, Ceutorhynchus assimilis
gctcagtgaccattaagacaatgttggaggatttgggcatggacgacgaagaagaagaagctgtgcctctgcccaacgtcaactctgctattttgcgtaaagtgctgcaatgggccactttccacaaggacgatccaccaccgccagaggatgatgaaaacaaagagaagcgtaccgatgacatttcttcttgggacgctgattttctgaaagttgaccaaggaacgttgttcgaattgattttggcagctaattatttggacataaaaggtttgttggatgtcac

SEQ ID NO: 3078 - DNA, 793 bp, Ceutorhynchus assimilis
atgactgcaagcaattaacggaaaatcaagtgaaaactttatgtgataaggcaaaggagattctgtcaaaagaatccaatgtgcaagaagtcaaatgtccagtcacagtatgcggtgatgtacacggtcagttccatgacctcatggaactgttcaggatagggggtcgtagcccggacacaaattacctatttatgggcgattatgtcgaccgtggttactactcagttgaaacagtaacactattagttgccctcaaagtccgctacaaggaaagaattaccatcttgaggggcaaccacgaatcaaggcaaattacacaagtttacggcttctatgatgaatgcttgagaaaatacggaaatgctaatgtttggaaattctttaccgatttatttgactatttaccactaactgctctagttgatagtcaaattttctgtttgcacggaggattgagccctagcattgataccttggatcatatcagagctttagatcgtctacaagaggtgcctcatgaaggcccaatgtgtgacctgttatggtcggatccggatgatcgaggtggatggggaattagtcctagaggtgctggttacacttttggacaagacatctcggaaacgtttaatcattctaatggactgacactagtttccagagctcatcagctggttatggagggctataattggtgtcacgatagaaacgttgttaccatctttagcgcacccaattactgctacagatgtggaaatcaagctgccattatggaattggatgatgcact

SEQ ID NO: 3079 - DNA, 722 bp, Ceutorhynchus assimilis
agaccaacagcgtcttatttttgctggcaaacagcttgaagatggcagaaccttatctgactacaacattcaaaaggaatccactctgcatttggtactcagactgagaggtggtatgcaaatctttgtaaaaaccttgactggtaagaccatcacccttgaagtagagccatccgataccattgaaaacgtcaaagctaaaatccaggacaaagaaggtatcccaccagaccagcaacgtcttatttttgctggcaaacaacttgaagatggccgcaccctctcagattacaacatccaaaaagaatccacgcttcacttggtattaagattgagaggtggcatgcaaatttttgtcaaaactttgactggaaagactatcacccttgaagttgaaccttctgataccattgagaatgtcaaggccaaaatccaagataaagaaggtatcccgccagaccaacaacgtcttatctttgctggcaaacaacttgaagatggccgcaccctctcagattacaacatccaaaaagaatccaccctccatttggtattaagactgagaggtggtatgcaaattttcgtgaaaaccttaactggtaagaccatcactcttgaagtcgaaccatctgataccattgagaatgtcaaggccaaaatccaagacaaagaaggaatcccaccagatcaacaaaggttgatttttgctggcaaacaactag

SEQ ID NO: 3080 - DNA, 724 bp, Ceutorhynchus assimilis
tcgtgagaaatggtaaagcaacaatatcgaatgatggggctactataatgaaattgttggatgttgttcatcctgcagcaaagactttggttgacatcgctaggtcacaagacgctgaagtaggcgatggcaccactagtgtggttttacttgctggagagtttttaaaacatattaaaccatatgttgaggaaggtgttcatcctagaattattattagatctgtccggaaatgcttacaactatgcctggccaaaattaatgagatttctgtgaaaatcaacaaagcaaatgtgtcagaatttcgttcattattagaaaaatgtgctgcaactgcaatgagttcaaagctaatcaatcagcaacgagtatttttctctaaaatggttgtagatgcagttctactacttgatgaacttttaccactgaatatgattggaattaaaaaagtacagggtggtggcctagaagattctatgttggttgcaggtgtagctttcaaaaaaactttttcatatgctggctttgaaatgcagccaaagatttataaaaactgcaaaattgctttattgaatattgaattggagttgaaagctgaaagagacaatgctgaagtgcgtgttgataatgtcaaagaatatcaaaagattgtcgacgctgaatggaatatactttacaagaaactgcaaaaaatccacgaatccggagctaatgttgtgctttc

SEQ ID NO: 3081 - DNA, 650 bp, Ceutorhynchus assimilis
tgactatgtagacgcttgtgtaatttctgtgctacaaattcatgtaacccaacccttgggggacgttttagtatttttaactggtcaagaagaaattgaaacttgccaagagtcactgcaagaccgtttgagacgtttgggctccaaagtaagggaactcataatattgcctgtatatgctaatttacctagtgatatgcaagctaaaatatttgacccgactccacctggagccagaaaagtagtattggccacaaatattgcagaaacttctttgacaattgacaacataatttacgtaattgatccaggatttgcaaagcaaaatcactttaactccagaacaagcatggagagtttgatggtggtaccaatttcaaaagcttcagctaatcagagagctggtagagctggccgagtggctgcaggaaagtgttttagattgtacactgcgtggtcttataaacatgaattggaagagaatacagtgccagaaattcaacgcattaatttaggaaatgctgttttaatgcttaaagctttaggcattaatgacttggtgcattttgactttttggacccgccccctcatgagacattagtgttagctcttgagcaactgtatgctttgggtgctttgaatcatcatg

SEQ ID NO: 3082 - DNA, 765 bp, Ceutorhynchus assimilis
aagggctattggtttgagagtaagagaaactaaagaaatttatgagggagaagtttgcgaactctctcctgtggaaacggaacatcccgttggaggtcaaggtaaatctgtcagtcatgtagtaatcggcctaagaacagcaaaaggcaccaaacaactaaaacttgatccgaacatttatgaggctctacaaaaagaacgagtcgaagtaggagacgtaatttacatagaagccctcagtggggctataaaaagacaaggaagatctgatgctttcgccactgaatttgatttggaagctgaagagtacgtgcctctacccaaaggagatgtacacaaaaagaaggaagttgttcaggatgttacattacacgacttggatgcagcaaatgccaagccacaaggtggtcaagatgttctttcaatgatggggcaattattgagatccaaaaaaaccgaaataactgataaattgagaaaagaagttaataaaattgtcgacaaatacattgaccaagggattgctgaattggtccccggagtacttttcatcgatgaagttcatatgctggatattgaaacttttacttatttgcacaaggctttagaaagtgccattgctcctatcgttatttttgctacaaatcgaggcagatgtcttattagaggtactgatgatatttattctccgcacggcattccattagatttacttgatagactcttgattatcaggactgtgccatacgatcgtccagatatgga

SEQ ID NO: 3083 - DNA, 676 bp, Ceutorhynchus assimilis
aaggaaaaggttacggtctcacgataactcctttaccagcaggccacatgattggcggaacaatatggaaaataatgaaagcaggcgaagaagatatcatatacgctaactcattcaaccacaaaaaagagaggcacttgaacggttgcgaattggaaaaattgcaaaggccttctttgtttattactgatgctttcaatgccagttatcaacaggccagacgtagagccagagatgagaaattgatgacaaacattttacaaactcttagaaatagcggtaacgttctaatagcagtagacactgccggcagggtattggaattggcccacatgttggatcagttgtggagaaataaggaatcagggcttttaacatattctctagcacttataagcaatgtagcttacaatgttgtcgagtttgccaaatcgcaaatagagtggatgagcgacaagctaatgagaagttttgagggtgcgaggaacaatccgtttcaatttaaacatttaaatttgtgccacagcttacaggaattaaataaagttcccagcccaaaggtagttttggctactagccctgacttggaaatgggttttgctagggaactatttttgcaatggtgttcgaattcaaataatagtgtaattattagtacaagaacatctccaggaac

SEQ ID NO: 3084 - DNA, 772 bp, Ceutorhynchus assimilis
aagaacgtatagaagacggcgaagacatcgaaatgcaacttgaaagtgacgacgatgaacctacaaatgtagattcaggcctcagtcatatggaagacagaacaggccctacaagccgtaaagataacaatcaagtgcaagatatggacgaggagagttcagaggaggaatatgaaagagaacagccacaacccatacaaccacctatgcctccggctttggataaagtggttgttaaaaaatatgatcctaaaaaacaaacaccaaaagttactagaccaactccaggggatgattatttggtgtcgccaattacaggagagaaaattcctgctagtaaagtgcaggagcatatgcggattggtttgttggatcctagatgggtggaacaacgtgataaacatgttacagacaaaatgaatcaagatacagtttatgctcaaggtccagccatagaggccagtttaaaattgttggctgaacgtcgtactgatattttcggtgtgggagatgaggaaactgctattggtaaaaaaattggagaagaagaaagaagagatgaaaaggtcacttgggacggacacacttctagtgtggaggcggccactagggctgcaagggctaatatcaccttggaagatcaaatacatcaaattcacaaggttaaaggtttacttcctgacgaagaaaaagaaaaaatcggtcctaagaacttgcaaggctcaaacaaaatgaaaatgccaccggctccgatcattaaacctccaccacc

SEQ ID NO: 3085 - DNA, 796 bp, Ceutorhynchus assimilis
aaaatcggcaactccaaaagagtagtaggggttttgttgggttgttggcgggccaaaggagttttagatgtttccaacagttttgcagtcccatttgatgaagacgacaaagacaaatctgtttggtttttggaccacgactacttggaaaacatgtatgggatgtttaaaaaagtcaacgccagagaacgtgttgtgggttggtaccacactggacccaaattgaaccaaaacgacattgctattaacgaattggtaaggcggtactgtccaaattctgtattggtaatcattgatgcggaaccaaaagatttgggcttaccaactgaagcttaccaagcagtagaagaagttcatgatgatggttcacctacttctagaacttttgagcatgtgccaagtgaaattggagcagaagaagctgaagaagtaggggtggagcatttactaagagacattaaagatacaactgttggtactttgtctcagagaattaccaatcagttattgggcctcaaaggccttcactcgcaactgagagaaatcagagactatttgatacaagtcagcgaatcaaaattgcccattaatcatcagataatctatcagttacaagacattttcaacttattacccgatatcaatcaattggaattcaataagtcgttttatgtgagaaacaatgatcaaatgttggttgtttacttgtctactcttgtccggtccattgtggctttgcacaatttgatcaacaataaattgaccaacaaagatgccgaagaaggcaaaaaggaag

SEQ ID NO: 3086 - DNA, 759 bp, Ceutorhynchus assimilis
cccattgacaaaaacgacaaagccgctcttagcaatgttgtcagaggttgcgttggcaccaaattcattggcaaatggtccgatttggcagtgaaaatcgctttggacgccgtccatactgtgatgctggaggaaaatggtagaactgaggtggacattaaacgatatgccaaagttgagaaaattcccggtgggtctattgaagaatcagaagttttaactggagttatgctcaataaagatgtcactcatcccaaaatgagacgttatattgagaatcctagaattattttgctcgattgttctttggagtataaaaaaggagaatctcaaactaatgttgaaattacttctgatggtgattttactagaatgttgcaattggaggaagagcacgtcaggaggcaatgcgacgaagttatagccctcaaaccggatttggtgtttaccgaaaagggggtttcagatttggctcagcactttttgttgaaagcaggaatcagtgctattcgtagagtaagaaaatccgacaacaacaggatcgctcgcgcctgtggcgccaccatagtaaatagaaccgaagaattgcaagaatccgacgtcggaactggagcgggtctctttgaaatcaaaaaaatgggcgacgaatacttttgctacatcaccaagtgcaaaaacccgaaagcttgcacaatcattttgcgtggtgccagcaaagatatcttaaacgagaccgaaaggaatttacaagacgccttg

SEQ ID NO: 3087 - DNA, 550 bp, Ceutorhynchus assimilis
ggatttaatccctacgctgacaatggcgggagtgttgtggcaatagcaggcgacgacttcgttataatcggagccgacacgcgtctgagtgccgggttttcgatttacactcgcgaacaaaacaaattgttcccattgtccagtaccacggtcttgggctgttctgggtgctggtgcgacaccctcactttgaccaggattttgaagtctcgcatgcaaatgtaccagcaggagcacaacaaaacaatgtctactactgcctgcgcccaaatgctctccactatgctctattacaaaaggttctttccctattacatttccaatgtattagttggtttggataatgatggaaaaggggtggtttacagttacgatcctattggtcattgcgaaaaaagaactcacagagctggaggatctgcgggtgctctattgcaaccacttttggataatcaaattggcaagaagaacatgttgaatgtgaaagaagaaccggtttcgcaacagagagctttgtccatcattaaagatgtgtttatttcagctgctg

SEQ ID NO: 3088 - DNA, 736 bp, Ceutorhynchus assimilis
ccaagtgctctagaacaacttaccagactcaatataaattacccaatgttatttaaactgacaaataaaaattctggaagagaaacacactgtggtgttttggaatttgttgctgatgaaggaaaagtttatttgccattatggatgatgcacaatatgaacctagaagaaggcgagctggtacaaatggaaagtgtctctctacctgtcggtacattttccaaattccagccattatctccagagtttctcgacattactaacccgaaagctgtattagaaaattgcctcagatcgtttgcttgcctcactaaaggagatgtaattgccgtgcaatacaaccaaaaaatctatgagctttgtgtattggaaaccaaaccaggtaatgccataagcattattgaatgtgatatgaatgtagagtttgctgcgcctgtgggatacaaggaacctgaaatagtgaggaaacctgaagaggaaatggctgtagatcctgctgaattgatgccggagcctactggatttatagcatttaaaggagccggtaatagattggatggaaagaaacggaaggattctacatctactgatgtttcgccacataaaccaatatacgtcagaggaattccagactatgactatgaaattggaagtttgagattcattagagcaatagcaaaaccaaaaaataatgataataatgaaagtgatgagtttaaaccgttctctggtgaag

SEQ ID NO: 3089 - DNA, 718 bp, Ceutorhynchus assimilis
aaatgatggtgtctcctgacggtgatgttaccgtaaccaacgacggcgccacgattctaaaaatgatggacatcgaacacgaaattggcaaactcctagtagaactatcccaatctcaagacgacgaaatcggcgacggtactactggagtcgtggtactcgctggggctttgctagaacaagcagccagtttagtagaccgcggcattcaccccataagaatagccgacggtttcgaaatggcctgccaaactgccgtagctcatttggaaaaaatcgccgaacttttcccggtttccgccaccaaccccgagcctcttatacaagtcgccatgaccactttaggttcaaaaatcatcaacaagtgtcacagacaaatggccgaaatcgcagtcaacgctgtgctagctgtggccgatttggaacagaaagatgtcaattttgagctgattaaagtcgaaggcaaagtgggtggcaaattggaagacactgtattagttaagggagtggttatcgacaagacaatgtcgcactcgcaaatgcccaaggagctgaaagatgttaaattggccattttaacttgcgcgtttgaaccaccaaaacctaaaaccaagcataagttggatgttggtgatgttgccgcttataaagagttgagacaatatgaacaggaaaaattcaaagaaatggttaatttggtgaaaaatgctggagctac

SEQ ID NO: 3090 - DNA, 208 bp, Ceutorhynchus assimilis
ggttcgaagtgaaaaagtggaatgcagtagccctatgggcctgggatatcgttgttgacaattgcgctatctgcagaaatcacataatggatttgtgtatagaatgccaggctaatcaggcctccgctaccagcgaagaatgcactgtcgcttggggcgtttgtaatcacgctttccattttcattgtatctcgagatggttgaagac

SEQ ID NO: 3091 - DNA, 652 bp, Ceutorhynchus assimilis
gtttggctcgacaattaaggttgactctatggccaaaattgcagaactagaattagcagaaaaggagaaaatgaaagacaaagtaaataagattctcaaacacaacgctaacgtttttatcaatcgtcaattgatttacaattacccagaacaattgtttgctgatgctggcgttatggcaattgaacatgctgattttgatggcattgaaagattagcattagttactggtggtgaaatagtctccacttttgatcaaccagaatctgtaaaattaggaacttgtgatctcattgaacaaatcatgatcggtgaagacattttgttgagatttagtggtgttgccttgggagaggcttgctctatagttattcgtggtgcaacgcatcaaattattgaagaagctgacagatccctccatgatgctttatgtgtcttggccgccacagttaaagaacatcgtgtagtgtatggaggaggttgcagtgaaactttaatggctgttgctgttagtaaagctgctttgaatacgcccgggaaagaagctgttgctatggaagcttttgccagagctcttctacaactgccaacgattattgctgacaatgctggttacgattctgcgcagcttgtagcggaattaagagcatcc

SEQ ID NO: 3092 - DNA, 673 bp, Ceutorhynchus assimilis
tctgcaccaagtcgaatacgccatggaagcggtgaacctgggttcagctactgtggggctcaaaagtaactcgcatgcggtcattatagccctaaaaagagcctcctctgaattgtctgcctaccagaaaaagatcatcaacatcgacgatcatattggtattactatatcagggcttactgcagatgcaaggattttgagcagatacatgagaacagagtgtttgaattataagtactctcacgatacttatatgccaatgaatagacttattacaactttaggcaacaaaatgcaagtttgtactcaacgttacgatcgtcgtccctacggtgtaggccttttagttgctggttttgacgataagggcagccacatttaccaaacttgcccttcggccaacttttacgattgcaaagccatgtctattgggtccagatctcaaagcgccaggacttacttggaaaagcatttggatcaattattaaacagcagcttagaagaacttattaaacacggtttgagggctttgagagacacccttcctccagaaatagatttgtctaccaaaaatgtttctattggttttgttggcaaggaaaggcaatttaagattttagaagaagaggagattgcaccttatttaggacttattgaaggtgaggagagaaga

SEQ ID NO: 3093 - DNA, 740 bp, Ceutorhynchus assimilis
gaaacttgtccagaagcctactgcaaaaacctctacttactctatgccaaacttgaggaagattacggaatggcccatcatgcaatggcagtttacgaacgtgccacacaagctgtctcacaagattccatgctggaaatttttaatatttacatcaaaaaggcatcgagcatttacgggataccaaaaaccaggcagatatatgaaaaggctatttctgtcttaccagagaaggacatacgggatgtttgtctaagattcgccgatatggaaactaaattgggagagattgacagggccaggggtgtttattcgcactgtagccagatttgcgatcctaggattacaggggaattttggcaaacttggaaggagtttgaagttaaacatgggaatgaggagactatgagagaaatgttgagaattaagaggagcgtgcaggcaacctataatactcaggttaatatgatgtcagtccaaatgttgggatcatcctcacctctaggaactacagccgatttagcaccaggcgaaaaggatggaatgcgactgttggaagtcagagctgccgaaatggcttcttcttcaggtgctcaaaaatcggcgaccagcggtataatgtttgttagaggcgaaactcaaggaggtaaaaaggataaagtggttaatccagacgaaatcgatatcgatgccgacgggggtgaagacgaagatggggaagatgatgaggatcctgaacc

SEQ ID NO: 3094 - DNA, 689 bp, Ceutorhynchus assimilis
tcttgatgttggtgccaatatatttattggtaatttagatctagaagttgatgaaaaattactttacgacactttctctgcttttggagtaatacttcaaacgccaaagattatgagggatccagaatctggaaattccaaaggttttgctttcgtcaatttcgccaactttgaatcttcggatgcttccatagaagccatgaatggacaatacttgtgcaacaggccaatttccgtatcttacgctttcaagaaagattcaaaaggagaaaggcacggatcagctgctgaacgtattttggctgcacaaaatccgttatcacaggctgacagaccccatcaactgtttgcagattctccaccaatcggcatgatgccaccaggaatgacgactgctcctccaccaccaccaggaatgttgggtctaccgccaccctctgtgacacccaacactacgattccacccccaccgcctgctgttcccccaccagcatcatttcctgcaggaattccgccgcctccgttaccgccctctcaaccacctttgccgccaattgcacccccaccgcctccagcttctaagccaggtgtgatgaacccaccagcaccatggaaaggggggttgggtaatcccccaccaccacctgtaccaccagtatctgatccaaacttctccaaattgcttctgc

SEQ ID NO: 3095 - DNA, 553 bp, Ceutorhynchus assimilis
cacacgaaaaagaggaaaggggcgcccaaattgcgttacttggacttttccgaaagacatggctacatcaagggtgtcgttaaggacattgttcacgatcccggcagaggagcacctttggctttcgtacatttccgtgacccttacaaattcaagacacgtaaagaattgttcatcgcccccgaaggaatgtacactggacaatttgtctactgtggcaagaaagccaatttgcaaattggaaatgtattgccagtaggaaccatgcccgaaggtaccattgtgtgtaaccttgaagaaaaaactggtgacagaggccgtttggctcgtgcctctggtaactacgccactgtaattgcccacaaccacgacacgaaaaaaaccagagtcaagttgccttcaggcgccaaaaaagtaatcccatccaacaacagagccatggttggtatcgtagctggtggaggtaggatcgacaaacccatcctgaaagccggtagggcttatcacaagtacaaggtgaagaggaactgctggcctaaggttagaggtgttg

SEQ ID NO: 3096 - DNA, 264 bp, Ceutorhynchus assimilis
gaaagctgcacgtaaaagtgccccggctaccggaggagtcaagaaacctcatcgctacaggcctggaaccgttgctctccgggaaattcgccgttatcagaaaagtactgaattgctgatcagaaaacttccattccagcgcttagttcgtgaaatcgctcaggatttcaagaccgatttgcgtttccaaagttcagcagtaatggctttgcaagaagccagtgaggcctacctggtgggtcttttcgaggacactaacctttg

SEQ ID NO: 3097 - DNA, 686 bp, Ceutorhynchus assimilis
cctgattggtgaactcttgaagcaggcagacatctacattgcagaaggcctccatccgagacttcttgctgagggctttgataaagctaagaccaaagctttagaagtcctggacaaaatcaagatccccattgaaatcaatagagaaaatttattggatgtttgcaggactagtctaaggacaaaggttcatcaaactttggctgatgtccttacagaagtttgtgtcgaagcagtcttagcgataagacccaaagacaacaaacctgttgatttgcatatggttgaattaatgcaaatgcaacacaaaaccgagactgattcatcattaatcaaaggtttggtacttgatcatggatcccgtcatccagacatgccaaaacgtctggaaaattgctacattttaacttgcaatgtgagtttggaatatgaaaagagtgaagtcaattctggctttttctacaaaactgctgaggagagagacaagatggttcttgctgaacgtgagtttattgatcagagagtcaagaaagtcattgagttgaagaaaaaaatttgcactggtaccaataagacttttgttatcatcaaccagaaaggaattgatcctatgagcttggatcaattagcaaaggaaggtattatagccttaagaagagccaaaaggcgaaacatggaacgtttat

SEQ ID NO: 3098 - DNA, 767 bp, Ceutorhynchus assimilis
gctcatgccaatagagatcatattgcccaagtagctgctagcattgaggttcctgtatttgttccaagatctggggtgaaaattgcggttactgattcacaaatggccgccaacggtaacaatgtcgacctggatcgtattactcaacttactcaagaaataccaaccagggataaaattgatggtgtcatgttgaaacccttggacttcgagaaggatgatgacaccaatttccatatggatttcattgtagcggcatcaaatctgagagccctcaactacaaaattcctcctgcggatagacacaagtccaaacttattgctggtaaaattattccagccattgctacaaccacgtctgtggtcgccggtttagtttgtctggaactttacaaattgattcgatctcaaagaagtctggaaccatttaaaaatggtttcgtcaatttggctctaccattctttggattcagcgaacctattgctgccccacaaaaggaatatggcgaaaacaaatggacattatgggacagatttgagattgatggagaaatgactttagctgaatttttgcaatatttcaaagataaacataatttggaaatcacaatgctttcgcaaggcgtttgcatgctttactcattcttcatgcaaaaagccaaagctcaagaacgtttgggcctttcaatgtccgaagtggtgaggagagtgtccaaaaaaaagatcgaacctcacgttaaagctctggtctttgaattgtggtgcaa

SEQ ID NO: 3099 - DNA, 729 bp, Ceutorhynchus assimilis
tccaaaaggatgaggatgtgctgaaaaatagttgtccgcatattgttgtcgggacacctggcaggattttggcgcttgttaggtccaagaagttgaacttgaagaatttgaagcattttgttttggacgagtgcgacaaaatgctggagttgttagatatgagaagagacgtgcaagaaatctacagaaacacaccacacggcaaacaagtgatgatgttcagcgccaccctaagcaaagacatccgcccggtctgcaagaagtttatgcaagatcccatggaagtgtatgtggacgacgaggccaaattgactcttcacggtttgcagcagcactacgttaaattgaaggaaaatgaaaaaaataaaaaattgttcgagcttttggatattctagaatttaatcaggttgtcatttttgtcaaatcagtccaaagatgtgtggctttggcccaactattgaccgagcaaaatttccccgccatcggaatccacaggggaatggaccaaaaagaaagattgtccagatatgaacaattcaaagatttccaaaagagaatattggtagcaacaaatctttttggcagaggcatggacattgaaagagtcaacattgtattcaactatgatatgcctgaagattcagacacttacctgcacagagttgccagagcgggacgttttggtaccaaaggccttgcaatcacttttgtttcagaagagagtgacg

SEQ ID NO: 3100 - DNA, 770 bp, Ceutorhynchus assimilis
tgacttgattgctgctaagtgctacttttatcattctagagtagctgaattgtctaataagttggacacaattcgtgctttcttgcatgccagattgcgtacagcaactttgaggaatgactttgaaggacaagcagttcttatcaattgtctgttgaggaattatttgcactattcactctatgatcaagcagacaagttggtttccaagtgtgtttttcctgaaactgctagcaacaatgaatgggccaggtttttgtattatttgggaagaattaaggctgctaggttagaatacagtgttgctcacaaacacttggtgcaagctatgagaaaggccccccaaaacactgctgtaggcttcaggcaaactgttcaaaaacttttagtggtagtagagcttcttctgggtgatattcctgaaagacagattttcaggcaacctgccatgcgtcactcgttgagctcctacttccaactcactcaagcagtacgtatgggcaacttgcaacgatttggagaagttttggaaaactttgggccccaattcaggcaggaccatacttatacattaatcttgcgcttgcgccataacgtcatcaaaactgctcttagaagtattggcctagcttattcgagaatctctttgcaagatattgcacaaaagttaggcttggattcagctgaagatgctgaattcattgtggcaaaagccataagggatggggttattgaggccacattagacgctgagggtggctatatgagaa

SEQ ID NO: 3101 - DNA, 651 bp, Ceutorhynchus assimilis
tccccagtacatttccaatgctccttggtactatggtactagtgggcctacgctcaagcatcaaagacctcaagaggagcaccagaagcagttttctggactagacgagtggtaccagagaggattggacacatcaaaaattgtcaccaaattccgaaaaggtgcctgtgaaaattgtggtgcaatgacccacaaaaaaaaagattgtatggatcgacccagaaaaattggtgccaaatattccaaatccaacattctgccagatgaatatgttcagaaaaacttggcgttgagttttgatggcaagcgggatagatggagcggatacgatccaagtgaacacaaaactgttatagaagagttccaaaaagttgaggaagccaaacgccaactaaaagctgagaaactagatgctgagaactcagatgaagaggaaaaggatgaggacaaatatgtagatgaagttgatatgcctggcaccaaagtggacagcaaacaaagaattactgtgaggaatttgcgtataagagaagacactgcaaaatatttgaggaatttagatccaaattctgcctattatgatcccaagacaagatctatgagagaaaatcccaatcctggagtggatgagacacaccaaggagaaaactt

SEQ ID NO: 3102 - DNA, 503 bp, Ceutorhynchus assimilis
aggaagttcgaattaggacgtccagctgccaatacgaaattgggagcccgcagaatccattatgtccgtaccagagggggcaacatcaagtaccgtgccctcagaattgacactggcaatttcgcttgggctagcgaaggtactgccaggaaaactcgtattatcgacgttgtatacaatgctagcaacaatgaattggttcgtaccaagactttggtgaaaaatgctattgttgttgttgacgccactccgttcaggcaatggtatgagacgcactatattttgcctttgggtagaaagaagggagctaaactgacagcagaagaagaggcaattttgacaaaaaagaggagcaaaaaagtccaaaagaaatacgaaaacagacagaaaatcgccaaggttgaacctgcgatagaagaacaatttcagactggtagattgttggcttgtctagcctcaagaccaggacagtgcggtcgagccgacggttacatcttggaagg

SEQ ID NO: 3103 - DNA, 669 bp, Ceutorhynchus assimilis
aagttatgggtctcatgctgggcgaatttgtagatgactacactgtaagggttatagatgtgtttgctatgccccaaaccggtaccggtgtcagtgtagaagccgtagatccagtatttcaagcaaaaatgttggacatgctgcgccaaactggaaggcctgaaatggtggtgggctggtaccactcgcatcccggttttggttgttggctttcaggagtcgacatcaacactcaacagtcttttgaggctttgtctgaaagagctgttgctgttgtagtcgatcccattcagtctgttaaagggaaagttgttattgatgctttcaggttgattaacccaaatatgatggttttgggccaagaacctcgccaaacgacctccaatttgggacaccttcaaaaaccttcagtgcaagctctcattcacggcctgaacaggcattactactcgattagcataaactacaggaaaaacgagctggaacaaaaaatgctgctcaatttgcacaaaaaatcttggatggacggcctcatgttggctgactattcagaaaactgtagtaccaatgaaaaaactgttgctgaaatgttggaattagccaagaattataacaaagctcttgaagatgaagagaaaatgactccggaacagttggccatcaaaaatg

SEQ ID NO: 3104 - DNA, 769 bp, Ceutorhynchus assimilis
gcgaagtagtcaaaccaatggacaagaaaaaagtcctggtcaaagtccaccctgaaggaaaattcgtagtcgatattgacaaaaacatcgacatcaatgacgtcactcctaattgcagagtggctttgagaaacgaaagttacactctacataaaatacttcccaacaaggttgatccattggtctctcttatgatggtggaaaaagtgccagattccacttacgaaatggtgggtggtttggacaaacaaatcaaggaaatcaaagaggttattgaattgcctgttaaacatccagaattgtttgatgctcttggtattgctcaaccaaaaggcgttttgctttatggtccacctggaactggtaaaactcttctagcaagagctgtagcccatcacactgaatgcacttttattcgtgtgtctggttctgagctggtacaaaaattcattggagaaggatccagaatggtgcgagaattgttcgttatggctcgagaacacgccccctctatcatttttatggacgaaatcgattctattggatcgtctcgtatcgagtctggttcaggaggtgactcagaagtccaaagaactatgttggaattgctgaatcaactggacggttttgaggcaactaaaaacatcaaagtcattatggcgactaatcgtatcgatattctggatccggccttgttgagacccggtcgtattgataggaaaatcgaatttccaccaccgaatgaagaagcccgtttggacattttaaa

SEQ ID NO: 3105 - DNA, 450 bp, Ceutorhynchus assimilis
agctactttcaaagaggctctgtgcaagaattcatgttgttttgtgctaaaaccattgctgaaaggacaataccagcttcgaggcaatctgtaaaagaaggcgaatacttttgtcatgtgtatgtaagagctgacaacttagcaggagttattatttcagaccaagagtatccttcaagagtatctcatacgttgctcaccaaaatcctcgatgattttgctgataaaatcccttctaccagttggcctaatttacaagaaagagatgtggcttttccgcaaataaatacctatttagcaaaataccagaagccagccgaggcagatatattgacaaaaatccaaggagaattggatgaaactaaaattatattgcacaataacattgcagctgttttggataggggcgaaaagttggacgacctagtttccaagtctgaaggtttgagt

SEQ ID NO: 3106 - DNA, 621 bp, Ceutorhynchus assimilis
taggttccactgctataggaatatctacaagccaaggggtagtacttgctgttgaaaaacgtatcacttcacagcttatggaaccaacgactattgaaaagattgtagaagtcgataagcatatcggttgtgctgtatctggcctcattgccgattccagaactatgattgatagggctcgcatcgaatgccagaaccactggtttgtctacaatgaaaatatgactgtcgagtcatgtgctcaagcagtatccaacttggccattcagtttggagattcggatgatgatggggcagctatgtctaggccttttggtgtagcaattttatttgctggtatcgatgaaaaaggtccccaactttatcatatggatccatctggtacttttgttcaatttgatgccaaagctattggttctggctcagaaggtgcccaacagagtctgcaagaagtctaccataagagtatgacgctagaagaagccaccacttcggcactgacaatcttaaaacaagttatggaagaaaaattgaactcgtcaaatgttgaagtgatgactatgactcctgataagctgttccatatgttttctaaagatcaagtagaagaggctctgactc

SEQ ID NO: 3107 - DNA, 737 bp, Ceutorhynchus assimilis
tatttgaccaggttccagtgggatatcgccaagtatcctatcaagcaatcgctgaggaacattgctgacattatcagcaagcaagtcggtcaaatcgatgccgatttgaagaccaagtcgacggcctacaataatttgaagggcagcttgcagagtttggagaaaaaacaaactggaagtttgttaacaagaaatctggccgatcttgtgaaaaaggagcatttcatcttggactctgactacttgcaaacattgcttgtaattgttcccaaggctcaggtccatgaatggaacgcgacctacgaaaaaatcactgacatgatcgtgccaagatcgtctcagatggttactcaggataacgaatacggcctattcactgttacactgttcaaaaaagtcatggacgaattcaagcatcatgccagagaaaagcgattcattgtaagagacttcacttatgatgaagagcaattggccgcgggcaaaaacgaaattaccaaattggccacggacaaaaagaagcagttcggaccgttggtcagatggttgaaagtcaatttcagtgagtgcttctgcgcatggatccatgtcaaagcccttagagtatttgttgaatccgtattgagatacggtttgccagtcaatttccaagcaatcctcattcatcccaataagaagtcaatgaaacgtcttagagatgttttgaaccagctttatggacatttggatggtagtgt

SEQ ID NO: 3108 - DNA, 656 bp, Ceutorhynchus assimilis
ttgtaaagaagcctgcagatatattcaagatcatttaactattcctgtagaggatttgggaaaggaatatattatcaatgttgccaagacttctatgagttctaagattattggagctgatgcagatttattctctgcaatggttgttgatgcagcatatgcagttaaagttacagatgttaaaggtaaccctctatatccaattaaggctgtgaacgtacttaaagcccatggacgaagtgctagagaaagtaccttaatccaaggttacgccctaaactgtacagtagccagccaggcgatgcccaaaaaaattgttggcgccaaaatcgcctgtctcgatttttctttgcaaaaagctaaaatgaagatgggagtccaagtactcatcaacgaccctgacaagctcgaagctgtccgtgctcgcgaactagacataaccaaagagagaatccaaaaagtcttgtccaccggggttaatgtgattttgtgctcgggaggtatcgatgatttgtgtttgaaatatttcgtcgaggctggagctatgggagtgaggagagtcaagagggtcgacttgaagcgtatcgctaaagctactggggccacgtttttgacttctctgtcaaacatggatggtgaggaatcatttgatgcca

SEQ ID NO: 3109 - DNA, 621 bp, Ceutorhynchus assimilis
agtacaacccaacgatttcaggcaacacactcaatctccagtgacaacatctacttctctagtagctgtcacttacgataaaggcatcattatcgctggtgatcttttagcttcatacggttcactagccagatacagaaattgcccaagaatcgttaaagtgaacaacaacataattttgggctccagtggcgattatgccgatttccaatacgttcaaaattttattgaacaaaaagtgataagtgatgaatgtttggatgacggtatcaccctcaaaccgaaatctctctactgctggttgaccagaatcctatacaacagaagaagcaaaatggatccactttggaataattttattgttgccggaattcaagacggagagcctttcttaggcacggtcgacaaacaaggcactgcgtactctgacaaaattatttgcactggctacggtgctcatattgccactcctatgctcagagacgctctggataataaacctcaactcacgcaagctgaagctagagctcaagttgaaagatgcatggaagttttgtactatcgtgatgctagaagttttcctaagtatcaattggggattattgatgctgatcaaggtgt

SEQ ID NO: 3110 - DNA, 764 bp, Ceutorhynchus assimilis
tcgaaggagatttgcttgaaatagacgcaacagagaatacagcaatcaaatttgtacatgtttatttgtttaatgacagtttaatgctaacaaacagaaattctaatagtagaggcttgatgcgatacgcctttgaaagcttatacgaacttagtagcttggctgtggttaatgtacgagatttaggcaacattaaacacgcattcaagttgcttatatttccagatacacgagtattccaatgttcatctaatgctagtaaaaaagagtggctggataagattgatcaagccaaaaaaacccgcttggtgcaagagcaacaaaaacgcgaatcctctttggaaaaaatctcccctgcccgttccatttcagttgacttaaacatcaacagccagcctgaagaaatattcacccatcccgattggtttttggacatccctgacgaactagacgtttgcatcgcccaaagacaattcgaagacgctgtcaaccacataaacaaatcaaaaacctacataaacaaacacccagaatatgtgggagcaattcagaaaaaaatcgaccaaaaacaaaacaccctagttgaaatgctaatgaaagagcttgaagttaatcctgaaaaatccttgcaaggtggtttaagagctactagaacagctgtcagattgttgaaccaattaggtcgctccacccaatcatgtgacttatttttaaagctttgctctagcatgttaaaaatccaatgcaaacgagtgaaaagagag

SEQ ID NO: 3111 - DNA, 785 bp, Ceutorhynchus assimilis
gccagtgacaaagatttagctgaatttatcatacatttatcagagaaaaacaacaccaatgattcattcaagaaagccctcattgaagctggtgcagaattcgcagattcatttatatccaatttgttgagaataatacagcatatgagacctagaaaagaccagtcaaaggatgaaattgttcaagaggaaaaaagtgaacttgcacagaaatttccaggtttagctataccaaatgagcctcagaaacctttgggtgatgatgaaaatattgattcaaaattagaaaattctaataaagctaaaaaacaggataatgatgttgtagcagatcttatggcacaatttgaagctgaggcaccatctgctagtaccaattccaaaactgaaaaatcaagaaaaaggtctagatcaagaaaccgatccagatcaaagaacagatccagatctagggaacgtaggcgcgacagatctcgtgatgacaaaaaaggtagatacagggacaggtcaagggatcgtcatcgagaaagagatcgtgaccgtgagcgtgatactgaaagaagaagagaaaggcacagaagcagatctagggagagacgaagatcaagagacagaagggacagaagtcggtctagaagtagaaccaggagaggcagagaggatgattttgataaaaaaaataaatttgataagggtagtgtggaacttgacgaagatcccgtggtaggcaaagtttacaacgctaaagtagcaaatattgtcccttttggttgttttgtgcaact

SEQ ID NO: 3112 - DNA, 658 bp, Ceutorhynchus assimilis
aggctaaagtttgtcctcagtcctggcgatagtgttcaaactgattttaatggtactgaacctttatgcagggttgtaaggctgcatccaaatggaaaacttatggcgagtggtggaacagatggtgatattcgtatgtggaaattccctggcctcgaaccattagcaaaactaaaggcccacactaaagaaatagacgatatagactttagttcttttggcaaccttctcatcacaatagctaaagatggcctggcagttttgtgggattgtgttaaaggtactgaaattaaaaggctcaagtgggagcagcctcaaggatcaaagtatttatacaaaagatgcagatttggatcaattgaaggccaacaaaaatcggctttgtatatgttagctaatcccacaggagtggctaaaaggcagaaatcctatctgcaacaatggtatccagaggaaggtattctaaaaagagtaacagaatttgatgaaagtttatctgccttggcagtcagagatgatggtagattcatagctgtaggtacaatgtttagcggatctgtatctatacatgtagcatttagtttgcagcgcgttttaaatgtagcgggtgcacattccatgtttgtaacaggcctagaatttctcccagtgtccaatc

SEQ ID NO: 3113 - DNA, 800 bp, Ceutorhynchus assimilis
ggccaaagaagaaaaacgaacctttcttcgccagtctttggaagccaggttagttgcactgtatttcgacactggcatgttcagtgaagccctacagcttggttctactttactgtgggagctgaagaagttggacgacaaaaatttacttgtagaagtgcagctactagaaagtaaaatttatcatgcattgagtaatcttcctaaagccagagccgctttgacttcagcccgtacaactgccaacacaatttattgtcccccaaaaatccaagcctctttagatcttcaatcaggcatattacacgcagcagatgagaaagatttcaaaacagcttattcatacttttatgaggcatttgaaggtttcgacagtgtagaatcatcaaaagcactaacagctttgaaatatatgcttttatcaaaaattatgctaaatcattctgaagatgttcagcaaattgtcagcgaaaaattggccatcaaatacgcaggcagggatattgatgcaatgaaagctgtggctcaagcttcccataaaagatctttggctgatttccaagtggcactcaaacaatacaaagcagaactcgaagacgacgtcatagttagggctcatttggacactttatatgataacatgttggaacaaaacctactgagaattatagagccttacagtagagtccaagttgattatatagcaaaggctataaaactgtccatggcacaagttgaacaaaaattgtcacaaattatcttagatgggaaatttgatgggattttggatcaaggcgaag

SEQ ID NO: 3114 - DNA, 653 bp, Ceutorhynchus assimilis
cagagccgagatcgaaaatatgtatgatagcaagattaagagtcttcaaacggccgctaatagacactctgcagccgctgccaatgctttggacgaagctcgtcaagttcgtaccagaatcgacactctatccagccgagtcacacagttggaaaatgaaaacggcgcattagtggccagatcaagagatcttgaaaaaatattggagcacgaacgtttgagacacgccgaagaactggcagccttggaaggcgaactgtccaggatgagagaagagatgaacgttcaactgcaagagtaccaagaccttatggacattaaggtgtctctagatttggaaattgcggcctacaggaaactattggaatctgaagaggacagattgaaaatcactccagcaggacaagaacgcgatgtttctcactcgagcagtcgcagtttggcacaacgttacactccaagccgtcacaacacgaaacggaagcgctttctgatggaagaaagtcaagattccagcctatcagacttcagcgttaccacttcttgcaagggcgacattgaaattctggaagccgaccctgagggtagatttgtgaaattagttaacaagagcaatcaagaagtttcacttggtggttggcaattacttcgta

SEQ ID NO: 3115 - DNA, 681 bp, Ceutorhynchus assimilis
attctgttgaaggtctcaccggcaacctctttgaagtgtatttgaaaccatacttccttgaagcttacagaccaattcacaaagacgacgtttttatcgtcagaggaggcatgcgtgctgtggaatttaaagttgtagagacggatcctgctccattttgtatagttgctcctgacactgttattcattgtgatggagatcctattaaacgtgaagaagaggaggaagctttgaatgctgtgggttatgatgatatcggaggctgcagaaagcaactggcacaaatcaaggagatggttgagttgcctttgaggcatccatcattgttcaaagctattggagttaagcctccaagaggaatcttgttgtatgggcccccaggtacaggaaagacattgattgctagggctgtggctaatgaaactggtgcctttttctttttgattaacggtcccgaaattatgagcaaattggctggcgaatctgaaagtaatttgcgtaaggccttcgaagaggcagataaaaattctcctgctattatatttattgatgaattggatgccattgccccaaaaagagaaaaaacccatggagaagtggagagacgtatcgtttctcaacttttaactttgatggacggcatgaaaaaatcctctcacgtaattgtaatggctgctacca

SEQ ID NO: 3116 - DNA, 676 bp, Ceutorhynchus assimilis
aaaaatctgagcgacctcatcgatttggtacccagtttgtgcgaggatctcttgtcttcggtcgatcagcctttgaaaatcgccaaagacaaggaaactggcaaggattacgttttgtgcgactacaatcgagatggtgactcgtacagatctccttggtccaacacctactaccccccactggacgacggccagatgccttcagaaagactacgcaagttagaactggacgcaaaccacgcctttgaccaatacagagaaatgtactttgaaggaggcgtgagctcagtctacttttgggacttggatcacggatttgctggtgtaattctgattaaaaaaatcggggatggttctagaaaaatcaaaggttgctgggactctttacatgtggttgaggtgcaagagaaaagctcgggcaggaactcgcactacaaaatgacttccactgccatgctgtggctgcaaaccaatgaaacaggttcaggcactatgaatttgggtggtagtttgaccaggcaaattgagcaggactctgcagtcaacgagaataatcctcatattgctaatattggcaggatggttgaagatatggagaataaaataagaaatacgctcaatgagatttattttagcaaaactaaggacattgttaatagtttaagatcggtccagc

SEQ ID NO: 3117 - DNA, 795 bp, Ceutorhynchus assimilis
tggaagaaagtacgaaacgtaaaaaagaaaagaaaaaacaaaaaatgaaagacaaaccgaaaaagaattcagtacaagcgctggcccttcccaacagtactggtccccgaggtccaaaaccgggagcaggggcgccaggagtgaacgcgggcgggccggcgggcaaacgcgcgaaagcgggcagaggagcgggagcgggcggggcgggtccgggtcgcaaaaaagcgcagccagtgtccgtggtaccggcgttcgattcagaggacgaggacagcgccaagccgatgtcctacgacgagaaacgtcaactgtcgctggacatcaacaaactaccaggcgacaaactaggtcgagtcgtgcacataatccagtccagggagccgtcgttgagggactcgaatccggacgagatcgagatagacttcgaaacgttgaaaccgtcaacgttgagagaactggaaagttacgtcgcgtcgtgtctcagaaaaaagccacgtaagccctactacaaaaagttaccgggcaaatcaaaagaggaacaaatcgcagagaaaaaaaaggaactcgaggaccgactactcgacgtaaatcataaaatcggacccaccaaaaaggcgcctaaaaaagatgcaaaatctgatcctacaggagcaggtgcaggacacatgtcatcgtccagctccagttcggacagtgacagttcgacgtcgtccatgagcagcagctcgagcgattccagcgacagcgaagcaggtgcctcggcagccaggcaggcgaaaaagcctaaaatcgcga

SEQ ID NO: 3118 - DNA, 686 bp, Ceutorhynchus assimilis
tcttcccattgtcttcaaggccccaatcaggcctgatgtggtcaactttgtccatcagcaagtttccatgaaccgtcgtcaaccttacagcgtaagcgacacagcaggacatcaaacttctgctgaatcctggggtactggacgtgccgtcgcccgtattccccgtgttcgtggtggtggtacccatcgttccggacagggtgctttcggcaacatgtgtcgcggtggtcgtatgtttgctcccaccaaaccttggcgccgttggcaaagacgtgtaaacatcaatcagcgtcgttacgctttggcttcagctatcgctgctagtggcgtaccagctttagtcatgtccaaaggacatgttgttgatcaaatcccagaattgcctttggtagtctccgacaaagtccaggaattgaccaagaccaaacaggctgttcagtttttgaggcggatcaaggcttggccagacatccaaaaggtatacaaaagtcaacgtttccgcgctggtaaaggtaagatgcgtaacaggaggagaatccaacgtaaaggacctttggttgtctaccatcaagatcaaggtcttcgtagggctttccgtaacattcctggaatcgacctaatcagtgttgaaaaactcaatcttttgaaattggctcctggtggtcatgttggacgtttcatcatct

SEQ ID NO: 3119 - DNA, 734 bp, Ceutorhynchus assimilis
tttggatgacagactggaagatgaagattatgacttgttggaagaaaacttgggggttaaagtggaaagaagaaaattcaaaagactgagaagaattcaagacgaagaaagcgaaggagaagacgaaaacgacgctgaacaagacagagaacaaatcgctaacgatttattttctgaagatgaaagagatggaggaagtagaaaggatgatgaaagacattctgaacgcagtcacagaccaacagttgtcgatccagatcaatttgctgaagaagaagacgaaggcgaatactcagacgcagatgatttcatcgttgacgacgacggtaaaccaatagcccgaaaaaagaagaagcccatctttactgatgctgctttgcaagaggcccaagaaacctttggagtcgatttcgattatgatgaattttcgaaatatgatgaatacgatgatgaagaggaagatgaagaagatgaatatgaggaggacgaagaaggcgaaagaagacgccgccagaaaaaggcagccaaaaaacgcccaaccaaaaagtcaatatttgaaatctatgaaccgtctgagcttaaacgaggcttctttactgatttagataacgaaatccgtagtacagacatcccagaaagaatgcaacttagagatgtcccattaacaacagtgcctgatgattcaactgaattagacgatgaagccgaatggatctacaaacaagccttttgca

SEQ ID NO: 3120 - DNA, 671 bp, Ceutorhynchus assimilis
cgaatgatgcaagcagaaataactgataaatcatcagcagcatttcaaagaattgcttgggaagctttaaaaaagtccattcatggattcattaacaaaataaacacgtcaaacattggaattattgcaagggaattgttgcatgaaaatataatcagaggaagaggtttattatgtaaatcaattattcaagctcaagcggcttcaccaacatttaccaatgtatatgcagcattagttgctgttataaattcgaaatttcccaatattggagaacttttactcaaaagattggtattacaattcaaaagaggcttcaaacaaaataataaaaccatttgtatatcagcatcaacattcattgcccatttggttaaccagtctgttgcacatgaaattttagcactggaaattttaacgctacttattgaaactcctactgatgattctgtagaagtttcaattgcatttctaaaggaatgtggacagaagctctcagaggttacaagcagagggattaatgctatttttgaaatgctaaggaatattttgcatgaggggaaattggaaaaaaggatccaatacatgattgaggtcatgtttcaaataaggaaagatggtttcaaggatcatgctgctgttattgaagagctggacattgtggaagaaga

SEQ ID NO: 3121 - DNA, 739 bp, Ceutorhynchus assimilis
tgaggatgatatctgcttgctgtaaaatgcacaatatttcagctgaaggcataactttggttgaagatattttcaaaacccgcgaaccattgcccacaatggaagctgtttatctgataactccttcaaaagagtctgtggaagcactaatgagggactttgacggcatcaaacatattatgtacaagggggcacatgttttcttcactgaagcatgtcctgaccagttaattaatgacttagctcgtcaccctgtggccaaatatattaaaacccttaaagaaatcaacattgcttttgtaccaaatgaagctcagatcttttcgttggattgtgccgagactttccaatgctactataatccagcctattcccaaaaatacagcgccaatatggaaaggatggcagagcaaatagctactttgtgtgccactttaggcgaatatccttctgtaagatatcgcagtgactgggacaaaaacgttgaactagcccaactgattcaacaaaaattggacgcctacaaagcagatgaacctacaatgggcgaaggtccagaaaaagccagatcacagctgttgattctggatcgcggcttcgattgtgtttccccacttttacacgaattgactttccaagctatggcctacgatttgttaaatatacaaaatgatgtttatgagtatgaagcttctgctggtgtaaaaaaagaagtcctccttgacgaaaacgacgaaat

SEQ ID NO: 3122 - DNA, 674 bp, Ceutorhynchus assimilis
cgagtagtagacgctcaaaaactgatgacccatttaagtgaatttttatcaaatggtccgttaaccagctccattttcaacgatccctatagaatcgacgaagcggctgacgtaatacagaaactatttttaatatcacaagatttgccttcgcccaagtttgaaaatgttaaaaggaaaatcgaaaggacttactcggatattgaaaaggctttaattgaagattttgttagggctatgagcaaagaggatctggttaggatgagggctatagctaacgtgctgagtcagtttaaaggttacagccagtgtgttgatgcctatattgatcaaagtcaagcaggttgtttgttgagcaaagacgttttcgctcatttggttccgctttgcaagcacaactacgaaattataaaagaagttttcaatagtccagaacaagtaatggctaaatttgttctgaacttgtaccagttgaaattggctgattatatagactccaggctaagtgctaaagttggcagctacggttacttgcaaatactttatgagttgtactcaaaaacaaatcagttttccaacgaattgagcgtctatgatttgggtaacgatcagaattatttgagcaaattgactacgaagatttttaataaatatatcagcgattatgtgcagat

SEQ ID NO: 3123 - DNA, 678 bp, Ceutorhynchus assimilis
agggaaagattgaggcaattagcccttgaaaccatagatttgcaaaaggacccctattttatgaaaaaccatttggggtcctacgagtgcaaattgtgtctgaccttgcacaacaacgagggaagttatttggcccatacacaaggaaaaaagcatcaggctaatttagctagaagggcagctaaagaagccaaagatgcccctagcatgctacaacctgaaaaacccagggtggaacccaaaaaattcgttaaaatcggtagacctggatacagggtgaccaaacaaagggaccccgaaactggacagcaaagcttgctgtttcaaatcgattatcccgaaattgccgatcatgttttgcccaggcacagattcatgtctgcttacgagcaaaaaattgaacctccagaccgtaaatggcaatatttgttgtttgctgcagaaccctatgagactatagcatttaaggttcctagcagagaagttgaaaaaaccgaccagaaattctggactcattggaacagagacaccaaacaatttttcctgcaatttgccttcaaaatcgaaaacaagaaactgaccaacatagtgccaaggcctcctatgatgggagttggaatacctcctccacctcctatgttgccagtacctccaccaccgagacctccaatgttcaat

SEQ ID NO: 3124 - DNA, 260 bp, Ceutorhynchus assimilis
tgacctgcgaaactattaccggcgaagtttacagaggaaaacttatcgaagccgaagataatatgaattgccaaatgactcaaatcactgtgacttaccgggacggcagagtagctcagctagaaaatgtttacattagaggttcgaaaatgagatttttaatactgccggatatgttgaaaaatgctcctatgtttaagaagcaaactaaggctggggtggctgggagaggaaaatctgggatacttcgagctcaagtg

SEQ ID NO: 3125 - DNA, 774 bp, Ceutorhynchus assimilis
cgaaacgagcgaaaatctaggagccgctcacgtaattcgcaccgctgccggtctctcgacacaaaacatgactcagttcgccatcacccgcaacattcaacaactaggagccagtctaaccgccacttccgatagagaaaccatttcttacaccctagaaggcactagacaagccgtggaaaaagctctaccatacctaacagaagtagccacccaacaagtctttaaaccatgggaattggccgaactctcagaccgtctcagaatcgatttggccacaagacccttgcaattgcgcgcagtcgatttgcttcacaaagcagccttccgtacgggtttgggcaattcgctttacgcgcccaaattccaaattggaaaaatttcatctgaaactcttcagcattacgtgtcgagcaacttcacttcggctagaggggctgttgttggattgggactcgatgaatgcaaaatggacgagctggctcagtctttgactttggacgacagcaatggccatgttaatgtgagtccttacaaaggaggcgaaataaggtcggacaaaggtgggagttttgcctttatggctgtagcaggtgaaggggcttcggttaaaaaccctaaagaagctatggctactgctgttttgcaacgggcgctcggagttggacctcaaatcaaatggagcactgtagataatggtattttgagcaaggctatttgcagtagtgaaggctacgcctcttctgctattagtgctacctattcagacacagg

SEQ ID NO: 3126 - DNA, 185 bp, Ceutorhynchus assimilis
caacgaaatcgaacacgaaaatgaacgtatggcacaggaactatctgacaaaataggcgtcctgaaatccttatccatagacatcggtaacgaggtgcagttccagcacaaactgttgagggacgtagacgatgacatggatagaactggagggtttctcggcaaaaccatgtctagggtagtca

SEQ ID NO: 3127 - DNA, 750 bp, Ceutorhynchus assimilis
ttgacgtcatgaactccattgcccgtggtcagaagattcccattttttcagcagctggtttgccccacaacgaaatcgccgcccaaatctgtagacaagccggtcttgtcaaggtgcctggaaaatcagttctagatgaccatgaggataactttgctattgtgtttgctgctatgggtgtcaacatggaaaccgctagatttttcaaacaagactttgaagagaatggttctatggaaaacgtatgcttgttcttaaacttggcaaatgacccaactattgaaagaattattaccccacgtttagctttaaccgctgccgaatttttggcttatcaatgtgagaagcacgttctagttatcttgactgatatgtcttcatatgccgaagcgttgcgtgaggtatccgccgccagagaagaagtacccggtcgtcgtggtttcccaggttacatgtacactgatttagctaccatttatgagcgtgctggtcgtgttgaaggtagaaacggttccatcactcaaattcccatcttaacgatgcctaacgacgacattacgcatccaattcctgatttgactggttatattactgagggtcaaatctatgtagacagacagttgcacaacagacagatctacccgccagttaatgtgttgccatccttgtcgcgtttgatgaagtctgctattggtgagggtatgacccgaaaggaccactctgatgtatctaaccaactgtatgcttgct

SEQ ID NO: 3128 - DNA, 266 bp, Ceutorhynchus assimilis
gcggataaagaaacccaaacaataccatgcggtaaaccaaaagtacccgaaggttatcaggatttattgctagagtttaccataaattgtaatctccatcatccgagaaacctcgtcgattatgccgctgaatattttgccgccttgaaagatcaaaaacataccaagattgtctacgatctggtttgtactgagaaagaagaaaaaacagacagggacagtactgcttttagtgaagctacaacagtcacggattcggaattttc

SEQ ID NO: 3129 - DNA, 740 bp, Ceutorhynchus assimilis
agactattgaatccgccatcacgttggcccttggtgaaagctgtaattggactgatcaggaaccttgcactgtgccaggataacttcgcaccattacgggaatcttgtgctatcaattatttggtgcaattattgatgagagcttatcaagatacacagagacgagctagcttggcaagtggaggcagtcaacaaccaggaacttacgctgatggtgttagaatggaagaaattattgaaggtactgttggcgctctacacgttcttgccagagaattctacaatcgcgaacaaatcagacaacaaggcgttattcccgttttcgtacaacttctattcaacgacatcgaaaatatacaacgagtagctgctggagtactttgtgaattggccgccgataaagaaggggcggatttgatagagcaagagggcgccactgcaccgctgaccgagcttttgcattcacggaacgaaggtgttgcaacatacgctgcagcagtgctattccgtatgtctgaagataagcctcaagactacaaaaagcgcctctccatggagttatcaagctcactgtttagagaggagaacctttggaaccctgacctgggcatggggacagatttccaggatattttgagtccggaacaggcctatgataatatgtacgcccaagggccgcctagtgtacatagcagccacactggtaggccttatcagcaacaaggctatgaccagatacc

SEQ ID NO: 3130 - DNA, 654 bp, Ceutorhynchus assimilis
agcttgtatgcatgtgagaaatggcgtatgcacattatcagagaaatagctaaaaaagtcgctcagattcaaaacgctggtttaggtgaatttagaataagggatttgaacgacgaaattaacaaattgctcagggagaaacggcactgggaagaccaactaaaagaacttggtggtcctgattatcagaaaatcggccctcgaatgttggatcatgaaggaaaggaagtaccaggaaatagaggatacaaatattttggagcagcaaaagagctacctggtgtaagagagctttttgaacaagaaccacctcctcctcctagaaagacccgggcagagctaatgaaagatattgatgcagattattatgggtatatggatgatgatgatggtattttgataccactcgaaatgcaagctgaaaaaatagctgtccaaaaagcagtaacagaatggaaggcaaagaaagaagctagaaaggctgcaggtgaagcttcggatgaagaggatcaagaagtaagtgtatatgcagttgatgaggacgtagagaaagatgaaatactagaagatccaagtcagcaacttctcgatgggtcacaacaaagatttgtggctcacgtaccagttccatcacaacaagaaatcgaacaagcc

SEQ ID NO: 3131 - DNA, 501 bp, Ceutorhynchus assimilis
aaaaccacctttgtaaagcgtcatttgactggcgaatttgaaaaaaaatatgtagccaccctcggtgtagaagtgcatcccttagttttccacacaaacagaggcgaaatccgcttcaatgtttgggatactgctggccaggaaaaatttggaggtcttcgtgatggttattacatccaggggcagtgcgcaattattatgtttgatgttacttctcgtgtaacttacaagaatgtaccaaactggcacagagatctggtcagggtgtgtgagaatgttccaattgtactttgtggcaacaaagtggacatcaaagataggaaagtcaaggctaagagtatagtgttccataggaaaaaaaatctacagtattacgatatctctgccaaatccaactacaattttgagaaacccttcttgtggctggcccgtaaactaataggcgatcccaatctggagtttgtagctatgccagcgctcgtaccaccagaagtacacatg

SEQ ID NO: 3132 - DNA, 773 bp, Ceutorhynchus assimilis
agagaggttgcttctgaaagtggtgtggattcaacggacactttgttgaatgactacactgttacgcctcatgctacagccactccaagaacaccggcagcacaaactgacagaattttacaggaagctcaaaacgtaatggcacttacccacgttgatactccactcaaaggcggcctgaatactccattacataattcggattttagtggggttgtgcctcaacaacaagctattgccactccaaacactgtgttggctactccttataggtcagttaggagtgaaactggttcaactcctggaaatacaggttttatgacacccaaaagtggagctatggtgccagtgggtggaacatctacaacttatgtggcaccatctataagggataaattaaatattaatactgaagatgccctagaagtaggagatactccagcacagcatcttatgtatcagatgtccaccaagcagcaacttaaaatgggcttgagtagtttaccaacgcctaaaaatgattacgaaattgttgttccggataatgaagaacagactattccagaacaagctcaagaaaaatcaattgaagaccaagctgacgtagatatgagatatcaagaagaaatgaaagccaaagctgccaaagagcttttattgagatcacaggtgatccaaagagatttgcccaggccacaagatgttaacctctcagttttaaggcctgccaatgagagttactcactgactgagctccagaaagcagaagaact

SEQ ID NO: 3133 - DNA, 360 bp, Ceutorhynchus assimilis
ttgcacatccagacaaattgaaaaagaagattaccagagaacttatcactactatactggctaggaaacctaaaatgtgtagtttccttgagtggagagaccttaaaatagtgtacaaacgatatgctagtttgtatttctgctgtgcaatagaacaagatgacaacgaacttcttactttggaggtcatccatagatatgtggaactcctggacaaatactttggtagtgtttgtgagcttgacattatctttaacttcgagaaagcttactttatattagacgaactgatgttgggaggtgaaatacaagaaactagcaaaaagaacgttctcaaagcgattgctgcacaagatcttc

SEQ ID NO: 3134 - DNA, 774 bp, Ceutorhynchus assimilis
agctggaaagatttcagaggagatttcaaaaaccacacattcaattggggaaaaagcacaagaaataggtaaaactaatgcttttcaaagtatcagcaaagctactgaagcagttaaaaaagaaatggataccaatagtatgcaaggtagagtttacgttagtccaataaaacttcggaaaagaacagaaacctcggcggtacaaaaccaaaaacattacgaaccaaacacagaagcgatgggtattgagctacataaagattctaaattttatcagtcatggcaaaatttcaaagacaataatccatatgttcacaaagtcatggattggaaattaaaatttgatgaaagtgaaaacccagtaataagggcttcaagggtgctaactgaaaaagtatcagatattatgggaggactatttcagaaaactgagctttcagaaactttaactgaaatctgcaaaattgacaacagttttgatactaaacgatttttaaaacagtgcgaagctgacataatacccaatgtattggaagctatgactaggggtgatttggaagttctaaaagactggtgtcacgaaggtccttacaatctcttctcgattcctataaaagaagcttacacgaaaggttataaaatagagtcaaaaatcttagatatagataatgtagatctagtcatgggtaaagtaatggaacaaggtcctgttctaataatttcatttacttcccaacaagtaatggccgtaagagattctcagggaaatgtggt

SEQ ID NO: 3135 - DNA, 678 bp, Ceutorhynchus assimilis
aattgaagccgggactaaatacagtacaccaagcaccaaaaaaggcagttaacaatgttgaaggtttaaatcacaaactagaggaaatctatttaaatctaccatggatcgaaagattagactgcataaacgcacaagcacctttagctccagaactggctgctcaattaatggctcatgaacagaaacgagaaaaccaattaaagaataataaaaaactgccacagcttaaagcaagcgaggatcctatattgaatgattttaaaagggaaatggagtttcatagacaagcccaagccgctgtacttgatgccataccaaagttgaaggctcttggaatacctactaaaagacctgatgactattttgctgaaatggcaaaaacagacgagcatatgcaaaaaatcagagaacatttgatgacaaagcaacagcagcaacagagaagcgaaagagttaaacaactaagacaacaaagaaaagaaggcaaaatgcttcaaatacagaccaaactccaaaggcagcaagagaaaaaagaaatgctggaccaggttaaaaagcaccgcaaaggagtctcgaaagatctagacttcctggattccaaaaaaagcaaagctatttcgcggaaggcattggaaaagagaaatatgaaaaataagaaatttggatttggtggca

SEQ ID NO: 3136 - DNA, 725 bp, Ceutorhynchus assimilis
cacttcgaaactgaagaagcggcaaacaaatccattgaaaaagtaaatggaatgttgcttaacggcaaaaaggtttacgttggccgcttcattcctcgcaaggaaagggagaaggaacttggagaaaaagcgaagctatttactaacgtctatgttaagaatttcggagaggaattatcagaagaacaattgcgtaacatgtttgaaaaatacggaaagatcacgagctacaagatcatgaataaagatgatggaaaatcgaaaggatttgggtttgttgcttttgaatgttcggaagcagctgaggcagcagtggaagcacttaatggaaaagaatcagttgatgggaaacctctttacgttggtcgtgctcagaagaaagctgagcgccaacaagagttaaaacgtcgctttgaggctttaaaaatggaaagacttaaccgataccaaggtgttaacttgtatgtcaaaaatttggatgacacaattgacgatgaacgtttacgtaaagaattcactccattcggaacaataacttcagctaaagtaatgatggaagaagggcgtagtaaaggttttggttttgtctgcttctcctcccctgaagaggccaccaaagccgttactgaaatgaatggacgcatagtcggctccaaacccttgtacgtggcattggctcagaggaaagaagacagaaaagctcatttgacatcccaatacatgca

SEQ ID NO: 3137 - DNA, 751 bp, Ceutorhynchus assimilis
aaatctcgatacactggacgaaccagaagctcgtgcctcaatggtatggattatcggtgaatacgccgaacgaatcgataacgctgacgaactcttggacagtttcctggaaggatttgccgatgaaaacgctcaagtacagcttcagttactaacagccgttgtaaaactgttcctaaaacgaccacagcacactcaaggtctagtgcaacacgttctaagtttggccactcaagattctgataatcccgatttgagagatagaggatttatctattggagattattgagtaccgatccggccgcagctaaggaagtagttcttgctgataaaccactgatttctgaagaaactgacttattagagcctacactgttggatgaattaatatgtcacatttcatctttggctagtgtctatcataagcctcctacagcttttgtggaagggcgcagtgctggtataagaaaaacgttaccagcgcgtcaagggtctgaagaagctcctactcaggaagcaacagttattccaaatcaggagagtctcattggagatttattgtcaatggatcttggggggccaactatacccactccagctgctgcacctgttgttgctccaactagtaatgtggatctgttaggtggaggattagatgttttgttgggtggtggtccagaagtaaccagcaacgtaggtgctgctccctcaaccacaggccttctaggtgacatcttcggaatcacaaca

SEQ ID NO: 3138 - DNA, 382 bp, Ceutorhynchus assimilis
gaagtaggagccacatcatcccttgcccctaaaatcggtcccctaggtctgtctcccaaaaaagtcggtgatgacatcgccaaaggcacagccgattggaaaggtctgaaaatcactgtacaattgaaaatccaaaatcgtcaggccaccatttctgtatgcccctcagcggcttctctaatcattaaagctttgaaagaaccaccaagggatcgtaagaagcaaaagaacatcaaacacagcggtaacatttcttttgacgatgtaatctctatcgccagacaaatgaggccccgttccatggccaaaaacttggcaggcacagttaaagaagtcttaggtactgcccaatctgttggctgcacaattgatggtaaggcac

SEQ ID NO: 3139 - DNA, 655 bp, Ceutorhynchus assimilis
gaactagccgatgaagctaaaaaattgggcgtgaaaatggtgttttcgcatgaaactgaaccgctaggaactgctggccctatagctttggctggagaacatttgagaaaaagcgacaaaccgtttttcgtgttaaactctgacatcatttgtgattttccatttaaaaagttgattgaattccacaaatcgcacggcaaagaaggcaccattgtagtgacaaaagttgaagagccttcaaaatacggtgtggtagtttacaatgagcaaaagtgcattgaaagctttgtagaaaaacctcaggaatttatttcaaataaaatcaatgcgggattgtatgttttaaatcctagtgttattgatagaatagaacttaaaccaacttcaattgaaaaagaagtttttcctaatatggcaactgacaatcaattgtttgccttcgagctggaaggattctggatggatgtgggacaaccaaaagactttttgattggaatgtgcttgtatcttaaacatttgaggagtgcagatccagagaaattgtacaggggaccaggcgtaataggtaatgtcttagtagaccctacagcaaaaataggcaaaagttgccaaataggaccaaatgtcaccatcggcccaggtgtagtaatcgaag

SEQ ID NO: 3140 - DNA, 724 bp, Ceutorhynchus assimilis
ggcgagtttaacgaggtatttaatgatgttagaaaattgctggacaacgacgacctgctcaaagagggggccagcggggcattcgcccaatacaacaaggaccaactgacccccgtccgaatagagaattctgatcattgggtactgattactgaatacaacgatttaggaaataataggttttttgatccccgctccaaacaaagtttccgttatgaccacctcagaaaagaagcgtccgactaccaatcctacagcccggatacaacagccgaaccgtggcggtctgccctcgacacagaatttgttcaatacacaagaaatcactataaagatggtgtatgcagcgttatagggcgcagccaagggggcgtggtcagtttgacagcatgtatcgaggaccatcagtttcaacccaaaaatttctggaatggtagatggcgtagtcaatggttcataaccctaaacggtacctcaggtgccgaactacgaggtgtcctcaaagtacaagtccactactatgaagaaggtaacgtgcaactggtcagcaccaaggaaacaaaagacacagtcagcattaccactgaagcacaaactgttaaagatattgttcaggcaatagaggctgcggaaaatctttatcaaactgctatttcggagaattaccatacaatgtctgatacgacttttaaagctcttagaagattattgccagtcacacgta

SEQ ID NO: 3141 - DNA, 718 bp, Ceutorhynchus assimilis
tacaaacgaaaacgcaaacattagaatttcgctttggggctaccgcgaaacctccataagaccctcactattatacattacagatatagctgaaaacgtccaaaacactggagagtacacgatagtaccttcacagtaccgcaacagagaaaacacctttttaaccgacataaaattcggcttcattcaaatcaatttaaccgaatcaatacctattcagtacgattatagcggtaccactcaaacaactacccaagctacaaccattaaccctgtagtatggagcaggcctatacctttaggctggtacttcggctggcaatgggaacgcatgtacggtaccaactggcccaaaaccttatgcgacgattggctaaggaccgacagatacctaaaaaactttgcccacgagctaccgcaatgtccttgcaccctggaacaagccctcatcgacaaaggcaaatacatgcccgattttgattgcgacaaagactcaaaccccacttgctactacaacaaccaagcagtacattgtgtgagaactggttctcctacactagaaggttccgagcaacagtgttgctacgacaaaaaccactacctaatgttgtcttatgaccaacaatggggctccagcccgaaacgttgccacaatttaggcctaatgccgtaccaggaagcaacaaaagtacccactttgtctcaatggttcaacgat

SEQ ID NO: 3142 - DNA, 193 bp, Ceutorhynchus assimilis
aatccttgggtcagtaggtatcgaagctgaagcagaaaaactgaaaaaggtcatctctgagctcaatggcaaatccatcgaggaagttatttctcagggccgagaaaagttgagctccatgcccactggtggcgctgctgcacccgccgccgccgctggtgctgctccagcagccgaagagaagaaagagtcc

SEQ ID NO: 3143 - DNA, 764 bp, Ceutorhynchus assimilis
agaagtcataaatgctgccaggattttggcagctaggcctcgtagcaaagttgctcaagagaatatggacgcgtttagacttacttgggaaaatcaggtgcggattttaacagatgctattgatgacataacaaccgtggacgatttcttggccgtatccgaaaatcacatcttagaagatgtgaataaatgtgtgttagctctccaggaaaatgaagctgatactctggaaagaactgctgctgccattagaggtcgaactggacggataggagttgttgttgcagccgagatggataattacgaaccttgtatctataccaaaagggttttagaagctgtaaaggtgctcaatgatcaagtgatgccaaagtttacacaacgcgtacaagttgccgttcaagcaataataaatggacaacagggtcaaccctctaaagaattggacgaaaatgaatttattgatgcttcaagattggtctatgatggcgtcagagaaatccgcagggcagttcttatgaacagggctgatgaagatttggatccagaagatgttgaacttgatgaaaattatactttggagactaagagtaaatcgagtgcccatacaggtgaacatggtgttgatgaatatcctgatataagtggtatcacaacagcccgtgaagctatgggcaaaatgccagaagaagaccgtaagaagatccttcagcaagtagaatacttcagaagtgagaaactcaagtttgacagagaagtggcta

SEQ ID NO: 3144 - DNA, 776 bp, Ceutorhynchus assimilis
aggatttggtggttttggattgggaactgcaggtaagcgtccagctcctgcttctgtaacatctacagctgcaaccagtgtgccaggacttcagttcagcttcagttcaccagcttctgcagctgcaacaactgccacaactactttcactcctattgttggttccactgcaactagcactataaatgttccagcaacagctccaacttccagtgctccaaagctgggattaggtgttgcacctactactactactccggcaaccacaggattttctttgggtttaggtagtacagctgccactacaacaactgttacttcagctcagtcgacaacttctacagcagccactacaaccactggatcactgacttttgcccaattagaagatgcaatcaacaaatggactattgatttggaagaacaaggaaaattctttatcaatcaagctaagcagcttaacgcttgggacactttattgatttcaaatggtgacaaaattctgaatttgaacaccaacattgtaaaagtacagcaacaacaatcccaactagatcaggaattggattttattagtgctcaacaaaaagaactggaagaactcctggtgccactagaaacagaattaatggatgttcctgcgactgatatcaacaggaaccaaatgtatcagttttcagaaataattgattcacagcttaaacaaatttctgatgatctaaaagaaatcgttgaaataattaatggttcaaataaagaccaggacacttcaaatc

SEQ ID NO: 3145 - DNA, 449 bp, Ceutorhynchus assimilis
cttcctgggtctggataatgccggaaagacaacactgttgcatatgctcaaggatgatcggctagctcagcatcttccaacgctacatcctacatctgaagaactttcgattggcaacatgagatttactacttttgatttgggaggccacacacaagccagaagagtatggaaagattacttcccagcagtagattcaatagtgttcttggtagacgcctacgatagatctagatttaaagaaagtaaacaagaattggactcgttactcacagacgaaagtttggcaaattgtcctgttttgattttgggaaataaaatcgacttgcccggcgctgcttccgaagacgaacttaggaattactttgccttgtatcaacaaacaacaggaaagggtaaagtgccaagagcagatcttccaggacgccccctggaactctttatgtgct

SEQ ID NO: 3146 - DNA, 423 bp, Ceutorhynchus assimilis
aatattgcccaaggaaacctcgttggaaaacaagtcccaggccatcaccgatttactgttgcagtctcaaacgatgatcacttccgctctgagctgtcgagaatcaatcacttctatcctaggccacatgactacaatcaacaactatttggacccttgcaattgggaaaacgatctggaagttgaagctaagaggcattacttattggaattgtatccagagctcagaaacactgtccagctggtacgttctgtccaaaaactcatcccatacaccaactcagataagatcatgaaagtgactgagctgtcaggcaaactggagcagctgactgaaaccaatctggttgtatactcagaaagtcgagacgtgactcagaaggtgctaaaatcattgcaacaatacaatgacatcaccacctc

SEQ ID NO: 3147 - DNA, 742 bp, Ceutorhynchus assimilis
aggagacagagcttcttttgttcaaattagagggtcaattcctttattttggttccaaaaacccgacctcaggtataaacccagcattgatattgaccatagtgtcgatcctcaggagcatcaaaatgcttgtctgaggcatattgaatcgatggccggagtttatggcaggcaagttatggttgatttggtcgatcaagttggatcagaaggtagattagaaaaagccttcaaagacaccatcaattatttagctcatccgtccgtgagatatgaaccattcgattttcacgccgaatgtagaaaaatgaaatggcatcgattatcaattttaatagacagagtgtctttggatcaggacgaaatggggtactttttgattttgaaagatggtactctgtcctcattacaagaaggtgtctttagaacaaactgtatagattgcctggatcgtaccaatgtagtccaaagtatgttagcgcacaggaatttagaaattgtgcttaggaaattcgatattttaagcccagatcaaaagctagaaatgcaactttctttcgagtctttgaacaaaaatgtttgggctgatcatgccgacctcatcagtactcaatattcaggtactggagctttgaaaacggattttactagaacgggcaaacgaacaaaagcgggacttattcaggatggaatcaattcgttgatgcgttattataagaataactttaacgatggtttccga

SEQ ID NO: 3148 - DNA, 685 bp, Ceutorhynchus assimilis
cgtgtaaagtacagcaacaccttaccagacttaccatttgatctgaaatttatctcctacccctttgagccttcaagatttatccaatacaatccaacctctttggaaagaaactatagatacgatgtccttacagagcatgatttgggcgtaaatatagacctaataaacaaggacacttatcctactgaaccgggtgttgttttggacccagctgatgagaaacttctcgaggaagatattcttgcgccacaagattcaaaaagatcccggcaccatgctaaagcagtctcctggcttagaagaactgagtacatctccactgaacaaaccagatttcagccacaaacaatggacaaagtggaagccaaagttggttttagcattaaaaaatctctcaacaatgaaacacattatatggatagaaatgcgcaaattgaggctattgaaaaaacctatgcagactccaaaatacctattgaaaagcactatagtaaacccaacgttgtaccagttgaagtgtttccagtttatcctgatttcaatttgtggaaatatccttgcgctcaagttatatttgattcagatcctgctccggttggtaaaggtgttccagctcagattgaagaaatgtctcaagcaatgattcgtggtgtgatggacgaaagtggtgagcaatttgttg

SEQ ID NO: 3149 - DNA, 790 bp, Ceutorhynchus assimilis
tatgaactcgtttgccaagacgccggctggaaaaaagacgaaaaactcctgaaaaccttcaaaacgaaaaacgaggaacaaataaagaagctggacgaagctattgaagatgcggaaaagaatttgggcgaaatggaagtgagagaggcctacttgagaaaagccgaatactacagtagaataggtgacaaagaaaatgccatcagcaccttcaggcaaacctatgacaaaactgtatctttggggcacaggctagacatcattttccacttgataagaatcgggttgtttttcatggaccatgatcttatcacgaggaatattgaaaaagctaaaaccctgattgaggaaggaggcgattgggacagacgcaatcgcctcaaagtttatcaaggggcttactgtatggctgtaagagactttaaaactgctgctaacttgtttttggacactgttagcacttttacttcgtatgagttgatggattataaggcttttgtacgttatacggtttatacttctattataagtttgccaaggaatcaattgagggataaggttgtaaaaggttcagaaatccttgaagtattacactctgagcctttcgtcaaagactacctgttttccttgtacaattgccagtacgccgattttttcaaaaacttagccaaagtagaagagatattgagaaaggactacttcctcaacccccactacagatactacatccgggaaatgaaaatatcagcttacactcaactgttggagtcttacaggagtctcactttgc

SEQ ID NO: 3150 - DNA, 659 bp, Ceutorhynchus assimilis
tgtgggtttagctcagttacctggcgtaagggctggttggcaatgtagaaaatgtcgcaattgccaagtttgtcgaatgatgggggacgaaactaaattgatgagttgtgagcagtgcgacaaggtttatcacgccagctgtcaacgcccattagttacgtccattccaaaatatggttggaaatgtagatgttgtagagtatgtggcgactgtggttcccgaacaccaggcgctggtctatcttctagatggcatttacactatacagtttgcgattcgtgctatcaacaaagaaataaaggttgttgttgcccaatttgtcaaagggcttatagatcacatgctcatagggaaatggtgcaatgtggaacctgccgaaagtttgttcatgggacatgtgatccagaagcagatttggtaacatatcaacagaaaaaggaaataaatcctgattatgagtatcattgcgttatttgtaaaaattcattgcagcaactctccagccgccctgtcactagcaaaagatcaagtctagatgactttggagatttgtccgcttcccaagaatctttatatgatgacatatcagaatttgatatgccttctgaagaatctttcagagggacagggttgggaaaaggcaaaccatatgcaagta

SEQ ID NO: 3151 - DNA, 762 bp, Ceutorhynchus assimilis
cgcgatgtttctacgtttagtaaactgagcagggtcaagcgggcagaaaagggccgcttggtacaagatttgtttaccggacgtttggtggcggatttaaaaatttccgccaaagaattaatcaagtccagaacgtacgatttgccaacgctttgtcagcaagtccttaagctacgagaagaccaaataacagatttggaaccagacgaggttgtaagaatgtatgaaaacacagaagatatttttaaattaatagaatatacaatgcaagatactgcttatatgctcaaaatcttatacgatttaaacattattcctttggcattgcaaataaccaacatagcaggaaatattatgtccaaaacacttatgggtggcagatctgagagaaatgaatatttgctgatgcatgcttttcaagaaaaggactatattgttccagagaagaagttcaaaagaagaagaaacaataatgatagccaacaagtagctaagaagaaacctgcatatgcaggtggtttggttctggaacctaaaatcggcttctacgacaaacttcttttactcatggattttaattcactttatcccagcatcatacaagaatacaatatttgttttaccacattacccaccacagacgaagacaataatttagttttgcctgataaaaatctacctcccggcatcttgcctgtggaaataaaaaaacttgttgatagtagaaagcaagttaaaaagttaatggccactcctgatcta

SEQ ID NO: 3152 - DNA, 714 bp, Ceutorhynchus assimilis
ggcggaaaaatgattgagagtgttttaaaggaaaaagttcaatcgggagatgttatatttattgataaagcaactggaaaaattacacgtattggtagatcatttgcaagagcacgtgattacgatgccacaggtgctcaaaccagatttgttcaatgccctgaaggagaattgcaaaaaagaaaagaagtagttcatacagttactttgcatgaaattgatgtaattaatagcaggacgcatggatttttggctttattttcaggtgatactggagaaattaaacctgaaataagggaccaaattaatggaaaagtggcagaatggagagaggaaggcaaggcagaaattgtccctggagttctatttattgatgaggttcacatgttggacattgaatgcttttcattcctgaacagagcattagaaaacgaaatggctccaattgtaattatggccaccaatcgtggcataacaaaaatcagaggcaccacctacaaatctcctcacggcattcctttggaccttttggatcgtacaattattgtccctacaagtccttacgaagagaacgaactcaaagaaattctgagcatccgatgtgaagaagaagactgtcaaatgtcagataatgctttgactgtgctgacaagaatatctaaagaaacttctttgagatatggtatgcagctgatcatgacgtccagtttgatt

SEQ ID NO: 3153 - DNA, 760 bp, Ceutorhynchus assimilis
ggatgttcagaaggtccattacaaatgaagaaagaaaacgattgattgatttgggactttcacaacactgccttgccagtagtgtatctttgctaagggcttctgaggtcgaagacatcatcgaaggaaatgatgacaaatataaagctgtctcggttcatacaagtgacccaccagtaccaagggaaggtaaaagcaaaaagaaccaacaatgggtaccatctttgccaaattccagtcatttagatgctgtaccacaagctactccgattaatagaaacagagttgctgcaaaaaaagtaagaacttttcctttgtgctttgatgataccgatccccagctcaacattgaaaatggttgtcaacaagaggttctggtgcccatccgtttggacatggaaattgaaggacagaaattgagagacacttttacttggaataaaaacgaaagcttaataactccagaacaatttgctgaagtcttatgtgatgatttggatttgaatcccttgacttttgtgcctgccatttctcaagctatcaggcaacagttggacgcttttcctccagaacctcctagtattattgaggaaaacgctgatcaaagagttattattaagctgaatatccatgttggaaacacttcattagttgatcaagttgaatgggatatgagcgaaaaacaaaacaatccagaagaatttgctttgaaattgtgctctgaactgggattgggcggagagtttgtcacagcaatagc

SEQ ID NO: 3154 - DNA, 474 bp, Ceutorhynchus assimilis
agtaattgtcggtgatggagcctgcgggaaaacttgcctgttgattgtgtttagtaaagaccaatttcctgaagtgtacgtgcctaccgttttcgaaaattatgtggccgacattgaagtggatggaaagcaagttgaactcgctttatgggatactgccgggcaggaagattacgaccgtcttcgccccctgtcttatccagacacagatgtgatccttatgtgcttctcagtagactcgccagattctttagaaaacatacccgaaaaatggacccctgaagttaaacacttttgtcctaatgtacccattatcttagttggtaacaaaaaggatctccgtaatgatcccactacaatcaacgagctgaaaaatatgaagcaagaaccagtgaaaccgcaggatggtagatctatggctgaaaaaatcaacgcatttgcttatcttgagtgttcagctaaaagcaaggaagg

SEQ ID NO: 3155 - DNA, 797 bp, Ceutorhynchus assimilis
acacaacggcttgtacttatatttatgcagaattttaaggcttatttggaatagacattgtgtggaacgtttctgtcctgatggtgaattcgctttgtttcaaagcagcatatctgtagaagactgtatcaaattgcaaaataatttaaatgccctgcacaattttttgactttaaatactgatttttctggaactactaatcaaatggcaattcataataattctacattgaatcaaactttggtgcgtcagcctgtcacacttcaggacgctcaacttatagaacgcaagtctttggatgccctaaagacttttctgtgtcattgttgtcaaattatgggcttgtggaggatattgtgcgatcatcaatttcacgagctggtcgcttgtttgccggacaacgaccaggaaattttgcagaagactactttcaaggaattgttccttttcagaaaagacatttgcactgttttaatacaaactttggtgaatagctatttaggtgataatgcttcagtggacgctattagtaataggcttatggaggtttgtccgcatttgtataagcctgaggatgctgcttttacgaaggccagcgaacttctcaaaacaacacgaggcatacaaaacgtagatgaaagagaagagaaacttttaacggcgctgcaactctgcaaaaatatagctccaaatgtgaaacttcctgtggtttgcaaacaattcactgccttaaaagcttacaaggctgtcatagaactttgcgcctactgtgctagaaggatagaccccgacaata

SEQ ID NO: 3156 - DNA, 656 bp, Ceutorhynchus assimilis
cagtgtctatatgcgtccaatggaaggaggaggaacttggaggcctgtcatcaaggaagctgttcacgaaaaagaggcacttgatggaaaatcagatcctcgtcaagtttattcgcagcaccttttccatcctggaagatttccattatacacattgaataaatctttggggactttaatgaaaaacgaagtcaaattaacatcagtggcagccctaaaacaagccatatgcctagcaatagaaaacgatatccaaaatcaattcgccgacatcgaagatataaccgacgaggaatatttggaaaaagccaaatggtgctgggaaaaattctactcaagttgctgtcagtattatcaaatcagcctgaaacccttaggcctgatgcttctgcctcaaaactctgcagctattctcattaggaaagcaaccttttcacttgtcagacccatggaacctttggaacatatgtttttgtgcaacgattccggtttcaaagatcagtttataaattttgctcttttgggcgaagaacaagacttactggataatgtcaagaaattatttgatttgattgtctttattgagagtcaaatgagcaaaaatttaaagactacttttgaaagggaaattggtattactttgcaaccaaagcttg

SEQ ID NO: 3157 - DNA, 800 bp, Ceutorhynchus assimilis
gtttgttagtaggcacaggattagaaccaaaaaatgatttactagtctccaatgcattgcaatttttatctaccgtagccgaaagaaatcattatagaaatttatttgaagacgatcaagttttaagcagcatttgcgaaaaagtcatcatcccaaatatggaatttagagaatctgatcaagaattgtttgaagataatccagaagaatttacaagacgagatatcgaaggctcagatgtggacacaagaagacgtgcagcatgtgatttggttaacactttaagtgtgcatttcgaggaaaaaataatgaaaatttttggtcagtatttacaagtcatgttagccaaattcgcagagaatcccaaaagtaactggcgacacaaggatgcagctttatatttagtgatatcgttagtcagcagaggagcgacacaaaaacacggagtaactcaaaccagtaaattggtagatatttcccaatttttccagcaaaatattgtagctgagttacagcggcccaatgtagacgaacttcctgtactgaaagctgacgccataaaatatttgatgactttcagatcagtgttgcccagtactttagttgtttccagcctgccccagttgattagacatttgagctgtgaaagcgcggtagttcacacttatgcagcttgttgtatagaaaaaatactaatcatgagagatagtaataatcatccacatgtgacaggagctcaaattcaaccttttgctgctgaattaatttcacaattgtttggagttttggagaagccagta

SEQ ID NO: 3158 - DNA, 475 bp, Ceutorhynchus assimilis
gaacccgtttcaattcgaaatcacgttcgagtgtattgaagaacttaaggaagatctggaatggaaaatgatatacgttggatcagctgaatccgaggaattcgaccaagttttggattctgtttttgttggccccattccagagggcaagcatatgttcgtattccaggctgatccaccaaacgtttcgagaatcccagaaaacgacgctttgggtgtaacagttgtccttctaacctgctcctacagagcccaagaattcataagagtgggctacttcatcaacaacgagtacagcgatcccgagctcaaggaattgccacccagcccaccacaattcaacaaagttaccagaaatatcttggcttcagaacccagagttacccgattcaaaattaactgggaagaaccgaacgctcaggaatccatgcctggaccatcagaaaatgccgagcctatacctatcccgccacta

SEQ ID NO: 3159 - DNA, 651 bp, Ceutorhynchus assimilis
gcaaccaataacaagtcaggtgccccctttggccccaatgggtgggctaacgcccactttaagtttgggcatgggtaatgccattgcaatgccccatacaaaatatgtgactggtttcagtatgcctatggggggtaataatagtggaatgaccccacagacacctcaacattcaatgatgacttcgatggtaaatttggggggtacagggggtagtacccccagtatgacccccatagtgggagggccttcgactccaagcccgatgacccccatgacgccccattctgctgatcctggaatcgtacctcaattacaaaacatcgtatccacagttaacctaaactgcaaactggacctgaaaaaaatcgctttacatgccagaaatgccgagtacaacccgaaacgtttcgccgccgtcataatgcgaataagggaaccccgaaccacggccctgattttcagttccggcaaaatggtgtgcaccggagccaaaagcgaagaagattccagattagctgcccgaaaatacgctcggatcatccagaagttgggattcaacgcaaagtttctggattttaaaatacagaacatggtcggcagttgtgacgtaaaattcccgatccgtttggaaggtttagtgctgactca

SEQ ID NO: 3160 - DNA, 334 bp, Ceutorhynchus assimilis
gctacgctgaagaaatgaactttacttttgctgctggaaaccaagtattttatgatggaaaaagtgtaaaacaagttgacgtaccatcattctcaggcagttttggtatcctccccaaacacgtccccactttggctgtcctcaaacccggagtagtttctgtatacgaagaggatggtggtgtcaaaaaaatctttgtatccagtggtacagttactattaatgaagactcttcagtacagattttggctgaagaagcacatccaatagaaaatattgatgcttcagctgctagagaacttctcactaaatcacaaagtcaactttcttcagc

SEQ ID NO: 3161 - DNA, 741 bp, Ceutorhynchus assimilis
tgaaagaataagccgttccagccgtgaggccgaactgaaagcaaaaaaagaaaaagaggctgcgagaaaagctaaaaaggaggctaaaaagcttgaagagcaatctgttcagcctgcagaaattaaagaactgacagatgaagaagcggaaaagttgcaaaaagaacttgacactaagcaaagtgttgaaagtgttgcaacctcaagcgcagttggcacttcttctgaaacaacggatgaggtaactgaagaggaagaagatgaatcagaaaagggaaaaattaaacctaataaaggcaatggttgcgatttgggcaagtacaaatggacgcaaacattacaggatattgagttgagaattcccttgaacaaaaactatcaagtcaaaggaaaagatctggtagtcaatctaacgaaaaagcatctcgtttgcggattcagaaacgaacctcctattatcgatgacgattttcagcatgaaattaagctagaagaatctacatgggtgatagaagacggaaaaactctactttttaatttggagaagatcaacaaaatgaactggtggggcaaactagtcatgtcggatcccgaaattagcaccaagaaaattaatcccgaaccgtcgaagctcagcgaccttgatggcgaaactaggggccttgtggagaagatgatgtacgatcagagacagaaggagatgggtttgcctactagcgacgaacagaagaagcaagatgc

SEQ ID NO: 3162 - DNA, 325 bp, Ceutorhynchus assimilis
gaaagatgggtttgcctctatccagcctacataaacagcaaaaagtccttggccgaaggcagaagaatccccagaaataaatgtgttgaaaacccgacttaccaagaaataagggatgttcttgctgcagcaggtttgaatgttggagttgaaaacaagctctacagccgcgaaagaagcaaagaactcctctacagaggtcgcattcgcgttcaactcaaaaacgacgacggctctttggtcaatcctgcattttcttcaagagacacactgatgcttcatcttggtgacatgataccaaagctgaaaacgcgtttgcataaac

SEQ ID NO: 3163 - DNA, 726 bp, Ceutorhynchus assimilis
ctacgaagaactagaagcccaagactatgacagaactagacaagtatacaaagcctgtttggaactactaaatcataaagtgttcactttttccaaagtttggttgctctatgccaaatttgaaataaggcaaaaaaatttaacatcagctagaaaaatacttggaatggccataggcatgtgcccaagagacaaattattccgcggctacatagagatagaaattcagctaagagaatttgacaggtgcagaaaattgtatgagaaatttctggaatttgggcctgagaattgtgttacttggatgaagtttgctgaacttgaaaccctattgggcgattttgagagagctagaggcatttatgagcttgcaattaatgtgcctagattagacatgccagagctgctatggaaatcttatattgattttgaaatagctcaagaagaaccagaaaatgctaggcaaatttatgagagacttttagaaagaacttcacacgttaaagtatggctgtcttatgctaagtttgaattaaaccaagagtctgatgatggtatgaacattcgtttggccagaagagtgtttgaaagagctaatgaaaacctgaaaagttccccggacaaagagagcagggcgttgctgtttgaaaattggaaagagtttgaaaatatgcatggagatgaaacatctctgaacaaaatcaccaacatgatgcccaagagaat

SEQ ID NO: 3164 - DNA, 770 bp, Ceutorhynchus assimilis
accgggcattatttaatggtgcacaaaaattatttggcatggttatcactgttggtcaagctattgtctatgtaatgacaggtatgtacggagatcctgcagaaattggagcaggagtatgcctcttgatcatcatccagttattcgttgctggacttatagtattgcttctggatgaacttttacaaaaaggttatggattaggatctggtatttctcttttcattgccaccaatatctgcgaaacgattatctggaaggccttctcaccagctaccgtcaacactggacgtggtactgaatttgaaggagctgtaattgccttgttccacttgctcaccaccagacaagataaaatcagggctttgcgtgaagctttctaccgccagaacttgcctaacttgatgaacttattagccactattttagtgttcgctatagtgatatacttccaaggtttcagggtggacctacctatcaaaagtgcaagataccgcggacaatattccagttatccaatcaaacttttctacacctcaaacatacccattattttgcaatctgctctagtttccaacttgtatgtaatatcccaaatgctggcagtaaaattccaaggcaacattctgattaatttactgggcgtttgggcagatgtaggcggtggtggcccagcaagatcgtaccccatcggtggtttatgttactatttatctccaccagaaagtgtgagtcacattctcgaagatccagttcacgctttcctttac

SEQ ID NO: 3165 - DNA, 339 bp, Ceutorhynchus assimilis
cttctacgcctctcatgtaccctctacgtaggcaatctatcattctacaccactgaagaacaaatatacgaactattttcaaaatgcggcgaaatccgtcgaatcattatgggcctggacaagtacaagaaaaccccgtgcgggttctgctttgtcgagtactacattcgtgaggacgcagaaaattgtttgcggtacattaacggtaccagactggacgataggatagtgaggactgattgggatgcgggctttattgaaggccgtcagtatggacgaggtaaaactggcggtcaagttagggacgagtacaggacagattatgatgcaggaagaggc

SEQ ID NO: 3166 - DNA, 728 bp, Ceutorhynchus assimilis
aagaaaagcactggttggtagcctgggtatactggcaggaggagctggagccattattttcgccctggacaggtccgtgagggcttctgaattagaattgcacccacctaagaacccatggagccacaatggctggtttgattccttagatcatgctagtgtaagaagaggttacgaagtttacaagcaagtatgttcggcttgtcactcattgaggtttattgcttaccgtaacttggtaggagtgacacatactgaggaagaagctaaggctgaggcagaagaacaaatgattactgatggacctgacgaagctggtaacatgttcaaaaggcctggaaaactgtccgactacatccccagtccttatcccaatgaagaagctgctagagcagctaacaatggtgcctacccacctgatttgagttatattacgttggccagacatggaggtgaagattacattttcgctcttctaacgggttaccatgatgctcctgctggaattgctctaagagagggccagtatttcaatccgtactttgtcggtggtgctatttcaatggcccaatctttgtacaacgaagtaattgaatatagtgatggaacaccagcctctgccagtcaacttgctaaggatgtatcaactttcttgaaatggaccgcagaaccagaattcgacgatcgcaaacgcatgatggttaaggcgatcggcattttcaccattt

SEQ ID NO: 3167 - DNA, 748 bp, Ceutorhynchus assimilis
tttttccgcaaaaaccctacaaatatgcgcggcccccacagtcctaccccccgccattgacgaagacaaaatccacatccatcccgatactgtagagctccaatacaaccccaaatacgaagagttatttgctccaactgtggggcccacaaaccccttcaaacccaaacatcaagaaatcgaaaaaaacacgctttccggccacgtagaaccggcccatgtaagcgaattccaattcgaaaaccaacgccgcacctttgcaagttacggctacgctttggacccctctataagcgcacatgaacaaggcctcactaaagtaattggcgactcagaagaagccaccgattcactcaaaactgtatttgaaaagacccaactcagacccttggacaaaaggaagcgcaaaaaaaacgacaaaccggacgatattgaagggtttttaggcccctggggcggattcgaagacgaacaaaaaatcgcaaggcctacagaagaagaacaggccgaattgcaagaacttgtaagcaaaagaaccaaaaaaggcaaagaacctgaagaaaaacacacagaagaaaaatcagtgttgcacatcaaagatgccattgattatcaaggcagatccttcttgcacgccccccacgatgtcggagttaacctcaaatctgacatgcctcctgataaatgcttcttacctaaatcccacatccactcctggaccggacacactaaaggcgtctcagctatt

SEQ ID NO: 3168 - DNA, 672 bp, Ceutorhynchus assimilis
agctcctcttgctgtaaaaaaagtagaagcaaagaaagaagtaactcctttattcgaaaagaggccaagaaactttggaattggtcaagacatccaacctccacgtgatctttccagattcgtaaaatggcccaaatacatcagaatccaaaggcaaaaagctgtcttacaaaaaagattgaaggtgccaccaccaatcaaccaattcacccagactttagataaacaaacagcaactcaacttttcaaagttttggaaaaatacaggcccgaaactgcccttcaaaagaagaacaggttaaaggcaaaagctgaggctaaagtggctaaaaaagaagaggctccctcaaagaaacccaacactcttagggcaggtaccaacactgttaccaagttaattgagcaaaagaaagcccaattggttgttatcgcccatgatgttgaccccattgagcttgtactcttccttccagccctttgcaggaaaatgggagtaccatactgtattgttaaaggaaaggctcgtttggggctccttgtcagacgtaaaacttgctcagctgtagccttgacccaagtcgattccggtgacagatccaacttcaacaaaatcgtcgaagccatcaagaccaacttcaacgatcgcggtgacgaaatccgtaaacactgggg

SEQ ID NO: 3169 - DNA, 768 bp, Ceutorhynchus assimilis
tcttcgagtctctggtatgtattggggcctcacagctctggaactaatgaaagcacagcctgtgcaaagtaaagaccacattattgcttatattaaacaatgccaggacccacaaagtagaggaatcagtgcttgtattggtcacgatccccacatacttcatacactttctgccgtccaaatattggctatgtacgataaacttgatgcaatagactgcgaaggggttgtgaagtatgtacaaagtctccagcaacctgacggaagcttttcgggcgataaatggggtgaaatcgatacgcgtttctctttttgttctgttatgacgttgactttgcttaaaaaagaggatgctgttgatttggacaaagcagtggaatttgttcagagttgtaagaattttgacggtggatatggatcgaggcctctatcagagagtcacgcaggattggtttattgtagtgtaggatttttttcacttacaaagagattagatttggtggatagagatactttggcttggtggttgtgtgaaaggcaactaccttcagggggcttaaatggtaggccagaaaaattaccagacgtttgctattcgtggtgggtattagcatctttggctatattaggaagattacattggattgatggagaagcgctgaaaaactttatttttgcttgccaagatactgaaactggtggttttgcagataggcctggagatgtagcggatccgtttcacacagtatttggaattgccgcattatc

SEQ ID NO: 3170 - DNA, 656 bp, Ceutorhynchus assimilis
aagccatgccaacactaatagaacttatgtatgatagcagtgttgtagtcagagatacagcagcttggaccttcggcaggatttgtgagataatacctgaagctgccataaatgaagcctttttgaaaccattgctggaaagtttgattactggacttaaagctgagcccagagttggagcaaatgtttgctgggcattttcaggtttggctgaagctgcatatgaagctgctaaccgcgacattggcggcggtgatgatccaactcctgaaacttattgtttatcgcaatattttgaatttatagtgcaaaggctattggaaactacagacagaccagacggggcacaggccaatcttaggcctgctgcctacgaagcccttatggaaatgattaaaaattcgcctagggattgttacgttactgtacaaaagacaacaatgatcattttggagagattacaacaggtccttcaaatggaatctcacattagtaatcacaacgatcgttcccaattcaacgatctacaatccctattgtgtggcacattgcaatctgttttgagaaaggtcactcctgaggatgcccctcaaatttcagatgctgttatgacagctctcctaacaatgttcaactcaaacaaaagtggtggagtc

SEQ ID NO: 3171 - DNA, 741 bp, Ceutorhynchus assimilis
aatgagatcagtgtgccaatgtctgtggagtttgacgagttagcaaaggcaagagaaaatcctactgaggaaatgtcaaatttggtggaatttactgatgaagaaggatatggaaagtttctggacttgcacgaatgctatgaaaaatacatcaacttaaaaggcatagaaaaagttgattacatcagttacctgagtatgtttgatcagctctacgacatacccaaagaaagaaaaacaggcgaataccgaaaatacttaaattgtctcatagaatatctatgttggtttatccaaagaataaaacctttattgcatttggacattcttttagatgacgaagctagaaaggctgctatagaatgggaaacggattcttgtcctggatggccaaaagaagcagggtctgctttggctaatgttggagctcatttagacttgtctgcattttctagttgggaagaattagcttcactcggactagatagattgaaatctgctttgatggcgctggggctcaaatgtggagggactttagaagaaagagcacaaagactgttttcaactaaaggtcaaagctcactggatcctgccttaatgactaaaacaactaaaggaaaggcaagcaaagaaaaagaattgttgagacaaagagatttggctatgatggaagctcaaatttacaaactttctgagatagttagtgaccaacgagtagcaactaaagaaaacgtccaacgg

SEQ ID NO: 3172 - DNA, 535 bp, Ceutorhynchus assimilis
acgactctcgaacgtttattggcacgtttaaagccttcgataagcatatgaacatgattttgggcgactgtgaagagtttagaaaaatcaaacccaaaaattccaaagttgaacgggaggaaaagcgagtacttggctttgtgttattgagaggcgaaactgttgtttctctgactgtagaaggacctccgccaccagaagagggactgcctagagtaccgattccaggagcaacttctggaccaggcattggcagagctgcaggtcgaggaatgcctgcaggaatgagcggagtccctgtaggattacaaggtccagtcagaggtgtaggcgggccatctcagcaagtgatgacgcctggaggaagaggtcaaatggcgggtccaccacaaatgaaccacggtccacctaggatgggtgcacctccaccaggaatgatgggcggtccaccacctggtatgatgggcatgcctccaaatgccatgggcatgggtagaggtggtccaccaccgccaccaatgggaattagaggtcc

SEQ ID NO: 3173 - DNA, 681 bp, Ceutorhynchus assimilis
attacacatatcgactgggcatttcaactatcagcattgttgtggaagaagtttgtaccgttatttggactttgctcaaggatgaatgtatgggtataccaagtaccgaaaagtgggaaaacatttccatggaatttgaagagcgtgcaaattttcctaattgtatcggagccgtcgatggcaaacacatcagaattattaagccgacaaaaagtggctctctcttttttaattataagcatttcttctcagtccttttattagccgtttgtgacgcgaattattgcttcacttatatcgatgttggagcatatggaaagttttctgattccacagtattcaaaaatggtccgttttggcaaaaacttcaaaacgattcattaaatatcccaaaaggaaaacctttacctaaagaaagtattgctcaaccttatgtcatagtgggtgatgaagccttcccgctgacaaaaaatttactacggccgtatgcacgaaagaatctaaattacaaaaaaaaaatattcaactataggttaacccgtgctagaagatatatcgaatgtaccttcgggatattatcaaataaatggcgaatttttcacagaccattgaatgtaagtttacgcctttcaaaaaaaattattaaagcctgctgcattctgcacaactttgttcgtgtaa

SEQ ID NO: 3174 - DNA, 659 bp, Ceutorhynchus assimilis; identical to SEQ ID NO: 3150

SEQ ID NO: 3175 - DNA, 672 bp, Nezara viridula
gagacgacaagagagagaacaagaaaggcaagaacgggaagaagccatgatgagattgcagcgcgataaggaagctgaacagtttgaggcatgggcaacgcaggaagatcagtttcatcttgagcaagcaaggctgagatcaaggatcaggatagctgatgccagagcaaaacctattgatcttcttgcaaaatatatcaattcagaagaagaagtggatgctgttgagatgcatgaaccatatacttatcttaatggtctatcaattaaagaccttgaagacctcgttgaagatattaaggtctatatgaaattagaaaaaggaaaaaatttggattactggaatgatattactgttattgttgaagatgaattgtataagctgaggaaaatgggaaagaaatcagactatgaagcagctgttggcagaagagaaggtattcatgaatctgtagctaaagaagtatcttcagtcttcagaggtaaaacagcttcacaacttgcagccatgcaaaaacagattgagaagaaaatcagtgataaaggtgaaggaatcgatattggatactgggaatctcttctttcccaactaaaagctcatatggcacgagctcgtctcagagataaacaccaagaaaacctaaaacagaaattggaattactcaaagcgga

SEQ ID NO: 3176 - DNA, 792 bp, Nezara viridula
cagtggaatctgataaggcaccggaagctataagcaaagccgttgcttcattaccccctgagcaaatgtttgagctaatgaaacagatgaagctttgtatacaaaacaatcctacagaaggtaaagcaatgttgttacagaatcctcagctagcgtatgctcttttgcaagcccaggtcgtgatgaggatagtagatccacagattgctatcacaatgttgcacaaggccaacccaagcgtacctcctcttcagccgcctcctgtcgaggcaatacggcctgtgcctgtgccacagcctgctccagctgtcgcaccgcctccagttgtaccgccaatagtgcagacgagacctgtcgtggaaccggagtgggtacctccggctaggccgcatcaaccacctcatccaccaacattcattcctcaaccaggtggtgatttagatatgagaacattggacccgagggtaccaccggtgagattgaatcaagaccaagacttgaggatacctccgatggttccagcgcctcagcagcctccggctcagcctcctcagccgtaccctcaggaacatgtgatatcaagtactgttcgggatccaagacagtatcgtgatcctcgcacaggtgcagcacctgttcccgtcccgccaagaccggttgttgcccaggcagtggtgccaccacgacctgtagctcctccacccagtcatatcacatcagcgcttcctcctgcggcttcagaccaggagaaggctgccttaataatgcaagtactacaactttccgaggaac

SEQ ID NO: 3177 - DNA, 709 bp, Nezara viridula
tggtcagattgttggagaagtattaaagcagcttactgaagaaaaatttattgtcaaggctaccaatggtccaagatatgttgttggttgtagaagacaacttgataaattaaaacttaaatctggcacgagggtagcattggacatgacaactttaacaattatgcgacatttgccgagagaagttgatccattagtgtataacatgtctcatgaagatccaggagatgtaacatattctgctattggaggtcttgcagaacaaattagagaacttcgtgaggtgattgagctgcctctgttgaatcctgaactttttcaacgagttggtattactccacctaaaggatgtctactttacggccctcctggtactggaaagactttgttggccagagctgtagccagccaattagatgcaaacttccttaaggtagtctccagtgctatcgttgacaaatatattggagaaagtgctcgtctaattagagaaatgtttaattatgcaagagatcaccagccttgcataatttttatggatgaaattgatgctatcggaggtcgacgattctcagaaggaacatctgctgatcgtgaaatacaaagaactcttatggaacttcttaaccaaatggatggatttgattctctgggacaggttaaaatgatcatggccactaatcgtcccgataccttagaccctgctctt

SEQ ID NO: 3178 - DNA, 628 bp, Nezara viridula
gaagcaataagtcatgcagggacttgtctcgggatcctagcaaacgatggcattattcttgtagctgagaaaaggaatactaacaaacttcttgatgaatcagtatattcagaaaaaattttcaaactaaatgagaacatgatatgcagtttagctgggatcacagctgatgccaatgttctgactaatgagttaaggcttatttctcaaagatatttgttacaatatggagaaacaattccttgtgaacaacttgtctcgtggttgtgtgacatcaaacaagcatacactcagtatggaggtaaaaggccgtttggagtatccatattatatatgggttgggataagcactatggatatcaactttaccagtctgacccaagtggaaattactctggttggaaggcaacatgtatagggcataacagtggtgcagctgtttccagtttgaagactgattacaaagaaggtgaaatgacagtgaaagatgctttggctttgggtatcaaagttctaagtaaaacattagatactgctaagctttcagttgatagagttgaagttgcgacattatctcaaaagaatggaaaatgtgttacttgtatcctacctactgaagaggttcaag

SEQ ID NO: 3179 - DNA, 740 bp, Nezara viridula
attggggccatgaatatgttagacaattggaaggagagatagcggatgaatgggcctctacagaagaaaaagataagctgctaggtttggtggagagtataattaaatttgatatggagcataatgcagaaatccaagcctgtgatctcttgatggaaatcgaccgacttgatatgctggacaagctcatggatttgactaattattctagagtttgtctttacttgattaattgtgcagtttatgtagaagagccagaaagaggaaatattgtaaatggtgttatgaatcactacatgcgatttaaggaatatccccgtgcactgtgccttgctatgcaattaaataaacatgacttaatgatagacatctttaaccaatgccaagatccattggttcgtaaacagttggcctttatggtaggcaggcaacagttaagtctggaattgagtgatgacctacctgacaaatcagatctcactaacatcatgtctaatgcccatgtgaatgatcattttcacagtttaggaagagagttggatatcatggaacctaaaaccccagaagaagtatataaagtttggttagaagggttggtccttcgcccaacttacaatctggaagtacctctcgattctgctaggcataatcttgcttctacatttgtaaatgcttttgtgaatgctggcttttccagagataagttggtatcagttgaagatggcaacaagtggatgtat

SEQ ID NO: 3180 - DNA, 650 bp, Nezara viridula
tcagtgcacaggttacttacgtgacgggaggaggcagccgaggagagtacgtgacggccaaccagcctggctactggtccagtgagtacgtctaccagcagccgcagcaggagatccagctgcctccaggaacaccctacgtcttctccagcaatgggcaggctacctgggccatcgacgagtcttacgatcccaatatgctgtctacgagcgacatcaaggagtgcgtaaactgcgcggcgagcgttaccccgctgtggagaagggacgggactggacaccacctctgcaacgcctgcggcctctacagcaggatcaacggagtacacaggccaccggtgaggactcaccacaagaaagtacacaatattggcaacagaagaaatggcgtaagctgtgccaactgccagacaaataatacaaccctctggcgcaggaacaatacaggagaaccagtgtgcaatgcttgcggcctgtattttaaactacacggtgtaaataggcctcataccatgaagaaggaaggtatccaaaccaggaaacggaaaccaaagaacccccaagtaaaccttccaagtcctaaaaacgatataaagacaacaggtgaaaaatcaggcagttgggataaatgtgacaacgacctactagac

SEQ ID NO: 3181 - DNA, 696 bp, Nezara viridula
ctcttctccaaggcatatccaggctttgctcacaccctaatagagctgttcggatgtcagcaataacctatctgcaaagagcgcttctcatgcaagatttacagtccctctccggagaggaatgggaagaatgttttactcaagtgctgtttccactcctgtccactctattatctgttaatattccagcgattgaagaaacaaggataagggcagccactgtactatccaaggtgttcctgcaccacttgtctcctctgcaaacccttcctagttttgcacagctatggctgactatacttgattatatggataagtatatgcacgcagacaacagtgacctactttatgaggctattcctgaatcattaaaaaacctcttgcttgtaatggactcggctggtgttttcaatggattagacgggcgcaatgagatttgggtcgtaacttgggatcgaattagctcattccttcccaaccttcaggcagacctatttaaagatcatctaccagttgtagatgctagttcacttgaaacaaaagaagctttagaaacatctaaaagtgaaacagaagtcgttcaaaccgagcaaccaacattgcaaaggcctccaggctctcaacagtcatctcctctacctccgttaatgcctaaacctggagaagctgttgaaatatctggacctacgactaaca

SEQ ID NO: 3182 - DNA, 473 bp, Nezara viridula
gtgttgctattgcttcagacttgaggtttggtattcaagggcagactgtttcgactaattttgaaaaaatttttgaaatgggtcctcacttatacattggacttcctgggttaactactgatacatttaccgttctaaataaacttaaatttagggcaaacatgtttgaattgaaagaagataggaaaatagctccagatgtgtttctttcaatggtctcgaatttgttgtatgaaagaaggtttgggccattttttgttgaacctataattgctggattaaaaccaaaaacgtttgaaccttttatagcttcgatggatttacttggttgtcctaacaaacctgaagattttgtagtggcaggaacagcttctgaacaactctacggaatgtgtgaagctctttgggaaccagatcttagtcctgaagatttatttgaaactatatctcaagcccttgttaatgcttgtgac

SEQ ID NO: 3183 - DNA, 799 bp, Nezara viridula
caggcgatgactcttaatgatgtaactgacaatatagttgtggctacagctttccatgttcttgccaatagaatggcatcatccaatttacatgaagcagccgccgattgtgtttgctctcttcttgaatgccttgaagataacaataatcaacaatcgatcgagatgcaactgttcaacggagtcatttcattagagcaaccgtttcatatttctgtcgcacatgaagaacatgaaaagtgtgttaattattgtcgagtatttacagaacttgctgagagtttcctagaaaaaatagttagtgggagtagtcccaacaaagcacattttgctattaagattttcgatctcgttctaacttgtgttggtcatcatgactatgaagtagctgccattacatttaatttatggtatcgtctttcggaagaattataccaaaagaaaaactctggactgacctctttattcaaaccatacatcgaaaggcttattgaagcattatgtagacattgtcagatggaacccgatcatgaagggatccttgaagaaggggatgattttcctgattttaggatgaaagttgctgaactgattcgtgatgtcgtattcataatcggttcttccaactgctttaggcaaatgtttatttccctacaggggccaaataccacctgggacaccacagaagcagcgttgtttataatgcaagctgtcgccaaaaacattattccggaagaaaacgatgttgtccctaaggttgtcgaggcaattttaaaccttcctccaaacacacacatag

SEQ ID NO: 3184 - DNA, 709 bp, Nezara viridula
ggaagtagtggcaagaagaaaaagaagctggcagataagatcttaccccagaaagtacgagacctggtgccggagtcacaagcatacatggacttattggcattcgagagaaaattagattctacaataatgagaaagaggcttgatattcaggaagcgttgaaacgtcccatgaagcaaaaaaggaaattacgcatttttatttctaatactttctatccagctaaagaggcaactgagacggaagaaggcagtgtagcatcctgggagctgagagtcgagggaagactgttggaagattctaaaaatgatcctaacaagcctccaccgttacaggtaaagaggaagttttcctctttcttcaaaagtcttgttattgagttggataaagaactatacgggccagataatcacctcgttgaatggcacagaacccctaccacacaagaaacagatggttttcaggtcaaaagaccaggtgataaaaatgttagatgtaccatactgctccttttagattatcagcctttacagttcaaacttgatacccgacttgctcgtcttctaggagttcacactcaaacaagacctgttattataagtgcgctttggcaatatattaagactcataaattgcaagatccgcatgaaagagagtatataaattgtgacaaatatcttgagcaaaccttcagttgtccaaggatga

SEQ ID NO: 3185 - DNA, 297 bp, Nezara viridula
accctagaagaattagagcagaagatgagagaagccgaaactgaaccccacgagggtaaaagaaaagttgaatctttgtggccaatttttaaaattcatcaccagaaatcgcgatatatatatgatttatattatcggaggaaagccataagtaaagaattgtatgagcattgtctcaatgaaaatattgctgataaaaatttgatagccaaatggaaaaaacaaggctacgaaagtctttgctgtttaagatgcattcaaaccagagacacaaattttggaacaagttgcatatgc

SEQ ID NO: 3186 - DNA, 667 bp, Nezara viridula
gacactgaatttcctggagtggtggcaaggcctattggtgagttccgaagttcagctgactatcagtatcagcttctaaggtgcaatgtggatcttctccgtatcattcaattgggacttactttcttggatgaaaatggaaaagctccagctggtccttacagtacctggcagttcaattttaaatttaatctctcggaagatatgtatgctcaggacagtattgatcttcttcaaaattctggaatacaatttaagaaacatgaagaagatggtatcgaccctgttgattttgcagaacttctcatgacctcagggatcgtcctgatggagaatataaagtggttatcctttcatagtggctatgatttcggatacctattgaaactgcttacgaatcagaacttacccaatgatgaaagcgaattctttgagcttctgaaaatctacttccctactgtttatgatgttaaatatctcatgaagagttgtaaaaatttgaaaggtggtcttcaagaggttgctgaccagctggagcttacgagggtaggaccacaacatcaagctggctcggattcgttattgacaggaatggcctttttcaaaatgagagagatgtttttcgaagataatatagacgatggcaaatactgcggtcacttatacg

SEQ ID NO: 3187 - DNA, 718 bp, Nezara viridula
acaagggacactcaagttttatgtttgtctccaacaagagagcttgctgtacaaatacaaaaggttattcttgctttgggtgatctcatgaatgttcagtgccatgcttgtataggaggaacaagcttaggagaagatattagaaaacttgattatggtcaacatgttgtatctggtacacctggtcgtgttttcgatatgataaaacggcgaactctaaggacaaggtcaatcaaagtattagttcttgatgaagctgatgagatgttaaataaaggtttcaaagaacaaatttatgatgtatatcgtttcttacctccagctactcaggtagttcttatttctgcaacccttccccatgaaattcttgaaatgaccagcaaatttatgactgacccaatcagaattttagttaaacgtgatgaattgacattggagggaataaaacaattttttgttgctgttgaaagagaagaatggaagtttgacacactctgtgatttatacgatactttgactatcactcaagctgttattttctgcaatacaagaaggaaggtcgattggttaaccgaaaaaatgagggatgcaaatttcacagtttgttctatgcatggtgatatgcctcagaaagaaagagatgcgataatgaaggagtttagagctggaaaaagccgagtgcttataacaacagacgtgtgggctagaggtattgatg

SEQ ID NO: 3188 - DNA, 763 bp, Nezara viridula
tgatgaaccgtggaattcatccaacaacaatttccgatgcattcagcattgcagttgaaaaggccatcccaattttaagagagatgtctattcctctacaacaaaacgataacgaaagtcttatcaggagtgcatcaacatctcttaattcaaaggtcgtttctcaacattcatcgatattggctccattagctgtgaatgctgttcttagaattaccgacccaaagaaagacaaaaatgtcgacctaaaagatatcaagatcattaagaaacttggaggcaccgtggaagatacagaactcattgagggcttagtcttcacgcagaagttggcaaatataaacggaccaaagcgtcttgagaaagtcaaaattggtctcattcagttttgcatttctccccctaaaacagatatggatcacaacgtggtcatctccgactatgcagcaatggacaggattctaaaagaggaaagagcctacatactcaacattgcgaagcaaatcaagaaggctggatgtactatgttgttgatccagaaatctattttaagggacgccttgtccgatttagctattcacttctttgacaagttgaaaattatggtcgtgaaggatatcgagagggaagatatcgatttcgtctgtaagactctcggctgccgacccattgcgtctttggatcacttcaccagcgaggctctggtcagtgctgagctagcagaagaagtatcggcaggatcttctcgtatcgtcaaagtgac

SEQ ID NO: 3189 - DNA, 737 bp, Nezara viridula
gcttcaagctgatgagaaaccagatgttcagtattcggacattggtggtatggacatgcaaaagcaggaaattcgtgaggccgtagaattgcctttgacgcacttcgaactctaccgccagattggtatcgaccctcctaggggcgtgctgatgtacggcccaccgggctgtggcaaaactatgcttgccaaagcagttgctcatcatactactgctgcattcatcagagtagttggctctgaattcgttcagaaatatcttggagaaggaccgagaatggttcgtgatgttttcagactcgcgaaggaaaacgctccggccatcatcttcattgatgaaattgatgctatcgccactaaaaggtttgatgctcagactggtgcagatagagaagtgcagaggattctattggaactgctcaaccagatggatggtttcgaccaaaccacaaacgtaaaggttataatggctacaaacagagcagacacattggatcctgctctgctgcgacccggtaggctggacaggaagatcgaattccctcttcctgacaggcggcagaaaaggctcgtcttctccaccatcactgccaagatgaacctctccgaggaggttgacttggaagactacgtagccaggccggacagggtatccggtgctgacataaatgctatttgccaagaggctggaatgcatgctgtccgggaaaatcgttatatcgtccttgcgaaagatt

SEQ ID NO: 3190 - DNA, 347 bp, Nezara viridula
ttgcaaaatgttcagtaaccataaagactatgttggaagatctaggtatggatgaagatgaagaagaagttgttcctttgccaaatgttaattctgctattttaaagaaagtaattcaatgggctacataccataaggatgatccaccaccacctgaagatgatgaaaataaggaaaagagaacagatgacatctcatcttgggatgcagactttttgaaagttgatcaaggaactctttttgagttgattttggctgccaactatcttgatatcaaaggcctgcttgatgttacatgcaaaacagtggctaacatgatcaaaggtaaaactccggaagaaattcgt

SEQ ID NO: 3191 - DNA, 714 bp, Nezara viridula
ggagtcaaatgtgcaagaagtcaaatgccctgtcacagtttgtggagatgtacatggacagttccatgacttaatggaactgtttagaataggaggaaggtctccagacactaattatttgttcatgggtgactatgttgatagagggtattattctgtggagacagtgacattactagtagctctaaaggtaagatatcgagaaagaatcactatcttaagaggtaatcacgaatcacgccaaatcacacaagtatatggtttctatgatgaatgtttacgtaaatatggaaacgcaaatgtttggaaatatttcacagatttatttgactatttgccattgacggctcttgttaatggtcaaatattttgtcttcatggtggtctttcaccgtctatagacactcttgatcatatccgtgctttagatcgtcttcaagaagttccacatgagggtcctatgtgcgacttgctttggtcagatcctgatgacaggggtggttggggcatatctccaagaggtgctggttacaccttcggtcaagatatttcagaaacatttaaccactctaatggtctcactcttgtgtccagagctcatcaacttgtaatggaaggctataactggtgtcatgatcgtaatgttgtaacaatattttctgcacctaattactgttatcgttgtggtaatcaagcagctataatggagttgga

SEQ ID NO: 3192 - DNA, 704 bp, Nezara viridula
aggcatgcagatctttgttaagacacttactggtaaaacaatcacacttgaagttgagccttcagacacaattgaaaatgtgaaagctaaaattcaagataaggaaggaattcctccagatcagcagaggttgatttttgcaggtaaacagctcgaagatggtcgtacattgtctgactataatattcaaaaggaatctactctgcatttggtccttcgtctgagaggaggcatgcagatctttgttaagacacttactggtaaaacaatcacacttgaagttgagccttcagacacaattgaaaatgtgaaagctaaaattcaagataaggaaggaattccaccagatcagcagcgattgatctttgctggaaaacagttggaagatggtcgtactttatctgattataacattcagaaggaatcaacactacatttagtattacgtttaagaggtggaatgcagatttttgttaagacgctgactggaaaaaccataactttagaagttgaaccgtcagataccattgaaaatgtaaaagccaaaattcaagataaggaaggaattccgccagatcagcaaaggctgatctttgcaggaaaacagttagaagatgggcgtactctttctgattacaacatccaaaaggaatctactttacatcttgtacttagacttcgaggaggcatgcaaatttttgtca

SEQ ID NO: 3193 - DNA, 747 bp, Nezara viridula
tgtggatggtaatgggaaagcaacaatatcaaatgatggtgctactattttaaaacatttggatatagtgcatcccgctgccaagtgtttggtggatatagccaaatctcaagatgctgaggttggagacggaactacaagcgtagtcctgatcactagtgaaattttgaaacagctaaaaccatacgttgacgagggtgtgcatcctagaataatgatgaaagcagtgagaaaggcaacacaattatgtttagacaaaattaacagcttagctgttaagattgaaaagagtagtgcagaacaacatcgctctctgctggagaggtgtgctgctactgcactcagttccaagttgattcatcagcagaaagattttttttcgaaaatggttgttgatgctgtgttgttgttagatgaactccttccacttgatctcattggaatcaagaaagtacctggtggagctttggaggaatctttgttggtctctggtgtggcatttaagaaaactttttcttatgccggctttgaaatgcaacctaaaaagtacaccaatccaaaaatagctattctcaacattgaattagaattgaaagcagagagggacaatgccgaaatcagacttgataatgtagaggagtatcaaaaagtagtagatgttgaatggcaaattctctacgaaaaattggacactattgttaaatcaggagctcaggttgtgctgtctaaacttccaataggcgatgt

SEQ ID NO: 3194 - DNA, 683 bp, Nezara viridula
aacaggaagcagagaagaagaaggttcagtctcaggaaatccagtcccagattgaaaaacaaaaactacttatagcgcagaagagagaaggtgtgatggcagatcttgcccaagtggaaccagctgttattgatgctcagcaggccgtgaaagagataaagaagcagcagctggttgaggttaggtctatggccaaccctcccgctgtagtcaaattggcactcgagtccatctgcctcctgctaggtgagagtgccactgactggaagtccatcagggccgtcgtcatgagggacaacttcatcaattctatcgtcaacaatttctctacagaaaatatatccgatgaagttagagagaagatgcatacccgttacctgagtaacccagaatacacatttgaaaaagttaacagggccagtatggcttgtgggcccatggtgaagtgggccgttgcccagatcagttatgcagacatgttaaagaaagtggaaccactgagggaagaattgcgatcattagaagagcaggctggtgagaatgaacaaaaaggagaagacacaaaagcactcattgcgcagttggagaagagtatagcagcttacaaggaagagtacgcccaactaatacaggaagggcttgcgattaagcaagatttagaaaacgttcaagctaaggttgat

SEQ ID NO: 3195 - DNA, 689 bp, Nezara viridula
gaggaggaacagatgtcatctgctgtatttcactttggcgctaagaaaaaagataaatcccaagaagaatacgatttagttctagataatcagatcgagtttattcaggctatgagtctagctggaactaaagaaaagcctgagccacaattaacagaaaaagaaagaaaaagattgactattgaagaaactcaaaaaagcctccctgtttacaagtttaagaatgaacttgtacaagctatcaaggatcatcaagttctgattatcgaaggtgaaacaggctcaggtaaaactactcagatcccacagtatttataccaatcaggctttactgatgatggtaagaagattggatgtactcagccaaggagagttgctgcaatgtcagtcgcagcgagagttgccgaagagatgtccgttaagttaggaaatgaggtaggttacagtattcgttttgaagattgcacttcagaaagaacaattataaaatatatgacggatggtactcttcaccgagaatttctctctgaaccagatctgcaaacttacagtgtgatgatcattgatgaagctcacgagagaacgttgcatacagacatattgttcggtttagttaaagatattgctaggtttagatcagatcttaaacttcttatatccagtgctacgctggacgcagaaaaattctc

SEQ ID NO: 3196 - DNA, 660 bp, Nezara viridula
tgaaggtgaagttacagagctcacacctgtagaaacagaaaatccaatgggagggtatggtaaaactgtatcccatgtgatcattggcttgaaaacagcgaaaggtacaaaacagttgaagttagaccctagcattcatgaaagtttaaccaaggaaaaggtagaagttggagatgttatatacattgaggctaacagtggtgctgttaagaggcaaggaaggagtgatacatatgctactgaatacgatcttgaggcagaagaatatgtccctctacctaaaggcgatgttcataaaaaaaaagaagtcatccaagatgtgacattacatgatctagacgttgcaaatgctagaccacaaggagggcaagatgttttatcaataatggggcaacttattaagtcaaagaaaacagaaattactgacaagttaagagctgaaattaacaaagttgttaacaggtacatagaccaaggtattgctgaactagtgcctggggtgctttttattgatgaagtccacatgctggatatagaaaccttcacttaccttcatcaggctcttgaaagtgcgatagctcctattgtagtctttgctacaaatcgaggtcgttgtcaagttagaggggctgcagacattatttcaccacatggactacc

SEQ ID NO: 3197 - DNA, 682 bp, Nezara viridula
gtgaatttgtgcgcatagaagattacaaagctcctgataccgctaaacgtcctcctgaaaaaaagtctaaaaagaaggatgatgatattttagatcctgccgatattccaaccaaatgtgtttcttatgagaagtcactaactgtaaatgctcaagttcaatacatagattttgaaggaagatctgatggagaatcagtacagaaaataatcactcagttgagaccaagaagagtaatacttgtccgtggtacctcagaaaatacggaagctttagagaagcatcttttgcaatggtctgaggctaaaatattctgcccgaaaaaaggtgatatagtggatgctaccactgaaagtcatatatatcaaataagattgacagattctttagtatcttcattacacatgcaaaaaggtaaagattcagagcttgcatggattgatgctattaccaaataccgtcagaaaccctctgacactatgcagtcgacagaagaaatggaagttgaagaagatggtaattacagcatttacaatgatgactacttaactctggaacctctccccttaactgaagtcaatcctcatcaagcagtgtttataaatgagttaaaattatcagacttgaaacaaattttatctcgtaatggtatagaatctgaattctctggtggtgtattgtg

SEQ ID NO: 3198 - DNA, 780 bp, Nezara viridula
aattggtctgttggatcctcgctgggtcgaacaaagagacaaacacattcaggatagaatcaaccaggagactgtctacgcaggaggttctgctattgaggccagcttgaaacaacttgcggagagaagaactgatatttttggtgtgggtgatgaagaaactgctattggtaagaagattggtgaagaggataagaagaaagatgataaggtgacttgggatggtcacacttcgagcgtggaggctgcaactcgcgctgccagggctaacatcaccatcgaggaacagatccaccagattcacaaggtgaagggattgctccctgatgaagaaaaggagaagataggacccaagcctgtcccaggagcggggagcagcagcggaggaaatccaatggctggtggcccccaaatcgttgtccaagccaaagcccctcccctccctcctccaccgaaggtgcctccacttccacctccagctcctctgccgcctccaccgggccttgtacctcagccacccataatgatggtacctgcacctcttcgtcctccgctaatggttccgccgggagcattccccgtagttgctgctactccttctgctttcatggctccaccaggaactgcgcccttgccccccgccccgcagccgccccctcaggtcactcaggtggggaacttgttaaagcacgtcgcttctgcctctgtgggcgaggctgatgatgagcctatgaccaagaaggctaaaacagaagattgtcttgtaccagaagctcagtt

SEQ ID NO: 3199 - DNA, 674 bp, Nezara viridula
tagttttgcagtgccatttgatgaagatgataaagacaaatcagtttggtttttagaccatgattatttagaaaatatgtatggcatgtttaagaaagttaatgcaagagaaaaagttgttggctggtatcatacaggcccaaagttacatcaaaatgatgttgcaattaatgaacttatacgccgttactgccctaactcagttcttgttattatcgatgcaaaaccaaaggatcttggtttacctacagaagcatatagagcagttgaagaagtacatgatgatggttctcctacgacaaaaacatttgagcatgttcccagtgaaataggggctgaagaagcagaggaagtgggtgttgaacatctgctgagagatataaaagatacaactgtcggctcactttcgcaaagggttactaatcaatttcttggtctcaaaggccttaatcaacaaattcaagacatcagggattaccttatgcaggttgttgaaggaaaattgcccatcaaccatcaaataatatatcagcttcaagacatatttaatctccttcctgacatgaaccatgggaactttgttgattcattatacataaaaacaaatgatcagatgcttgtcgtttatctcgctgccctcgttagagctattgttgccttgcataatctgatca

SEQ ID NO: 3200 - DNA, 776 bp, Nezara viridula
cacaagatgaagaggttggagatggcactacatcagttgtgattctttgtggtcaaatcatggcagaaattgaaagacatatagatgaagtccatcctacgacaatcattaaagaatttaaaagagctttggatgatattttaaaaatacttccagacataagtacttctcttgatcttaaggacaaagctaaagtgatagaagtggttaaaggatgtttaggtaccaaatttttaggtacttggtctgaaatggcttgtcagatggcaattgatgctgtagatactgtcagagatctaaaaggtcttggaattgatttaaaaaactttgctaaaattgaaaaggttcctggtggttttattgaagattctaaagtattggaaggtgtaatgcttaacaaagatgtgacacatcccaaaatgtcacggttcattaaaaatccacgaattttattactagattgttctcttgaatataagaaaggggaaagtcagactaacgtggaaataattaaggaaggtgattatacaaggcttctacaaattgaagaagagtacattgaaaaaatgtgcaatcatattattgagcagaaacctaatgttgtcattactgaaaaaggaatttccgatttggctcaacaccatcttttcaaggctggtattacagccattcgtagagttaagaagactgataataacagaattgctcgagcagtagatgcaactattgttagtcgtgtggaagaaatcaaaccttatcatattggttgtggtgct

SEQ ID NO: 3201 - DNA, 568 bp, Nezara viridula
tgcaccttcttttagtccatattctgaaaatggagggagtgtagtagctgtagctggcgatgacttcgcaattatagcatctgatacacgtttaagtacaggttttcaaatttataccagaaaccagtcaaaattatttaaattgtctgacaaaacaattcttggtagtactggttgttggtgtgatgttctttctcttactaggcttgttcaaacccggataaaaatgtatcagtacgatcataataaagttatgtccactccagcagttgcccaaatgctctctgtactactttattataaacgctttttcccatactatgtagccaatattcttgctggaatagatgataatggtaaaggagtggtttacagttacgatccaatcggtcatcatgaaagctcaaaattcagagctggaggaacagctggagctttattacaaccactgttagacaatcagctcggtatgttgaatcaagaaaatgttcaagacaaaacatacactttggaaaaagcccatgcaattgtaaaagatgtctttatatcagctgctgaaagagatatt

SEQ ID NO: 3202 - DNA, 739 bp, Nezara viridula
gggaatgaaagggatgatgttgaacgtgggggtaaaattattatgcctccttcagcactggatcacttgactagattaaacattaattatcctatgctttttaagttgcataacgcgaaaacgaatagatcttctcacagtggtgtattagaatttgttgcagacgagggaaaagtctatttaccccactggatgatgaggaatttaatgcttgaagaaggtgatgttattgagatagaaagtgtctccctgcctgttgcaactttttcgaggtttcagcctcaggctccagattttttggatatttcgaatcctaaagcagtcttggaaaactgtctcagaaactttgcttgtttaactactggtgacattattaatattaagtataaccaaaaagattatgagctttctgttttagaaacacaaccaggggcagcagtaacaattattgaatgtgatatgaatgttgaatttgctgctcctttaggatataaagagcctaattctgaacaggagtcattggatgagtcatctgaaagaacagaaaacttatctaatgagggaagtggattcaccccattctttggtgaaggctataggcttgatggaaaacagaagaaagcgattgaagatgaaaatatgaaatttaaaatcccgactgtgagaggaattcctgattatgactggaaagtaggtgtgattaccttcatgagaaatgtgcgtcaacctgttaaagaag

SEQ ID NO: 3203 - DNA, 743 bp, Nezara viridula
agctaccatcatgaagcaaatggatgtggataatgaaattgcaaaactgatggtgcaactgtctcaatcccaagatgatgaaattggagatggaactacaggagtcgttgttcttgctggtgctttgttagaacaagctgatgttttattagataaaggtattcatcctattagaattgcagatgggtatgaattagctgctcgagctgccatagaacatttagattctatcgccacaaaatttcctgttgatcctaataatttagaacctcttattaagactgctatgacaactcttggatcaaaaatcgttaacaaatgtcatcgccaaatggcagaaatagctgttaaggcagtattatcagtggctgatctggaaaagagggatgtcaacttcgagctcataaaagttgatggtaaagtcggtggaaggctggaagattctatgcttgtcaaaggggtggtcattgataaggatttctctcatccccaaatgccaaaggtattaaaggatgttaaaatagcaatcttaacttgcccatttgaaccgcctaagccaaaaacaaaacataagttggatgtaacatctattgatgactatagggcgttgaggaagtacgaagaagagaaatttaataccatggtttctcaagtcaaagaggcaggtgctactcttgctatttgtcaatggggatttgatgatgaagcaaatcatcttcttctaaagagagaacttcctgcag

SEQ ID NO: 3204 - DNA, 195 bp, Nezara viridula
gcagtggaaaaggtgaaaaaaagaggttcgaagttaaaaaatggaatgctgttgcactttgggcctgggacatagttgttgataattgtgctatttgtcgaaatcatataatggatttatgtattgaatgccaagctaatcaagcctctgctacaagtgaggaatgcacagtggcgtggggtgtttgtaatcatg

SEQ ID NO: 3205 - DNA, 661 bp, Nezara viridula
tggacaagaaagttggtcaattccagcctaaaagggttgaaaatgccagaattcttattgcaaatactcctcttgacaccgataaaattaaagttttcggttcgagaatacgtgttgactctgtagctaaagtggcagatttggaattagctgaaaaagaaaagatgaaggaaaaaattgacagaattataagtcataaatgcaacgtatttgttaaccgtcagctgatatataattatcctgaacagctatttgctgatgctggaattatggcaattgagcatgcagattttgatggtattgaacgcctagcgcttgtcactgggggtgaaattgtctctacatttgatacacctgagcttgttaaattaggtgaatgtgatttaattgaggaaataatgattggtgaagacaatttgttgaggttcagtggagtcaagttgggagaggcctgcagtattgtcataagaggcgcaacacagcaaattgttgatgaagccgaacggtctcttcacgatgcattgtgtgtacttgtaaccactgtcagggataagaaaactgtttttggtggtggatgttcagaaataattatggcgagtgctgtaagcgatgaagccatcaatgttactggcaaagaagcagttgctatggaatcctttgc

SEQ ID NO: 3206 - DNA, 689 bp, Nezara viridula
ccggttacatcaggttgaatatgctatggaagctgtaaagcttggagcagcaactgttggtgtgaagaataaacagtatgctgtccttgttgctcttaaaagagcatcttcagaactttcagctcatcaaaagaaaattattcctcttgataatcacataggcatgagcatttctggcctaactgctgatgctcgtatattgagtcggcaaatgagaagtgaatgtctatcttattcatattcatatggaactgaaattcctattatcaggcttatgaataaaatatctaacatgatgcaaagttcaactcagcgctatgacagaagaccgtatggggttggtctactggttgcaggatttgatgccgacggtcctcacatttttcaaatttgtccttctgcaaatttgtatgagtgtcgttcaatggctattggtgctagatcccagagtgcaaggacgtatttggaaaagcatctagcagacattggaaactctggcaccctcacagaccttcttaagcatgcacttcgggctcttagggattcttctcctaatgatacagaacttagctctaagaatgtagcaatagcggtagtaggaaaagataccccactgaaggaattatctgaggccgacacccagacttatctggacatgatcctgagtgaagagagaagaagtggcgata

SEQ ID NO: 3207 - DNA, 680 bp, Nezara viridula
caaggaatggggtgaacataatctatgaaagagcattaaaagagcttcctggaagttataaactgtggtataattatttaatactaagaaaaagacagattaaaggacgatgcattacagatccttcttttgaacatttaaataatacttatgaacgatctttagtatttatgaataagatgcctaggatatggatggaatattgccagtttcttgttgatcaatgtaagattactaaagcccgtcacgtatttgatagatctttaagggcattgcctatcacccagcaccatcgtatttggcctctttatataaaattcttaaaaaaacataacattccagaaactgcagtccgtgtatttcgaagatatctaaagctctgcccagaagatacagaagaatatattgattatttaactgcaatccatcgtctagatgaggccgctgttagattggccgatattgtaaatactgatgattttgtttcaaagcatggaaaatcaaaccatcagttgtggactgaattatgtgatttaatctctaaaaatcctcaggaagttaggtctctgaatgtggatgcaataataagaagtggtttgaaaaaatatactgaccagttaggtcatttatggaattcattagctgattattatatcagaagtggactttttgaaaaggca

SEQ ID NO: 3208 - DNA, 777 bp, Nezara viridula
gagttatttgttcaagccggaccggttgtcaatgttcatatgccgaaagacagagtgacgcaacaacatcaaggctatggctttgttgagtttttgggtgaagaagatgctgattacgccataaaaattatgaacatgataaaagttcatggaaaacctattcgtgtcaacaaggcttcagcacatcagaaaaatttggacgttggggctaatgtgttcattggtaatctggatcctgaggttgacgaaaaattgttatatgacacattttcagcctttggagtcattctgcagacacctaagattatgagggatcctgatacaggaaattcaaaaggttttgcatttatcaattatgcttcattcgacgcttcagatgctgccattgatgcaatgaatggccaatttctctgcaatcgcccagtttcagtttcttatgcctataagaaggatgctaaaggtgaacgacatggatcggcggccgaacgtctcctagctgctcaaaacccattatcacaagccgacagacctcatcatatgtttgcagatgctccccctgcacctctgccacctcctccagtactgccgccacctcctgttttcaatcctccaccccctcctcatatgccacctcctccgttaccacctcaacggatggttgctcctatgcctccacctcctcctggtcctcctccaccaatgcctcctggaatgatgccatggcctccaatgcaaccacactttccacctcctcctcctccaccacctacaaacaaa

SEQ ID NO: 3209 - DNA, 627 bp, Nezara viridula
tgaggtctttagatttcgctgagaggcatggttacatcaagggagttgtgaaagatattatccatgaccctggtagaggagctcctttagcagttgtgcattttagagatccttacaggtttaagacccgtaaagagcttttcattgcccctgaaggaatttacactggccaattcctgtactgtggaaagaaagccaacttacatgttggaaatgttatgcccgtcggcactatgcctgaaggtactatcatctgtaatttggaagagaagaccggagacaggggtcggttagctagagcttcaggaaattatgctatcgttattgcacacaatcctgattcaagaaggaccagggttaagcttccatcaggtgcaaagaaagtcattccctctaacaacagagccatggttggtatcgttgctggaggtggacgtattgataagccagtccttaaggctggtcgtgcctattataaatataaggcaaagaggaactgctggcctaaggttagaggtgttgccatgaacccagtcgagcatcctcacggtggtggtaatcaccagcacatcggtaaagcttccaccgtcaagagaggaacttcagccggtagaaaggttggtctta

SEQ ID NO: 3210 - DNA, 261 bp, Nezara viridula
ggggtgttaagaagcctcacaggtataggcccggtacagtcgctctgagagaaatcaggaggtaccagaagagtaccgagctgctcatcaggaaactcccgttccagaggttggtgagggagatcgcccaggacttcaagaccgacctgaggttccagagctcggcagtcatggccctccaggaggccagcgaagcctatctcgtaggtctcttcgaggataccaacttgtgcgccatccacgccaagagggtgaccatca

SEQ ID NO: 3211 - DNA, 681 bp, Nezara viridula
ctccctgataaacccctagatttacacatgattgaaattatgacaatgcagagccgtcttgaatctgaaaccagattagttagagggcttgtcttagatcatggttcacgtcaccctaatatgcccaagaaactaaccaatgcttatattctaacgtgtaacgtaagtcttgaatttgagaaaacagagataaatagtgggtttttctataaatcagcacaggaaagagagaaactggtcgcatccgaaagagagttcattgagttaagagttgcaaaaattattgctttgaagaaatctgtatgtgatggaacagacaaaggatttgttgtcattaatcagaaaggtattgatcctgtctctttggatatgctagctagagaaggaataatggctctcaggcgagccaaaagaagaaatatggagagactaactttagcttgtggtggagtagcgatgaatagccttgatgatctcactgaagattgtcttggacgagcaggtctcgtttatgagcatgttcttggagaaactaagtatacatttgtgtctgattgcccaaaccctcatagcgtcactgtacttgttcatggcccgacttcatatgccattactcaaattcaagatgctcttcgggatggtttgagagctgtcaaaaatgcagttgaagatggtggtgta

SEQ ID NO: 3212 - DNA, 677 bp, Nezara viridula
gaatgttgaggtccctgaatttactcctaaatcaggtgtaaaaattgctgtaactgattcgcaaatggccaatggagctggtgggcaagttgatcaagatagaattggacagttgcagaacgaactaccttcaaaagaaatgttcaacggcttaaatatcacacccctcgaatttgaaaaagatgatgacaataaccttcatatggatttcatcgttgctgcatcaaatttgagagctgcgaattacaacatacctccagctgatagacacaaaagtaagttgatagctggtaagattataccagctatcgctactacaacatcagtcgttgctggtctagtttgtattgaactcatgaagttggctaagggttataaagatataagtttgtttaagaatggttttgttaatttggcgcttccattctttggattctctgagcctatattagcacccaaattgaagtattacgaaaatgaatggacattatgggatcgatttgaagttactggagagatgactcttaaggagttcatcgattacttcaaggataaacatcagctggaaataacaatgttatcccaaggtgtttgtatgctgtattccttctttatggctaagagcaaattagaagatagacttaatcttccaatgtcggaagtggttcgtagagttt

SEQ ID NO: 3213 - DNA, 750 bp, Nezara viridula
aatagttgattgcggctttgaacatccttctgaagtgcaacatgagtgtataccgcaagcagttcttggtatggatatactttgtcaagcgaagtctggaatgggtaaaacagctgtatttgtgttagctacccttcaacaaatggagttgactgaaaatcaagtaacagttttggttatgtgtcataccagagaattagcatttcaaataagcaaagaatacgaacgattttctaaatatatgccaaacatcaaggttgctgtattttttggtggtttacctatccagaaggatgaagaagtcttaaaaaataattgtcctcatattgtagttggtacaccaggacgtattttagctttagtgaagaataaaaaactaaatttgaaaaacctgaaacattttgtgctagatgaatgtgacaagatgcttgagcagttagacatgaggcgtgatgttcaagaaatttttaggaatacccctcatagtaaacaagttatgatgtttagtgccacactaagtaaagatataaggccagtttgtaagaaatttatgcaagatccgatggaagtgtatgttgatgatgaagcaaagctaaccctacacgggcttcagcaacactatgttaagctaaaagaaaatgaaaaaaacaagaaattatttgatttacttgacatcttagagtttaatcaggttgtaatatttgtaaaatcagttcagagatgtatggctttggctcaactgttatgtga

SEQ ID NO: 3214 - DNA, 717 bp, Nezara viridula
ctttctgtatcagtcctccgcaatataatatcttcattttatttaagtagtcctgaaaaagatgctttatttctatatattgaagatgctgtagattcagataccatccaaaaaacaaaactgatcaaaaattctaatgttcctctcttgccagaaattgatgcttacattcatttgttggtacttgtgagactaatagatgctggaaaggaatcagacgctgtgaagtgttctgatgctcttatggccaagataactgctcaaaatcgcaggagtttagatttagtggctgctaaatgttacttttaccattctcgagtttatgaacttactaaccaattggaaaaaatcagaggattcctgcatgctagactcagaactgccactcttagaaatgattttgaaggtcaagcagttttaataaattgccttttgagaaattacttacattataagttgtatgatcaagctgacaaattagtatccaaatcagtatacccagaatcagcaagtaacaatgagtgggctagatttctttattatttaggaagaattaaagcagctcgtttagaatattcagaatcacacaagcacctagttcaagctctgagaaaagctcctcaacatgctgctgtcgggtttaggcagactgttcaaaagcttgctgtcactgttgacttacttcttggtgatattccagaccgacagatatttcgt

SEQ ID NO: 3215 - DNA, 755 bp, Nezara viridula
agaaaattttgtgcgcttcaccggagatacgttagatcatgcaaaagtgcagttgttcgcatgggaggcacataacaagggtgttgacgttcatcctcttggagaacccaccaggctggaagtacttaagaaggaatttgttgggaagaaagaagagttcaaacaaaaaggacaagaagacctcattaaaaaatatggtggagaggaacatctaaaagcccctcctaaagaacttttattggctcagactgaatattatgctgagtatactcgttatggaactgttattaagggacaagaaaaagaagtggtgaggtccaggtatgaggaagatgtgcttataaataatcatacaactgtatggggatcattttggcattcaggaaaatggggatataagtgctgtcattcttttattaaggggtcttattgcactggtgaagctggtagactagcggcatctgctggagaggtagctgtcaagggcccggcatttattcctccacatccgtctacaccatctgcctcctcctcttctacgtcttccgattcttcatcgtcgtcgtcatcatcagaggatgaagaagagaaagaaaggatgaagaagaaacaagaaaagaagaaagcgaagaagaagaagcaaaaagtaaagaaacttaagaacaaaatcaaaaataagaaacctgaagaaaagactgaagaagaaaaacttcaggaagccttgaaaaaggaggaagaagctcagaaagaaggtg

SEQ ID NO: 3216 - DNA, 520 bp, Nezara viridula
aacccatcagaaagaagaggaagtatgagttaggaagaccagcagccaacactaagttaggcaccaaaagagttcatttggtaagaactagaggagggaatactaaatttagggccttgagattggactatggaaatttttcatggggttctgaatgttgtaccagaaaaactcgtctgattgatgtagtctataatgcatcaaacaatgagcttgtacgtactaaaacacttgtgaagaatgccatagttgtgattgatgctactccattcaggcagtggtatgaagcccactacgctctcccattaggaaggaagaagaatgccaaattgtctgaagctgaggaggctgtcctatacaaaaagaggtccaggaaaacggaaaacaggtataaggcgaggcagaaactggctaaagtcgaacctgcattagaagaacaattccagactggtcgtttacttgcttgcctagccagccggcctgggcaatgtggacgagctgatggttacatccttgaggg

SEQ ID NO: 3217 - DNA, 736 bp, Nezara viridula
ttctctggctctccttaagatgttaaaacatggaagagctggagtccctatggaagttatggggcttatgttaggagaatttgttgatgactatactgtaagagtaatcgatgtgtttgctatgccacagacaggaacaggtgtgagtgtagaagctgtggatcctgttttccaagctaaaatgttagacatgttgaagcaaaccggtcgccccgagatggtggtaggatggtatcattcccatccaggatttggttgttggttatcaggtgttgatatcaacactcagcaaagctttgaagctctttcagaaagagctgtagctgttgttgttgatccaatccagagtgtcaaaggaaaagttgtcattgatgctttcagattaattaatcccaatatgatggttcttggccaagaaccacgacaaactacctccaatttggggcatctgcaaaaaccctccgtacaggctttaatacacggtttaaatcgccattattattccatcagcatcaactacaggaaaaatgaattggagcaaaaaatgttgttaaatttacataagaagtcatggatggatggactgatgctctctgactattcagagaattgtaaagttaatgaaaccacagtcggggacatgcttgaattagctaagaattacaataaggcattagaagaagaggagaaaatgacacccgaacaacttgctataaagaacgttggtaagcaagat

SEQ ID NO: 3218 - DNA, 660 bp, Nezara viridula
tcgttaaagtgcatcctgaaggaaagtttgttgttgatattgataaaaatattgatataaatgatgtgactcctaactctcgagtggctttacgaaatgagagttatactctgcacaaaattctacctaataaggtcgatcctcttgtatcattgatgatggttgagaaagttccagactctacatatgaaatggttggaggtcttgataagcaaattaaggaaatcaaagaagtaattgaacttcctgtaaaacatccagaactgtttgatgcactaggaatagctcagcccaaaggagttttattatatggaccacctggaacaggtaaaacacttttggcaagagcagttgcccatcacactgagtgcacgttcattcgtgtgtcaggatctgagttggttcagaaattcattggggaaggatccagaatggttagagaattgttcgtcatggcaagagaacatgctccatctatcatatttatggatgaaatcgattcaataggttcatcacgtatcgaatctgggagtggtggtgattctgaagtccagagaacaatgttagagttattgaaccaattggatggcttcgaagccacaaaaaatattaaggtcataatggccactaataggattgatattttggaccctgctcttc

SEQ ID NO: 3219 - DNA, 453 bp, Nezara viridula
tggttgaagacagcttatgatgtccaaagttttgggtattttcaaagaggaactgcccaggacaccatggcttttgccagtaaaacaatagttgaaaggactcaatctgcgaccaggcaatctgtcaaagaaggagattatatttgtcacgtttatgtaagagctgacaacttagcaggggttgtgatatctaatcatgaataccctcatcgagttgcccacactctaataacaaaagtattggatgaatttagtgctaagtatccaccttcaacttgggcatcagcaaatgaagccaacattgattttcctgcattagcagctcaccttcaaaaatttcaaaatccaaaagaagctgatgctcttatgaaaattcaaagtgagcttgatgaaacgaaaatcattcttcataacaccattggagctgttttagagcgaggagagaaattagac

SEQ ID NO: 3220 - DNA, 624 bp, Nezara viridula
tttcaagtggagtatgccatagaagctattaagttaggttccactgcaataggtgtttgcactccagaaggagttgtaatgggagctgaaaagagaattaagtccacattaatggagccagaggctgtagagaagattctgcaagttgatgatcatattggttgtgcagtaagtggtttgatggctgattctagaaccttagtggagcatgctagagtacagtgccttaatcattggtttgtttatgatgaaaagatgcctatagagtcggctgcccaggcagtttcaaatttggctatcagattcggtgatgctgatgaagatgctggcccagcgatgagtaggccttttggagtagctgtcatgtttggtggatttgattatagaggacctcaactctatcatatggacccttcaggtacattcatttattttgatgctaaagccataggttctggaagcgaaggagcacaacaaagacttcaagagttgtatcataagggaatgagcctcaaagaagctacacatatgattttgactattttgaaagaagttatggaagaaaaattgaccgataacaacgtagaaatagcagtagtaactgcagaagagaaacaatttcgt

SEQ ID NO: 3221 - DNA, 650 bp, Nezara viridula
gatcaggtcactcacaaagtagctcagtatctgggcgaagttttagaggatcagaaggataaattacaggaaaacctaatggctaataacactgatttatctacctatattacaaagttccagtgggatatggctaagtatcctattaagcaatctcttcgtaatattgctgatattataagcaaacaagtgaatcaaattgatgctgacctgaaaacaaaatctaccgcttacaataatctaaaaagcagccttcaaaatatggaaaagaagcagagtgcaagtttgttgacacggaacttagcagacttagttaaaaaagaacattttattttagactctgaatatctgacgacattattagttgttgttccaaaatcaaacttcaatgagtggaataccagctatgaaaaacttactaatatgatagttccccgttcaagtcaacttgtttatcaggattctgattttggtttgttcactgtctcattatttaagaaggttgtaaatgattttaaattaatggctagagaaaagaaatttgttgtacgtgattttatttataatgaagaggaactagctgctggaaaaaatgaaattacaaaattggtgactgacaagaagaagcaatttggacctctagttcgttg

SEQ ID NO: 3222 - DNA, 691 bp, Nezara viridula
tatgcccttaattgcatggttgcatcaatgggaatgactaagcgagtagaaaatgctaaagttgcttgtctcgatttctctttacaaaaaacgaaaatgaaattaggtgtagaagttttagtagaagaccctaatcagttagaagcgattagagatagggaagctgatattacaaaagacagaattcaaaaaattcttagtgttggaaccaatgtagttcttttgagtgggggcattgatgacatttatatgaaatatttcatcgaagcaaatgctatggtggtaaggagggttaaaaaagctgacttaaaacgaatcgctaaagcaactggtgcctcttttgcaacatccctaactaatatggaaggtgaagaatcatttgatgctagcttattaggagaggccgctgaagtgtctcaagaaagaatttgtgatgatgagcttatccttgttaaaggtccaaaagcacactcagctgcctccataatcctccgtggacctaatgattatttctgtgatgaaatggaaagatcaattcatgactcattgtgtgcagtaaaacgggttctcgaaagtaaaacagttgtggctggtggtggagctgttgaagctgctttatcaatctatttggaaaactttgccacatctttaagttcaagagaacagttggcaatcgctgagtacgctaaat

SEQ ID NO: 3223 - DNA, 634 bp, Nezara viridula
acagcacacttgaagatcatcaagttaaaattatcaaagctccggattttctaactaggactttatatcctatgacaactacagcatctgtggttggaatcaaattcaataatggtgttgctattgctgcagatgttggtggctattatggatcattaaatcgtttcaaatctcttgataggctctacaaagttaataacaacattgtaatgacaacaactggagattatgctgattttcaatacatgagagagttaattcaacaaaaagttatcagtgaagaaattttagatgatagtttttccttaaaagccttttctcttcatacttggctcactcgcctgatgtacaacagaaggtcaaaatttgatcccttgtggaataatgttattgttgctggttatgataacaatggacccttcctgggaatagtggacaaactaggtatgagttatgaagatagttgtgtagccactggtatgggtggatacctcgctactccgctcttgagggatgtgtttgaacgcggtaaaggaaatttgactaaacaagaggcccatgctgcccttcagaaatgtatggaaatcttgtactacagagatacacaatcacttcctaagttccgaattgcaac

SEQ ID NO: 3224 - DNA, 759 bp, Nezara viridula
gtattgatcagcgttctcctatcagagttgaacgtcagtgctgaaaaatcattacaaggaggtcttcgagctagccggagagctgttaggctacttaatcagctgaacaaatcaacccaggcatgtgaactgtatttgaaagtttgtacaaacctcctaaaagcacaaagtaaacgagtgaaaagagagggcgcaacagtggcatacgtcaagagattatcagaagtatatttttcaaatctagcgtctataacttctgaatttcaataccgtgcattccctcacaatcaagattgtacatcagcttttgttgtatgggtgtcaatggaagcctctcatttcctttcacacatcataaagcaagtattcatccctcagacacctctcggtacgctagcagagtgcatagacattattaggaagcaatctcagcagatgtgtgagcttggactagatctaagctaccaggttaatggccagactatgaccgcagttacacgcgcagtagctgaagcaggagagaaagctgttgatgccgtcaaggtgagagctgccgaagacccatggagaccgtccaggcagacgcagcaatcagtcaacaagattcagtcagagttagggctccctgtttcagaatatctggctcaggatggagtctttgagctgactgcaaacagcctgtcttttgctaagttgttatcctctttgacggatgagggtcttatgatatcctgtcaggatttggagttcgcactaagt

SEQ ID NO: 3225 - DNA, 677 bp, Nezara viridula
ccgatgaagagccataatgagaaaaagttgaatctgtctacgattaaggaagaccctgaagacaatgaagtcgaagatgcgatggcagctcttgaagctttagctccttctaaagaaatgaaattcaattacaagactgaaagagcatccaagtctccagaaaaaattattaaacaagaattggagaagcccagaaaacgtagtcgcagccgtagtagaaatagagacaaaaagagaaataggagtaggagtagaagtagaggaagaggaagaagtaaagagaagacatccagtaaaagcaggcagagaagtgtgagtcgagggagaagaagaagaagtagagacagaagttctagtcgaaatagaaatcatgtaaagaacagggatagagaaaggagagacaaaaatgatcgtaggagtagaagcaggagcaatggtagaaagaggaatgaaagaagtcggagcaggagcactggtaggagaagaaatgacagaagtcggagcaggagctatgacagaaagaaaaatgacaggaaacgagaaaatgaagatgagaagaataagaatgatgaacctcttgaacccgaagttggtaaaatatataatggaaaagttaccaatatcgtttcttttggttgttttgttcaaatcgagggtttaaagagacgttgggaagg

SEQ ID NO: 3226 - DNA, 713 bp, Nezara viridula
gtattagcgtggagaaggaggtttccgaagaatcaatgaatggcacatcggatccacctaatctcagacacagaaaaacttctaaaaatcaccagaatgggatcagtgaagtgacaaataatgttaaaaagaaattagtttttaaattcaactctggggatagtatacagtctgattttagtgaaaaggaaccatgccaaagggtagttacaatatctcgttgtggcggttggatggcaactggtggcactgatggtattgtaaggatctggtcatttcctggccttcgaatgattagagctcttaaggcccacacgaaggagctggatgatttacatttcagtcctgattcaaagcaggtagccagtgtggcaaaagatggacaagcaattatttgggagctgaagtcaggaaaacaggttcataaacttgattggactcatcctacaggaatcaaatatctcttcaaacgatgtcggttcggtgtggttgagggtaaaggttgtagattgtttactacagctaaccctgtggctggtgggaaggaagcccaaggctggatccacgcctgggacgatggtcgtatttccaagtcgactgctgtatctgaacctacttcagcacttgctgttagagacgatggtgttttcattgctattggcaccatgttcacaggatctgtatccatttacatagcattctcccttcagaga

SEQ ID NO: 3227 - DNA, 701 bp, Nezara viridula
agtgcgttctttggtagattatttcttggatcttgaagctggaataggaatagaagttcaactttgtaaagagtgtatcgaatgggctaaagatgaacacaggacttttctcaggcagtcactggaagctaggcttatcgctctatatttcgacacaggaatgtttacagaagcactacagcttggctcaagtcttcttaaagaattaaagaaattagatgataaaaatttgcttgttgaagtccttttgttggaatctaaaacttatcatgctttgagcaacctttcaaaagccagggctgctttgacatcagccaggacaactgctaattccatatattgtccacccaaaatgcaagcagccctcgatttgcaatctggtatattacacgcagcagatgaacaagatttcaaaacagcttactcatatttctatgaagcttttgaaggctatgatagtgtagagagcccaaaggctttagttgctcttaaatatatgcttctgagtaaaatcatgttaaacacaccagaagacgtgcagcagttggttagcgggaaacttgctcttaaacatgctggtaaagatattgatgcaatgaaatcagttgctcaagccagccataagagatcacttgctgatttccagctaactttaaaaaattacaagaaagagcttgaggaagatccaattgtacgagctc

SEQ ID NO: 3228 - DNA, 652 bp, Nezara viridula
aaatgctgtgcaaaccttacgtgaagatttttcattcaaagaacagttacatgaacagcagttattggaaactcgtactaaaaaacaagtggaaataagcgaacttgatggtagattaacccaggagtatgaagaaagattataccagagtctccaagaaatacgcgatcaatatgaatgtgatattgaaaataacaaggaagagattaaaaaactgtatgaggaaaaaatccgcagtcttggtagtcaattgacacggaacagcaatgcagcagcaatggctattgaagaaatgaaaaatatgcaagctaaacttaatgagcttaataggaaattacttgacttagaagctgacagaaatgcagcccagcaaaaggctagagatttggaaaagattttggaacaggctaaagctcaatatatggaagaatatagtcagagagaagctgaaatcacaactcttcgtgaagagatggctcaccaagttcaagaatatcaagatttaatggatatcaaagttgcattagatttagaaatagcagcttatcgaaagttacttgaaggagaagaagctaggttgaatataacacctgtgagttctcctgctcagacttcttcccgtaaatttttagggaggaaaaggaaacgtact

SEQ ID NO: 3229 - DNA, 702 bp, Nezara viridula
attgttatggctgctaccaacaggcctaattcaattgatgctgctcttagacgtttcggacgatttgatcgtgagattgatattggtattccagatactactggacgtttagaagttcttcgaattcacacaaaaaatatgaaacttgctgatgatgttaatttagaacagattgcagccgaaacacatggtcatgttggtgctgatttagcatctctctgttcagaagcagctcttcaacagattcgtgaaaaaatggatctaattgatttagaagaagaccaaattgatgccgaagttcttaattctcttgctgttaccatggataacttcaggtatgctatgggcaaaagtagccctagtgcccttcgtgaaacagtggttgaagttcctaatattacttgggatgatattggtggtctcgataatgttaaaaaagagttacaagaattagttcagtatcctgttgaacatccagagaagttcttgaagtttggaatgcaaccttcccgtggtgttttgttttatggaccaccaggttgtggtaagactttgttggccaaagctattgctaatgaatgccaggccaacttcatctcggttaagggtcctgaattattaactatgtggtttggagaatccgaagctaatgtccgtgatatttttgataaggctagagctgctgcaccatgtgttcttttt

SEQ ID NO: 3230 - DNA, 673 bp, Nezara viridula
tccaagtctttgtgaagaactgttgtcttcagtagaccaacccttaaaaattgccattgataaaggggttggtaaagattatttgttatgtgattacaatcgggatggtgattcatacagatcaccttggagcaatacatatgatcctcccttagaagatggttcaatgccttctgagaggctaagaaaactagaagtagaagccaatgccgctttcgatcaatatagagagatgtattttgaaggcggtgtgtcttctgtttacctgtgggatttggatatgactggttttgcaggtgctattttaattaaaaaggccggagatggttcgaaaaaaattaaaggttgctgggattctattcacgtagttgaagttcaagaaaagacaactgggcgaaatgctcattacaaattaacttcaactgttatgctttggctgcaaactaacaaaactggctcaggtacgatgaacctgggaggtagtttaactaggcagatggaacaagatgcacctgtttcagaggcttctccacacattgctaatatcggccgaatggtagaagatatggaaaacaaaattaggaacatacttaatgatatttattttggaaaaactaaagacattgtcaatggcttaagaagcacacaggcattatcagaacagaaagcccag

SEQ ID NO: 3231 - DNA, 677 bp, Nezara viridula
gtccaacagaatcagacagtccccagcttgaccatgacaacagctaccggtacaattgtaaataaatctgtcggggctacacagcccgtagtaccgttagcaagcaccaataaacttaccgtacctacagtatctgcagtcgcacaccctgaacctgtgaaacctgtcgtggcatctcatagtagcctgcctcaacaacctgcgaggccgaccgctacagcagcccctctcacaaccgctaagagagcgtcaatccctacacctgccacagccttaggtatacctcctcctgcgccaaccagccttgaaacaggtcctgtcgagattaaacaagaattggatgttcctgtttcactagctcctgtgccagaccacttggatttcaaaaaccttttggaagttaagcccgagttgaatgatattgtaacagggatgccttcagtatttgatcctctgcccgactcaccccccataataaaggaagaaaaacatgccatactccctcaccacgctgatggacatctgaataactcacttccccctataagtaacatacctgttcaaccaattataccgagtgctgcacttccaacaacaccacacgtcttagatatgaacaaaaattctcagcctcctcagcttcctcagacaccagttttaccacactcctttaagcc

SEQ ID NO: 3232 - DNA, 693 bp, Nezara viridula
gcaggcaacaatcttcttacatcgcatcaaggcttggacagatattcagaaggtatacaagtctaaaaggttccgtgctggtaaaggtaagatgcgtaataggaggcgcattcagcgtagaggacctctcattatctacggccaggatcaaggcctaactcgtgcttttcgtaacattcctggtgttgatcttatcaacgtttcacgattaaacttacttaaactggcacctggtggtcacgtgggtaggtttgtaatctggacccaatcagcttttgatcaacttaatgctctctatggcacatggaagaaaaaatcaactttgaaaaaggactacaacttgccaatgcccaagatggtgaatactgatctgtcccgactttttaagtctgaagaaatcaagagtgtcctcaaacctccaaggaagaccatagtcaggagggtaaggaaactgaacccattgaggaatacacgagcaatgctgaagctcaacccatttgctgctgttctgaagaggaaagctattttggctgacaggaaacttaagcttgagagggctattgagagatcaaagaaggaaggagttgagcttacccctcatcaaaagaggtatgttgctatgcttgagagaaggaaagctcagatcaaagccgccaaggctgctaagcctaaaaaggttaagaagcctaaggc

SEQ ID NO: 3233 - DNA, 768 bp, Nezara viridula
ccttacctcttgaattggctaaagagtttgtttcatcgaaatttcaagcaccagaagatgttttgaaagctgcaaagtttatggttgcgacacaactgagcagggaacctcttgttcggcgttgtatgcgggatacgttttttgaaaaagcaaaaattgatgttaaacctaccaagaaaggatcaaaggaagttgatgaaaatcatccttgttacgttatgaaatatgtcaaaggaaaaccggtgagagatttaactgctgaccaatatttgaaactgcatattgcccatcaagataaacttttaaatgtttctattagtgatcatattggaggccatacaacaacttcctatattgaggaaattaagcaactctactaccgagatgagttcatgcagcatgtacaagagtggaataatattcgtcaagaatgtgttgacgtagcgattaagaagatgttagtcccagaactgataaaagaactccatactcgtctccttgaagaagctaaagaatttgttctgagatcatgtgccagaaaagtttacaattggattaaggtggctccatttaatgttgaattcggagatgatgatgaagatgactgggatacaagcaagggtattcgtgtcatgggaatcgcttatgtacctgatttagctcaggcctcttttgcctgcatggtggctcctgatggtgaatgtactgattttcttaggctaccctatcttttaaaaagaaaaaatacttggcgagaagatgaaagaa

SEQ ID NO: 3234 - DNA, 678 bp, Nezara viridula
cagggtgtagctcatgaaattctcggactggaattggttactttattagtagaaaaccctacagatgattcaattgaggttgcagtagcgtttttaaaagaagcaggccagaaattaagtgaagtaacaagcaaaggcacaaatgctatatttgatatgttaagaaatattcttcatgaaggaaagttggagaaaagggtacaatacatgattgaagttatgtttcaagttaggaaagatgattttgctacttttccagcagtaccagaagagctggatcttgtagatgaagaaaatcagttcactcacttaattggacttgatgatgcaatagatacccaagatatactaaatgtattcaagcttgattccgaatatcaggcaaatgaggaacgttacaaagaattgagaagtgaaattcttgatactgattctgaagatagtgggtctgaaggaagtagtactgaagcagaagaggattctgattctgaagatgaagaaaagaaagtcacaattgtagataatacagaaacaaacctgatatcactcagaaaaactatttatctaacaattcaatcaagtcttgactttgaggaatgcgcccataagttgttgaaaatggaaattaagcctggacaagagaaggaactttgtcatatgtttctagattgctgtgct

SEQ ID NO: 3235 - DNA, 691 bp, Nezara viridula
tacaagtacgaagctacagccggagctccagaaaaagaggtgttgttggatgaaaatgatgaactgtgggtagaattacgtcatcaacatattgctgtggtctcacagaatgtcacaaagaatttgaagaagttcacagagtcgaaacggatgcctcaaggagacaaacagtccatgagggaccttagtcaaatgattaaaaagatgccacaatatcagaaagaactcagcaagtattcaactcatttacaccttgcggaagattgcatgaatgcctatcaagggcatgtcgataagctctgcaaggttgaacaggatttggctatgggtaccgatgccgaaggagaacgtataaaggaccacatgagaaatattgttcctattctcctcgaccaatccgtctcaaattatgacaagatgagaatcatcctcctttatactctgtccaagaatggtatttctgaagagaacttgaacaaacttgttcaacacgctcagatccagccacatgagaaacaggccattgtcaacttaggaaatcttggcctaaatgttgtagttgatggtactcgtataaagaagccatatgtgcctcctcgcaaagagcgtattactgagcaaacatatcagatgtctcgttggacacctgtaattaaggatctcatggaagattccatagatgacaagctcg

SEQ ID NO: 3236 - DNA, 717 bp, Nezara viridula
caagtcatggccaaatttgttttgaatatttaccacttaaaactacagaaacatattgtaagcaacctttctgacaagtctgatacaaataaatatctaagaaacttaatggaattatatactaggactactgaactatctgcagaattgagctgtttcaaaatggggtctgacgattcatatcttcaaaagctaactcataatatatttcaaaaatatttagaatcgtatataagtgtcgaagtcaagggcttaaaggaaaaatgttcaacattgttacaaaaatattatgattccaaagatcaccataaacgacaaatacagtctggaggatttcaagactttagacgtgatcttcaagctgtaattggcacaagagctaatattaacattgctcaaattgaagattatggaggagaaacatttttatctgaagaattggttattagtcttatacaagagtctaagcaggcgttttacagatgtaaattgctctctaaacctgcagacttagcaagtaatgcagtgcagctgttagaagttctattaaattgtattataattgatcatgttgattatgctgtagaattagctttacaagcagtaccgattcctgaaagtaaaacacagtctcagccaatttatttctttgatgttgtaagacaggcaaatactattgtgcatctgattgaaaaacacttcaacgattctgctctt

SEQ ID NO: 3237 - DNA, 724 bp, Nezara viridula
atggtcagagacaaatcgagaccgaagagagaggctaaggcaactagctctcgaaacaattgatataaacaaagatccctattttatgaaaaatcatttgggttcttacgaatgtaagttatgtctcaccctacataataatgagggaagttatttagcccacactcaaggaaaaaaacatcaagcaaacttagcaagaagagcagccaaggaagccaaagattctccacagcaacctgctccagataaaccaagaatagaaccaaaaaaatttgtcaaaattggtagacctggttatcgagtcactaaacaaagagatcccgaaactggtcagcaaagtcttctttatcaagtagattatccagaaattgcagaaggaatcttacctaggcatcgtttcatgtcagcttatgaacaaagagtggaacctccagataggaaatggcaatatcttctatttgctgctgaaccttatgaaactatagcctttaaggtgcccagccgtgaagtagacaaatctgaaaacaagttttggacacattggaacaaagacacaaaacaatttttcctccagtttgcatttaagaatgaacctcttgctcctcctatgggtgcacctcacttaggtcaaatgagacctccacatatgctgccaccacctatgagcgtacctccacctcccatgtttaatcctgttccacctccccctccaaatctaatgctt

SEQ ID NO: 3238 - DNA, 263 bp, Nezara viridula
cgttacatgcgagacaaaaactggagaagtctacagaggaaagttgatcgaagctgaagataatatgaattgtcaaatgaccggtttaactgttacctatcgcgacggccgagtggctcagttagaaaatgttttcattagaggctcaaaaatacgttttcttatattaccggacatgttgaagaatgcgccgatgttcaaaaaacaagggaataaaggtaatactggtgcggggagaggtaaatctgcaattctcagagctc

SEQ ID NO: 3239 - DNA, 659 bp, Nezara viridula
cttgatactctgaggaaggctgttactggtcaagaattcaggccttgggaattgtctgataatatttctaggatcaaaattgaattggcatcattgccttcacaggcaaaagtaatagatttgattcataaagcagctttcaggagtgggcttggaaattctatttttgttcgagaattcaatattaagaaacttaacagtgaaacgctgcaacattatgctgctaataatttaactggggacaaagctgccatagctggttgtggtatatcccaatctgatctgacttgtttcgccgaatcccttgggctctgccctggtagtggcagtgcattgcctgcatctaagtatagtggaggagaaatcaggattgaggaaaacattccactccagcataccatcattgctgctgaagcaccaagcttagacaaaagtgatgccctggcctacgctgttctgcgatatgcccttggaactggtccttcagtctaccgtggcacaggatctggaccactttccaaggttgctggtgtgcttgtcggtgctcaggccctttccatggcacactctgacgctgggctctttggtatttatgttgcttctccaggctacaacgctaaagaggctgttgaagcagcagtgaaagttttgaagggtgg

SEQ ID NO: 3240 - DNA, 189 bp, Nezara viridula
tcgaagaggaaaatgaccagatgacaaataaactgaaagataaaataactgctttaaagcacttgtcaatcgatattggtgcagaagtaaagtaccaggataagatgctacatgggatgtcagaagacttcgaccgtaccggaggctttctaggaaatactatgaatagagtattacgcctcaccaaag

SEQ ID NO: 3241 - DNA, 726 bp, Nezara viridula
atttgcagctatgggtgttaacatggaaactgctcgatttttcaagcaagattttgaggaaaatggttccatggagaatgtgtgcttgtttttgaacttggcaaatgacccaactattgaacgtattatcacgcctcgccttgctctcactgctgcagagtttcttgcctaccaatgtgagaagcatgttttggttatattgacagacatgtcttcttatgcagaggccctgcgagaggtatctgctgccagggaagaggtgcccggtagaagaggtttcccaggttatatgtacaccgatttagcaaccatttatgagagagctggacgtgttgaaggcagaaatggcagtataactcaaattccaattcttactatgcctaacgatgatattactcacccaattcctgatttgacgggatatattactgagggccaaatctatgttgaccgtcaattacataacagacaaatttacccaccaattaatgtactgccatcattgtcccgtttaatgaaatctgccattggagagggaatgacccgaaaggatcattcagatgtctcaaatcaattgtacgcctgctatgctattggtaaagatgtgcaagccatgaaggctgttgtgggagaagaggcacttacacccgacgatcttctctacttagagttcttgacaaaatttgaaaagaacttcatttcacaaggtacctacgagaacagaac

SEQ ID NO: 3242 - DNA, 745 bp, Nezara viridula
cagggtctcttggctattttcaaaagcggtggcatccctgctctagtgaagcttttaagttccccagtggaatctgttcttttctatgcaatcactaccttgcacaacctccttcttcatcaagaaggaagtaagaccgctgtgcgagttgctggaggattgcaaaagatggttgttttactacaacgaaataatgtgaagttcttagccattgtgactgactgtctccaaattctagcttacggcaatcaagaaagtaagcttattattttggcatctcagggtcctattgagctagtgcgaatcatgaggagttacgattatgagaaactgctttggacaacatcaagagtacttaaagtattatctgtctgttcgagtaacaaacccgcaatagttgaggctggaggtttacctgcactggcagtgcacctggggcatccatcgcagcgacttgttcagaattgcctttggaccttgagaaatctttcagatgctggaacaaaagttggtggcttagaagggcttcttcagtctcttgttcaactcctggattcctctgatatcaatattgttacttgtgcagctggtatcttatcaaatttgacttgtaacaatcaaaggaataaagtgactgtgtgccaggttggtggtgtcgatgctcttgtccgtacaattatatcagctggagacagagaagaaattactgaacctgctgtttgtgctttgaggcacctaacttctc

SEQ ID NO: 3243 - DNA, 651 bp, Nezara viridula
gctgaaaaatggagaatgcaaatcataagagaaatagctcgtaaagtttctcaaattcagaatgctggtcttggagagtttagaattcgtgatttaaatgatgaaatcaataaactactgcgagaaaaagggcattgggaagcacaaattcgagaacttggtggtccagaccactcaaggtctgggcctaaaatgctggatgctgaaggaaaagaagtgccaggaaatagaggctacaaatactttggtgcagcaaggcaacttcctggagttagagagttgtttgagcaggctcctcctccacctccgcataagacacgtggggaactaatgagagatattgatgcctcttattatggttatatggacgacgaagatggaatcattataccactagaagaaattgaggaaactaaagctattaaaaaagctgtagcagaatggactgtaaaaaaggaaaaatcaatggaaatagacgaagaagaaaaagaagaagtcgaagaagataacatctacaaagcagcaggaaataaagagggcggagaagatgatgaagaggaagatgcaggggaagacgatgggttcgaactgagtgctaagttactggaagggtacagagctcatattcctgttccttcacaaagagaggtg

SEQ ID NO: 3244 - DNA, 515 bp, Nezara viridula
tgtcaaacgccatttaactggtgaatttgaaaaaaagtatgttgccaccttaggggtagaagtgcatcccttagttttccacaccaacaggggtcctattcgcttcaatgtatgggatactgcaggtcaggagaagtttggtggacttagggatggatactatattcagggtcaatgcgctatcattatgtttgatgttacttcaagggtaacctacaaaagtgttcctaattggcatagagatttagtacgcgtctgtgaaaacattcccatagtactttgtggaaacaaagtagatattaaagatagaaaagtgaaagctaaaagtatcgttttccatagaaagaagaaccttcaatactacgacatcagtgctaagagtaattataattttgaaaagccttttctgtggttggctcgaaaactgatcggtgatccaaatctagaatttgttgctatgcctgctctgttgcctcctgaagttaacatggatcctgaatggaaggaccagattg

SEQ ID NO: 3245 - DNA, 362 bp, Nezara viridula
ttatgctctaccgttatggcgggaaacaaggatttctgggagtaggtggaacgtggaacttgtatgaagtaaaaagtgctgatgctgaaattattgcatctggagtttttgtgggatttttcatctacacatcagttatcttaatttcatactgctttggaacaacaaagcacaaatatagtgcagtagatataataatgaatgtgagtggaactatattgttcaccgctgtaggaggcatagcattacattactgggttggtttccaggatgaaaaccattatgtgggaatttctcaagaaaaacaaataggacttgcattaggcagtcttagtgtagtatgtgctgctatctaccttctc

SEQ ID NO: 3246 - DNA, 795 bp, Nezara viridula
tgaaaggaggtttgaacacaccactttataactcagagtttagtgttcatccaccgtctgatcagatcacaacaccgaacactgtactgactacgccgttttctaatcgaactcatgaaggaaggactccaggtttccaaactccgcaagacgtaagaaccagcctcaccactcctgtcagagataaattaaacattaatccagaggaaggtggtgatacaccatatgctcctgtaaataatcaaaaacaggtaaaagaggaacttgctgctcgtcttaggtcactaccacagcctaagaacgattatgaaatcgttgttcctgaagatgaagtttcgtccgaaacagctgcagagggttctggtatgctaagtgttgaagatcaagctgatatcgatgctagaaatttgagtttccttgctcaacaacgcgaaaaagaattaaagagtagatcacaggtaattcaacgagctttgcccagacctggagacatcaacatagtactccgcccggctaatacagatccacctctaacagatcttcagaaggctgaagagatgataaaggaagaaatgataacaatgttacattatgatgccattcacagcggtgagccttcttctgcaagaaaaataggaactgtaagtcaggcacagcaccttgcctatctcgaacaacacccataccacacttactcagaagaccaaatagagaaggccaaagaaatgctgaaagccgaaatggaagttgtcaagcaaggtatgaaccatggtgatctgtcgctggaaacattta

SEQ ID NO: 3247 - DNA, 347 bp, Nezara viridula
aatggtatgttgcacatccagataaattgaagaaaaaaattaccagagaactaattactacaattttggcaaggaagccaaaaatgtgtagctttttggaatggaaagatttgaaaatagtatacaaaaggtatgcaagtttatatttttgttgtgccatagagcaaaatgataatgaactgcttacattagaagtgattcatcgatatgttgaacttcttgacaaatactttggaagtgtttgtgagttggatattatattcaactttgagaaagcatacttcattctagacgaacttttacttggaggtgaaattcaggaaacaagcaaaaagaacgtcctgaaa

SEQ ID NO: 3248 - DNA, 725 bp, Nezara viridula
aatcagaagcatcgaaaggtggtgaagttttcaaggagaaattggaccacattaaagataaagtcagtgatgtgctggaggaagcagcaaaatcagaaatcgggaaaaaagcaggtcagctgggagcagaaattggaaagactgcgaggggagctgctgaaacattatcagaaacaggacagcagatcggaaaaagtggagcttttcaaactatcagccaaacagctgcagctgtaaaacaagaattagatcaatccggaattcatgctcatgtttatcagccgccacgaaaactaagaaaaagattggaaatagtaccagataataaagctttaaaacctgacacagaaacattaggtattgatctccataaggactcaaaatttttccaaagttggcaacaattcaaagacaataatgcttatattaacaaagttctcgattggaaaatgaagtatgatgagagtgataatcccgtcatccgagcatctcgagtattcacagacaaagtttcaagtgttatgggtggcctttttcagaaaactgaactttctgaaacactgacggagatatgtcgaatagatccgaattttgaccgagctcactttttgaaagattgtgagaaagatatcatcccgaatattcttgaagctatggtccgtggagatttagacatattgcaagactggtgccatgaaggtccatataatgttcttgctgctcca

SEQ ID NO: 3249 - DNA, 631 bp, Nezara viridula
tgattcagaaacagaggcaatacaagaagcttttgccagaggagatcttaagccaggacttaacattcctgttaaagataaagtcaagacaaataatgttcctctcctgaaagacacattaagtgaaatcaagttggaccttccgtggattgaaagattggatgtaacaaacgaacaagcaccattggcccctgaactcgctttgcagatcagggaagaagaacaaggacataatccattagtttatgacgagttgaagagagaaagcgtattctatagacaagctcagaacgcagccatgaaagtgttaccaaaattgaaagaactgggccttagaactgagaggcctgacgactattttgccgaaatggccaagtcagatcagcatatgcagaaggtgaaaggtgaagccatcaagaaaaaactaatgatggaaagaattgaaaaactgagagaaatacgagctcagaagaaagttcagaaagctcttcacgctcaagctaaggttgctaaagttcaaagtaaaaaacaaatgctagaagaagtgaaaaagtacaggaaaggagaaactaagagtttagctttccttgagccaggatttaagccaaaagccaaaccaaacaaatcccaa

SEQ ID NO: 3250 - DNA, 677 bp, Nezara viridula; identical to SEQ ID NO: 3225

SEQ ID NO: 3251 - DNA, 754 bp, Nezara viridula
taatgtggtcacaacgtgatccttctctcagaaaatctggcgtgggcaatgtctttattaagaatttagacaaaagtattgacaataaggctatgtatgacactttctcagcttttggcaatattctcagttgcaaagtggcacaagatgaaaatggcgtttccaaaggatatggttttgtccattttgaaaccgaggaagctgccactaagtcgatagataaagtgaacggcatgttgctcaatggtaaaaaggtttttgttggtaagttcattccacgaaaagaacgtgaaaaggaattaggtgaaaaagccaaactgtttaccaatgtatatgttaaaaattttggggaagactttactgatgacatgctgaaagagatgtttgagaaatatggaccaattaccagtcacactgttgttgtaaacaaagatggcaagtctcgtggctttggttttgttgctttcgaagacccagaagctgctgaaagagcagttgaagatctgaatggaaaagagcttattgaaggaaaaccactatatgtaggaagagcgcagaaaaaagctgagcgtcagcaagaattaaaacggaaatttgaacaactcaaaatggagcgtatgaaccgttatcaaggcgtcaacttatatgttaaaaatctagatgatactatagatgatgaaagattgaggaaagaattctctcctttcggaaccatcactagtgcaaaggtcatgttagaggaagggcgtagtaa

SEQ ID NO: 3252 - DNA, 794 bp, Nezara viridula
ttgtgaagatgctaaccctcttataagagctcttgcagtaagaacgatgggttgcattagagttgacaaaataactgaatatctttgcgaaccactcagaaaatgtctgaaagatgaagatccctatgtgaggaaaacagctgcggtatgcgttgcaaaattatatgacatcaatccccagcttgttgaagatcaaggtttcttagatcagctcaaagaacttttatctgattccaacccaatggttgtagctaatgctgttgcagcactctctgaaatgaacgaagcctcagttaatggggcgcccctcattgaaatgtctgctgcgactataaacaaacttcttactgctcttaatgagtgcacagaatggggccaagttttcatattagattctttggccaattatagtcctaaagatgaaagagaagctcaaagtatttgtgaacgtattactccaagactagctcatgctaatgctgctgtcgttttatctgcagtaaaggttttgatgaagtttttagaaatgttgccatctgaatctgactttgtatcaactttgacaaagaagcttgcacccccattggttaccctgctgtcatccgaacctgaggttcaatatgtcgctttgcgaaatataaacttaattgtacaaaaacgaccagatatcctgaaacatgaaatgaaagtcttctttgtgaagtataatgaccctatttatgttaaactggaaaaactggatatcatgattagattagcttctcaagctaacatagctcaagttctttccgaat

SEQ ID NO: 3253 - DNA, 359 bp, Nezara viridula
aaagattggtcctcttggtctgtcccctaagaaagtgggtgatgacattgctaaagctacagcagattggaagggtctgaaaattacagtttgccttactattcaaaacaggcaagctgctatctcagttgtaccatcagcggcttctctcatcattaaagccctgaaagaaccaccaagggacaggaagaaagtcaaaggagtaaaacataatggtaacctcaccttcgatgaaattctcaccattgccaggtcaatgaggccaagatccatgtctaggaaattagagggtactattaaggaaattctcggcacatgccaatctgttggttgtacagttgatggtaaaactccttccg

SEQ ID NO: 3254 - DNA, 654 bp, Nezara viridula
agctggagtaactgaagttgtattagctgtatcatacagagcggaacagatggaaaaggagttgagtgatgaggcaaaaaagttgggtgttaaattaattttttcgcatgaaacagaacccctgggtacagctggacctctggctttagccaaagatattttatcatcgactaatgaaccattttttgttctgaattctgatattatttgtgaatttccgttcaaagaacttgtttctttccataaaaatcatggaaaagaaggaacaattgtagtgacaaaagtggaagaaccatctaagtatggtgttgttgtttatgatgagaaaggttgtattgccagtttcattgaaaaaccacaagaatttgtttctaataaaataaatgcaggcatgtacatactaaacccttcagttttaaaaagaattaaactggaaccaacaagtattgagaaagaagtatttccgtttatggctgaggcaggagaattgtatgctatggagcttagtggattttggatggatgttggacaacctcaagattttcttacaggcatgtgcttatatcttacatctttgcgtcagaaagcacctgaaaagttgtacgctggccctggatgtattggaaatgttctagttcatcctactgctcgaat

SEQ ID NO: 3255 - DNA, 670 bp, Nezara viridula
tatattacattcgccaccgggagaatttaacgaagtttttaatgatgcaaggatattattaaacaacgatactcttctgaaagaaggagctcttggagtcttcgggcagtactgtaaagaccagcttacgcctgtgaagattaagaacagtgagtatccagttttaattacagaacataatgatctaggatccaacaggttttatgatgcaaggtcgaaacagtcatttaaatatgatccattaaggagagagacatctaattatgactcatgggaagcagaacctggtacagaaaagtggagatcagctttagagagtgaattagatgcatatatagctaaacactttgaaagtggctctggtagtgtattttctaaaagagaggatggcaaagtaaacttggttgcgtgcatagaagcccatttattccaaccaaaaaattgctggaatggttgttggcgatctcagtggtttgtgacaatagattcagataatgcggatgtgaaaggtgttttaaaaattcaagttcattattatgaagatggcaatgtgcagcttgtcagtttaaaagatattaaccaaacactgccagttgttgatgaagaacagttaagtaaggctttaattaaaatattcgaagactctgaaacagagtaccaacaagcgata

SEQ ID NO: 3256 - DNA, 788 bp, Nezara viridula
caggattggacaattgggtatcaatgatgtagaccagagagaaccaggagtgtattttaggatggaaagggacttgatgacaagaaaagataaattcggagttgaaatgagagagagggtgaaatgggacatacgagaaagtgttgtcggctccgattcttttgaacccaaacatgctgtgattgttacctggaaaaatgtttcgtttgctggtggcattgaaaactcagtacaaacaacaaacacgtttcaattggttctagcaacagacgaagtattcacttatgctatattcaattatgctcaaattaagtggaccacacatactgaagcacgaggggacacagttaaaggagaaggaggtgtgccagcatacataggatttaatgctggcaatggcacaagaagttacgaatatagaccttattcacagacatcgacaatcagagatttggttggccgtggttgggctaacggtttcccaggaaggcacatttttagaattgatgaaaatattcttccaggaacttgtaacaaggatattgctgcagcaagtttgcctctcgcattcgctcctgaaagtggtaacatgctcggtggtaccatagtgaatataacaggaccttgttttgaaccaactatgaagattgtatgcagatttgacatgaaagctgtatatggtacagttgtggacaggaatagagcaatttgtgttcaacctttcgtcatggcagaaggttacatattgtttgacatcgccatcgatgacggaaaatacgtttggaagg

SEQ ID NO: 3257 - DNA, 206 bp, Nezara viridula
aagctctgttggaattgagtctgattcagaacgagtgaacaaagtaatttcggagctgaaaggaaaaaacattgaagaagtgatagctgcaggtaaagagaagttggcttcagtgccctcaggaggtggtggtgcccctgccgctgctgctgctgcacccgctgcagcctcacctgccaaagcagccgaagagaagaaggaagcaa

SEQ ID NO: 3258 - DNA, 746 bp, Nezara viridula
agggcccagtaaaaagaaaaagggaaggtcaaaacgcgctcatgttttggttgcagctgtcgaaaaagccactgaaaattttattgaaaaaggtgaaatgatagcttatgaaaatcctgatattaagcaagaaatgctgtcagctgtagaagaagtgagaaaaacaggggaagctatgagtgcagctgcaagagaatttgctgatgatccatgctcatcaatcaaacgtggtaatatggtacgagcagcccgcaacttgctctctgctgtgactagactactgattctagccgacatggtagatgtacatctgctgttgaagtctcttagagtagttgaagatgatctggtcaaagttaaaaatgcatcaagccaaccagaactgcttgaaaacattaaagcatttggacgtaacgcttccgagttaatgtctcaggctgccaaacggcagcttgagctaaaggattcacagctgagggacgacttagctgcagcacgtgctgttttgaagaaacatagcaccatgttactgactgcatccaaggtatatgtcagacatccagaacttgctgctgctaaggcaaatcgtgattatgtttttaaacaagtttgtgaagctgtcaatacaatcagtgatgtagctcagggtaaaggaccatcgatcactaccaatccttacgaaggccctggcgagcttgcagctgctttggatgattttgatgaacgtatggtgatggaacctttgg

SEQ ID NO: 3259 - DNA, 693 bp, Nezara viridula
tggcttatcatcaatcggaggaaatgctccagccagtaccggactgaatttcggaagcactgctaaatctactaatgctggagccactttgttcagtgcaactaaaagcgcacttgcgcctgtcaacacggctgcgacaacttcatctttaacattgccaccttcttccacaacatctctcactagttcattatcaaacaaacctgttactagtactggtccttcaatctctcagcaacaaaatcttacatttcaacaattggaagaattgattttgaataaatggactgcagaattatacgaacaggagaaagtatttttaaatcaagcaacacagattaatatatgggacaaggttattaatgaaaatgctgaaaaattaactcagttacattctactatggagaaagtacggaagcaacaaggaaaaataaatgatgacctagaaattatatttactcatcagaaggacttggaagcatgtcttgttcccatggaaaaggaagacttactttcggtccttaaggctgatccgaatagaaaaaatctgtatataaatgctaagaaaattgattctcagattaaaactatgtcagaggatttgaaggaaacaattgaacatatcaatgaaacgtcacgatcacatgatacagaagatcccgtcatccaggtagggcgaattttaaatgctca

SEQ ID NO: 3260 - DNA, 434 bp, Nezara viridula
gctggtaaaacaactcttctccataggttaaaagatgacagattggcacagcatgtaccaacactacacccaacttctgaagaactatccataggaaatatcagattcacaacttttgaccttggaggacacactcaagctcgtcgagtatggaaagattactttccggcagttgatgctattgtttttcttgttgacgcttgtgacacaactcggttacctgaaagtaaagcagaattagatgcccttttgactgatgagagtctcatcaactgtcctgtccttattcttggcaataaaattgatcttccaggtgcagcttcagaagatgatctcaggaattttttcaacttatacgggcaaacaactggcaagagcaaagttccacgaagtgaattgtctggtcgtccattagagctattcatgtgttcagt

SEQ ID NO: 3261 - DNA, 702 bp, Nezara viridula
aaatcatactgctgccttcagtaagcattttgaaacacagctgatggactatgggagacaagttatagtgaatttggttgaccattctggctctgagggcaagctggaaggattctatagaaaactagtgaatgaagcaaataatcccaatctgaagtatgaagcttttgacttccacagagaatgttctaagctaaggtatgatagattgaagattctcatagatcgcctggcctatgatttagaacaaatgtcggtgactatgattgttggagatggaactgttatatctcagcaggaaggtgtattcaggacaaattgtattgactgcctggacaggactaatgtggttcaatcgttgttggctagggccaatcttacatatattttacagagactaacaatattaaagaaaggacaaacagttgaggatcaagttggtcttgaaaacacatttaaaatactctggagtgaccatgcagatctaatatcaatccagtattcaggtacaggagcattaaaaacggattatactagaacaggaaaaagaacgaagtccggaataattcgagatgggataaactctcttgtgcgatactacaaaaataattttcagcatggttttcgtaaagatgcattggacctttggcttggtcattaccgggtttcttcagaagaaggaatagtcatcagaagccctct

SEQ ID NO: 3262 - DNA, 674 bp, Nezara viridula
cagaattagtttgccgtgtcaagtactgcaacactttgcctgatattccgtttgatccaaagtttattcaatatccatttgaatccactcggtttatccaatataatcccacatcgctagaacgtaattataaatatgaagttcttactgaacatgatctcggggttactattgatctcattaacaaagatatgtatgctgctgatcataatgcagtacttgatcctgctgatgagaaactacttgaggaagatatcctcacacctcatgattctaaaaggtctagacatcattctcgatcagtttcatggcttcgtagaactgaatacatttccaccgaacaaacacgttttcaaccgcaagttatggataaagttgaagccaaagttggattcagcattaagaaaagtcttaaggaagaaactctttacatggatagagagagccaaattaaagctatcgaaaagacatatgacgatgctaaactacctatagagaaacatcatagcaaacctaatgtcgttccgatagaggttcttcctgtgtttccagactttcagttatggaagtatccttgcgctcaggttatgttcgattctgatcctgcaccaataggaaagaccgtacctgctcagctagaacaaatgtctcaagctatgatcaggggtgtgatg

SEQ ID NO: 3263 - DNA, 662 bp, Nezara viridula
aggcaaagttggactatctgtgtagcattggggacaaggaaaatgctagcgcattagccaacagcaagttacaggacaaaacggttcctaagactcatcgtatcgatgcggtttttgcattatttaggatatcgtatttccacggttgcgatatcaaagggatgtctgcagcaatcgaaaaagcaaccgaactcatcgaagggcaaggggattggagctctaggaataaattaaaagcctacgaaggagtgtggagtttcgccgtgagggattatttgcgtgctgcaaagctatttgttgatgttgttcccacatttgaatcatacgagcttgctgactttgggacaattattaaatacacagtactttcgtgtatgatagcgttgcccaggtgcgagttgaagaagaagctgatgcaccatggcgtgatggcccaggcacttcactctcaatatagaaacttgaaggagtatttccagtcactttacgatggccactatgcagaattcctagtcgcgctagctcaggtggaatccgatatgaaacgtgatcctctacttcatcctcattatcgccactatgtgcaagaaatgagacttagagcttataagcaaatcttgcaagcatatcgttcactctctttagattatatggcggaagcg

SEQ ID NO: 3264 - DNA, 733 bp, Nezara viridula
tcaaacgaaacaggatagcaaaggaggtggaggtagcgctggttctgcttctccgcagtctcctcttttgtcgccggctggtggaggcatcggtggacatcagtcccaccaaccttcccctcaaacatcgtcggtctccccagtaagacatagcccagccggaacaccacattcacagagtggtgatgacaaaagcgaaggcagtggtcttccatctcccaggccaccccccatgacacccactccgcctagccctcatcaattccatcagataaggcatccctcgatggtgtcaaggtttgccagatcccctgaaggaggattaaggccacgtttggctcctctccaaacgtctggtttcaattctcccaggggaatgtcgcctcaaccgccatctcctcagacaatgagattgactcaacagcagcaacttctccttcaaagacatcaacttcagcagcaaaaacagcagattctagaacagcatcctgaagcgggggctattctgagtagacaactcttgagacaagaaccacagaggcagtacagaacattcccaggtcctcagagtcctggttctcaaggagggtctccattgtatagtcctcgtgctccacctagtccgatggtttaccaaggacttcagacaccgacatctccgatgcctcagtttacccagcccacatctccaatgcagtctcctcgtttacagtatgcacctagtagtcctcat

SEQ ID NO: 3265 - DNA, 568 bp, Nezara viridula
ggaaagattttgattgaatcagctaatacttatgtaagctgttgtgtctctgtaaaaaatattgaaaggcgtatatttctcctaccaagagaaaggaaaatgaatctcaagacaaatgaaacatatggtgatcctgtgacaatgactgatgtttatcaggaattcagctcaattgtagctgaaaagtataaaataaagcagttcaaatcaagaaaaatttccaagaaatatgcttttggtgataacagtgttcctgcagagtctgagtatctggaaataagatatccgagtacttctccagcactgcccagtgatctcaaaggcgaaaccttttctcacgtatttggaaccaagacatcatttttagaaattcttctgttggaaagagggatcaaaggtcctagttggattgagatcacaaatgctgaacctgttctagctccatttacttggtgcaaagtagaggcatcctgtatgaaagccagcgatgttcatgtgttgaaacctggtttgccgcacattcctccattagttttggttactcttcatccacaagctgtccataatc

SEQ ID NO: 3266 - DNA, 785 bp, Nezara viridula
ttggcatccggataaaagaagaaactgaaatcattgaaggtgaagttgtcgaaatacaggtggaacgaccagctacaggagttggtgccaaagttggaaaactcactttaaagactacagaaatggaaactgtctacgaccttggaacaaagatgattgatgctcttaccaaagaaaaggttcagtcgggtgatgtaattactattgacaaggctactggtaaaattagccgaatcggtagatcatttaccagagcaagagattatgatgcgactggtcctcagactaggtttgtccagtgccctgagggagagttacaaaagagaaaggaagttgtacatactgtatcgatacatgaaattgatgtcatcaattctaggacccatggattcttagctctcttttcaggtgatactggtgaaatcaagccagaagtcagagaacaaatcaatacaaaaattgctgaatggagagaagaaggaaaagcagaaatctcacctggtgttttgttcattgatgaagttcatatgcttgatattgaatgcttctcatttttgaatcgagctcttgaagatgagatggcgcccgttgttattatggctacaaaccgaggtatcactaacatcagaggaactaattatacatcacctcatggaattcctattgatctcttagacaggatgataatcatttccacctcgcaatacagggagagtgagcttagagaaattttgaaaattaggtgtgaagaagaagattgtgaattgtctgatgatgctttgaca

SEQ ID NO: 3267 - DNA, 728 bp, Nezara viridula
ctcattgtttagcctccagtatatctttactaagagcttcagaagtcgaagatatcattgagggaaatgatgaaaaatacaaagctgtttcagttcattcttctgaaactcctattacgagttcttctaaacccaaaaaagctatgccttgggtaccttcgcttccaaatagttcacatttagatgctgtaccacaggcaacaccaattaacagaaatagagttgttagtaaaaaagttagaagctttcctctttgctttgatgacactgatccatcatctataatggaaaatgcttcacaaatggaagtacttgtaccaatacgtcttgatatggaaatagagggacagaaacttcgtgatacatttacttggaataaaaatgaaagtttgataacaccagagcagtttgcagaaatactttgtgatgacctagatttgaatcctctcagttttgtccctgctatagcccaagctattcgtcagcaaattgaaggttttcctactgacaatattttagaagatcagactgatcaaagagttatagttaaactgaatatacatgttggtaatacctctctcgttgatcaaatcgaatgggacatgagtgaaaaagagaatagtcctgaacagtttgctatgaaattgtgtgcggaacttggattaggaggcgaatttgttacagctattgcttattctattcgaggacagcttagttggcatcagaaa

SEQ ID NO: 3268 - DNA, 515 bp, Nezara viridula
gtgatggctgctatacgtaaaaaattagttatagttggcgatggtgcttgcggaaagacttgtttgttgattgtatttagtaaagatcaatttccagaagtatatgtgcctactgtgttcgagaattatgttgctgatatcgaagttgatggaaagcaagtggaactagcattgtgggatactgctggtcaagaagactacgatcggctaagaccactttcttatcctgatacggatgttattttaatgagtttttctattgattcaccagattcattagaaaacatacctgaaaaatggacccctgaagtaaaacatttttgcccaaatgtacctatcattcttgtaggaaataaaaaagatttgcgaaatgatccaaacacaattaaagagttggcaaaaatgaaacaagaaccagttaaaccagaagaaggtagagctatggctgataaaattaatgcctttgactatcttgaatgttctgccaaaacaaaagatggggttagacaagtgtt

SEQ ID NO: 3269 - DNA, 714 bp, Nezara viridula
ttttggagttgtgggtgttacagaaaatggaattcggttatattttactacaggaagcccacctaggccatctacattgtctcttcttcatgccaggctgcctcctggacatgctcctaatacatcaaatgtgaggattggcagagtagctatggctattcataaatcaggtacatttattatggtatcatccatgggtgactattctcctgaccggttatggtgcttcactatggatggtttatctgctttgaagttacccttaacagaatttgtctttacgaatcctcaaaatgcttcaattgctattgctgaatcacgggaaaatatgagtttgacagatcgaggattacatggacactttctagtttaccagcaaaattatccccaggatagatttattattttaagtcagcagggcacagatatttatgaaaagctgagacctgttgacatatttggtgagctaatgcgagagaaaggtggaccagactgtgaagaagtaaaacaattctttgctcagcatggttcagatcaagcatgtgcaatggctcttatacttgcctgtgacgaaaccaatcaacatatggcagaatgggcaactcgtgctttttttctttatggaggtgaccctaaatatgttctacaaaccattcagcaacctatacaacagccaaccatgaccaaccctcttcagcaaagcataatgcatca

SEQ ID NO: 3270 - DNA, 665 bp, Nezara viridula
gagctttccatccttcaagaagctgctgatctcattcatccttctaagcaacttgatgatgctctaagtatcttctatgaagaaggtttaggaagaagtttaaattgtcttatagaagaattagctgtgcctgaagattttaataaagatggtacctgggaatcgttttgtagttatagtggcgttggtgctgtgacatctgcatttcgagattatgttgctgtgaggttaaagatttgtgaaaaaatgttattgcttactgagcttgctatgagagatgatgatggtgctgcagataggactcaacacaggagcttagctgccctttgtaaagcgtattatattttaaaatggatctgtacatccaagtccactggaaatgcacccatgattcatgtgttttctttggtcaacccaacatcaattatgcaatcttctcttgaacaatgtgtgcttggccttgctaattgcttatggccattagcaacaaatagtacacttgctcagcatttgctatcaaccaaacagtatgcacttctacaaacatttgcaagattagttggaataaataactggagtttactactagcagaatcatacattctgacaggacagcctggcaaggcatttgatgtttgtttaaaaaatgctggatcagatgttgt

SEQ ID NO: 3271 - DNA, 669 bp, Nezara viridula
gttggttgcaccttctagtattcagaagcagctttctgaagcaattggcactattggaaagtgtgatttcccaaaagattggcctgggcttctgacaaatatggtcgagaagtttgccggaggtgacttccacgtcattaatggaattctacaaactgcccattccatattcaaaagatacagatatgaattcaaatctcaaaagttatgggaggaaataaagtttgtcttggacacctttgcaaagcctttgactgatctggctgtggctacgcaaaatctaactcaagtacatgctacaaatccagatgctctacgagtgatttattcatcactgctcctcatttcaaagattttttactctctaaattttcaggatctgcctgagttctttgaagataatatgaatatttggatgccactatttcatacactccttactactgatgttaagtgtcttcatactgatgttgatgacgaggcaggtttacttgagcaactgaggtctcaagtgtgttcgaatattgcattgtacgcacagaagtacgatgaggaatttcaaccatatctccagggttttgtcactgatatctggagccttcttgtatcagtttcacttcagcctaaaaatgatctgcttgtcagcaatgcactgcagttcttatcaac

SEQ ID NO: 3272 - DNA, 470 bp, Nezara viridula
gaatccgtttcaattcgaactaacattcgaatgtatcgaagaattaaaagaagatttagaatggaaaatgatttatgttggttctgcagagagtgaagaatatgatcaagttttagatactatttatgttgggcctattccggaaggaagacacaaatttgtctttcaggcagatcctcctgatgtaactaaaatacctattgaagatgcgcttggtgttactgtggttttactaacttgttgttaccgtggccaggagttcgtgcgagtaggatattttattaataatgaatattccgatcctgagctaagagagaatcctcctgcgataccacagtttgacaaggttgtaaggaacattttaggctctgaaccgagggttacaaggttcaaaatcaattgggacgactcagagtcacaagatcaacctagtcaagaatcggaagaacaacagcaaacgacagaaaatg

SEQ ID NO: 3273 - DNA, 698 bp, Nezara viridula
ctttgcaaatgccacctttactaccaatacaatcttcaattaatcagccaaaaccaatgaacacttatgccccttcaatgggtttcacaacaccgcaaagtatgatgcatccacaaacaccacaaaatctcatgtcacctatggtaaatagaatggaccagacgccaaatagtattattaatccaaccactcctggaccaatgacacctatgacaccatcgtctgctgaccctggctttatgccgcagttacagaatatagtgtctactgtcaatttaggttgtaaattagatcttaaaaagattgcattgcatgcaagaaacgctgaatataatccaaaaagatttgctgctgttatcatgaggataagagaacccagaacaacagctcttatttttagttcaggaaaaatggtttgcactggtgcaaagagtgaggatgattctagactagcagcaaggaaatatgcacgaataattcaaaaattaggattccaggctaaatttctagacttcaaagtacaaaacatggttggtagttgtgatgttaaatttcccataagattagagggtttggttttaactcatggacaattcagcagttatgaacctgaactttttcctggacttatttatcgaatggtgaaacctcgcattgttttattaatatttgtatcaggaaaagtcgtactcacaggt

SEQ ID NO: 3274 - DNA, 338 bp, Nezara viridula
taaaacaagctgttaggggctatgcggatgagatggcattcacatttgctgcagctaataaggttttctatgccaactccaatgtgaaacaagttgatgttccctctttcagtggagcttttggtatcctccctaaacacgttccaactcttgctgttttgaaacctggtgttgttactgtttttgaacaagatggctcctctaagaaagtttttgtttcaagtggaacggtaacaataaatgaggactcttcagtacaagtattggcagaggaagcgcaccctgttgaagaccttgatgcatccgcagctagggagcaactctctaaagcacaaggg

SEQ ID NO: 3275 - DNA, 663 bp, Nezara viridula
ttggctgctgaaaagaaaagaactgaaagtgttgaagctgaaaagaaaaggaaagaaaagcttgctgccaaggccactcctaaagtaatggaaataactgacgaagaagcaaaagtaattgaagatgaagaaaaaaagagaaaagaagatgaagaaatagctctatcaaaaccaattacagaaaccgaaggcgaagatgaggaacaagataaaggaaaacttatgcccaatgcgggaaatggtgctgaccttgagaattacaggtggacacaaactctccaagagttggaaataagagttcctctgaagactacttttaatgtaaagtcaagggacttggtggtagaccttggtaagacacatctgaaaattgggctgaaagggcatgaaccaattgtggacggcgaattagagcatgaaatcaaaattgaagaatcaacctgggtcattgaggatggcaagactctatttctaactgttgagaaggtaaataaaatggagtggtggtcaaggctgttagcaacggatcctgaaatagctacccgaaaaattaatcctgaaccatcaaagttatccgatttggatggtgaaactaggggtctggttgaaaaaatgatgtatgaccaaagacaacgtgagcttggacttccaacctctgatgag

SEQ ID NO: 3276 - DNA, 285 bp, Nezara viridula
tttgaacagcaaaaagacccgtgctgagggtagaattattgcaaaagataaagcaatagaaaatcctacataccaagaaataagggatgtgttatcagcagctggtttgaaagtaggtgttgaaaacaaactttacagtagagaaaaaagtaaagagcttctttacagaggtcgaataagagttcagttgaaaaacgacaatggtactccattaaatccagatttcgctaccagagaatccgtaatacttcatgcttgttcaatgattccgaagttgaaaacacg

SEQ ID NO: 3277 - DNA, 665 bp, Nezara viridula
atgctctagaccatcttcctaaagaacgcactgccgaaatatataaggcctatactattcatgagaaaaaatatggagacaggactggaattgaggatgtaatcgtgagcaaaaggaaataccaatatttagaggaagtaagaacaaacccgatcaattatgatgcttggtttgacttgctgaggcttgtcgaagaagagggtaacgtagatactattagggaaatgtacgagagagctattgcaaacataccaccatcaagggaaaaagatatgtggaggcgttatatctatttgtggattaattatgccctatatgaagaattagaagcagaagatgaagacagaacaaggcaaatttataggacatgcctcgacatcattcctcataagacgttcacgttcagtaaaatatggctgttatatgcccagttcgaaataagacataaaaacctttcaacagcaagaaaaactctgggaatggctttaggagtctgtcctagggataagctctaccgtggttacatagatcttgaaatacaattaagagaatttgatagatgtagaacattatatcaaaaatttttggagcatggtcctgaaaactgtattacatggatgaggtttgctgagctagaaacactattaggtgacacagatagagca

SEQ ID NO: 3278 - DNA, 663 bp, Nezara viridula
tttctccagctactgtcaacactggtaggggaactgaatttgaaggtgctgtcattgcattattccatctcctggcaacaaggcaagacaaagtccgtgctttgcgtgaagctttctatagacaaaatcttccaaatttaatgaacttactggctaccatccttgtgtttgccatagtgatttatttccagggattcagggtagaccttcctattaagtcagctcgttatcgaggtcaatacagcagctatcctatcaagctcttctacacttcaaacattcctattattcttcagtcagctcttgtatcaaatctatatgttatatctcagatgttagctgtgaaattccatggaaatgtgtttgttaacatgcttggagtgtgggcagatgttggaggtggtggtccagcccgagcttatccagtcggcggtctttgttattatctatcgcctcctgaaaatcttggtcatatacttgaagatcctatccatgctatgttatacatcattttcatgcttggttcttgtgctttcttctccaagacttggattgaggtttctggatcatcggcaaaagatgttgcaaagcaacttaaggaacagcaaatggtaatgcgaggtcatcgtgacaattccatgatccatgaactgaacaggtaca

SEQ ID NO: 3279 - DNA, 462 bp, Nezara viridula
aaatgaatctcctgaaggcgatgagtcctacttcggtgactccttccgtcgaactcagtacctacagggaccagcattttaagggctctcggacagaacaggaaagacttcttcgcgtatcaactactttatatattggaaatttatcgttttatacaacagaagaacaaatatatgaactgttttcaaaatgtggtgatattaagaggattattatgggattggataaatataagaaaattccatgtggattctgctttgtagagtattaccaacgaccggatgctgagagcgctatgaggtatattaatggaacaaggcttgacgatcgtattataagaacagactgggatgcagggttcgttgaaggaaggcagtatggaaggggaaagagtggtgggcaggttcgtgatgaatatagaagagaatatgatgctggacgaggtggttatggaaaagtga

SEQ ID NO: 3280 - DNA, 678 bp, Nezara viridula
cctacagataggcagcttttctactactaaatcatggtcaagaggaaagaaagctttgtatacttcacttggtattttaacgggaggaacaggcatgttgatatatgctcttgaaaaaagtcttcaagctggagatcttgaactccatcctcccaaacttccttggagccacagtgggtattttcaatcactggatcatgcaagcattcgacgaggttatgaagtttacaaaaatgtgtgtgcagcctgccacagtttaagatttgtttgctatcgagatcttgtaggtgtttcacatactgaagctgaggctaaagcggaagccgaagaacaactcgttttggatggaccaaatgaagttggtgaaatgtttaaaaggcctggaaaactttctgatcatatgcctagtccttatccaaatgaagaggctgcaagagcagctaataatggagcatatcctcctgatctttcatacatagttcctggacgtcatggtgaagaagattatatattccacttactgactggatactgtgatgctcctgaaggtttgattttaagggaaggccaatattttaacccttattttcctggaggagccataagtatggcacaagcattatataatgagattattgaatactctgatggaactccagccactcaaagtcaattagc

SEQ ID NO: 3281 - DNA, 732 bp, Nezara viridula
gttatgttgaagcagctcacatgagcgaatttcagtttgaaaatcagcgaaagactttccaaagttatggttatgctcttgacccttcaattgataatatgggtcgcactgaagatagtatacctgtcgtcggggctgtagatgttgcaaaagaaactaacctgaagacagtttttgaatctacttcaaaacgacctcttgacaaacggaaaagaaataaaaacgatgatccggctgatatcaatggcttccttggcccatgggggtcctacgtggatgagaaaaaagtagttaaacctgaccctgaagttgctgctgaacttgaagaatatcttgctaagagacaaaagctaggtaaaaaagttgaagacaaacctctggaggaaaagacagtccttcacatcaaagatccagttgattaccaaggccgcaacttcttacatcctcctcaggatgttggagtcaaccttaagtctgattctcctccggacaaatgttttatcccgaagtcagaaatacatgtttggaaaggacacacaaaaggtatttctgctatacggtggttccccaaatatgctcatcttcttctctcttgcagtatggattgtcgtgtcaagttgtgggaggtatataatgaaagacggtgtattagaacctattatggacacaggcaagctgttagagatgtttgttttaataaccgaggaacaaaattcctatcagctgcttacg

SEQ ID NO: 3282 - DNA, 650 bp, Nezara viridula
agcaagaggttcagaaagttgtcaatccactttttgaaaagcgagccaggaattttggaattggtcaggacatccaaccttcccgtgatttaagcagatttgtcagatggcccaaatatattcgtatccaaaggcagaaatctgttttacagaagaggctgaaaattcctccttcaattcatcaattttctcaatctttagacaagcaaacagctactcaactgtttaaaattctggaaaaacacagacccgaaactgcacttgctaagaagcagaggttgaaggctagggcagaaggaaaaataaaacaaaaggaagaagttcctacaaaaagacctaatgttatcaggtctggtgttaatactgttactagacttgttgaacagaaaaaagctctcctcgttgtgattgcccatgatgttgacccaattgagctggtgcttttcctacctgcactttgcagaaagatgaacgttccatattgtattattaaaggaaaggctcgtcttggcaggttagtcaggagaaaaacctgcacttcaattgcagtaacccagatggagggtaatgatcgtactgctttaaataaggtcattgaagccgtcaagaccaattacaatgacagatatgaagaaatcaagaggcactgg

SEQ ID NO: 3283 - DNA, 688 bp, Nezara viridula
aagctggatgaagttgacaagaaagaatttattgacttcatacttgaatgtactgatgagaaaacaggtggcattggtgcttgtgttggtcatgatcctcatattctatatactttaagtgctgttcaaatagcttgtatcttaaggtcattagacctacttcctttagaaaagattgtaagttttgtggccagtttgcaaaaagaagatggtagttttatgggtgacaaatggggtgaagtcgatacgagattttcattctgtgctattgcttgtctgtctcttattggccgcttagatgccataaatcttgaaaaagcagtagattttgtgcttagctgtcaaaactttgatggtggctttggttcccaacaaaattcagaaagtcatgctggattaatctactgttgtgttggtgttttgtcaatcacacagaatttgtatcgaatagatgccgatcaactaggttggtggttatgtgagcgccaactgccttcaggtggattgaatggaagaccagaaaagctaccagatgtttgttattcttggtgggtgttatcatctttaactatgttaggaagactacattggattgataaacagcttttgaagaaatatattcttgctagtcaagattctgatggaggttttagtgatcgaccaggagatatgccagatcccttccata

SEQ ID NO: 3284 - DNA, 795 bp, Nezara viridula
gtcacacattcttcagcatggaggtaactccccagttgcacgtatggcagctagtttacagctcaaaaataacctcacttccaaagatcaaaacatcaaagcacagtatcaagccaggtggctcgcctttcccgaggaaactagaatgtatattaagaaaaatatcttaggagctttgggaacagaaaacacaaggcctagctcggctgctcaatgcgtcgcctatgttgcggtagctgagatccctgttggtcagtggcctgatttaattccaacattgtctgctaatgtaactggacccacttcgactgaaatcatgaaagaggctactcttgaagcaattggttatatttgccaagaaatagaacatgattgtttagctagtcaatctaatcaaattttaacagcaatagtccatggaatgcggtctggtgagagaagtaattacgtcagactggcagcaacaaccgcgcttcttaattcacttgaattcactagggctaatttccagcaagatatggagcgtaactacttgatggaagtagtttgtgaagctacacagtcaactgatacacaagtccgtgttgcagctctacaatgtcttgttaaaataatgactctatactaccaatacatggagacctatatgggtcaggccttgtttccaattacattagaagcaatgaaatctgacataaaagaagtggctcttcaaggaattgaattttggtctaatgtctctgatgaagaagtcgacttagcgatagaagaatcagaagctgtagaaatggggaa

SEQ ID NO: 3285 - DNA, 743 bp, Nezara viridula
taaaacctctgcttgacctcgaccaggaattaactaatgttcaaaaggacttcacgtcacagtgggaagcaggaacattccctggttggccgaaagaaactggcagtgtgttaagcaatgttggtgcccatcttgacttatctgctttttcatcccctgaagagttggcttctctcggtctggacagacttaaatcagcattaatggctttaggattaaaatgtggagggacattagaagaaagggcccagcgtttattcagcactaaagggaaaaaatcccttgatccaaatttacttgccaagtcaaagccaggtaaatcaaaccgagaacgtgatcttgaaagacagcgggacatagcattcttggaagcacaagcttataagttagctgaattactaagtgaacaacgagctgctactaaagaaaatgttcaaaggaaacaagctagaacaggagaagaaagaggagattcggaaggtgaagcatcatcgtcaggaagtgaaagtgagggagaagatgatggagttccgtataatccaaaaaatttacctcttggttgggatggaaagcccattccgtattggctttacaagttgcatgggctcaacatcagttataattgcgaaatatgtggtaattttatctataaaggaccaaaggcttttcaaagacattttgctgagtggaggcatgctcacggtatgcgttgccttggaattccaaatacagcacatttcgct

SEQ ID NO: 3286 - DNA, 504 bp, Nezara viridula
cgagaacatttattggcacatttaaagcatttgataaacacatgaatctcattcttggagattgtgaggagttcagaaaaattaaaccaaaaaataccaaacagccagagcgggaagaaaagagagtgttaggatttgtattgttaagaggcgaaaatatagtttcccttacagtcgaaggtcctccacctccagaagaagggttgcctagggtgccccttcctggagcaggtggtggaattggttcagcaagacctgcgggacgtggagttccagctcctggtacaccagctgcacctggtctccaaggtccagttcgtggtgtaggtggcccatctgcacaagttatgactccagcggggcgtggaggacaagtttctgctcctcctcagatgcgtgctccacccccaggaatgcccccaatgatgggagctccaccaatgatgaacatggcaccaggaatggcgatgggaagaggtgggccacctcctcaaatgggtgctc

SEQ ID NO: 3287 - DNA, 676 bp, Nezara viridula
cccaccaatttaggatcacagtatttcaataacaaaggaactttatgtatagtgcttttggcaatggtggactacaactacaacttcacatttattgacattggaaattatggtagtattgaagactatggaatatttgcaaaatcatcccttatgaaagtgattgagcaaaatcagatcaatatgcctgaaggagcagtcatactgggtgattcaacttttccttcaaagtcttattcaataaagcagtatcctacagaaaaaaatttgaatgttgctcaagaaatagataatgacagacactatcatgcaaagcgcttcgttgagaattcatttgatatcttcacatctcgtttccgggtattaaggaaaccaattcacttacttcctgaaacagtggtaaaaatgacaaaagctgcatgtgctttgcataattggattagaaaatctacaaatctgattatgacagcaaataatgaagataatggctgctctggtagaataattcgagagtcttggcagaaagatgactacagagtagatgatgtagctaatgtcatgccattacttcaacataattatgtgccagacacgagagaaaaaagaggtgaatttctaaaatactccaccaagaaagtagctgttagttgtcagatgacagaggagaatgactgtc

SEQ ID NO: 3288 - DNA, 786 bp, Euschistus heros
gatcaggatagcagatgcaagagctaaaccaattgatcttcttgctaaatacatcaattcagaagaagaagtagacgctgttgagatgcatgaaccatatacttacctgaatggtttgtccataaaggaccttgaagacttggtggaggatattaaggtctacatgaaacttgagaaaggaaagaatttggattactggaatgatattactgttatcgttgaagatgaactgtataagcttagaaaactggggaaaaaatcagactatgaagcagccgttggtaggagagaaggtatccacgaatcagtagctaaagaagtttcttcagtctttagaggaaaaaccgcctcacaacttgcagccatgcaaaaacagattgaaaaaaaaatcagcgataaaggagaaggcattgatatcgggtactgggagtcacttctttcccagctgaaagcccatatggcacgggctcggcttagagacaaacatcaagaaaatctaaaacagaaattagaactacttaaagcggagcagaggcatcaagaacaagaaatcaaagaagaacctatagatgaatcagaagaacagcaagaggctgtagttagtgatgaaatcaaacaggagaaagatgatagtgaagaagaagaaggaagtggaggtgaagaagatgctggggagtctatgctgaaagaaagctttggagagtatgaagctggagcgtactcacctgtctacgttgatcccgctagccttgaaccaggaactcttataatcggtgaagaggagga

SEQ ID NO: 3289 - DNA, 678 bp, Euschistus heros
gttggtcctgttctctcatttaaattagtttatgatcgcgaaactggaaagcctaaaggttatggattttgtgaatataaggatcaagaaacagctcttagtgctatgagaaatttaaatggttatgaaattggtggacgatctttgagggttgataatgcatgtactgaaaaatcaagattagaaatgcaaagtcttttagctggaccaccgattgataatacatatggggaatcagtagagtctgataaggctcctgaagctataagcaaagccgttgcctctttaccaccagaacaaatgtttgagctaatgaagcagatgaagctttgtatacaaaataatccaactgaaggcaaagcaatgctattacagaatcctcaattagcttatgctcttttgcaagcccaggttgtcatgaggatcgtagatcctcagattgctattacaatgttgcacaaggccaacccgagtgtgcctcctcttcaaccacctcctgtcgagacaatacgcccagtgcctgtgcctcagcctgctccagcagttgctcctcctcccgtggtgccaccagttgtgcaggcgaggccagttgaaccagagtgggtacctccagctaggccgcatcagcctcctcatccaccgacatttataccccagccaggtggtgatctggatatg

SEQ ID NO: 3290 - DNA, 675 bp, Euschistus heros
tggtcagattgttggagaagtattaaagcagcttactgaagaaaagtttattgtcaaggcaacaaatggtccgagatatgttgttggttgtagaagacaactggataaatctaaacttaaatctggtacaagggtagcattggacatgactacattaacaattatgaggcatttgcctagggaagtagatccattagtatataacatgtcccatgaagatccaggagatgtcacgtattctgctattggaggtcttgcagaacaaattagagaacttcgagaggtgattgaactgccacttttgaatcctgaactgtttcaacgtgttggcattactcctccgaaaggatgcctgctttatggacctcctggtactggaaaaactttactggctagagctgtagccagccaattagatgcgaatttccttaaggtagtctccagtgctattgttgataagtatattggtgaaagtgctcgtctcatcagagaaatgtttaactatgcaagagatcatcaaccttgcataatttttatggatgaaattgatgccattggaggccgaagattctctgaaggaacatctgctgatcgtgaaatacaaagaactcttatggagcttttgaaccaaatggatggatttgattcattgggtcaggtgaaaatgatcatggc

SEQ ID NO: 3291 - DNA, 648 bp, Euschistus heros
ccaggttgaatatgctatggaagctattagtcatgctggaacctgtcttggtattctagcgaatgatggcattattcttgttgctgaaaaaaggaatactaacaagcttcttgatgaatcagtatactctgaaaaaattttcaaattgaatgagaacatgatatgcagtttagctggtattacagctgatgcaaatgttctaactaatgaactaaggctcatttctcaaagatatttgttacaatatggagaaactattccttgtgaacaacttgtttcttggctgtgtgacattaaacaagcatatactcagtatggaggtaaaaggccatttggagtatctatattatatatgggttgggataagcactatggatatcaactttaccagtctgaccctagtggaaattactcaggctggaaggcaacttgtatagggcataacagtggtgcagctgtttccagtttgaagactgattacaaagaaggagaaatgacagtgaaagatgctttggccttgggaattaaagtcctaagtaaaacattggataccgccaagctttcagttgatagagttgaagttgcaacattatcccagcagaatggaaagtgtgttacttgcattctaccacctgatcaagttcaaga

SEQ ID NO: 3292 - DNA, 748 bp, Euschistus heros
agaaaatcactggaccagacacccacctgtacgtacctgcattagaaagcatgcgagatcttataagaagttctacaacaagtatgacttcagtgccaatgcctctgaagttcctcagatctcattatggcgctctcaaagaagcctgtgctgttatggcagataggaaggctcaggagctttgtgcaagcatagtctctgttctagcaatggggcaggatttaccaggggcacgagaatgtcttaagtattgtttacaatcacatcagaaagatgttggtgactggggccatgaatatgtaagacaattagaaggagaaatcgctgatgaatgggcatctacagaagaaaaagataagctactgggattggttgagagtataatcaaatttgatatggagcataatgcagagattcaagcctgtgatctcttaatggagattgacagacttgatatgctggacaagcacatggatttaactaattattcaagagtttgtctgtacctaattaattgtgctgtgtatgtggaagaaccagaaagaggaaacattgtaagtggagttatgaaacattatatgcgatttaaggaatacccgcgagcactctgtcttgcgatgcaattgaataagcaagatataatgttagacatttttaaccaatgccaagatccgttggttagaaaacagttagcctttatggtcggaaggcaacaattgagccttgaattgagtgatgatttggcaga

SEQ ID NO: 3293 - DNA, 712 bp, Euschistus heros
ctacatcaaggctgagactcccctaacccccaagaacttcgcccacttcgatcacccggtcacctctcatccaacacaactcagtgcacaggttacttatgtgactggaggaggtagcagggagtacgtgacaactaaccagcctggctactggtccagcgaatacgtgtaccagcagcctcagcaggaaatccagctgcctcctggaacaccttacgtcttctccagcaatgggcaggctacctgggctattgatgagtcctacgatcccagtatgctgtcggctagcgacatcaaggagtgcgtcaactgtgcggcaagcgtgaccccgctgtggcggcgggacggtaccggacaccacctctgcaacgcctgcggcctctacagcaggatcaacggagtacacaggccaccgattggtaacaggagaaatggcgtaagttgcgccaactgccagacaaataacacaaccctgtggcgcagaaacaacacaggagagccagtctgtaatgcctgtgggctgtattttaaactgcatggtgtaaacaggccacatacaatgaagaaggaaggcatccaaactaggaaacggaaacctaagaaccctcaagttaatataccaagtccaaaaaacgacattaaagcaccaggtgaaaaatcaggcagttgggataaatgtgataatgacctactcgacagtggctatacaatg

SEQ ID NO: 3294 - DNA, 667 bp, Euschistus heros
cttggtgacagagctctatcttaattacgattgctctctttactgccccaatttgtatgaagaactaaccaacctgttgtctaagaatgctttccctgtaactggtgtctataacacacatttactatctttggatgctttattgacagttatagactctatagaaagtcattgtaatagccgaatattaaatgaaaggcaaaatccatcaaaagatggagaaattaataaattagaatttcacgattttgccagcaattatataaatcggactgggacccgtcaaaagttgtcactgaacattccaagtcatgagcaattaatggctgtgaaaagaaaaaaaaaacttctggctactggaactgaacatttcaattcaaaaccaaaaaaaggaatccagtttttacaggaacataaccttctttcgactcctttagatgcagttgaagtcgttgcctttttgagagaaaacccccacctcgataaaaaaatgattggagaatatattagtaatagagccaacatcgctatacttgatcaatttgtaaaatcattcgactttactgagctgcgcatcgatgaagcattaaggttgtatttagaaactttcaggctacctggagagtctcctctcatatctttagtgatggaacattttgctgaacac

SEQ ID NO: 3295 - DNA, 512 bp, Euschistus heros
gtgttgctattgcttctgacttgaggtttggtattcaaggacagactgtgtcaaccaattttgaaaaaatttttgaaatgggtcctcatctatttattggacttcctggtttaactactgatacttttactgttctaaataagcttcaatttaggaaaaatatgtttgagttaaaagaagataggaaaatagcaccagatgtatttctttctatggtctcaaatcttttgtatgaaagaaggttcggaccatttttcgttgaaccaataattgctggtttgaacccaaaaactatggaaccttttatagcttcgatggatttacttggctgccctaacaaaccggaagattttgttgtggcaggtacagcttctgaacaactttatggaatgtgtgaagctctttgggaaccagatcttggcccagatgatttatttgaaactatatctcaagcacttgttaatgcatgtgacagagatgctctttcaggttggggagcttctgttttcata

SEQ ID NO: 3296 - DNA, 668 bp, Euschistus heros
gctgcacaaactatgagaactaaaatccaacattctttccatgaacttcctgcagagtctcatcttccgctccgagattctctgatggatcatattagcaaaattaatgagtcaacaaattctgtgattggtactcagttgtaccttgctctagctgatcttgcattacaaatggtatcttgggaaaaacctgcaattgatttgattgaacgatattctgcgacctcagttcctcctcttcttgaaatgttgacatttttaccagaagaagttaattctcgagcattgcgcttgggttctaaccggaggcgagaacttctcaacaaattttctcttgctgttccaaatgtttctgaatttttgaaaatgtgtcttaacaattcaggaaataatcctcaaattcaagtcaaagttttcaaatgttttacaagttgggtgtcagttcaagcgatgacacttaatgatgttaccgacaatatagttgtggctacagcttttcacgttcttgctaatagaatggcatcctctaatttacacgaagcagctgcagattgtgtttgctcgcttctcgaatgcctcgaagataacaataatcaacagtcgattgagatgcaactgtttaatggcgtcatttcattagaacaaccatttcatatttctgtcgccca

SEQ ID NO: 3297 - DNA, 753 bp, Euschistus heros
aagcttacatggaccttctggcattcgagaggaagctggattctacaattatgagaaagagactcgatattcaggaagcgttaaaacgcccaatgaagcaaaaaagaaaattacgtatttttatttccaatactttctatcctgcgaaagaggcgacggagactgaggaaggcagtgtagcatcctgggagctgagagtcgaaggaaggctattagaagattccaaaaatgatccgaacaagcctccaccgttacaggtgaaaaggaagttttcatctttcttcaaaagtcttgtcatcgagttggacaaagaactgtacgggccagataatcaccttgtagaatggcatagaactcctaccacacaagaaacggatggttttcaggtaaaaagacctggtgataaaaatgtcagatgtaccatcctacttcttttggattatcagcccctacagttcaagcttgatacccgacttgctcgtctcttaggtgttcacactcagacgagacctgtcattataagtgcactttggcaatatattaaaactcataaactgcaagatccacatgaaagagagtatataaattgtgataaataccttgagcagactttcagctgccccaggatgaagtttgctgaaataccgcagcgtctcaaccctctacttcatcctccagaccctattgttatcaaccatattattagtgtggaaggtaccgaacagaaacaaaccgcttgttatgacatcgatg

SEQ ID NO: 3298 - DNA, 298 bp, Euschistus heros
gaaccgactcttgaggaattagaacagaaaatgagagaagctgaaaccgaacctcatgaaggtaaaaggaaagtggaatcattgtggcctattttcaaaattcaccaccagaaatctcgctacatttacgatttatactacagaagaaaagctatcagtaaagaattgtatgagcattgccttaatgagaatattgctgataaaaacttgattgccaaatggaaaaaacaaggctatgaaagtctttgctgtttacgatgcattcagaccagagacacgaattttggaacgagttgca

SEQ ID NO: 3299 - DNA, 744 bp, Euschistus heros
cgtgatgtatgggctcataatttgaaggatgaatttaaagttatcaggaagatcattcataaatataattatgttgcaatggatactgaatttcctggagtggtggcaaggcctatcggtgagttccgtagtacagctgactatcagtatcagcttctgagatgcaatgtggatcttctccgtatcatccaattggggcttactttccttgacgaaaatggaaaagctcctgcgggtccttacagtacctggcagttcaatttcaaatttaatttggcagaggatatgtatgctcaagacagtattgatcttcttcagaattcagggattcaatttaagaaacacgaagaagatggaattgatcctgtggactttgcagaactgctcatgacctcaggaattgtactgatggaaaatatcaagtggttatcctttcatagcggctatgatttcggatatctattgaaactgcttactaatcagaacttacccaatgatgaaagcgaattctttgagcttctgaagatctactttcctactgtttatgatgtaaaatatctcatgaaaagttgtaaaaatctgaaaggaggtctgcaggaggttgccgaccagctggaacttacgagggtaggaccacaacatcaagctggctcagattcattattgacgggaatggcctttttcaaaatgagagagatgtttttcgaagacaatatagacgatggcaaatactgtggtcacttg

SEQ ID NO: 3300 - DNA, 695 bp, Euschistus heros
atggccaacatgttgtatctggcacacctggtcgtgtttttgatatgattaagcgacgaacactgaggacaagatcaatcaaagttttagttcttgatgaagctgatgagatgttgaataaaggtttcaaagaacaaatttatgacgtttatcgtttcttacctcctgctacccaggtggtcctaatttcagctacacttcctcatgaaattcttgaaatgaccagcaagtttatgactgaccctatcaggatcttagttaaacgtgatgaattgacgttagaaggaatcaaacaattttttgtcgctgttgaaagagaagaatggaagtttgatacactctgtgatctatatgatacattgaccattacacaagctgttattttttgcaatacaagaaggaaggttgattggctgactgaaaaaatgagggatgcaaatttcactgtttgttctatgcatggtgatatgccacaaaaggaaagagatgctataatgaaggaattcagatcaggaaaaagccgagtccttataacaactgatgtgtgggctagaggtattgatgtacaacaggtctctcttgtcattaactatgatttacccaacaaccgtgagttgtatattcataggattggtagatcaggaagatttggaagaaagggtgttgccattaatttcgtgaagagtgatgacatc

SEQ ID NO: 3301 - DNA, 702 bp, Euschistus heros
ttttgtatttccccacccaagacagacatggatcacaatgtggttatctctgactacgcagcaatggataggatattgaaagaggagcgagcttacatactgaatattgcaaaacaaatcaagaaggctggttgcacaatgttattgatacagaaatctattttaagagacgccttgtccgatttagctattcacttctttgacaagttaaagattatggtcgtgaaggacattgaaagagaagatattgatttcgtctgtaagactcttggttgccgccctattgcatctttagatcactttacaagtgaagcacttgtaagcgctgagcttgcagaagaagtatcagcaggatcttcccgtatcgtcaaagtcacaggaattcacaatcctgcaaagactgtcacaattctagtccgtggatccaataatcttgtcctggaagaggcagatcgttcaattcacgatgccctttgtgtcatccgatgtcttatcagggaaagggcacttctgcctggaggaggagctcctgagatcgagttgtctcttcggttaggacagcatgcacaggttttggcatcagtagaggcttattgtttaagagagtatgcaaaagctttagaaattgttccttatacccttgccgagaatgctggtctcaatcctgtagctacagtgacagaactgaggaataagcacgtt

SEQ ID NO: 3302 - DNA, 764 bp, Euschistus heros
atactggaatcgttggtagcactacaggttctaattattatgtaaggattttatcgacgattgatagagaactgttgaagccttcagcgagtgttgctctccataagcacagcaatgccctcgtcgatgtgcttccacctgaagcagattcctctatttcaatgcttcaagcagatgaaaaaccagatgtgcaatattcagacattggtggtatggacatgcaaaagcaggaaatccgtgaagccgttgaattgccgctaacacactttgaactatatcgtcagattggtatcgatcccccaagaggggtgctgatgtatgggcctcccggctgtggcaaaactatgctcgctaaagctgttgctcatcataccactgctgcgttcattcgagtggtcggctctgaattcgttcagaaataccttggagaagggcccagaatggttcgtgatgtttttagacttgctaaagaaaatgctccagccatcatctttattgatgagattgatgccatcgcaacaaaaaggtttgacgctcaaactggtgcagacagagaagtgcagaggattctattggaactgcttaaccagatggatggctttgaccagacaacgaacgtaaaggttataatggctacgaacagagcagatacattggatcccgccctgctgcgacctggtaggctggacagaaagattgaatttcctcttcctgacaggcggcagaagaggcttgtcttttcgacaatcactgccaagatgaac

SEQ ID NO: 3303 - DNA, 406 bp, Euschistus heros
gtggaaattgcaaaatgttcagttactattaagactatgttagaagatttaggcatggatgaagatgaggaagaagtagttccattgccaaatgttaattctgccattctgaagaaagtaattcaatgggccacataccacaaggatgatccacctccaccagaagatgatgaaaataaggaaaagaggaccgatgatatttcctcttgggatgctgactttctgaaagtcgatcaaggaactcttttcgagttaattcttgctgctaattatcttgacattaaaggcttacttgatgttacctgtaaaacagtagctaacatgattaaaggaaaaacccccgaagaaatacgtaaaacctttaatattaagaatgatttctctgctgctgaagaggaacaagtac

SEQ ID NO: 3304 - DNA, 685 bp, Euschistus heros
aatgtcctgtcacagtttgtggagatgtacatggacagttccatgatttaatggaactgtttcgaataggaggaagatcaccagacaccaattatctgtttatgggtgactatgttgatagaggatactattctgtggaaacagtgactttactagttgctcttaaggtaagatatcgagaaagaatcaccatcttaagaggtaaccatgaatcgcgccaaatcacacaagtatatggtttttacgatgaatgtttacgtaaatatggaaatgcgaatgtatggaaatatttcacagatctatttgactatttgccattgacagctctcgtaaatggtcaaatattttgtcttcacggtggtctttcaccgtctatagacactcttgatcatatccgtgcactagatcgtttacaagaagttccgcacgagggtcctatgtgcgacttactttggtcggaccccgacgataggggtggttggggcatatctccaagaggtgctggttacaccttcggtcaagatatttcagaaacatttaaccattcaaatggcctcactctcgtatctagggcccatcagcttgttatggaaggctataactggtgtcatgatcgtaatgttgtaacaatattttctgcacctaattattgttatcgttgtggtaatcaagcagccataatgga

SEQ ID NO: 3305 - DNA, 766 bp, Euschistus heros
ataaccctggaagttgaaccttcagatacaattgaaaatgttaaagctaaaattcaagacaaagagggaattcccccagatcagcaaaggctgatctttgctggaaaacagttagaagatggtcgtactttatctgactacaacattcaaaaggaatctactctgcacttggttttacgtttacgtggtggtatgcaaatttttgttaagactctgacaggaaagaccattactttagaagttgaaccctctgatactatagaaaatgttaaagcaaaaattcaggataaggaaggtattccgccagatcagcaaagactgatctttgcaggaaaacaactagaagatggccgaacactttccgattacaatatccaaaaagaatccactttacatctagtgcttcgtctgcgaggtggtatgcaaatttttgttaaaactcttactggcaagaccatcaccctggaagttgagccctctgacacaattgaaaatgttaaagctaagatacaggataaagaaggtatccctccagatcagcagcggttgatttttgctggtaaacaattggaagatggacgtactctgtctgactacaacattcagaaagaatctaccttacatcttgtgttaaggcttaggggaggtgcaaagaagcgtaagaagaagaattactccactccaaagaaaatcaagcacaagaagaagaaggttaagctagctgtgcttaaatattacaaggttgatgagaacggtaaaatcagca

SEQ ID NO: 3306 - DNA, 743 bp, Euschistus heros
tcggagatggtactacaagtgttgtcttgatcactagtgaaattttgaaacagctgaaaccatatgttgacgagggtgtccatcctagaataatgatgaaagcagtaaggaaggcgactcaattatgtttagacaaaatcaacagcttagctgttaagatcgaaaagagtagtgcggagcagcaccgctctctgctggagaggtgtgcagcaacagcactcagttccaaattgattcatcaacagaaagatttcttttcgaaaatggtcgtagacgctgtactattgttagatgaactccttccactcgatctcatcggtatcaagaaagtacctggtggagctttggaggaatccttgttggtctctggtgtggctttcaagaaaaccttttcctatgcaggcttcgaaatgcaacctaaaaagtatacaaacccaaaaatagctattctcaacattgaattagaattgaaagcggagagagacaatgctgaaatcaggcttgacaacgtagaggagtatcaaaaagttgtagatgttgaatggcaaattttgtacgaaaaattagatacaatcgtcaaatctggagctcaggtcgttctgtcaaaacttcccataggagatgtagctactcagtattttgcggacagagatatgttctgtgctggacgtgttgctgatgaagacataagaaggacacaaaaagcttgcggtggcaccatgatcaccactaccaaagacatg

SEQ ID NO: 3307 - DNA, 680 bp, Euschistus heros
gctgttgagaaaaatctcggaggaaggcttcaggcaggcattgatgcttggactgatgcattagaaggcaagagccatgagctagatctgagtatggacactgatgcgccagcgagaccaacccatgcacctggtggtgacccacatgtgcagacagtgactcatgaagttcgcattaccaatcagattatgtacctttatccgagcatagaggaagcaagattccagataatgcaacagttgtttcagtggcaggctgttgtaacttcccagcaaagacttcagagctcacgatatcagcttggacttgaaaggctcatgtcccagtcatatagagacttgttgactaagctacctaatggttcccaagccctcatcaatgcatatgattcaatagacaggaaaatcaaagatgttgtcaactatgtagatgagtggttgaggtaccaatctttgtgggatctccaatcagataccctgtacagtcggttgggagatgacattaccatgtggatgagatgtctttctgatgtcaagaaatcacgaactacatttgatacatctgagactcgccgacaattcggccctattgccatagattatgctaaagttcaaagtaaagtagcactgaaatatgattctcttgataaggaaatcttggctaaatttggtggcctttt

SEQ ID NO: 3308 - DNA, 705 bp, Euschistus heros
ggaaacgttgtacttaccctaaaagcattaggaatcaatgatttgatcaattttgatttcttagatccacctccccatgaaacattggtacttgctttagaacagctttacgcattgggggccttgaatcatcatggggagttaactaagttgggtcgaagaatggcagaatttccattagatccaatgatggggaaaatgttacttgcttctgaaaaatataaatgtagtgaggaaatagttactattgcagcaatgttatctgtaaatggtgccatattctatagacctaaggacaaagttgttcatgctgatactgccagaaaaaatttcttccttcccggtggtgatcatcttgttctctggaatgtttataagcaatgggcagatactgacttcagtacacaatggtgctatgaaaattatattcagtacagatccatgaaaagagctcgagatgttcgagaacaactggtaggtctaatgcaacgtgtagaaatggactttatttctaatcctacagatactattgcaatacgaaaaacaattacttctggttatttctaccacattgcaaggctttctaagggaggtcattacaaaactgttaaacataatcaaactgtaatgatccatccaaacagttgtctatttgaggatcttcctcgctgggttgtgtatcatgagcttgtcttcactaccaag

SEQ ID NO: 3309 - DNA, 650 bp, Euschistus heros
aagcttaaccaaggagaaggttgaagtaggagacgttatatacatagaggcaaacagcggtgccgttaagaggcaaggaaggagtgatacctatgctacagaatatgatctggaggcagaagaatacgtcccacttcctaaaggagatgtccacaaaaagaaagaagtgatccaagacgtgacattacatgatcttgacgtagctaacgcgaggccgcaaggaggtcaagatgtactgtctataatgggacagctgattaagtcaaagaaaactgaaattaccgataaattaagagctgaaattaacaaagtcgtcaacaggtacatcgaccaaggtatcgctgaacttgtgcctggcgtcctatttattgatgaagtacacatgctagatatagagaccttcacttaccttcatcaggctcttgagagtgcaatagctcctatcgtagtctttgctacaaatcgtggtcgttgtcaagttagaggtgctgtggatattatttcaccccatggattaccgttggacctcctggataggttgctcataattcgtaccgcaccttacagccaaccggaaatgtgccaaattctaaaattgagggctgtaactgaggggcttagcatcgacgaggatgcattatcagagctca

SEQ ID NO: 3310 - DNA, 761 bp, Euschistus heros
gaaaatgtggacttagctgccctgtttatgctactattccagtttacaagatgggacaaatgtttatgtatgatttataccaatctcgctacaacatggaagactttaatgtgtttagtcttgatgatgttgatgctgcatttgataaagttgttcaattaaaatataaccagtcagtaacaatgaaggggaagtgctatggactcagcattgttccaatgccagctggtcatatgattggaggaacaatgtggaaaattatgaagacaggagaagaagatattatatatgccattgattttaatcataaaaaggaaagacatcttaacggctgtgatctagaaagattgcagaggccatcattgctaataactgacgcatttaatgctacttatcagcaagaaagaagacgagcaagagatgaaaaactcatgacaacaattcttcaaacattgagtagcaatggaaacattcttattgctgttgatactgctggtcgccttttagagttggcacatatgctggatcaactttggaggaataaaaattctggtttacagattcatcctttgtgccttatcaataatgttagttataatgtagttgagtttgctaaatctcaaatagaatggatgagtgataaattaatgaaaagttttgaggcagttcgtaataatccatttcaattcaaacacatacgtttatgtcatagtgtttcagaacttaataaaataccttcagccaaagtagtacttgccagt

SEQ ID NO: 3311 - DNA, 668 bp, Euschistus heros
cttcacgaaacttcttgagcaatatacaaaggtcttgattcctccaaaagacctaatgtctcgtctaaaagaagagtgttctaatcctactggagttctggagcaagtcaggtaccgtgcggactggcttcactatcaagaactgcagaagaggaaagaggaacaagcactggagaaagaaagggtggcttatgctcagattgattggcatgactttgttgttgttgagactgtagactatattccgggtgaggtaggcaacttccctcctcctaccactccagatgaagttggagctagagtcctgatgcaggagagaatcttggaaaatggaggagaagatcttacggaaggagccggtagcgatgaagagagggagaaggaagacagtgaaagagaggaggcaactggtgacaagggagacaatactcaggttcaagacatggaggaagagtcatctagcgatagcgatgatgatgatgaaagagatcaatctcttggggagaaacaaccagcaacacaagctcagaaacaacaaatgttacaacaaaatcaacagctggcctcagcagatggcaaaaaaccatctacacagccttcaatgcaacctcccctgcctccggcacctgataaagttatcgtcaaaaaaggctataaccctaagcaga

SEQ ID NO: 3312 - DNA, 702 bp, Euschistus heros
tagttttgcagtgccatttgatgaagatgacaaggataaatcagtttggtttttagaccatgattatttagaaaacatgtatgggatgtttaagaaagttaatgctcgagaaaaagttgttggctggtaccacactggtccaaagcttcatcaaaatgatgttgcaattaatgaacttattcgtcgctactgccctaattctgttttggtgataattgatgcaaaacctaaagaccttggtttacctacagaagcctacagagcagttgaagaagttcatgatgacggctcccctaccacaaaaacatttgaacacgttcccagtgaaataggagctgaagaggcagaagaagtgggtgttgaacatctgttgagagatattaaggacacaactgtaggctcattatctcaaagggttactaatcaatttctgggcctcaaaggccttaatcagcaaattcaagatatcagagattaccttatgcaggtagttgaaggaaaattacccatcaaccatcaaataatataccaactgcaagacatctttaacctacttccagacatgaatcatggaaactttgttgattcattgtacattaaaacaaatgatcagatgcttgtcgtttacctcgctgctcttgtacgagcaatagttgctttgcataatctgattaataataaactcagtaatcgtgatgctga

SEQ ID NO: 3313 - DNA, 725 bp, Euschistus heros
gcagaaaccaaatgttgtcattactgaaaagggtgtttctgatctagcccaacatcatcttttcaaggctggtattacaaccatccgtagggtaaagaagactgataataacagaatagctcgagctgtagatgcaactattgttagtcgtgttgaagaaatcaagccctatcatattggatgtggtgctggtctctttgaagttaagaagattggagatgagtatttcactttcattactgaatgcaagaatccaaaagcttgtacaatattattgcgtggtcctagtaaagatgtattaaatgaggttcagagaaatttacaagatgcaatgaatgttgttagaaacttgtacttggatcctaggatacttccaggaggaggtgctgtagaaatggcccttcatagagctctaattaaagctaattttactgtagatatggatgaagactgttatgctgccattccatctgctttaagaattattccgagaacccttttgcaaaatgctggtgggaaagtaatcaggtctatgaatgaactcgagaaacaacataattctggtgttcttaaaggagttgatgggattactggcgagttaaagacagttgatgaattaggtgtatgggaaccatactcagttaaagttcagatttataaaactgctattgagtctgcaatcctattgttgaagattgatgacattgtttctggtgcgaagaata

SEQ ID NO: 3314 - DNA, 670 bp, Euschistus heros
aaacgttggtcattctttgggtgacttagttgtttatcaagaattagtctttacaatggcaatgccaagaacttacggtggtttatcagattatagaaatgttcctgcaccttcctttagtccatattctgaaaatggaggaagtgtagttgctgtagcaggtgatgattttgcaattattgcatctgatacacgtttaagtactggttttcaaatttacaccaggaaccagtccaaactgtttaaactttctgataaaacaatacttggtagtactggatgttggtgtgatgtcctttctctgactaggctggttcagacccgaataaaaatgtatcagtatgatcataacaaagttatgtctaccccagcagttgcacaaatgttgtctgttctactctattacaagcgatttttcccttattatgtagctaatattcttgctggaatagatgacaatggtaaaggtgttgtttatagctatgaccctattggtcatcatgaaagctcaaaattcagagctggtggaacagctggagctttattgcaaccattgttggacaatcagcttggtatgttgaatcaagaaaatgttcaagataaaacttatactttggagaaagcccatgcaattgtgaaagatgtctttatatcagctgctgaaagagat

SEQ ID NO: 3315 - DNA, 654 bp, Euschistus heros
agctgcataactcaaagacaaatagaacttctcatagtggtgtgttagaatttgttgcagatgagggaaaagtgtatctcccgcactggatgatgcggaatttaatgcttgaagaaggtgatgttattgagatagaaagtgtttcattacctgttgccactttttctaggtttcagcctcagtctccagattttttggatatatcaaacccaaaagcagtgttagaaaactgccttagaaactttgcttgtttaactactggtgacataataaacattaagtataaccaaaaagactatgagctttctgttttagaaacgcaaccaggtgctgctgtgacaattatagaatgtgatatgaacgtagaatttgcaccacctttagggtataaagagccaaattctgaacaggaggctttggatgaatcatccgaaagatctgaaaacttaacaaatgaaggaagtgggttcattccattctttggtgaaggatatcggcttgatggtaaacagaagaaagctatcgaagatgagagtgtaggatttaaaatacctactgtgagagggattcctgattatgactggaaagttggtgtgattacctttatgagaaatgtacgccaacctgtaaaggaagcccagaaagatgatgaag

SEQ ID NO: 3316 - DNA, 756 bp, Euschistus heros
aggtttggataagctccttgtatcacaagatggtgatgttatggtaagcaatgatggagctaccatcatgaagcaaatggatgtggataatgaaatcgcaaaattaatggtgcaactttcacaatctcaggatgatgaaatcggtgatgggacaactggagttgttgttcttgcaggtgctttattagaacaagctgacattttactggataaaggaattcatcctatcaggattgctgatgggtttgaattagctgctagagctgccatacaacatttagattcaatcgccacaaaatttcctgttgatcctaacaatttagagccccttataaagaccgctatgacaactcttggatcaaaaattgttaacaaatgccatcgtcaaatggcagaaatagctgttaaagcggtattatcagtggctgatcttgaaaaaagggatgttaactttgaactgataaaagtagacggcaaagttggtggaaggcttgaagattcgatgctcgtaaaaggggtagtaattgataaggacttctctcatccacaaatgccaaaggtattgaaggatgttaaaatcgcaattttaacctgcccatttgaaccacccaagccaaaaacaaagcataagttggacgtaacttccattgatgattatagggcattgaggaagtacgaagaagagaaattcaacaccatggtttctcaagtcaaagatgctggtgccactcttgctatttgtcaatggggattcga

SEQ ID NO: 3317 - DNA, 238 bp, Euschistus heros
cagtagtggaaaaggtgaaaaaaagaggttcgaagttaaaaaatggaatgctgttgcactgtgggcctgggacatagttgttgataactgtgctatttgtcgaaaccatataatggatttgtgtattgaatgccaagcaaatcaagcctctgctacaagcgaagaatgcacagtggcctggggagtttgtaatcatgcatttcattttcattgtatatcgagatggttgaagactagg

SEQ ID NO: 3318 - DNA, 735 bp, Euschistus heros
tttaagcgcgatacagatcattaaaaaaacaggtggctcattggatgattcatttctagatgatggcttccttctggacaaaaaagttggccagtttcaacctaaaagagttgaaaatgctaaaattcttattgcaaatactcctcttgatactgataaaattaaagtttttggttcaagaatacgcgttgactctttagccaaggtggccgatttggagttggctgaaaaagaaaagatgaaagaaaaaattgataggattataagtcataaatgtaatgttttcgtcaaccgtcagctgatctataattatcctgaacaattgtttgctgatgctggaataatggctattgagcatgcagattttgatggtattgaacgtttagcccttgttacaggaggtgaaatagtttctacgtttgatacaccagaactagttaaattaggagaatgtgacttaatcgaagaaatcatgatcggtgaagacaaattattgaggtttagcggggtgaagttgggagaggcttgcagtattgtcattaggggagcaacacagcaaattgtcgatgaagcggaacgatctttacatgatgcattatgtgtgctcgttactactgttagggataagaaaacagtttttggtggtggctgttcggaaataattatggctagtgctgtaagtgatgatgctattaatgtaactggcaaggaagcagttgctatggaatcctttgc

SEQ ID NO: 3319 - DNA, 658 bp, Euschistus heros
agcaacagttggtgtaaagaataaacaatttgcagtccttgttgctcttaaaagagcatcttctgaactttcagctcaccaaaaaaaaattattcctcttgataatcatataggcatgagcatttctggtttaactgctgatgctcgtatattgagtcggcaaatgagaagtgaatgcctttcttattcatattcttatggaactgaaatacccattatcaggcttatgaataaaatatctaacatgatgcagagttcaactcagcgctatgacagaagaccatatggtgttggtctactggttgctggatatgatggagatggtcctcatatttttcaaatttgcccttctgctaatttatatgaatgccgctcaatggccatcggtgctagatcccaaagcgcaaggacatatttggaaaagcatctggtagacatctcaaactctccgactctgacagaccttctcaagcacgcacttcgtgctcttagagattcttcacccaatgatacagaacttagctccaagaacgtagccatagcggtagttgggaaagataccccgctcaaggaattatctgaagccgatacccaaacttatctggacatgatcctcagcgaggagagaagaagcggcgatacaggtggagctagtgat

SEQ ID NO: 3320 - DNA, 656 bp, Euschistus heros
agattaaaggacggtgcattactgatccttcttttgaacatttaaataatacatatgaacgttctttggtatttatgaataagatgcctcgaatatggatggaatattgtcagtttcttgtcgatcaatgtaaaattactaaagcacgacatgtttttgatagatccttaagagcactgcctatcacccaacatcaccgcatttggcctttatatataaaattcttaaagaagcacaatattccagaaactgcggttcgtgtgtttcgaagatatctgaagctttgtcctgaagatacagaagaatacattgattacttaactgccatcagtcgtctagatgaggctgctgttagattggcagatattgtaaatactgatgattttgtttcaaaacatggaaaatcaaatcatcaattatggactgaattatgtgatttaatatctaaaaatcctcaagaagttaggtctctgaatgtagatgcgataataagaagtggtttgaaaaaatatactgaccagttaggccacttatggaattccttagctgattattatatcagaagtggactttttgaaaaggcaagggacatttatgaagaagcgatacaaactgttactactgtcagagattttactcaggtttttgatgcgtac

SEQ ID NO: 3321 - DNA, 738 bp, Euschistus heros
acagagtaacacaacagcatcaaggatatggttttgttgagtttttgggtgaagaagatgctgattatgctataaaaattatgaacatgataaaagttcatgggaaacctattcgtgtgaataaggcttcagctcatcagaaaaacttggatgttggagctaatgtgttcattggtaatctggatcctgaggttgatgaaaaattattgtatgacacattttcagcctttggagtaattctgcagacaccaaagattatgagagatcctgatacagggaattcgaaaggttttgcattcatcaattatgcttcctttgatgcatcagatgctgctattgatgctatgaatggtcagtttctctgcaatcgccctgtttctgtttcctatgcttacaaaaaagatgctaaaggtgaacgacatggatcggcagctgaacgtctcctagccgcacaaaatccattatcacaagccgataggccccatcatatgttcgccgatgctccccctgcacctctcccacctcctccagtcctgcctccacctcctgtcttcaatcctccaccgcctccccatatgccgcctcctccattgccaccccaaaggatggttgctcctatgcctccacctccacctgggcctcctccaccaatgcctcctggaatgatgccgtggccaccgatgcagccccactttccccctcctcccccacctccacctacaaacaaagctcctcctc

SEQ ID NO: 3322 - DNA, 635 bp, Euschistus heros
ccacacaaaacaccgtaaaggtgcccctaaactgaggtcattagattttgctgaaaggcatggttacatcaaaggtgttgtgaaagacattatccatgaccctggtagaggagctcctttagcagttgtgcatttcagagatccttacaggtttaagactcgtaaagaacttttcattgctcctgaaggaatatacactggtcagttcttgtactgcggaaagaaagctaacttacacgttggcaatgttatgcccgttggtggtatgcctgaaggtaccatcatctgtaacttagaagaaaaaaccggagacaggggtcgtttagctagagcctcaggaaattatgctattgttatcgcccataatcctgattcaagaaggacaagggttaagcttccatcaggcgcaaagaaagttatcccctccaataacagggccatggttggtatcgttgctggaggtggtcgtatcgacaagccagtccttaaagctggtcgtgcgtactataaatataaggcaaagagaaactgctggcctaaggttaggggtgttgctatgaacccagtcgagcatccccacggtggtggtaatcaccagcatattggtaaagcttccactgtcaagagaggaactt

SEQ ID NO: 3323 - DNA, 264 bp, Euschistus heros
caaagctgccaggaagagcgctccggcgactggaggagtcaagaaacctcacagatacaggcccggtaccgtcgctctcagagaaattagaaggtaccagaagagtaccgagttgctcattaggaaactcccgttccagaggttggtgagggagatcgcccaggacttcaagacagacctgaggttccagagctcggccgtcatggccctccaggaggctagcgaagcctacctcgtaggtctcttcgaggataccaacttgtg

SEQ ID NO: 3324 - DNA, 715 bp, Euschistus heros
attatgacaatgcaaagccggcttgaatctgaaactaggctggttagagggctcgtcttagatcatggctcacgtcaccctaatatgcccaagaaactcactaatgcttttattctgacatgtaatgttagtcttgaatttgaaaaaactgaaataaatagcggatttttctacaaatctgcagaggaaagggaaaagcttgtggcatctgaaagagagtttattgagttaagagtcaagaaaattatagctttgaagaaatctgtatgtgatggaactgacaaaggatttgttgtcattaatcaaaaagggattgaccctgtctctttagatttactggccagagaaggtataatggctcttaggcgagctaaaagaaggaatatggagagactaactttagcttgtggtggtgtagcaatgaatagtctcgatgatctcacagaagaatgtctaggtcgagcaggtctcgtatatgaacatgtacttggtgaaactaagtatacatttgttactgattgtccaaatccacatagcgttactgtacttgttcatggccctacttcatatgccattactcaaatccaagatgcgcttcgagatggtttgagagctgttaaaaatgcagttgaagatggtggtgtccttcctggtggaggagcagttgaattaaaaatacgtcatgaattgaagaaagttgctgagaccactaaag

SEQ ID NO: 3325 - DNA, 669 bp, Euschistus heros
agatcaacttcatgtggcatttaaagctctagatgcttacaagaaagaatttggcaagttaccttcaccatggaacagcaaggatgcttctgattttctgaactgttgtaagactgtaatgcctgatgtaagagaaaatctagaattaaatgaaaaacttatggagcaattttccaaaacttgttctggaaatatgaatcctattgatgcattcattggtggtgttgttgcccaagaagtgatgaaagcttgtagtggaaagtttcatccaattttccagtggctatattttgattgcattgaattattgccaaaagaagatttaagtcctaatgattgtgcacccaccaattctcgatatgatggacaagttgctatttttggaaaagagtttcagaaaactttaggcgctctcaaatattttgttgtaggtgctggagccattgggtgtgaacttctcaagaatttttcaatgatgggagtaggagcagatggtggtaaagtaattgtaacagatatggatcttattgaaaaatctaaccttaacaggcaatttttatttagacctcatgatgtacagaaacctaagtcagctactgctgctaaagcaataaagaaaatgaacccattaatgaatgtgattgctcatgaaaatagagttggccctga

SEQ ID NO: 3326 - DNA, 783 bp, Euschistus heros
tctgaagtccaacatgagtgcattcctcaagcagttcttggcatggatattctatgtcaagccaagtctgggatgggtaaaactgctgtatttgtattagcgacccttcagcagatggagttaactgaaaatcaagtaacagttttggttatgtgccatactagggaattagctttccaaataagcaaagaatatgaacgattttcaaaatatatgccaaatatcaaggttgctgtattttttggtggtttacctattcagaaggatgaagaagttttaaaaaataactgtcctcatatcgtagttggtactcctggacgaattttagctttagtgaagaataaaaaactgaatttgaaaaaccttaaacactttgtgttagatgagtgtgacaagatgcttgagcagttagacatgaggcgtgatgttcaagaaatttttaggaataccccacatagcaagcaagtcatgatgttcagtgccactctaagtaaagatattaggccagtttgtaagaaattcatgcaagatccaatggaagtttatgtagatgacgaagccaagctgaccctgcatggccttcagcaacactatgttaagcttaaagaaaatgaaaaaaataagaaactgtttgatctgcttgacatcttagaatttaatcaggtggtgatatttgtaaaatcagttcagagatgtatggctttggctcaactgttatgtgaccaaaatttcccagctgtagctattcatagagctatgagtcaagaagagagacttgccaag

SEQ ID NO: 3327 - DNA, 699 bp, Euschistus heros
aaatacgagggtttctgcatgctaggctgagaactgctactctcagaaatgattttgaaggtcaggcggttctaattaactgtttattgagaaattacttgcattataaactgtatgaccaagctgacaagttagtatccaaatcagtatatccagaatcggcaagtaacaatgaatgggctagattcctttattatttaggaagaattaaagcagcacgtttagaatattcagaatcacacaaacatctagttcaagctttaagaaaagctcctcaacatgctgctgttggatttaggcagacagttcaaaagcttgctgtcactgttgacttgcttctaggtgacattccagacaggcagatctttagacaagcacctcttcgtcgttctcttgcaccatatcttcagttaacacaagctgttagaactggtgatttacaaagatttggtgaagtgttagaaatgtttgggcctcagtttcgttctgaccatacatttacattaattcttcgtttaagacataatgttataaaaacagcaataagatgtattggtttatcttattcacgcattactcctaccagcatagcttctaagcttgggttagattcaccggaggatgcagagttcattgttgctaaagcaattagggatggtgttattgaagcaaccttagatcctgagcatggttatatgc

SEQ ID NO: 3328 - DNA, 759 bp, Euschistus heros
agtgctagaggtcctacattaaaacatcagagaatacaagatgaaagtgttaaaaaatactctggtattgatgaatggtacaaacgaggagttgacaattcaaaagtggttacgaaatatagaaaaggggcatgtgagaattgtggagccctcacccatcaaaaaaaggactgtatggaaaggccacgaaagattggtgccaaatttactggtgctaaaattgcacccgatgaatttgttcaacctgaactctcacgagattatgatggcaaaagagatcgatgggcaggatatgatccatcacaacataaaatggttattgagagatatgccaggatcgatgaagctaaaaggcagttgagggcagataagcttaattctgaacagtctgaagaagccgaagaagaagaggcaaaagacaatatcgctgatgaaggaggtgaagatgaggataaatatgtggacgaagtcgatatgcctggtacaaaagtagattcgaaacagagaattactgtgagaaatctcagaatcagagaagacacagccaaatatttgagaaaccttgatcccaattctgcatactatgatcctaaaaccaggagtatgagggacaacccttacgctggatctgccgatactgatgtggactatgctggagaaaactttgtgcgtttcactggtgatacattggagcatgcgagagtgcagttgtttgcatgggaagcacacaacaaaggagttgatgttcatcctcttggg

SEQ ID NO: 3329 - DNA, 498 bp, Euschistus heros
tatgaattaggacgaccagcagccaacactaagttgggtcccaaaagggttcatttggtaagaaccagaggtggaaatactaagtttagggccttgaggttggactatggaaatttttcatggggttctgaatgctgtaccagaaaaactcgtctgattgatgtcgtctataacgcttcaaacaatgaacttgtacgtaccaaaaccctcgtgaagaatgccatagtagtgattgacggtaccccgttcagacagtggtatgaagcccactatgcgctcccattgggaagaaagaagaatgccaaattgtctgaagcggaggaagccgtactttataagaagaggtctaggaaaacagaaaataggtacaaggcaaggcagaaactcgccaaggttgagcctgctttggaagaacagttccagactggtcgtattcttgcatgtttagccagccgacctgggcaatgtggacgagctgatggttatatcctcgagggg

SEQ ID NO: 3330 - DNA, 776 bp, Euschistus heros
gacacagcagaacaagtctacatttcttctctggccctgcttaagatgttaaaacatggaagagctggggttcccatggaagttatgggacttatgttaggagaatttgttgatgattacactgtaagagttattgatgtgttcgctatgccacagacaggaacaggtgttagtgttgaagctgtggatcctgttttccaagctaaaatgttagacatgttaaaacaaactggccgaccagaaatggtggttggatggtaccattcccatccaggatttggttgttggttatctggtgttgatatcaacactcagcaaagctttgaagctctttcagaaagagccgtagcagttgtagttgatccaatccaaagtgtcaaaggtaaagttgttatagatgctttcagattaattaatcccaacatgatggttcttggtcaagaaccacgacaaactacttctaatttagggcatcttcagaagccttctgttcaggcgttgatacacggattaaatcgccattactattctatcagcattaactacaggaaaaacgaattggagcaaaaaatgttgttgaacttacataagaagtcatggatggatggtctgatgctctccgattattctgaaaattgtaaagtaaatgaaactacagttggtgatatgcttgaattagctaagaattacaacaaggcattggaagaagaagaaaaaatgacgcctgaacaacttgctattaagaatgttggaaaacaagaccctaagaggcattt

SEQ ID NO: 3331 - DNA, 651 bp, Euschistus heros
attctggagcaaatggatgtggatgagaaaaagggggagggttttcgttcttattacatcactaaaattgaagagcttcagttgatagttgcagagaaaagtcaaaaccttaggaggctccaagcacaaaggaatgaacttaatgccaaagtaaggatgttaagagaagaattgcaactacttcaagaacaaggctcttatgttggtgaagttgtgaaacccatggacaaaaagaaagtgttagttaaagtgcacccagaaggaaagtttgttgttgatatcgataaaaatattgatattaatgatgtgactcctaattcaagggtggcccttcgaaatgagagctatactctgcacaaaattctacccaacaaggtcgatcctttggtatcattgatgatggttgagaaagttcctgactcgacgtacgaaatggttggaggtcttgataagcagattaaggaaattaaagaagtaattgaacttcccgtaaaacatcccgagctatttgatgcgttagggatagctcaacccaagggagtattgctatatggacctcctggaacaggtaaaacacttctagcgagggcagttgcccatcacactgaatgcacattcattcgtgtgtcaggttctgagctggtacagaaa

SEQ ID NO: 3332 - DNA, 453 bp, Euschistus heros
tggttgaaaacagcttatgatgttcaaagttttgggtattttcaaagaggaactgcccaggacactatggcttttgccagtaaaacgatagttgaaaggactcaatctgcaaccaggcaatctgtcaaagaaggagattatatatgtcatgtgtatgtgagagctgacaatttagctggggttgtaatatctaatcatgaataccctcatcgagtggctcatactcttataactaaagtgttagatgaatttagtgcaaagtatccaccttcaacttgggcgtctgctaatgaagccaacattgattttccggcattggcagctcaccttcagaagtttcaaaatcctaaggaagctgatgctttaatgaagattcaaagtgagctggatgaaactaaaatcattcttcacaacaccattggagctgttttagaacgtggcgagaaattagat

SEQ ID NO: 3333 - DNA, 602 bp, Euschistus heros
gttaggttccacggctataggtgtttgtaccccggaaggagttgtcatgggagctgaaaaaagaatcaagtcacctttaatggaaccagaagcagtggaaaagatccttcaagttgatgatcatattggttgtgctgtaagtggtttgatggctgattccagaaccttagttgagcatgctagagtccaatgcctaaatcattggtttgtatatgatgaaaagatgccaatagagtctgctgctcaggctgtctccaatttagctatcagatttggcgatgctgatgaagatgctggtcctgctatgagcaggccttttggagttgctgtcatgtttggaggatatgactacagaggacctcagctgtatcatatggatccatcaggcacatttatttattttgacgctaaagctatcggctctggaagtgagggagcacaacaaagactccaagaattgtatcataaaggaatgagccttaaggaggctatccagatgattctgaccatcctaaaagaggtaatggaagaaaagttaactgataacaatgtagaaatagcagtagtaactgcagaagagaaacagtttcgcatgtatacca

SEQ ID NO: 3334 - DNA, 652 bp, Euschistus heros
agcagccttcaaaatatggaaaagaaacaaagtgcaagtttgttgacccgaaacttagcagatctggttaaaaaggaacattttattttagactctgaatatttgactacattactagttgttgttcccaagtcaaactttaatgattggaattccagttatgaaaaactgactaatatgattgttcctcgttctagtcaacttgtttatcaagattctgattttggtttgttcactgtatcattgttcaagaaggttgtaaatgattttaaactaatggcaagagaaaagaaatttgttgtacgtgattttatttacaatgaagaagagttagctgctggaaaaaatgaaattacaaaattggtgactgataagaagaagcagtttggacctcttgtacgttggttgaaggttaattttagtgagtgcttttgtgcttggattcatgtaaaagcattgagggtttttgttgaatctgtcttgagatatggtttaccagtaaatttccaggctatgttgattcatcctcataaaaagtctgttaaacgtttgagagatttactgaatcaactatatgcgcctttggatagtagtgcccagcagcaaggagggcaaggtggtggtaacgatagtgtggacattcctggtttag

SEQ ID NO: 3335 - DNA, 723 bp, Euschistus heros
gccatcaacatccttaaagcccatggtggatcagcaaaagaaagcatattggttaatggatatgccctcaactgcacagtcgcctcaatgggaatgattaaacgagtagaaaatgctaaaattgcttgccttgacttctctttacaaaaaaccaaaatgaaattaggtgttgaagtcctggtagaagacccgaatcagttagaagctattagagatagggaagccgatataacaaaagataggatacagaaaattctcagtgtcggcaccaatgtagttcttttgagcggaggcatcgatgacatttacatgaaatacttcgtggaagccaatgcaatggttgtaaggagggtgaaaaaagcagacttgaaacgaatcgctaaagcaactggtgcctcctttgcaacatccctaactaatatggaaggcgaagaagcatttgatgctagtttgttaggtgaggctgctgaagtatcacaagaaagaatatgtgatgatgagcttattcttgtcaaaagtccaaaagcacattcagctgcttccataatcctccgtggaccaaatgactatttctgtgacgaaatggaacgttcaattcatgattcactgtgtgcagtcaaacgagttcttgaaagtaaaacagttgtggccggtggcggagctgtcgaagctgctttatcgatctacttagaaaactttgctacttccttaagttcacgggaa

SEQ ID NO: 3336 - DNA, 641 bp, Euschistus heros
aataacacacttgatgatcatcaagtaaaaattattaaagctccggattttttaactagaactttatatcctatgacaactacagcttctgtggttggaatcaaatttagtaatggcgtagctattgctgcagatgttggtggatattacggatcattgaatcgttttaaatctcttgataggttgtacaaagttaataacaacattgtaatgacaacaactggtgattatgctgattttcagtacatgagagaattaatacaacaaaaagttattagtgaagagattctagatgacagtttctccttaaaagcttcttctcttcatacttggcttactcgcctgatgtacaataggaggtcaaaatttgatcccttatggaacaatgttattgttgctggatatgatagcaatggaccctttttgggaattgtggataaattaggtatgagttatgaagacagttgtgtagcgacaggtatgggtggatatctagctacacctcttttgagggatgtgcatgaacgaagtaaaggaaatttgactaaacaagaagcccatgcagctcttcagaagtgtatggaaattttatactatagagatactcagtcacttcccaagttccaaattgcaacagtcac

SEQ ID NO: 3337 - DNA, 777 bp, Euschistus heros
atacagctcttcatcgaacccgtgccttactcttttctgatatgtttatgatcgctacctggatgtccgaaaggaaaggacttgccaagtataagtttgaaagcaattatgatctgggtagcctagctgttgtaaatgtgagggatcttggtcaggttaaacatgcttttaaacttctagtttttcctgataccagactttttcaatgtgtgaataatgaagccagggaggaatggttgaaaaaatttgatgaagctaagaaagctagattgaatacagatcagaccaaaaaaaaagatgaaaatgaaaaagaatctcatcctgttcatgaacatttgactaaaccccctgatagaactgactcggtcgaatttggatctaacccattcgggtttgtactggatgatgatggagacagtgacgctctgcctgaatggttgactgaagcagctgatgatcttgatgtatccattgctcagaggcattttgaagaagcttatgcaatcatacaaaaagccgaggagtactttgcatctgcgcaagatgatcagtcactggccgatataaagtccaaagtggaaaacagaaaagatgtattgataagcgttcttctatcagagttgaatgtcagtgctgagaaatcattacaaggaggtcttcgagctagccgaagagctgttagactccttaaccaacttaacaagtcaacccaagcatgtgaactatatctgaaagtttgtacgaacctactaaaagcccaaagtaaacgagtgaagc

SEQ ID NO: 3338 - DNA, 680 bp, Euschistus heros
ttgttgatccaggattcgttaaacagaaagtgtacaattcaaagacaggaatggattctcttgttgttactcctatttcacaggctcaagcaaagcaaagagcaggtagagccggtagaacaggaccagggaaatgttatcgactatacaccgagcgtgcctacagggatgaaatgttacctactcccgttcctgaaatccaaagaacaaacttagccactactgtgctacagctgaagacaatgggcattaatgatctccttcattttgattttatggacgctccgccagttgaaagtttaataatggctcttgaacaacttcacagtctcagcgctcttgacgatgaaggactccttacaagactaggaagaaggatggcggaatttcctttagaacccaatttatcaaaaatgttaattatgtctgtacatctccagtgctcggacgagatacttactgtggtctcgatgctttctgtccaaaacgtattttatagaccaaaagataaacaagcccttgccgatcagaagaaggcgaaattcaaccaagccgaaggagatcatctaacactccttgctgtttataattcatggaaaaataataaattcagtaatgcctggtgttatgaaaattttgttcagattaggacgctgaagagagcccaagatgttaggaaa

SEQ ID NO: 3339 - DNA, 744 bp, Euschistus heros
tcctaacctcaggcatagaaaatcttccaaaaatcaccaaaatggtatcagtgaaacaacaaaaaactctttaaggaagaaattagctttcaaattcaactctggtgacagtatacaatctgactttagtgaaaaagaaccatgccaaagggtagttacaatatctcgttgtggtagttggatggcaactggtggcactgatggtattgtaagaatctggacgttccctggccttcgattaattagagctctaaaggcccataccaaagagctggatgatttacatttcagtcctgattcaaagcaggttgccagtgtggcgaaagatgggcaagccattatttgggaaataaaatcaggaaaacaggttcataaactcaattgggctcaccctacaggaattaaatatatttttaaaagatgtcgctttggaatgattgagggtaaaggaagtagactatttaccactgttaatcctgtggctggtggaaaggaagcccaaggttggatccacgcctgggatgaaggccgtatctcgaagtctacatctgtatctgaacccacttcagcacttgctgttagagacgatggagttttcttagctattggtacaatgttcacaggatcagtatccatatacatagcattttctcttcagagagttctgcatgttgatggtgctcattcaatgtttgttactggtgttgaactgttgccctgttcatcttcatggggtgctataga

SEQ ID NO: 3340 - DNA, 776 bp, Euschistus heros
agatgaacacaggactttccttaggcagtcactggaagctaggctcattgctctatattttgacacaggaatgtttacagaagctctacagcttggctcaagtctccttaaagaattgaagaagttagatgataaaaatttgcttgtagaagtacttttgttggaatctaaaacttatcatgctttgagcaatctctcaaaagccagggctgctttgacatcggccaggacaactgcaaattcaatttattgtccacccaaaatgcaagcagcccttgatttgcaatctggtatacttcatgctgcagatgagcaagatttcaaaactgcctattcatacttttacgaagcttttgaaggttatgatagcgttgaaagcccaaaagctttggttgctcttaaatacatgcttttgagtaaaattatgttgaacacaccagaagatgtacaacaattagtcagcggtaaactcgcacttaaacatgcaggtaatgacatcgatgctatgaaatcggttgctcgagctagccataagagatcccttgctgattttcaacaaaccttaaaaaaatacaagaaagaacttgaagaagatcctattgttcgagcacatttgggaacactgtatgacaatatgttagaacagaacttgtgtcggataattgagccctattccagagttcaggttgattttatttccaaatcgattaaacttcctctgcctcaagtagaaaagaagctttctcaaatgattcttgataagaagttcaacggca

SEQ ID NO: 3341 - DNA, 675 bp, Euschistus heros
agcagttattggaaactcgtaccaaaaagcaagtggaaattagtgaacttgatggtagattaagccaagagtatgaagaaagattgtaccaaagtcttcaagaaatacgtgatcagtatgaatgtgatttagagaataacaaggaagaaataaaaaaattatatgaggaaaaaattcgcagtcttggaagtcaattgacacggaacagcaatgctgcagcaatggctattgaagaaatgaaaaatatgcaagctaaactgaatgagcttaataggaaattgcttgacttagaagcagatagaaatacagcccagcaaaaggctagagatttggaaaaaatcttagaacaagctaaagcccaatacatggaagaatatagtcagagggaagctgaaataacaactcttcgtgaagaaatggctcatcaagttcaagaatatcaagatttaatggatattaaagtagcattagatttagaaatagcagcttatcgaaagttgcttgaaggagaagaagctaggttaaatataacacctgtcagttctcctgcacagacttcttctcgcaaagtcttaggtagaaaaaggaaacgtactttcattgaggaatctgatgaaacagatgtttcaaattactctgttacttcttcatcgaagtgtgatgttgcaatctcag

SEQ ID NO: 3342 - DNA, 776 bp, Euschistus heros
aaacagtggttgaagttcctaatattacttgggatgatattggtggtttggataatgttaaaaaggagttacaagaattggttcagtatccagtggaacatccagaaaagttcctgaaatttggaatgcagccgtcccgtggtgttctattctatggaccacctggttgtggtaagactttgttggctaaagctattgctaatgaatgtcaggcaaatttcatctcagtaaagggtccagaattattaactatgtggtttggagagtctgaagctaatgtccgtgatatttttgataaggctagagcagctgcaccttgtgttctattttttgatgaactggattcaattgctaaatcaagaggggggagtgttggggatgctggaggtgcagctgatagagttattaaccaaatccttacagaaatggatggtatgggagccaagaaaaatgtttttattataggtgctacaaatagaccagacataattgatcctgctatcctgagacctggtcgtttagatcagctgatttatatacctttacctgacgagaagtccagagaagctattttcagagcaaacttaaggaagtcacctgttgcaaaggatgttgatttacaatatattgccaaagtcacatttggttactctggtgctgatcttactgaggtatgtcaaagagcatgtaaactcgctatcagacagtcaattgaagctgaaattaaaagagaaaaaagtagattagatggagccacacgaatggagatggatgat

SEQ ID NO: 3343 - DNA, 674 bp, Euschistus heros
gttccaagtctatgtgaagaactattgtcttcagtagaccaacccttgaaaatagccatagataaaggggttggtaaagattatttattatgtgactacaacagggatggcgattcatacagatcaccttggagcaatacttacgatccaccccttgaagatggctcaatgccttcagaaaggctaagaaaactagaaatagaagcaaacgccgcttttgatcaatatagagagatgtattttgaaggcggagtgtcatccgtctacttgtgggacttggatatgactggttttgctggtgcaattttaataaaaaaggccggcgatggttcaaagaagatcaaaggttgttgggattccatccatgtcgttgaagttcaagaaaagacgactggacgaaatgctcattacaaattaacttcaactgttatgctgtggctccaaactaacaaaacaggttcgggtacaatgaacctggggggtagtttaacgaggcagatggaacaagacgcagctgtttcagattcttcaccacacattgccaatattggccgaatggttgaagatatggaaaataagattaggaatatcctgaatgatatctattttggaaaaactaaagacattgtcaatggcttaagaagcactcaggcattatcggaacagaaagcaca

SEQ ID NO: 3344 - DNA, 734 bp, Euschistus heros
agaaacctatggatctcggaactgtaaagcaaaaaatggacaatcgagaatacaaaacagcaactgaatttgctgctgatgtgagactaatttttacaaattgttacaagtataatcccccggaccatgatgttgttgcaatgggccgaaaattgcaggatgtttttgaagtgagattcgctcaagtacctgaagactcccctatatcgactgttcctgaaaaggaagaagaatccacctctgggtcatcgtctggctctgaatccgaaacagataattcagatgacgaaagggcccgtaaacttagtcaattacaagagcagttaagaatcatgcaggaagagatgagaaaactcgtcgaagaaggaactgttaaaaagaagaagaaaaagaaagaaggttcaggttctggtggaagttcttctagtaagaaacggaaatctgctgataggacattaggtaaaacagccgatggtgggcttatagctggtgccggagcacccgctatcatggaaataaaggctactgatggcgtaaaggctgtccctcctccaggcaggaatgcagtcccttcaccccaggtcaaaccaaacaagggcaaagcccctggaagggcaccaggaaaaaccaattctcagggtaagaggccaaagccgaactccaggtctactaactctaagaagaagaatcctgttgtcacttcagagtttaactcggaagatgaggataatgca

SEQ ID NO: 3345 - DNA, 668 bp, Euschistus heros
tgaatcaaaagaggtacgcaatggtttccgccattgctgctactggagttccagctcttgtcatgtctaaaggacacatggtcaatgaagttccagaaatccctcttgtagtaactgataagattcaggaatatactaaaaccaagcaggctacaattttcctgcatcgtatcaaggcttggtctgatattcagaaggtctataagtctaagagatttcgtgctggtaaaggtaagatgcgtaacaggagacgcattcaacgtaggggccctcttatcatctatggtcaagatcaaggcctaactcgtgctttccgtaacattcctggtgttgatcttatcaatgtttcacgattgaacttgcttaagctggcacctggtggtcacgtaggtagatttgttatctggacacaatcagcttttgatcaactcaatgctctctatggcacatggaagaaaaaatcaactttgaaaaaggactacaacttgcccatgcccaagatggtaaacaccgacctttctcggctgttcaaatcagacgaaatcaagagtgttcttaaacctccaaggaagaccatagttaggagggtaaggaaactgaacccattgagaaatactcgtgcaatgttgaagctcaacccattcgctgcagttctgaagaggaaagct

SEQ ID NO: 3346 - DNA, 748 bp, Euschistus heros
atggtgaccctattgaaaccgaagtagaagaacaagaggaaactcctcctcctgaaataccttctgtaaaacattctatacgttctggaccttatgcaatttgccgaaaagctggaataggtggtttggcaaaacgatttggtttgaaacctgaacagttcgctgaaaatcttagggataattaccagcgccacgatgttgaacaggagccatccttacctcttgaactggcaaaggagtttgtttcaacgaaatttgttacaccagaggatgttttaaaagcagcaaaatttatggttgctacacaactgagcagagaaccccttgttcggcgttgtatgagggacactttctttgaaaaagctaatattgatgttaaaccaaccaagaaaggttctaaagaagttgatgaaaaccatccttgttatgtcatgaaatatcttaaaggtaaaccagtgagagatttaactgctgaccagtatctaaaactacacattgctcatcaagataaactattaaatgttactattagtgatcatattggtggccatacaacaacatcttatattgaggaaattaaacaactctactatcgtgatgagttcatgcagcatgtgcaagaatggaataatattcgccaagaatgtgttgatgttgctattaagaagatgttaattccagaattgattaaagaactccatactcgtctgcttgaagaagctaaagagtttgttttgaggtcatgtgc

SEQ ID NO: 3347 - DNA, 720 bp, Euschistus heros
taacattggtgtcgttgctaggttattattcaaggaaaatataattcgtgggagaggccttctttgcagatcaattatacaagctcagtctgcttctattacatttaccaatgtatatgcttgtttggtggctataattaattctaagtttccaagtataggagaacttttactgaagagagttattattagattcaaaagggcttataaaaggaatgataaagctgtctgtatttcttcagcaacatttatagcacatcttatcaatcagggtgttgctcatgaaattcttggattggaattagttactttattagttgaaaatcctacagatgattcaatagaggtagcagtagcctttttaaaagaagcaggacagaaattaagtgaagtaaccagcaaaggcactaatgctatatttgacatgttaagaaatattcttcatgaaggaaagctcgaaaaaagggtacaatacatgattgaagttatgtttcaagtaaggaaagatgattttgccacttttccatcagtaccagaagagcttgaccttgttgatgaagaagatcagttcactcatttaattggacttgatgatgctattgatacccaagatatattaaatgtgttcaagcttgattcagaatatcaggcaaatgaggaacgttataaagaattgaggagtgaaattcttgatactgattctgaagatagtggctctga

SEQ ID NO: 3348 - DNA, 663 bp, Euschistus heros
aagaggtagagtggagagtccttgtcgtggatcagctagcgatgcggatgatctctgcttgctgtaaaatgcatgaaatttctgccgagggcttaacaattgttgaagacattaataaaaagagggagccacttccatcaatggaagctgtttatctaataaccccgagtgaaaaatccgtacatgccttgatgaacgattttgcctcaccgaatcgtatcatgtacaaagctgcccatgtctatttcacagaagcatgcccaaatcctttatttgacaccctgtgtcatgcgagaatcgctaaatttataaagactctgaaggaaataaatatagcatttattccatacgaacagcaggtgttttcccttgatgctccagaaacattccagtgcttctacaacccatcattggctaacagccgacttgctaatatggagcgtattgcagaacagatagccacattgtgcgccacgcttggtgaatacccatctgtcagatataggagtgattttgataaaaatgtagaattagctcagatagtgcagcagaaattggatgcctacaaagctgatgaacctacaatgggtgaagggcctgaaaaatctcgttcccaattgttgatccttgatcgaggttttgatgcagtttctcctcttcttc

SEQ ID NO: 3349 - DNA, 674 bp, Euschistus heros
gactgaactatctgccgaattgagtggcttcaaaatgggatctgatgattcttatcttcaaaaactaactcaaaacatatttcaaaaatatttagaatcttacataagtgttgaagttaagggcctgaaggaaaagtgctcaacgttgttacaaaaatattatgactcaaaagatcaccataaacgacaaatacagtctggaggattccaagattttagacgtgatcttcaggctgttattggcactagggctaacatcaatattgctcaaatcgaagattatggaggagaaacatttttatcagaagaattagttattagtctaatacaagagtctaagcaggcattttacagatgtaaattgctgtctaaacctgctgacttggcaagtaacacagtccagctgttagaggtactactgaattgtattattatcgatcatgttgattacgctgtagaactagctttacaagcagtaccaattcctgaaagtaaaacacaggctcagccaatatatttctttgatgtcgtaaggcaggcaaacaccattgtgcatctgattgaaaaacacttcaatgattctgctcttcctttagtaatgtcaacttctaaacatggggaatgtgtcatgaaaaaaaaattcttattaaaccatttggaacagaaactggaca

SEQ ID NO: 3350 - DNA, 685 bp, Euschistus heros
gcaactagctctcgaaactatagatataaacaaggatccctattttatgaaaaatcatttaggttcctatgaatgtaagttatgtctcaccttacacaataatgagggaagttatttagcccatacccaaggaaagaaacatcaagcaaatttagcaagaagagctgctaaagaagcgaaagattctccacaacagcccgcaccagataaacctagaatagaacctaaaaagttcgtaaaaattggtagacctggttatcgagttaccaaacaaagggatcccgaaactggccaacaaagtcttctttaccaagtggattatccagaaattgcagaaggaatcttgcctaggcatcgttttatgtcagcttatgaacaaagagttgaacctccagacagaaaatggcagtatctcctttttgcagctgagccttatgaaacaatagcctttaaggtgccaagtcgtgaagtagacaagtctgaaaacaagttttggacccattggaacaaagataccaaacaattttttctccagtttgcatttaagaatgaacctcttgctcctcctatgggcgcaccacatctaggccagatgaggcctccacacatgctgcctcctccaatgagtgttcctccacctcctatgtttaatccagttccacctccccctccaaatctaatgctt

SEQ ID NO: 3351 - DNA, 295 bp, Euschistus heros
tgtgaaaccaaaactggagaagtctacagaggaaaactaattgaagcggaagataatatgaattgccaaatgactggtttaactgttacctaccgcgatggcagagtggcacagttggaaaatgttttcattaggggttccaaaatacgttttcttatactgccggacatgctaaagaacgcgcctatgtttaaaaaacaaggcaataaaggaaatacgggtgcggggagaggtaaatcagcaatattaagagctcaagctgcccggggtagaggttcacaatcaagaggaggtg

SEQ ID NO: 3352 - DNA, 672 bp, Euschistus heros
gagtgggcttggaaattctatttttgttcgagaattcaatattaagaaaattaactgtgaaacgttgcaacatttttatgctagcaatttcactggtgataaagctgctgtagctggttgtggaatacctcatagttttctgacttcttttgctgattcactggggctgtgttctggaattcccagtcaaatacaagcatccaagtatagaggtggtgaaataaggattgaggaaaacattccattccatcataccatcattgctgcagaagcaccaggtttagacaaaagcgatgcacttgcttatgctgtcttacgatatgccctgggcactggtccttctgtgcaccgtggtcaaggatctggacctctttccaagattcctgctaaggctatggcgctttccatggcccactctgacgctggtctttttggtgtttacgtttcttctcttggtacagatgctaaagaggctgtggaaggagcagtgaaagctttaaagtgtggagtcactgaacaagatgtcgcacgaggtaaagcacagttaaaatcagaattgttatattccggcgaaacctgtcggggaatagtggatgaccttgttgggcaggctttacttgtcaaaggggcacctcccatgaccattgttgaattggccgaaaaagtttcttc

SEQ ID NO: 3353 - DNA, 195 bp, Euschistus heros
aggaaaatgaccagatgacgaataaactcaaagataaaataactgctttaaagcacttatctattgatatcggcgcggaagtcaagtatcaggataagatgctgcatggcatgtcagaagactttgatcgtactggtggcttcttaggaaatacaatgaatcgagttttacgcctgaccaaagggagtcacaatt

SEQ ID NO: 3354 - DNA, 710 bp, Euschistus heros
tgaagatatgcttggacgagtcttcaatgggagtggaaaacccattgataaaggtcctccaattcttgccgaagattatttggatattcaaggacaacccataaatccttggtctcgtatataccctgaggaaatgattcagactggtatctctgcaattgatgtaatgaattcaattgctagaggacaaaaaataccaatcttctctgctgctggattgcctcacaatgaaattgctgctcagatttgtcgacaggctggtttagtaaaattacctggaaaatctgttcttgatgatcaagaagataattttgccatagtatttgcagctatgggagttaacatggaaactgcccggtttttcaagcaagattttgaggaaaatggttccatggagaacgtttgcttgtttttgaacttggcaaatgatccaactattgaacgtattatcacacctcgtcttgctcttactgctgctgaatttcttgcttatcaatgtgagaaacatgttttagttatattgacagatatgtcctcttatgcagaggcccttcgagaagtatcagctgccagggaagaggtgcctggtagaagaggtttccctggttacatgtacactgatttggccaccatttatgagagagctgggcgtgttgaaggcagaaatggaagtattactcaaattccaattcttaccatgcctaacgatg

SEQ ID NO: 3355 - DNA, 737 bp, Euschistus heros
gtcaaagaccagacactcatgtggcaacagagctcatatttggctgattcaggaattcattccggtgcaactaccacagccccctcactctcaggtaaagaagaagaaatgtatggggatcaggacatgtttgacttggatcaaggttttgcccagggtttcacccaagaacaagttgatgaaatgaatcagcagctctctcagacacgatctcagagggttcgggcagcaatgttccctgagacattagaagaaggtattgaaattccatctacccagtttgaccaagctcaatccacagcagttcaaagacttgctgaacccagccaaatgctaaaacatgctgttgtgaatctcataaattatcaggacgatgcagatctagctactcgtgctattcctgaattgataaaattactcaatgacgaggaccaagtagtagtgtcacaggctgctatgatggtacaccagctgtctaaaaaggaagcctctcgccatgccatcatgaacagtcctcagatggttgaagctttggtgagagcattatcaaacagtaatgacttggaaacaaccaaaggagctgttgggacattacacaatttgtctcatcacaggcagggtcttttggctattttcaaaagtggtggcatccctgctctagtaaaacttttaagttcgcccgtggaatctgttcttttctatgcaatcacgactttacacaacctccttcttcatca

SEQ ID NO: 3356 - DNA, 678 bp, Euschistus heros
gcacaattaggagaaggtgatcaagctaaacaaagaagaccgtatttagcatctgagtgcactgatcttcaacaagctgaaaaatggagaatgcaaattataagagaaatagctcgtaaagtttcacaaattcaaaatgctggtcttggtgaattcagaattcgtgatttaaatgatgaaatcaataagcttttacgggaaaaagggcattgggaagcccaaattcgagagcttggtggcccagaccactctaggtctgggccgaaaatgctggatgctgaaggaaaagaagttcctggaaatagaggttacaaatactttggtgcagcaaggcaactccctggagtgagagagttattcgagcaggctccacctcctcctccacataaaacacgtggtgagctaatgagagatattgatgcttcttactatggttatatggatgatgaagatggaatcattattcccctggaagaaattgaagaaagtaaagctattaaaaaagctgtatcggaatggactgttaaaaaggaaaaatcaatggaaattgaggaagaagagaaagaagaagtcgaagaagacaatatctacaaaatagggaataaagagggtgaggaagatgatgaagaagtagaagatgatggatttgaattaagtgccaagttactggaagggtac

SEQ ID NO: 3357 - DNA, 500 bp, Euschistus heros
tgtcaaacgccatttaactggtgaatttgaaaaaaagtatgttgcaactttaggggtagaagtacatcctttagttttccacacaaatagaggccctatccggtttaatgtttgggatactgcaggccaagagaagtttggtggacttagagatggatactatattcagggtcagtgtgccattattatgtttgatgttacttcaagggtaacatacaaaagtgtccccaactggcatcgagacttagtgcgagtttgtgaaaacattcctattgtactttgtggaaataaagtagacattaaggataggaaagtgaaagccaaaagcattgttttccataggaagaagaacttacaatactacgacatcagtgctaaaagtaactacaacttcgaaaaacccttcctgtggttggctcgaaaacttattggtgatccaaatctggaattcgttgctatgcctgctttgttgcctcctgaggtcaacatggatcctgaat

SEQ ID NO: 3358 - DNA, 362 bp, Euschistus heros
tcattttgatgctttaccgctatggtggaaagcaaggatttttgggggtaggtggaacatggaacctgtatgaagtaaagagtgcagatgctgaaattattgcatcgggtgtttttgttggattttttatatatacatctgtcattttgatttcctactgcttcggaacaacaaaacacaaatatagtgcagtggacataataatgaatgtgtgtggaactatactgtttactgcagtaggaggaatagcattacactattgggtcggcttccaggatgaaaaccattatgtgggaatctctcaagaaaaacaaatcggccttgcactgggcagcctttgcgtcgtctgtgcagctatttat

SEQ ID NO: 3359 - DNA, 682 bp, Euschistus heros
cagcctaagaacgattacgaaattgtcgttcctgaagatgaagtttcatctgaaacagccgcggagggttctggtatgccaagcatcgaagatcaagcagatatcgatgccagaaatttgagccttctcgctcaacaacgtgaaaaagagttgaaaagtagatcgcaagtaattcaacgaggtttgcctcgacctggagacatcaatatagtactgcgcccagctaacacagatccacctctaacagatcttcagaaggctgaagagatgataaaagaagaaatgataacgatgctgcattatgatgctatgcacagtggtgaacctccttcctcgaggaaaattggaactttgagtcaggcacagcaccttgcctacctcgagcaacatccgtatcaaacttactcagaagatcaaatggaaaaggccaaagaaatgctgaaagctgaaatggaagttgtcaaacaaggtatgaatcatggcgatctctcgctggaaacttttacgcaagtttgggaagaatgtttagctcaggttttatatttgccaaatcaaaatagatacactagggcaaatttagcaagtaaaaaggaccgactggagtccgtcgaaaagaggcttgaacaaaataggactcatatgactcgagaggctaaaagagctgcgaaaatggaacgaaaaa

SEQ ID NO: 3360 - DNA, 349 bp, Euschistus heros
aatggtatgttgcacatccagataaattgaagaaaaaaattacaagggaattaattacaactattttggcaagaaaacctaaaatgtgtagctttttagaatggaaagatttgaaaatagtttacaaaaggtatgcaagtttatacttttgttgtgctattgagcaaaacgataatgaactgttaacattagaagtgattcatcgctatgtagaacttcttgacaaatactttggaagtgtttgtgagttggatatcatattcaactttgagaaagcatactttatccttgatgaactcttacttggaggcgagatacaggaaacaagtaaaaagaacgtcctgaaagc

SEQ ID NO: 3361 - DNA, 654 bp, Euschistus heros
aaactggaatccatgctcatgtttatcagcccccacaaaaactaagaagaaggttggaaacaatgcccgataacaaaacattgaaacctgacacagagacattgggcatcgatcttcataaggattcaaaatttttccagagttggcagcaattcaaagacaataatgcttatatcaacaaagttcttgattggaaaatgaagtatgatgagagtgataatcctgttattcgggcttctcgagttttcactgataaggtttcaagtgttatgggtggcctttttcagaaaactgaactttctgaaactttaacagagatatgtagaatagatcccaattttgatagagctcatttcttgaaagattgtgagaaagacatcatcccaaatattcttgaagctatggtccgtggtgatttagatatattacgagactggtgtcatgaaggtccttataatattcttgctgctcctattaaacaagcaaaagatgcccattttaagttttgttctaaaattttagatattgataatgttgatttggtaatgggtaaagtaatggatcaagggccagtcttagttattagtttccaatctcagcaattactatgtatcaaagataaaaatggtaatattgttgaaggtgatccaaaca

SEQ ID NO: 3362 - DNA, 674 bp, Euschistus heros
tcagatactgaggctcttcaagaagcttttgttaaaggggaactgaagccaggtcttaatataccagttaaagaaagaacaaaaactaataatgttcctcttctaaaggaagtattaaatgatatcaagttggatctgccttggattgagagattggatgtaactaatgatcaagcacctctggctccagaacttgcccttcagatcagagatgaagaaaaaggccataatccattagtttatgatgagcttaagagagaaagtgtattctaccgacaagctcagaatgctgcaatgaagattcttccaaaattgaaacaattaggtttgagaactgagagaccaggggattattttgctgaaatggctaaatcagatcagcacatgcaaaaggttaaaggcgaagctataaagaaaaaattaatgatggaaaggattgagaaattgagagaaatacgagcacagaagaaagttcaaaaagctctccatgcacaagctaaagttgccaaagtacaaaataaaaaagaaatgcttgatgaagtgaaaaagtatagaaaaggagagaccaaaagtttagcttttctagaaccaggctataaggcaaaaccaaaagccaataaatcacaaattaaacggcaacacaagaatgccaaatttggtcatggtggaaagaa

SEQ ID NO: 3363 - DNA, 678 bp, Euschistus heros
ggaggagtagagacagaagttcaagtcgtaatagaaatcaggtgaagaactgggaaagagacaggagaggtaaaaatgatcgaagaagcagaagcaatggtaggaagagaaatgaaaggagtagaagcaggagcgttggtaaaaggaggaatgatagaagtagaagcaggagctatgatagaaaaaaaaatgataagaaaagggaaaacgatgatgagaagaataagtctgatgaaccactcgagccagaagttggaaaaatatataatgggaaagttacgaatattgtatcgtttggatgttttgttcaaatcgagggtttgaagagacgatgggaaggactcgttcatatatcgcaactgagaagagaaggaagagtaacgagtgcctctgatgtcgtttctcgtggaatgaaagtcatgatcaaagtattgtcggtggctggacaaaaggtatctctgtcaatgaaagatgtcgaccaagaaactggaaaagatctgaaccctaccgtccgacatgctatcaataaggacagggaagaagaagcttcgatgcgaaatcccgatcgccctacgacacttctagatttaggctcctttgatgaccatgatgactttcagagtagaaaaagggttaataggatatcttcacctgaaaaatgggaaatcaagcagatgt

SEQ ID NO: 3364 - DNA, 729 bp, Euschistus heros
atcgttggaactaagcctttgtacgttgctcttgcccaacgtaaagaagatcgcaaagctcatttagcatctcaatatatgcaaagaatggctaatatgcgtatgcagcagatgggacagatctttcctactggtggtactggaggctactttgttcctactctgccacagccgcaaagattttttggaccagctcaaatggcgcagatgcgtcctcagcctcgttggccagcacaacctcaagtcagacccagcacgcaagccactgcatcaggttttcccaatatgcaaggcccattcagaagtggaccacgaggcccaggtgctgcaggcggtggtggtggcccaggaagtgccgccgctgctgctgcggctatgcgctcctccatcagtgctgctgctgcagcggtggctgcggctggccgcccgacagccaatgcagctgctgcagccgccgctgctgctgccaacccagctgttgcccggcaattggcccaaggagcttctcaaggtgctccagtatctgtgtctgctcaaggtcgtcctgcaaattacaaatataccgcaaacatgcgaaaccccccacaaatgggaggtggggctggagcaggtgctggaggtcctccgcaacaagcattacacatccaaggacaagaaccccttaccgcaagtatgttatcatcagcgaatccccaggaacagaaacaaatgcttggagaaagactcttc

SEQ ID NO: 3365 - DNA, 783 bp, Euschistus heros
caggttcaacttcagctacttacggctattgttaaactgtttttgaagaggcctacgcatacacaagaacttgtacaacaggtgttgagcctagctactcaggattctgacaatcctgacctccgagacagaggatttatctactggaggctgctatcaactgatcctggtgctgcaaaggaagttgtcttagccgagaaaccactaatttcagaggaaactgatcttcttgaaccaactctcttagatgagcttatatgtcatatttcttcacttgcctctgtttatcacaagccacctactgcttttgtcgaaggtagagctggtttgaggaaatccctaccagcaagatctggatctgctgaagtggttcaagaaactcctggtgctcaagtcattccatcacaagattcactgattggggacctcctatccatggatataggcggggtttcagctcctcctccacctccaacgacatctgctcctgttgacctcttggggctggattctcttcttggaggggtccctgaacctacagtatcacagagtactactggattgctcggtgatatattcggtttaggatcagctggaccgacaacatattctccaccaaaaaccatgtggctctccagtgaaaggggtaaaggttgtgaaatatcaggaactttttcacgaaggaatggacaaatccaaatggatttgacaattgtaaataaagctatgcagccaatgaccggctttgccatacaattgaataagaacagttttggtgtgact

SEQ ID NO: 3366 - DNA, 350 bp, Euschistus heros
ctacatcttctcttgctcccaaaattggacctcttggtttgtctcctaaaaaggtgggtgatgatattgctaaagccacagcagattggaagggtctgaaaattacagtttgtctcacaattcaaaacagacaagctgctatttctgtagtaccttctgcagcttcacttataatcaaggctctcaaagaaccaccgagggacaggaagaaagtcaaaggagtaaaacataatggtaacctcacttttgatgaaatcctcagcatcgccagatcaatgagaccaaggtccatgtcaaggaaacttgagggtaccgtaaaagaaattcttggtacatgtcagtctgttggt

SEQ ID NO: 3367 - DNA, 682 bp, Euschistus heros
ctagacttagacccctgacactaagcaggcctaagccgcttgttgaatttgcaaacaaaccaatgctaatccatcagatagaagcattagttgaagccggcgtgactgaagttgttttagccgtgtcatatagagcggaacaaatggaaaaagaattgagtgaggaagctaaaaaattgggtgttaaattgattttttcccatgaaacagaacctcttggtacagctggacctctcgctcttgccaaagatattctaacatcgagtaatgaaccattttttgttctcaattccgatattatttgtgaattcccattcaaagagcttgtttcttttcataaaaaccatgggaaagaaggtactattgtagtgacaaaagttgaagaaccttcgaagtatggtgttgttgtttatgatgaaaaaggttgtattgccagttttatcgaaaagccacaagaatttgtttcaaataagataaacgctggcatgtacattctcaatccttcggtcttaggaagaatcaaactagagccaactagtattgagaaggaagttttcccgtttatggctgaagaaggggagttgtatgctatggagttgaaaggattttggatggacgtaggacagcctcaagattttctcacaggcatgtgcttgtatcttacatctctacgtcagaaagc

SEQ ID NO: 3368 - DNA, 699 bp, Euschistus heros
tatattacattcgccaccgggagagtttaacgaagtttttaatgatgcaaggatattattaaacaacgatacccttttgaaagaaggagctctcggtgtcttcgggcagtactgcaaagaccaacttacgcccgtgaagattaagaacagtgagtatccagttttgattaccgaacataatgatctaggatccaacaggttttatgatgcaaggagtaaacagtcgtttaaatatgatcctttaaggagagagacctctaattatgattcctgggaggcagaaccaggtactgaaaagtggcgatcagcattagaggttgaattagatgcatatatagctaaacattttgaaagtggttcaggtagtgtattttctaaaagggaagatggaaaggtaagcttggttgcctgtatagaagcccatttatttcagccgaaaaactgctggaatggttgttggcgatctcaatggtttgtcacgatagattcagataatgctgatgtgaaaggtgttctgaaaattcaggttcattattacgaagatggcaatgtgcagcttgtcagtttgaaagatattaatcaatcactccaggttgcggatgaacaacagttaagtaaggctttaattaaaatattcgaagactctgaaacagagtatcaacaagcaatatctgaaaactaccatacgatgtcagacac

SEQ ID NO: 3369 - DNA, 704 bp, Euschistus heros
aaggagagtttgtgctactgcacactgattctgaaaggtttaagctagacgttcaagcaaggttcgagcaagtaggaaaaaacatttatggcgatgtggcagcaactcagttgacatctatagcagcaagagataatacttcaagcatcattgaagtaaggcttagaccaaaggaggcacaatggagatacagactagatgtctttgcaaataagaaaaggatatattttgacaggccatctcttcgtgtacagcactttacaggtgtcacagtttaccaaccttcacatgtacttaatcagtccgaaatcattatgatgtttcaatcaggtgttggagtagaagttgttgaaaataaaggatacatggctgcaagggtttatttgccctgggaatatataaacagaacaagaggcctgtttggaaattggagtttcgatccatctaatgatttcactcttcctgatgggactgtggtcagtgctgaaaacctcaatgacttcgagagaatacacaagcaattcgcaatttactggagattagaggacaatgttgaacccaataaaggtgaacctctctttgttagagaatatggaagaacttcaagttattatttgaatagaacatttgttccagtatggaaatcaactcctcaagaaattattcctcctaacaggaccaaagatatacaacaagccttggca

SEQ ID NO: 3370 - DNA, 223 bp, Euschistus heros
tcagcagctgatattgacaagatattaagctctgttgggattgagtctgattcagaacgagtgaacaaagtaatatcagagcttaaaggcaagaatgttgaggaagttattgctgcaggtaaagagaagttagcttcagtaccatcaggaggtggtggagcacctgccgcagctgctgctgcccccgctgcagcctcacctgctaaagcagctgaggaaaaga

SEQ ID NO: 3371 - DNA, 669 bp, Euschistus heros
taggcctaaatcgaaagtcgcacaggaaaacatggatgttttcagagattcgtgggagtcacaagttcgagtactaactgaagccgtagatgatataacaactattgatgacttcttagctgtttctgagaaccacatcctagaagatgttaacaaatgtgttatggccttacaagaaggagatggagattctttagacaggacagctggtgcaattaggggtcgttcagctcgtgtagccaatgttgttactgctgaaatggacaactatgaaccaggaatctacacagaaagagttctagaagcaattaaagttcttagggagcaggtgatgccaaattttgctcaaagagtggaagttgctgtagatgctctttcttcaaatccacctaaagatgttgatgaaaatgagtttattgatgcctctcgtttggtgtatgatggtgttagagaaattcgaagagctgttctcatgaacaggagttcagaagagttagacactgatacggaattcgaaccatgtgaggacaacatgactattgatacgaagaatagacctagtgcacatactgccgatcatggtgttgatgagtatcctgaaatcagtggtattactactgctagggaagccatgcgtaagatgactgaagaagacaagcagaagattgc

SEQ ID NO: 3372 - DNA, 698 bp, Euschistus heros
gcctctatgccattaggtactggtttatcatctacaggaggaaatgctccaccaactggcctgaattttggatctgctcctaaatcaactaattctggatctactatcttcagttcaacaaaaagttcactcccagcttctaatgctgttacaacctcatctttaacattaactccttcttctaccacttctcttaccaattcattatctaacaaacctgttactagcactggggctacaacctcccagcaacaaagccttacatttcaacaattagaagaattgattcttaataaatggactgcagaattgtatgaacaggaaaaggtattcttaaatcaagctacacagattaatatttgggataaggttattaatgaaaatgctgaaaaattaactcagttgcattctactatggaaaaagtacggaagcaacaaacaaaaataaatgatgacctagagatcatatctacacatcaaaaagacttggaagcctgtcttgtgcccatggagaaggaagacttgttatcagttcttaaagctgatccaaataggaaaaatctttatataaatgccaaaaaaattgattctcagatcaaaactatgtctgaggatttgaaggaaacaattgaacatattaatgaaacttcacgatctcatgatacagaagatcctgtcattcaggtagggcgaatttt

SEQ ID NO: 3373 - DNA, 432 bp, Euschistus heros
aggcaaactgttgtttttaggattagataatgctggtaaaacaactcttctccataggttaaaagatgacagattggcccagcatgtgccaacattgcacccaacttctgaagaactatccataggaaatatcagatttactacttttgaccttggagggcacactcaagctcgtcgagtatggaaagattactttccggcagttgacgctattgtttttcttgttgacgcttgtgacacaagtcgattgcccgaaagtaaagcagaattagatgcactcttgactgatgagagtctcatcaactgtccagtcctcatccttggcaataaaattgatcttccaggtgcagcttcagaagatgatctcaggaattttttcaatctatatggacagaccactggcaagagcaaagttccacgaagtgaattgtc

SEQ ID NO: 3374 - DNA, 783 bp, Euschistus heros
aaatcatactgctgccttcactaagcacttcaatacccagataatggattatggaaggcaagttatagtgaatttggttgaccattctggatctgagggaaagctagaagagttatatagaaagttagtaaatgaagcaaatattgcagatctaaagtacgaagctttcgatttccatagggaatgttctaaactacgttatgataggttaaaaattctcattgaccgcctggcctatgatttagaacagatgtcagtgacaatgattgttggaaatgggactgttgtatctcagcaggaaggtgtatttaggacaaattgtattgactgcttggacaggactaatgttgtccagtcaatgttggctagggtcaatctctcttatgttttacaaaagctttcaatattgaagaaaggagaaacagtagaagatcaagttcaacttgagaaagtgtttaaactactctggagtgaccatgcagatctaatatcaacccagtattctggaactggggcattaaaaacagattatacaagaacaggaaaaagaaccacagctggaattgttcaagatgggataaactcgcttgtacgatattacataaataattttcagcatggttttcgtaaggatgcattagatctttggcttggtcattatcgggtttcttctgaagaagggattgtgatcaaaagccccattggtgtcaaaagagaattcaagtataaagcttttccactcatcctactcgttgctgttgctatattcttcgcaaacctggt

SEQ ID NO: 3375 - DNA, 777 bp, Euschistus heros
ttctaaaaggtccaggcatcattctcgagcagtttcatggcttcgtaggacagaatatatttccacagaacaaacacgtttccaacctcaagttatggataaagttgaagccaaagttggatttagcattaagaaaagtcttaaggaagaaactctgtacatggatagggaaagccaaattaaagctattgaaaagacatatgatgatgctaaactacctatagagaaacatcatagcaaaccaaatgttgttccagttgaaattcttcccgtttttccagatttccagttgtggaagtatccttgtgctcaggttatgtttgattcagaccctgcacctataggaaagactgttcccgctcagttagaacaaatgtcacaagctatgattcggggtgtcatggatgaaagcggagaacagtttgtagcttatttcttgcctactgattcaactttagaaaagcgcaggagagattttacaaacggtattgattatgaagacgaggaggaatatgattacaaaatagccagagagtataattggaatgtaaaaacaaaagcttcaaaaggatacgaagagaattatttctttgtcattaggcatgatggtgtttattacaatgaattagaaactagagtacggttgagtaaaaggagacagaaggctggaactgctccaaataatactagattagttgttagacatagaccaatggatgctaatgaatttaacattcaccgtctaagggagaaacaacttcaacatccagtggaaga

SEQ ID NO: 3376 - DNA, 698 bp, Euschistus heros
ggtgggtaatggatgaaagtttgtgtgcacatatggtgaaaaataatgaactaaggcttgcagaattagagaaagaacatgagaattcagttattgaagatgaagagcaagtgagtggtctatggcaggcaaaactagactatttgtgtagtattggagacaaagaaaatgctactacattagcaaatagtaagctacaagataaaactgtgcctaagactcatcgtattgatgctgttttcgccctgtttaggatatcatatttccatggttgtgacattaaagggatgtctgcagcgattgaaaaagctactgaattgatagaaggccaaggtgattggagttcaagaaataaattgaaagcttatgaaggagtgtggagttttgcagttagagactatttgcgggctgccaaactatttgttgatgtagtaccaacatttgaatcttatgaacttgctgactttggaacaattattaaatatactgtactttcatgtatgatagcattaccgaggtgtgaattaaagaagaagcttatgcaccatggtgtaatggctcaggctcttcactctcagtaccgtaacttaaaggagtatttccagtccctttatgatggtcactatgcagatttcctagtcgctctggcacaagtagaatctgatatgaaacgggaccctctgctacatccccattac

SEQ ID NO: 3377 - DNA, 799 bp, Euschistus heros
ctatacctgtcgaccaaaggatccaaactggaggccgagaaggagaggaaataccagaaagtgttaccgcggaattagaaaagttggaagaagaaggaggtacaattggtggtgaagccgacgaggtttctgcaattttctctggtcttgtggaagatgatgatgaacttctcgcggaaatgggtccggatttcaatattcttgagtatgctgatccagaacttgatactgtatctggaggagaaaagacgaatatccttgacgatctggaagatgaagttgagaaaaaaaaacaaatgtcttccagaaaagaaaatactgctagaagaagttcttcagacagtattaataaagagctaactgaaccaagacctgagagtaagccaagcgaagaagtgaatagggtatcggtaacatccactccacctcatctacctcaacagatttcattaagtggaaacagtggcattacacaaccaaaaattgttggatcaggttaccaaacgcaatttgcgactcctagtacacctctcccgaggatgcaagttttgcaaggtgcaaatcaagtgagtcgtggaaatgcaagctttgttggcaatcctccgcctcctccacccccatatcctggccctcccccaccatatccagggcagcaagctgcgatacgaggaaggggtgttagatcgcacatcatcccaggcccagcggcacaggctcaacagagaagaaccttgctccttcaagagcagcctctactgctggaagaattactcgaagaggagaaaagggagcaagagaa

SEQ ID NO: 3378 - DNA, 650 bp, Euschistus heros
ttgaaagtcgaaggcatgtaaagaagcttctgaagtcagccgcttctcctgagcagaaaatgcagtatgatattcgtcaaatggctttgaaattgactgctaacagtatgtatggttgcttaggattttcaaattccagattttgtgccaaaggtctcgctgctcttgttacagctaaaggcagagaaatacttttaactaccaaaagaatggtagaatcttttggctatgaagttatttatggagatactgattcaatcatgatcaatactagaaccaaagactttgaacaagtacatcaagttggtaagaagttgaaatttgaggtgaacaaatgttacaaacaagttgaattagatatagatggagttttcaagtatatgcttctgttaaaaaaaaagaagtatgctgctgtaacaattaataagcttccaaatggtgagttcgttgaaaaacaagaaatgaaaggtttggatattgttagaagagattggtctcaactagctgctgcagctggaaggcacattttaaatgaaatattgtcgaacaaatcaagcgatgatagaattgatggaattcacaattatttagaaaaaatccgctctgatttagagactaataaagtaccagttaccttgctaacagtcacc

SEQ ID NO: 3379 - DNA, 787 bp, Euschistus heros
tgaaggtgaggttgttgaaattcaggtagaaagaccagcaacaggagttggtgctaaagtcggaaaacttacattaaagacgactgaaatggaaactgtctatgaccttggaacaaaaatgattgatgcccttaccaaagaaaaggttcagtccggtgatgtaattacaattgacaaggctactggtaaaattagtaggatcggaagatcatttacaagagcgagagattatgatgcgaccggtcctcagacaaggtttgtccagtgtccggagggagaattgcagaagagaaaggaagttgtacatactgtatctattcatgaaattgatgttatcaactcaaggacacatgggttcttggctcttttctcaggtgatacaggtgaaataaaaccagaagttagagaacaaatcaacacaaaaattgccgaatggagagaagaaggaaaagccgaaatctcaccaggtgttctgttcattgacgaggttcacatgctggatattgaatgtttctcatttttaaatcgagctcttgaagatgagatggcacctgttgttatcatggccacaaacagaggcattaccaatatcaggggaactaattacacttcgcctcatggaattccgattgatctcttggacaggatgatcatcatatccacatctcagtataaggagaatgaacttagagaaattctaaaaattaggtgtgaagaagaagattgtgaattgtctgatgatgctttgacagtccttactaggatagctatggagacaagtcttcgg

SEQ ID NO: 3380 - DNA, 772 bp, Euschistus heros
tttacggatgtttcgtggatctctgtataagagatatcctggaatgtatagaagaactcttggaaatgaggaaagaaaaagactaatagagcttgggctaagctctcactgtttggcttccagtatatctctgttacgagcatctgaggttgaagatattattgagggcaatgatgaaaaatacaaagctgtttctgttcattcttctgaaactcccattacaagttcttctaaaccgaaaaaagctatgccatgggtaccttctcttccgaatagttcgcatttagatgctgtaccgcaagcaacaccgattaatagaaatagagttgttagcaaaaaagtaagaagtttccctctttgctttgatgacactgatccatcatctatcatggaaaatgcttcgcaaatggaagtactcgtacctatacgtcttgacatggaaatagaaggtcagaaactccgtgatacttttacctggaataaaaatgaaagtttgataactcctgagcagtttgcagaaattctttgtgatgacctagatttaaatcccctaagttttgtccctgctatagcccaggctatccgacagcaaatcgaaggtttccctactgacaatattttggaagatcagactgatcaaagagttatcgttaaactaaatattcatgttggtaatacttcccttgttgatcaaatagaatgggacatgagtgagaaggaaaacagtcctgaacagtttgcgatgaagttgtgtgcagaacttggattagga

SEQ ID NO: 3381 - DNA, 571 bp, Euschistus heros
ttagtactgttgggagttgctccaagtggttattgtttagtgatggctgctatacgtaaaaaattagttatagttggggatggtgcttgcggaaagacttgtttattgatagtatttagtaaagatcaatttccagaagtatatgtgcctactgtgttcgagaattatgttgctgatatcgaagttgatggaaagcaagtggaactagcattgtgggatactgctggtcaagaagactacgatcggctaagaccactttcttatcctgacactgatgtcattttaatgagtttttctattgattcgccagattcattagaaaacatacctgaaaaatggactcctgaagttaaacatttttgtccaaacgtacccatcattcttgtaggaaataaaaaagatttgcgaaatgatccaaataccattaaagagttggcaaaaatgaaacaagagccagttaaaccagaagaagggcgagcaatggcagataaaattaatgcctttgattatcttgaatgttctgccaaaacaaaagatggggttagacaagtatttgaaacagcaaccagag

SEQ ID NO: 3382 - DNA, 758 bp, Euschistus heros
aatcacgggagaatatgagcttaacagatcgtggattgcatggacactttctagtttaccagcaaaattaccctcaagataggtttattattttaagccagcagggcacagatatttatgaaaagctgagacctgttgacatatttggtgagctaatgcgagagaaaggtggaccagattgtgaagaagtaaaacaattcttcgctcagcatggtacagatcaagcatgcgcgatggcccttatacttgcctgtgaccagactaaccaacacatggcagaatgggcaacacgtgcattttttctctatggaggtgatcccaaatatgttctacaaactattcagcaacctgtacaaccgccaactattactaaccctcttcaacagagtatccttcatcatacattacctctgggtttcaaacctaacacagttagtactccattaggggagaagcaagcacaaccttcaacaagaagtattgaaacctatggggtagcaatgtcatcaaagcataatggtctttacctattcctgagccgtatgcttagaccagtttggtcaagaagagttttagatgtcaattacaataaaaaacctatttatctaccaaccattacctgtgaagaacttagtttaaagacagtacaactttatgagcttcgttcatttctcaccagatacaccttaagttcgtcagatgttgctaccagtttgcagcctgccaacactatgactgttgtttctccaagtggtcaa

SEQ ID NO: 3383 - DNA, 695 bp, Euschistus heros
atgagagatgatgatggtgctgcagacaggactcaacacaggagcctagctgctctttgtaaagcctattacatattaaaatggatctgtacatctaagtctactggaaatgcacctttgatccatgtgttttcattggttaacccaacatcaataatgcagtcttctcttgaacaatgtgttcttggcctagctaattgcttatggccattagcaacaaatagtactcttgctcaacatttattatcaacaaaacaatatgcccttctacaaacattagcaagattagttggaataaatagctggagtttactactagctgaatcctacattctaacaggtcaacctggcaaggcatttgatgtttgtttgaaaaatgctggatcagatgtggtgcatttccttaatgctataagactttttgaaaagcattcaaggtctgatttagttatagcgatggctactaaagcattagaacttcttattgtttcacattctgatagggaaacacttgaatctgcattatttgttcatgaattgggaatggaaaattatgatgctgcttggagttggattgaatcgtgtagttcttggtcccgcaggtctgactttttgcagcgcttggtagctaacatgatatcagaaggaaaactcactgatcttatctccttttcctatactgggctccttgatga

SEQ ID NO: 3384 - DNA, 678 bp, Euschistus heros
gttggttgcaccttctagtattcagaagcagctatctgaagcagttggtactattggaaaatgtgacttcccaaaagactggcctggacttctgacaaatatggtcgagaaatttggtggaggggactttcatgttattaatggaatccttcaaactgcccattccatattcaaaaggtatagatatgaattcaaatctcaaaagttatgggaggaaattaagtttgtgcttgacacgtttgcaaaacctttgactgatcttgctgtggctacacaaaatttaacacaagttcatgcttcaaatccagatgctctaagagtgatttattcatctttacttctcatttcaaaaattttttactctttaaactttcaggatctgcctgagttctttgaagacaatatgaatgtctggatgccgctctttcatacattacttactaccgatgttaagtgtcttcaaactgatgatgatgaagaggcaggcttacttgaacaactgaggtctcaagtgtgttctaatgttgcactgtatgcacaaaaatacgatgaagaatttcaaccatatctccagggtttcgtcacggacatctggagccttcttgtgactgtttcacttcagcctaaaaatgatctgcttgtcagcaatgcactgcaattcttgtcaactattgcgga

SEQ ID NO: 3385 - DNA, 437 bp, Euschistus heros
tgaatccctttcagtttgaacttacattcgaatgtatcgaagaattaaaggaagatttagaatggaaaatgatttatgttggttctgccgagagcgaagattatgatcaagttctagatactatttatgttggccctattccagaaggacgacacaaatttgtctttcaggcagatcctcctgatgtaactaaaatacctattgaagatgctcttggtgttactgttgttttattaacctgttgttaccgtgggcaggagtttgtacgagtaggatattttattaacaatgaatattctgatccagaactcagagagaatcctcctccaatgccacagtttgacaaggttataagaaacattttaggttctgaacccagagttacaaggtttaaaattaattgggatgattcagaatcacaagaccaacctagtcaa

SEQ ID NO: 3386 - DNA, 691 bp, Euschistus heros
aatagcacaacagcaacaacaaatacaaccacctttgcaaatgcccccgttactaccaatacaatcttcaattaatcagcaaaagccaatgaatacttatgccccttcaatgggatttactacaccacaaagtatgatgcatccgcaaacaccacaaaatctaatgtcacctatggtaaatagaatggaacagacaccgaacaatattattaatccaactactcctggaccaatgacacctatgacgccatcatctgcagaccctggctttatgccacaattgcagaacatagtttctactgtcaatttaggttgtaaactagatcttaaaaagattgctttgcatgcaagaaatgctgaatacaatccaaaacgattcgctgctgttatcatgaggataagagaacccagaacaacggctcttatttttagttcaggaaaaatggtttgcactggtgcaaagagtgaggatgattctagactggcagcaaggaaatatgcacgaataattcaaaaattaggattccaggcaaaatttctagactttaaagtacaaaatatggttggtagttgtgatgttaaatttcccatcaggttagaaggattggttttaactcatggacagtttagcagttatgaacctgaactttttcctggccttatttaccgaatggtgaaacctcgtattgtt

SEQ ID NO: 3387 - DNA, 333 bp, Euschistus heros
ctatgcagatgagatggctttcacatttgctgcagcgaataaggttttctatgccaattctaatgtaaagcaagtagatgttccctctttcagtggagcttttggtatccttccaaaacatgttccaactttggctgttctgaagcctggtgtcgttactgtttttgaacaagatggtagctccaagaaggtttttgtttcaagtggaacagttacaataaatgaggactcatcagtacaagtattggctgaggaagcccacccagttgaagatcttgatgcctccgcagccagggagcagctttctaaggcccaagcagatctatctagggc

SEQ ID NO: 3388 - DNA, 659 bp, Euschistus heros
ttggctgctgaaaagaaaaggacagaaagtgctgaagctgaaaaaaagaggaaagaaaggcttaatgccaaatccacccctaaagtaatggagataactgatgaagaagcgaaaaaaattgaagaggaagaaaaaaagagaaaagaagaagaaagtctttcaaaaccaattacagaagccgaaggtgaagatgaagaacaagacaaagggaaactaatgccaaatgctggaaatggtgcagatctcgaaaattacaggtggacccaaactcttcaagagttagaagtccgagttcctcttaagacttcttttaatgtaaggtccagagacttggttgtagaccttggcaagacacacctaaagattgggctgaaagggcaggaaccaattgtggacggtgaattagagcatgaaatcaaaattgaagaatcaacttgggtcattgaggaaggcaaaactctatttctgacggctgagaaagtaaataaaatggagtggtggtccaagctgttaacgacagaccctgaaatagctacccggaaaataaatccagaaccatcgaaactgtctgatttggatggcgaaacaagaggtttggttgaaaaaatgatgtatgatcaaagacagcgtgaattaggtcttccaacctctgatgaaca

SEQ ID NO: 3389 - DNA, 282 bp, Euschistus heros
gatttgcatttatccagcgtatttaaacagtaagaagacccgtgcagaaggtaggattatttcaaaagaaaaagcagtggagaatcctacctaccaagaaataagggatgtcttatctgcagctggtttgaaagttggtgttgaaaacaaactttacagtagggagaaaagtaaagagcttctttatagaggtcgaataagggttcaattgaaaaacgataatggtactccactaaacccagattttgctaccagagaatctgtcatacttcatgcatgtgc

SEQ ID NO: 3390 - DNA, 739 bp, Euschistus heros
gcttgttgaagaagagggtaacattgacacaattagggaaatgtatgagagggctattgcaaacattccaccatcaagggaaaaagatatgtggaggcgctatatctatttgtggattaattacgctctttatgaagaacttgaagcagaagatgaagataggacaaggcaaatttataggacaagtcttgacataatacctcataaaacattcacatttagtaaaatatggctgttatacgcacagttcgaaattagacataaaaacctttcaacagcccgaaaaaccttgggaatggcattaggagtctgtccaagagataaactctaccggggttatatagatctcgagatacagttaagagagttcgatagatgtagaacattataccaaaaatttttggaacatggtcctgaaaactgcattacatggatgaggtttgctgagttagaaacactgttaggtgacatcgacagggcaagagctatttatgaactagccgttaatcaaccaaggcttgatatgcctgaaattttatggaaagcttacatagattttgaaatcaacgtaggtgaagcaagaaatgctaggcaactgtatgaaaggcttttagaaagaactcaccatgtcaaggtttggatgagttacgttaaatttgaaatgactcatagccaagaagaagaaattgaacctatttcattggccagaagaatttatgagagaggtaacactgctttg

SEQ ID NO: 3391 - DNA, 721 bp, Euschistus heros
ttacttgacgaacttctgcagaagggctacggtcttgggtcaggaatctctctgttcatagccacaaacatttgtgaaactattgtttggaaggcattttcacctgctacagtcaatacaggtaggggaactgagtttgaaggtgccgtcatcgcacttttccatcttctggcaacaagacaagacaaagttcgtgcattgcgtgaagctttctatagacaaaatcttcctaatttaatgaacttattggctaccatccttgtgttcgctatagttatttattttcagggattcagggtagatcttccaatcaagtcagcccgctatcgaggacaatatagcagctatcctattaaactcttctatacttcgaacattcctatcattcttcagtcagctcttgtatcaaatctgtatgttatatctcagatgcttgctgtaaaattccatggaaatgtatttgttaacatgcttggagtgtgggcagatgttggaggtggtggtccagccagggcttatccagttggcggtctttgttattatctttcacctcctgaaaaccttggtcatatacttgaagatcccattcatgctatgctttatatcatttttatgcttggttcttgtgctttcttctccaaaacctggattgaagtttctggatcatcagccaaagatgttgcaaagcaacttaaggaacaacaaatggtgatgagaggac

SEQ ID NO: 3392 - DNA, 380 bp, Euschistus heros
ctacagggaccagcattttaagggctctcggacagaacaggaaagacttcttcgcatatcaactacattatatgttggaaatttatcattttatactacagaagaacaaatatatgaacttttttctaaatgtggtgatataaaaagaattattatggggttagataaatataagaaaattccatgtggcttctgctttgtagaatactaccaacgagcggatgctgagagctcaatgaggtatattaatggcaccaggctagatgatcgtattataagaacagactgggatgcaggtttcgtcgaaggaaggcagtatggaaggggaaagagtggtgggcaggtgcgtgatgaatacagaagagaatacgatgctggac

SEQ ID NO: 3393 - DNA, 717 bp, Euschistus heros
aaatcatggtcacgaggaaagaaagctttgtatacctcacttggtattttgactggtggaacaggcatgttgatatatgctcttgaaaaaagtcttcaagcaggagatcttgaactccatcctcccaaacttccttggaaccatagtgggtattttcaatcactggatcatgcaagtatacggcggggctatgaagtatacaaaaatgtgtgtgcagcctgtcatagtttaagatatgtttgctatcgagatcttgtcggtgtttctcacactgaagctgaggctaaagcagaagctgaagaacaacttgttttagatggtcccaatgaacttggtgaaatgttcaaaaggcctgggaaactttctgatcatatgcctagtccttatcctaatgaagaggctgccagggcagctaataatggagcttatcctcctgatctatcatacatagttcctggacgtcatggagaagaagattacatattccacttattaactggctattgtgatgcccctgctggagtggttttaagggatggccagtactttaatccctattttcctggtggagccattagtatggcacaagcactgtataatgagattattgaatatgctgatggaactccagctactcaaagtcaattagcaaaggatgttgctactttccttaaatggacctctgagcccgagcatgatacacgaaaacaaatggcc

SEQ ID NO: 3394 - DNA, 792 bp, Euschistus heros
aaaaacgacgatccttctgatatcaatggtttcctcggtccttggggttcttatgttgatgagaagaaagtagtcaaacctgaacctgaagttgctgcagaacttgaagaatatcttgccaagagacaaaaacttggtaagaaagttgaagataaacctcttgaagaaaagactgtccttcacattaaagatccagttgactaccaaggacgaaacttcttacaccctcctcaggatgtaggtgtcaacctgaaatcagactctcctccagacaaatgtttcattccgaagtcagaaatacacgtttggaaaggacatacaaaaggcatttctgctatccgatggtttcccaagtatgcccatctccttctttcttgcagtatggattgccgtgtcaagttatgggaagtatataatgaaaggcggtgcattagaacttattatggccacagacaagctgtaagggatgtttgttttaacaaccgaggaactaaatttctttcagctgcttatgatcgctacataaaattatgggatacagaaactggggagtgtatatcgcgattcacaagtagaaaaattccatattgtgtgaagtttaatcctgacgaagacaaacaaaacttatttgttgctggaacttctgacaagaagatcatttgttgggacttacggtctggtgaaatagtacaagaatatgaccgccatttgggagctgtaaattctattacttttgtggatgaaaatagaagattcgtcaccacttctgatgacaaaagcttacgtgtttgg

SEQ ID NO: 3395 - DNA, 672 bp, Euschistus heros
gcaagaggttcagaaagttgtaaaccctctgttcgaaaagagaccaaggaattttggaatcggtcaggatatccagccatctcgtgatttaagcaggtttgtcagatggcctaaatatattcgtattcaaaggcagaaatctgttttacagaagaggctgaaaattcccccttcaattcaccaattttctcaatctttggacaagcaaacagcaactcaattgtttaagattcttgagaaacaccgacctgaatcagcacttgctaagaagcagaggttgaaggctagggctgaaggaaaaattaagcaaaaagaagaagttccaaccaagaggcccaatgttatcaggtctggtgtaaatactgtcactaggttggttgaacaaaagaaagccctccttgttgtgatcgcacatgatgttgatccaattgagttggtgcttttcctacctgcactttgcagaaagatgaatgttccatactgtattatcaaaggcaaggcccgtctaggcagacttgttagaaggaaaacctgcacatcaattgcagtaactcagatggagggtaatgatcgtactgctctgaataaggttgttgaagcagtcaggactaattacaatgaccgatatgaagaaatcaagcgacactggggaggtggtttacttggctctaa

SEQ ID NO: 3396 - DNA, 788 bp, Euschistus heros
tttgcatgacagaacacttgagaatgtctggtatgtattgggttctaaccacattagcagttaccaaaaagttggatgaagttgacaagaaggaatttattgactttatacatgaatgtactgatgagaaaactggtggcattggtgcttgtgttggtcatgaccctcatattttatatactttaagtgctgttcaaatagcatgtattttaaggtcattagaccagcttcctttggaaaagattgtaagttttgtagcaggactccaaaaagaagacggcagttttatgggtgataaatggggagaagttgacaccagattttcattttgtgctattgcttgtctatcactcatcggccgcttggatgctatcaaccttgaaaaagcagtagagtttgtgctgagttgtcaaaactttgatggtggtttcggttctcaacaaaattcggaaagccatgctggattgatctattgttgtgtcggagttttgtcgattacccagaacttataccgaatagatgctgatcaactaggttggtggctatgtgagcgtcaactgccttcgggtggtcttaatggaagaccagaaaagcttccagatgtttgctattcctggtgggtcttgtcgtctttaacgatgttgggaagattacattggattgataagcagcttctgaagaaatatattcttgccagtcaagatcctgatggaggtttcagtgatcgaccaggagatatgccagatccctttcacactttgtttggtattgctgctctttcacttttg

SEQ ID NO: 3397 - DNA, 795 bp, Euschistus heros
aaacacaagacctagctctgctgctcaatgtgtcgcctatgttgcagtagctgaaataccagttggtcagtggccggatttaatcccaacattatcagctaatgtaactggaccctcttcaactgaaatcatgaaagaggctactctagaagcaattggttatatttgccaagaaattgaacacgattgtttagctaatcaatctaatcaaattttaacagctattgtacatggaatgcggtctgcagagagaagtaattatgttagactggctgcaacaacagcactcctcaactcacttgaattcactcgggcgaatttccaacaagatatggagcgtaactacttgatggaagtagtttgtgaagctacacagtcaacagatacacaagtccgtgtcgcagcacttcaatgtctagtcaaaataatgactctttactaccaatatatggaaacatatatgggccaagctttgtttccaattacattagaagcaatgaaatctgacattaaagaagtagctcttcaaggaattgagttctggtctaatgtctctgatgaagaagttgatttagctattgaagaatcggaagccgtagaaatgggaaaacctccagctagaacatcacgttattatgcaaaaggagctctccagtatcttgttcctgtagtgctcaccaaattgaccaaacaggaggaatttgatgatgaagatgattggaatccaagcaaagctgctggagtttgcttaatgttgctagctacatgctgtgaggaagacattgtaccccatgt

SEQ ID NO: 3398 - DNA, 777 bp, Euschistus heros
aattctatcgcaggattcccaatgaaatttctgttcctatgtctgtcgaattcgaagaactggcaaagcttagagaaaaccctactgaagaaacttccaatttagtagagtttacagatgaagaaggatatggaaaatatcttgatctccatgaatgctatgaaaaatatatcaatttgaaaggagtcgagaaaggagattacattacatatcttactacgtttgaccgactttatgaaattcccaaagataggaagagttctgagtacaaaagatatgttattatgctcttaaattatctgtgcgattacattgctagaattaaacctctgcttgacctagaccaggaattaaataacgtccacaaggatttcacatcacaatgggaagcaggcacctttcccggctggccaaaagaaacaggcagcgtgttaagcaatgttggtgcccatcttgacttatctgcattttcatctcctgaagaattggcttctcttggtttggacaggcttaaatcagcattaatggctctaggattaaaatgtggcggaactttagaagaaagggctcagcgtttattcagcacaaaagggaaaaagtctcttgatccaaatttacttgccaagtccaagccaggtaaatcaaatcgagaacgtgatcttgaaaggcagcgggacattgcattcttagaagcacaagtttataagttagctgaattattgagtgaacaacgagctgctactaaagaaaatgttcaaaggaaacaagctaggacag

SEQ ID NO: 3399 - DNA, 486 bp, Euschistus heros
tgcaagattcgaggacatttattggcacatttaaagcgtttgataagcacatgaatctcattcttggagactgtgaagaattcaggaaaattaagccgaagaacacaaaacagccagagcgagaagaaaagagagtgttaggatttgtattactaagaggtgaaaatattgtctcccttacagttgaaggccctcctccaccagaagaaggattacctagggtaccccttcccggagcaggtggtggaattggtactgcaagacctgctggtcgtggggttccagcacctggtactccagctgccccaggtcttcaagggccagttcgtggtgtaggtggcccatctgcccaagttatgactccagctggccgtgggggccaagtttctgcacctcctcagatgcgggcacctcctccaggaatgcccccaatgatgggagccccaccaatgatgaatatggcacctggaatggcaatgggtagag

SEQ ID NO: 3400 - DNA, 656 bp, Euschistus heros
tattctcggatgtccatgtgcagtttcgatgaattactggggcttataaaagatcaaattacaaaaaatgacactaggatgagaagctgcataccacctgaagaaaagctcatcataacattgaggtatcttgcaagtggttgttctttagctgatctgcgcaacaactttcgcgtaggaaaaagtactgctggtgttattgtaagagaagtatgcaacgcattatggatatgtcttcgcgaaatcaccatgcctcctttaactaatgatagatggcttgaaattgctaaagggtttgaaacgtgggcagggttccctaattgtattggcgccattgatggtaaacatataagaatgaagcagccatgtaacagtggatcaatgttttacaacttcaaaaattatttttctactgttctatttgcgatgtgtgatgcaaattattgcttcacatacatagaggttggatcgtatggaaaatccagtgattcaggaatatttaagaattcgttactttacaaaaaaatgtgtgatggtagtttacaaatacctgctccacgctcattcgacaataattcaagtgagcagttttcatatgtcatagtcggtgacgatgctttccctttgtcagataatttgcttaagccttatggagg

SEQ ID NO: 3401 - DNA, 789 bp, Piezodorus guildinii
gatcaggatagctgatgcaagagcgaaacctattgatcttcttgctaaatacatcaattctgaagaagaagtggatgctgttgagatgcatgaaccatatacttatcttaatggtttatcgattaaagacttggaagacttggttgaggatattaaggtatatatgaaactagaaaaaggaaagaatttggattattggaatgatataactgttattgttgaggatgaattgtataagctgaggaaaatggggaaaaaatctgactatgaagcagctgttggtaggagagaaggtattcatgaatctgtagctaaagaagtctcttcagtcttcagaggaaaaacagcttcacaacttgcggccatgcaaaagcagattgagaaaaagataagtgataaaggagaaggtattgatattggatactgggagtctcttctttcccaactgaaagctcatatggcacgagctcgtctcagagacaaacatcaagaaaaccttaaacagaaattggaactgcttaaagcggaacaaagacagcaagaacaagaaataaaagaagaacccatagatgaatcagaacatcaggagactatgagtagagaagaaatcaaagaagaaagagaagatagtgatgaagagcacagtggaggtgatgaagatgctggggagtctatgctaaaagagagtttcggagagtatgaagcaggagcttactcccctgtttatgttgatcccgcaagtcttgaaccaggaactcttatcattggtgaagaagaggatgctcagag

SEQ ID NO: 3402 - DNA, 685 bp, Piezodorus guildinii
acagaaggtaaagcgatgttattacaaaatccgcagttggcttatgctcttttacaagcacaagttgtgatgaggatagttgatccccagattgctatcacaatgctgcacaaggctaacccgagcgtgccccctctccagccgccccccgtggaagctattcgcccagtgccagtacctcagcctgctccggccgtggctcctcctccagtggtgccacctgtcgttcaggcgaggcctgtcgtggagccagagtgggttcctcctgccaggccccatcaacctccgcatccgccaacgttcatcccacaaccaggtggtgaccttgatatgaggactttggacccgagggttcctccggtgcgactgacccaggaccaagacttaaggatcccgccgatggtgcccgccccacagcagcctccgacccagccgcctcagccctaccctcaggaacacgtgatatccagtaccgtacgagatccaaggcaatatcgtgatcctcgcacaggtgcagcaactgtgccagtgcctccacgacctattgtgacacaggcagtgataccaccgcgacccgtagctcctccgaccagtcatatcacatcagcgcttcctcctgcagcctcagaccaagagaaggctgccttaatcatgcaagtgctacagctgtcagaggaacagatag

SEQ ID NO: 3403 - DNA, 708 bp, Piezodorus guildinii
gtcttgcggaacaaattagggaacttcgtgaggtgatcgagctgcctctattgaatccagaactttttcaacgtgttgggatcactccccccaaaggatgtctactttatgggcctcctggtactggaaagactttattggctagagctgttgccagccaattagatgctaatttcctgaaggttgtttccagtgccattgttgacaagtatattggtgaaagtgctcgtctgatcagagaaatgtttaattatgcaagggatcatcagccttgcataatttttatggatgaaattgatgctattggtggtcgaagattctcagaaggtacatctgctgatcgtgaaattcaaagaacccttatggaacttcttaaccaaatggatggatttgattcattaggacaggtaaaaatgatcatggccactaatcggcccgacacccttgacccagctctcctccgtcccggtaggttagacaggaagattgaaataccactgccaaatgaacaggccaggctagagatcctcaagatccacgctagtcctatttcgaagcatggagatattgattacgaggctgttgtgaagttgtctgataatttcaatggagctgatttgagaaatgtttgtactgaagctggtctttttgctattcgagctgaaagggaatatgtaatgcaggaagattttatgaaagccgtgagga

SEQ ID NO: 3404 - DNA, 633 bp, Piezodorus guildinii
tatggaagccatcagtcatgctggaacctgcctcggcatcctagctaatgatggaattattcttgtagctgagaaaaggaataccaataaacttcttgatgaatcagtatattctgaaaaaattttcaaattgaatgagaacatgatatgcagtttagctggtattactgcagatgccaatgttcttaccaatgaactaagacttatttctcaaagatatttattgcaatatggagaaactattccttgtgaacaattggtttcatggttgtgtgatatcaaacaagcatacacccagtatggaggtaaaagaccattcggagtatccatattatatatgggttgggataaacactatggatatcaactttaccagtctgatcctagtggaaattactcaggttggaaggcaacatgtattgggcataacagtggggcagctgtttccagtttgaagactgattataaagaaggtgaaatgacagtgaaagatgctttggctttgggaatcaaggttctaagtaaaacattagatacagctaagctttcagttgatagagttgaagttgcgacattgtctcaaaagaatggaaagtgtgttacatctatcctgcctcctgatgaagttcaaga

SEQ ID NO: 3405 - DNA, 653 bp, Piezodorus guildinii
cataactcttttgctgccagtgctctcagactcgaggtcgacaccagaggtggttgctatggcagcgttggcatgtgctctcattacccttggtacacctcatcctgatgtagtatcgacgatactgcaaaccctccttgatcttcctgtggctgagatgactgatggccactactccaagtttttgccacttgcccttggtttatgttacttaggtcagcgagaaggcactgaagctacaaaggctgcacttgaagcacttccagagcctttgagatctttgtcgcaacatatgttgaagatgtgtgtctatgcagggactggggatgtacttgtcatccaggaacaactacaagtgtgctcagaacattaccctactccagaagaaaagaaagaaaccgataagaaggataaggataaagacaaagacaaagatgagtcgaagagcagtaaagtgaaagacatgacatgtatgcaggcagtcgccgctctgtctgtggcagtgattgcaatgggtgaggagacgggatctgaaatggcaactaggatattcgcgcaattgggaaggtatggtgaacctgcagtacggagagctgtacccttggctatcgcattatcatcgatatcaaaccctcagttagcagtgatcgatg

SEQ ID NO: 3406 - DNA, 754 bp, Piezodorus guildinii
acgggatactacacctacaaggaggaggaggacgtctacatcaaggctgaccctccgctgacgccaaagaacttcgcgcacttcgaccaccccgtcacctcccatccgacgcagctcagtgcacaggttacttacgttacgggaggtggtagcagagagtacgtgacaaccaaccagcctggctactggtccagtgagtacgtctaccagcagcctcagcaggaaatccagcttcctccaggaacaccttacgtcttctccagcaatgggcaggcaacatgggctatcgacgagtcgtacgaccccagtatgctgtctacgagcgacatcaaggagtgcgtcaactgcgcggcgagcgttaccccgctgtggagaagggacgggaccgggcaccacctctgcaacgcctgcggcctctacagcaggatcaacggcgtccacaggccaccggtgaggacgcaccacaagaaagtacacaatattggtaatagaagaaatggcgtgagctgtgcaaactgccaaacgaacaatacaaccctgtggcgtagaaataacacaggagagcctgtgtgtaatgcctgtggactgtatttcaaacttcatggtgttaataggccgcataccatgaagaaggaaggtatacaaaccagaaaacgtaaaccaaagaacccacaagtaaacctaccgagtccaaaaaacgatataaagacaacaggtgaaaaatcagggagttgggataaatgcgacaacgatc

SEQ ID NO: 3407 - DNA, 710 bp, Piezodorus guildinii
taaggacattcgttgaagcagctgctaatacagttgaaaggaaaagcagaaaagccggtagggatacagctaggcaatccaagaggaaaaatacaaaaagacgagaggaaagaggactgagccctacggggagtgcctatgacgcagatgagagtgatcctgaggactcccctggctatcagcaagtttgcattcagcttttggaattgatgcatacacttcacacaaggacggctcagatcttccgatggtgggctgaagagacaggacagaaagaagtgtccaatccctcttactggactccaggttggtgccctcttctccaaggcatatccaggctttgttcacaccctaatagagccgttcggatgtcggcaataacttatttgcaaagagcacttctcatgcaagatttgcaatctttatctggggaagaatgggaagaatgtttcactcaagtactgttcccactcctgtccactctgttagctgttaatattccagcgatcgaagaaacaaggataagggcagctactgtactttccaaggtgttcctgcatcacttgtctcctctgcaaaccctatctagttttgcacagctgtggctgaccatacttgattatatggataagtatatgcacgcggacaacagtgacctgctttatgaggctattccggaatcattaaagaacctgttacttgtgatggac

SEQ ID NO: 3408 - DNA, 485 bp, Piezodorus guildinii
tgtcgctattgcttcagatttgaggttcggtattcaaggacagactgtttcaactaattttgaaaaagtttttgaaatgggtcctcatttatacattggacttcctggattaacaactgatacgtttaccgttcttaacaaacttaactttaggaaaaacatgtttgaattgaaggaggataggaagatagctccagatgtgtttctatcaatggtctcaaatctattgtatgaaaggaggtttgggccattttttgttgaacctataattgctggtttgaaaccaaaaactatggaaccctttatagcttcaatggatttactcggttgccctaacaaaccagaagattttgttgtggcaggaacagcttcagaacaactttatggaatgtgtgaagctctttgggaaccgaatctaggtcctgaagatttatttgaaactatatctcaagctcttgttaatgcttgtgacagagatgcacttt

SEQ ID NO: 3409 - DNA, 742 bp, Piezodorus guildinii
gttcttgcaaataggatggcatcttccaatttacatgaagccgctgcagactgtgtttgctcacttctcgaatgcctagaagataacaacaatcaacagtcgatcgaaatgcaactgtttaatggtgtcatctctttagagcaaccgtttcatatttccgtagcccacgaagagcatgagaagtgtgtaaattactgtagagtatttacagaacttgctgagagttttctggaaaaaatagttagcggaagtagtcctactaaagcgcatttcgccattaagatttttgaccttgttcttacttgtgttggtcatcatgattatgaagtagctgctattacatttaatttatggtatcgcctttcagaagaactgtatcaaaagaaaaactctggacttacatcgttatttaaaccatatatagaaaggctcattgaggcgttatgtaggcattgtcagatggaacctgatcacgaaggaatcctcgaagaaggggatgactttccagacttcaggatgaaagttgccgaactgattcgtgatgtcgttttcataatcggttcctccaactgctttaggcaaatgttcctatccctccaaggacccaataccacctgggacaccacagaagccgcattgttcatcatgcaagccgtagccaaaaacatcatcccggaagaaaacgatgttgttccaaaggttgttgaagctattttgaaccttcctccaaacacacacatag

SEQ ID NO: 3410 - DNA, 658 bp, Piezodorus guildinii
taagatcctaccccagaaggtgcgggacctggtaccggagtcgcaagcttacatggaccttctggcgttcgagaggaaactggactcaaccataatgaggaagaggcttgatatccaggaagcattaaaacgtcccatgaagcaaaaaaggaaattacggatttttatttctaatacattctatccagcgaaagaggcaaccgagactgaggaaggaagtgtagcatcctgggagctgagagtcgagggaagactgttggaagattctaaaaatgatcctaacaagcctccaccgttacaggtaaagaggaagttttcctctttcttcaaaagtcttgttattgagctagacaaagaactttatgggccagataatcacctcgttgaatggcacagaactcctaccacacaagaaacagatggttttcaggttaaaagaccaggtgacaaaaatgtgaggtgtacaattcttctcttgttagattatcagcccttacagttcaagcttgatacccgacttgctcgccttctaggagttcacactcaaacaagacctgttatcataagtgcgctttggcaatatattaagactcataaactgcaagatcctcacgaaagagaatatataaattgtgacaaatacctcgagcagacattc

SEQ ID NO: 3411 - DNA, 286 bp, Piezodorus guildinii
cgaaccgactttagaagagttggaacagaaaatgagagaagccgaaactgagcctcatgaaggcaagaggaaagtggaatccttgtggcctatttttaaaatacatcaccaaaaatctcggtacatttacgacttgtactatagaaggaaagctataagtaaagaattgtacgagcattgccttaatgagaacatcgctgataaaaacttaatcgccaaatggaaaaaacagggctatgaaagtctttgctgcttacgatgcattcaaaccagggataccaacttc

SEQ ID NO: 3412 - DNA, 733 bp, Piezodorus guildinii
aacttagcgttgcaataggagaacctctggttgcgagctcagatgccagttgggcgaatcacattctcctaggacaccctgctatgcccacagccacaggacacagtggggtcatcccaagtaatgaagaatgcggcattcgcgatgtatgggctcataatctgaaggatgaatttaaagttatcaggaagatcatacataaatacaattatgttgcgatggacaccgaatttcctggagtggttgcaaggcctatcggtgagttccgaagtacagccgactatcagtaccagctcctgaggtgcaatgtggacctcctccgcattatccaattggggctcaccttcctcgacgagaacggaaaggctcccgcaggtccttacagcacctggcagttcaatttcaaattcaatcttgcagaagatatgtacgcccaggacagtatcgatcttcttcagaattcagggattcaattcaagaaacatgaagaagacggaatagaccctgtagactttgcagaacttctcatgacctcaggaatcgtactgatggagaatatcaagtggttatcctttcatagtggctatgatttcggatacctattgaaactgcttactaatcagaacttacccaatgatgaaagtgaattctttgagcttctcaagatctactttccaactgtttatgatgttaaatatctgatgaagagttgtaaaaacttgaaaggagggct

SEQ ID NO: 3413 - DNA, 659 bp, Piezodorus guildinii
tcatgaacgttcagtgtcatgcatgtatagggggcacaagcttgggagaagatataaggaaacttgattatggccaacatgttgtatctggtacacctggtcgtgtttttgatatgataaagcggcgaaccctaaggacaagatcaatcaaagttttagttcttgatgaagctgatgagatgttgaataaaggtttcaaagaacaaatttacgatgtttatcgcttcttacctccagctactcaggtggttcttatttctgccacattacctcatgaaattcttgaaatgaccagcaaatttatgacggaccctatcagaattttagtcaaacgtgatgaattgacattggagggaataaaacaatttttcgtcgctgttgaaagagaagaatggaagttcgatactctttgtgatttatatgatacattgactatcactcaagccgttattttctgcaatacaagaaggaaggttgattggcttactgaaaaaatgagggatgcaaatttcactgtttgttcaatgcatggtgatatgccacagaaggaaagagatgctataatgaaggaattcagggctggaaaaagccgagtgcttataacaacagatgtgtgggctagaggaattgatgtacaacaagtctcccttgtcatcaac

SEQ ID NO: 3414 - DNA, 706 bp, Piezodorus guildinii
tcagttctgcatttctcctcccaaaacagatatggatcacaatgtggttatctctgactatgcagctatggacaggatactcaaagaggaacgagcgtacatcctcaatattgccaagcagatcaagaaggcagggtgtactatgttgctgatccagaagtctattttgagggatgccttgtccgatttagccattcacttcttcgacaagttgaagatcatggttgtcaaggatatcgaaagggaagatatcgatttcgtttgtaagactctcggctgcagaccgatcgcatctcttgaccacttcaccagtgaggccttggtcactgctgagctagcggaagaagtatcagcaggaagctcccgtatcgtcaaagtcaccggaatacacaatcccgcaaagactgttaccattttagttcgaggatccaacaatcttgttctcgaagaggctgatcgttccattcacgatgccctttgtgtcatccgttgtctcatcagggaaagggcacttcttcccggaggaggagctcccgagattgaactttcccttcgcctagggcagcacgctcaggtcttgggctcggtagaggcctactgtttgagggaatatgctaaagctctagaaatcgttccttacaccctagccgagaatgctggtcttaacccagtagctaccgtgacggaactgaggaataagcacgtt

SEQ ID NO: 3415 - DNA, 693 bp, Piezodorus guildinii
agcttagcaccatactaggacagaatctgtcagatgacagcgatagtagtgatttattcaccaagtttaagaaattacaaaggcagcttgaatttttagcagttcaggaagagtacatcaaagatgaacagcgtaatctgaagaaggaatatttacacgcacaggaagaagtaaagcgaatccagagtgttcccttagttatcggtcagttcttagaagcagttgatcaaaatactgggattgtaggtagcactacaggctctaattattatgtgaggatcttatctacgatcgatagagaactattgaagccttcagctagcgtcgcccttcacaagcacagcaatgctcttgttgacgtcctcccgcccgaagcagattcctctatttcgatgctccaagcagacgaaaaaccagatgttcagtattcggacatcggtggcatggacatgcagaagcaggagattcgtgaggctgtggaattgcctttgacacatttcgaactctaccgccagattggtatcgatcctcccagaggagtgcttatgtatggacctccaggatgtggcaagactatgcttgctaaagctgttgctcatcacacaactgctgcattcattcgagtagttggctccgaattcgttcagaaataccttggagaaggaccgaggatggttcgtgacgtttttagac

SEQ ID NO: 3416 - DNA, 348 bp, Piezodorus guildinii
attgccaaatgttcagtgaccataaaaactatgttggaagatttaggcatggatgaagatgaagaagaagttgtaccattgccaaatgttaattctgccattttgaagaaagtaatccaatgggccacttaccacaaagatgatccacctccaccagaggatgatgaaaacaaggaaaagagaaccgatgacatttcttcttgggatgctgattttcttaaagttgatcagggaactctttttgaattgatacttgctgccaactatcttgatatcaaaggtctacttgatgttacatgcaaaactgtggctaacatgattaaaggaaaaactcctgaagaaattcgt

SEQ ID NO: 3417 - DNA, 651 bp, Piezodorus guildinii
gcagttccatgatttgatggaactgtttcgaataggaggaagatctccagacactaattacttgttcatgggtgactatgttgatagaggatactattctgtggaaacagtgacattactagttgctttgaaggtaagatatcgagaaagaatcacaatcttaagaggtaatcacgaatcacgccaaatcacacaagtatatggtttctatgacgaatgtttacgtaaatatggaaatgcaaatgtttggaagtatttcacagatttatttgactatttaccattaacggctcttgtaaatggtcaaatattttgtcttcatggtggtctttcaccgtccatagacactcttgatcatatccgtgcattagatcgcctacaagaagtaccacatgagggtcctatgtgtgacttactttggtcagatcccgatgacagaggtggttggggtatttctccaagaggtgcaggttacaccttcggtcaagatatttcagaaacttttaaccactcaaatggcctcactcttgtgtcaagagctcatcagctcgtaatggaaggctataactggtgtcatgatcgtaatgttgtaacaatattttctgcacctaattactgttatcgttgtggtaatcaagcagccattatgga

SEQ ID NO: 3418 - DNA, 734 bp, Piezodorus guildinii
aagaaggaattccaccagaccaacaaaggcttattttcgctggaaaacagcttgaagatggcagaactttgtctgattataacatccagaaagaatcaaccctacatttagtattgcgtctgcgaggaggtatgcagatttttgtcaaaaccttgactggtaaaaccatcaccctggaagtagagccttcagatactattgagaatgttaaagctaaaattcaggataaagaaggtattccaccagatcagcaaagattgatttttgcaggtaaacaacttgaagatggtcgcaccctttctgactacaatattcaaaaagaatcaactcttcacctcgtcctccgtttaagaggtggaatgcaaattttcgttaaaactttaactggaaagaccatcaccctagaagtcgaaccatctgacacaatagagaatgttaaggctaaaattcaagataaagaaggaattcccccagatcagcagcgattaatttttgcaggaaagcagctcgaagatggccgtactctttcagattacaacattcagaaagaatccaccttgcatttagtacttcgtctgagaggagggatgcagatttttgtcaagactttaacaggtaaaaccattaccttggaagttgagccttcagacacaattgaaaatgttaaagccaaaattcaagacaaagaaggaattccgccagaccaacagaggttgatttttgcaggaaagcag

SEQ ID NO: 3419 - DNA, 755 bp, Piezodorus guildinii
tcggagatggtactacaagtgttgtccttatcactagcgaaattctgaaacagttgaaaccatatgtggacgagggtgtgcatcctagaatcatgatgaaagcagtccgcaaggccacacagttatgcttagataaaattaacagcttagctgtcaagatcgagaagagcagcgcggagcagcaccgctccctgctggagaggtgcgctgccacggccctcagctccaagctgatccaccagcagaaggagttcttctccaagatggtcgtagacgctgttctcttgttggacgagctccttcctctggacctcatcggaatcaagaaggttcctggtggagctttagaggaatccttgttggtctctggagtagcctttaagaagaccttctcctacgcaggctttgaaatgcaacccaaaaagtacacaaatcctaaaatagctattctcaacattgaattagaattgaaagccgagagggacaacgcagaaatcaggctcgacaacgtggaggaatatcaaaaagtcgtagatgttgaatggcaaattttgtatgaaaaattagacacaattgttaagtctggagctcaggttgttctttcaaaacttcccatcggcgatgtagccactcagtattttgcggacagagatatgttctgtgctgggcgtgttgctgatgaagacatcagaaggactcagaaagcctgtggtggcacgatgattaccacaaccaaagatatgtctgcttccgtc

SEQ ID NO: 3420 - DNA, 791 bp, Piezodorus guildinii
ccctgttatggtcatttggaggagatgctaaactcaaagttcgctcagacttgggcgatttcattcgttctgttaccaccataccgttgccgccaaacaatcccaacataccaatcatagattatgaggtaaatatatctggggaatggagcccatggtccgccaaagtacctcaaatcgaagtggaaactcacaaagttgcagcgccagatgtggttgtgcctacgctggacacggttcgccacgagtctctattgtatacctggcttgcagagcatagacctttagtgctttgtggtcctcctggatcaggtaagacaatgaccctgttttctgcactaagggcccttccagatatggaagtggtcggccttaacttcagctctgctacaacgccagagcttctcctgaagactttcgatcattattgtgaatataggaagactcccaatggggttgtcttggcgccagttcagttgggaaaatggttggttcttttctgtgatgaaatcaacttgcccgacatggactcttacggaacccaacgagtcatctccttcttgagacaacttgtcgaacagcggggattctataggtcttctgatctcgcttgggtttcccttgagaggatccagtttgtgggtgcttgtaatcctcccacagatcctggcaggaagcccttatcacacagattcctgaggcatgtgccggtcatttatgttgattatccgggcgaaacatctctcaaacagatttacggaacattctcacgagctatgctgaggcttatt

SEQ ID NO: 3421 - DNA, 690 bp, Piezodorus guildinii
catgagagaacattgcacacagacattttatttgggttagttaaagatattgcaagatttagatcagatcttaaacttttaatatccagtgctacattggatgcagaaaaattttcaacattttttgatgatgctccaatttttagaattccaggaagaaggtttccagttgatatatattataccaaagctcccgaagcagactatattgatgcttgtgtggtctcaattctacagatacacgcaactcaacctttaggcgatattctagtattccttactggacaggaagaaattgaaacctgccaagaaattttgcaagatagagtaaggcgtcttggaagcagaatcaaagagttattaatacttccagtttattctaatctaccatctgacatgcaggccaaaatcttccaaccaactccacctaatgcaagaaaggttgttttagccacaaatattgctgagacctctctcactatagacaatataatttatgtcattgatcctggtttctgtaaacagaataactttaactcgaggactggtatggaatcattgatagttgtgcctgtttcaaaggcttcagccaatcagcgtgcaggaagagctggacgtgtagctgctggaaaatgctttaggctttatacagcatgggcgtataaacatgaactggaagacaacactgtt

SEQ ID NO: 3422 - DNA, 715 bp, Piezodorus guildinii
cagaacttacacctgtcgaaacagaaaatccaatgggaggatatggcaaaactgtgtcccacgtaataattggattgaaaacagcaaaaggtacaaaacagttaaaactagacccaagtattcatgaaagtttaacgaaggaaaaagtagaagttggagatgttatatacatcgaggcaaacagcggtgctgtcaagaggcaaggaaggagtgatacctatgcaactgaatatgatcttgaggcagaagaatacgttcctcttcctaaaggtgatgttcataaaaagaaagaagttattcaagatgtgactctacatgatctagatgtagccaatgctagaccacaaggagggcaagacgttttgtcaataatgggacaacttatcaagtcaaagaaaacagaaattactgataaattaagagctgaaattaataaagttgtcaacaggtacatagaccaaggtattgctgaactagtgcctggtgtgctttttattgacgaagttcacatgcttgatatagaaaccttcacttaccttcaccaggctcttgaaagtgcaatagcacctattgtagtctttgctacaaatcggggtcgttgtcaagtaagaggtgctgcagacattatttcaccacatggactacctttagatctgctggataggttgctcataattcgtactgcaccttacagccaaccagaaatgtgccaaat

SEQ ID NO: 3423 - DNA, 662 bp, Piezodorus guildinii
gtgggcctctgattctaaaaacagtattgttttaacatcaagatgttgtgaaggtacattagcaagagatttattggataacggtgttggaaggaccatccagatcacagttaaaaaaagagttcgtcttgaaggggaagaattaaaggaatacttaaaagcacataaaaaaacaaatgacaaaaatgaagagaaggaaagttctgagtcagaagatgaaattcagttgcttagtgtcactaaaggtagccatgatcttgtaattaagcaggaacgtaggaaaaaaaatcaaaagtccttaaagaaattttaccctatgtttccttttatcgatcgtaaagttaaatttgacgaatatggtgaatttgtgcggatagaagattataaagctcctgatactgctaaacgtcctcctgaaaaaaagtctaaaaagaaggatgatgacattgtagatcctgctgatattccaactaaatgtgtttcttatgagaagtcgctaacagtgaatgcccaggttcaatatatagattttgagggaagatcagacggagaatcggtacaaaagataatcacgcagttgaggccgcgaagggtgatacttgtccgtggtacttctgaaaatactgaagctttagaaaagcatcttcaacaatggtctgagg

SEQ ID NO: 3424 - DNA, 736 bp, Piezodorus guildinii
catgaacagggaacagagaaattatcaatttgatttccttcgtccccagcattctctgtttctgtatttcaccaaactactcgaacaatatactaaggtgctgattcctccaaaagaccttatgtcccgcctgaaggaagagtgctccaaccctaccggagtcctagagcaggtgaggtaccgtgcggactggcttcactaccaggagcttcagaagaggaaggaggagcaagccctcgagaaggaaagagtggcttacgctcagatagattggcacgactttgttgttgtcgagaccgtggactatatcccgggcgaggtgggcaacttccccccgcctaccacaccagatgaagtcggtgccagggtcttgatgcaggagcgaatattagaaaatggaggtgaagatctggcggaaggagctggcagcgatgaagagagggagaaggaagacggtgaaagggaagaaggagccggtgataagggagataacactcaggtacaagacatggaagaagagtcatcgagcgatagcgatgaagacgacgaacagagagagcagccgccaggagagaagcagcaggcgcagcccggtcagaagcagcagcctcccgacggcaagaagcctcccctccagccgtcgatgcagcccccgctacctcccgcaccggacaaggtcatcgtcaagaagggatacaaccccaagcagaaccaaaagatttcgaaaggtgcagat

SEQ ID NO: 3425 - DNA, 768 bp, Piezodorus guildinii
attaggttgttggaaggcaaaaggtgttttggacgtatctaatagttttgctgttccttttgatgaagatgacaaggataaatcagtttggtttttggaccatgattatttggaaaacatgtatggaatgtttaagaaagttaatgcaagggaaaaggttgttggctggtatcatactggtccaaagcttcatcagaatgatgttgcaattaatgaacttattcgccgctactgccccaattcagttcttgttataattgatgccaaaccaaaagatctcggtttacctactgaagcctatagagcagtagaagaagtacatgatgatggctctcctaccacaaaaacatttgagcatgtccccagcgaaattggagccgaagaagcagaagaagtgggtgttgaacatctgctgagagatattaaagacacaactgtaggctcactttcgcaaagggttactaatcaatttctgggcctcaaaggccttaatcaacaaattcaagatatcagggattatcttatgcaggttgttgatggaaaattacctatcaaccatcaaataatataccagctacaggacattttcaaccttcttcctgacatgaaccatgggaactttgtggattcattgtacataaaaacaaatgatcagatgcttgtcgtttacctcgctgccctcgttagggcgattgttgctttacataatctgattaataataaactcagtaaccgtgatgctgaaaaaaaggaaagcaccaagaaaga

SEQ ID NO: 3426 - DNA, 791 bp, Piezodorus guildinii
cacaagatgaagaggttggagatggtactacatcagtcgtgattctttgtggtcaaattatggctgaaattgaaagacatatagatgaagttcatccaactacaatcattaaagaatttaaaagagctttggatgatattttaagaatacttccagacataagcacttctcttgacctaaaggataaagctaaagtaatagaagtagttagaggttgtttaggaaccaaatttttgggtacttggtctgaaatggcttgtcaaatggcaattgatgcagtagaaactgtcagagatctgaagggtcttggaattgacttaaagaactttgcaaaaatagaaaaggttcctggtggttttattgaggattctaaagtattggaaggtgtaatgcttaacaaggatgtgacgcatcccaaaatgtcccgttacattaaaaatccacgaattttattactagactgttctcttgaatataagaaaggggaaagtcagactaatgtggaaatagttaaagaaggtgattatactagacttttacaaattgaagaggagtacattgaaaaaatgtgcaatcatattattgagcataagccaaatgttgtgataacagaaaagggtgtttctgacttggcacaacaccatctttttaaggctggtataactgccattcgtagggttaagaagaccgataataacagaattgctcgagcggtagatgcaactattgtcagtcgtgtagaagaaataaagccccatcacattggttgtggtgctggtctctttgaagta

SEQ ID NO: 3427 - DNA, 635 bp, Piezodorus guildinii
gcctagaacttatggtggtttatcagattatagaagcgttcctgcaccgtcctttagcccttattctgaaaatggagggagtgtggttgctgtagcaggagatgacttcgcgattatagcctctgatacacgtttaagtactggttttcaaatttacaccaggaaccagtcaaaattatttaaactgtctgataaaacaattcttggaagtactggatgttggtgtgatgttctttctcttactaggcttgttcaaacccgaataaaaatgtatcagtatgatcataacaaagttatgtctactccagcagttgcccaaatgctttccgtactactttattacaaacgcttttttccttactatgtcgccaatattcttgccggaatagatgataatggcaaaggagttgtttacagttatgatcctattggtcatcatgaaagctcaaaattcagagctggaggaactgctggagcattattacagcctctgttggacaatcagcttggtatgttgaatcaagaaaatgttcaagacaaaacatacactttggagaaagcgcatgcaatcgtaaaagatgtctttatatcagctgctgaaagagatatatttactggtgacagaatatcaatca

SEQ ID NO: 3428 - DNA, 744 bp, Piezodorus guildinii
tgggaatgaaagggaagatgttgaacgtggaggcaaaattattatgcctccttcagcacttgatcacttgacaagattaaatattaattatcccatgctttttaaactgcacaactcaaaaacaaataggacttctcacagtggtgtgttagaatttgttgcagatgagggaaaagtttatttaccacattggatgatgaggaatttgatgcttgaagaaggtgatgttattgaaattgaaagtgtttccttacctgttgcaactttttcaaggttccagcctcagtctccagattttttggatatatcgaatccaaaggccgttctagaaaactgcctcagaaactttgcttgtttgactactggtgacataatcaatattaaatataatcaaaaagactatgagctttcggttttagaaacgcaaccaggcacagcagtgacaatcatagaatgtgatatgaatgtagaatttgctgcacctttaggatataaagagccgaattctgaacaggaatcattggatgaatcttctgaaagatcagaaaacttgacaaatgaaggaagtggattcatcccattttttggtgaaggttacaggctagatggaaaacagaagaaaaatattgaagatgaaaatgttggatttagaataccagctgtgagaggaatccctgattatgactggaaagttggggtgattacttttatgagaaatgtgcgccaacctgtgaaggaatctca

SEQ ID NO: 3429 - DNA, 707 bp, Piezodorus guildinii
gatgggtttgaattagctgcaagagctgccatacaacatttagattcaattgccacaaaatttcctgttgatcctaacaatttggaacctcttattaagactgctatgacaactcttggatcgaaaattgttaataaatgccataggcaaatggcagaaatagctgtaaaagcagtattatcagtggctgatctggaaacacgggatgtcaactttgagctaattaaagttgacggaaaagtcggtggaagactggaagattcaatgcttgttaaaggggtggttattgataaagatttttctcatccccaaatgcccaaggtgttgaaggatgttaaaatagcaattttaacttgcccatttgagccacccaagccaaaaacaaaacataagttggatgtaacatctattgatgactatagggcattaaggaagtacgaagaagagaaatttaataccatggtttctcaagtcaaagatgctggtgctacacttgctatttgtcaatggggatttgacgatgaagccaaccatcttcttttgaagcgagaacttcctgcagttagatgggtcggtggaccagaaattgagctaatcgccattgcaactggtggacgtatcgtacctcgatttgaagagctgagtcctgaaaaacttggtcgagctggacttgttagagaaatctcctttggtaccacaaaggacaa

SEQ ID NO: 3430 - DNA, 195 bp, Piezodorus guildinii
agtagtggaaaaggtgaaaagaaaagattcgaagttaaaaaatggaatgctgttgccctgtgggcttgggacatagttgttgataactgtgctatttgtcgaaaccacattatggatttgtgtattgaatgccaagcgaaccaagcttctgctacaagtgaggagtgcacagtggcctggggagtttgtaatcat

SEQ ID NO: 3431 - DNA, 786 bp, Piezodorus guildinii
cgacttcggttacagttttggccgccgaacttctcagagaagctgaaagattgatcgagaggaaaatccaccctcagacaataatcagcggatatcgaaaggccacgaatgtagccctggctgctttagataaatgtgctgtcgacaatagcagcaatgacaaagagttcgccgatgatttgctcaaaatcgcccgtacttcgttgagttccaaaattttgaatttgcacactgaaaaattcagcaaattggcagttgaggcagtacttcgcctcaaaggatctggaaatttaagtgcgatacagatcatcaaaaaaacaggtggctcattagatgattcatttttggatgatggcttcctcttggacaagaaagtcggtcagttccaacctaaaagagttgaaaatgctagaattctcatcgcaaatactccccttgacaccgataaaatcaaagttttcggttccagaatacgcgttgattctttagctaaagtggccgatttggagctagctgaaaaagaaaaaatgaaggaaaaaattgaaagaattataagccacaaatgcaacgtgtttgtcaatcgccagttgatttataattatcccgaacaactgtttgctgatgctggaatcatggcgattgagcatgctgatttcgatggtattgagcgtctagcccttgtgacaggaggtgagatcgtttctacatttgacacacctgagcttgtcaaattaggagaatgtgatttaattgaagaggtcatgattggtgaagacaaattgttgc

SEQ ID NO: 3432 - DNA, 653 bp, Piezodorus guildinii
ccgattacaccaggttgaatatgctatggaagcggtgaagcttggagcagcaaccgttggtgtaaagaataagcaatatgcagtccttgttgctcttaaaagagcttcatcagaactttcagctcatcaaaagaaaattattcctcttgataatcatataggcatgagcatttctggcctaactgctgatgctcgtatattgagtcggcaaatgagaagtgaatgcctttcatattcgtattcatatggaactgaaattcctattatcaggctcatgaacaaaatatctaatatgatgcagagttcaactcagcgatatgatagaaggccttatggagttggtctcctggtggcaggatatgatgctgatggtcctcatatttttcaaatttgtccttctgcaaatctttatgaatgtcgttcaatggctattggcgctagatcccagagtgcgaggacatatttggaaaaacatctggtagacatcggtaactctccgacgctcacagaccttcttaaacatgcacttcgtgctcttagagattcgtcacccaatgatacagaacttagttctaagaacgtagccatcgcagttgtggggaaagatacgccgctgaaggagctgtcagaggcagatactcagacgtacctgg

SEQ ID NO: 3433 - DNA, 800 bp, Piezodorus guildinii
gaaaattgccacacctcaaattattatcaactatgggctttttctagaagaacacaattattttgaagaagcttttaggacttatgagaaaggaattgctttgttcaaatggcctaatgtctttgacgtatggaatacatatttaaccaaatttttaaagcgctatgggggaagtaaacttgaaagaacgagagatctatttgaacaatgtttggaaaattgtcctccaaagtatgctaaaggtttctacctattatatgcaaaattagaggaagaacatggattagctaggcatgcaatggcagtgtatgaaagggctacttctgctgttttacctgaagaaatgtttgaggttttcaatatttatatcaaaaaggctgctgaaatttatggtgttccgaaaactcgtcaaatttatgaaaaagctattgaagtgttgggtgaagataattcaagagaaatgtgtcttaggtttgctgagatggaaactaaattaggagaaattgatcgagccagggcaatttatgcgcattgtagtcaaatgtgtgatccacgggttactagtactttctggcaaacatggaaagattttgaagtgcgccatggcaatgaggatactatgagagaaatgctgcgaatcaaaagaagcgtacaagctacatacaacacacaggtcaatatgatgtcagcacaaatgttatctgctgccagtaatgtttctggaacagttgctgatcttgctcctggtgctaaagatggaatgcgcatgttggaagctaaagcagcagaaatgactgtta

SEQ ID NO: 3434 - DNA, 683 bp, Piezodorus guildinii
tgaaactcttatgtgggagctattcgttcaagccggaccagttgtcaatgttcatatgccgaaagatagagtgacacaacaacatcaaggatatgggtttgtcgagtttttgggagaagaagatgctgattatgccataaaaattatgaacatgataaaagttcatggaaaacctattcgtgtgaataaggcttcagcacatcagaaaaatttggatgttggtgctaatgtgttcattggtaatctggatcctgaggttgatgaaaagttattatatgacacattttcagcttttggggtcattctgcagacgcctaagattatgagggatccagatacaggaaattcaaaaggctttgcattcatcaattatgcctcatttgatgcttccgatgctgccattgatgcaatgaatggtcagtttctgtgcaatcgcccagtttcagtttcttatgcttacaaaaaagatgccaaaggtgaacgacatggatcggctgctgaacgcctgttagctgcacaaaatcccttatcacaagctgacaggccccatcatatgtttgcggatgctcctcctgcacccctgccaccccctccagtattgcctcctcctcctgtcttcaatcctccaccccctcctcatatgcctcctcctccattgccaccacaaaggatggtagctccta

SEQ ID NO: 3435 - DNA, 640 bp, Piezodorus guildinii
gcccctaaattgaggtctttggatttcgctgaaaggcatggttacatcaaaggagttgtgaaagatattatccatgaccctggtagaggagctccattagctgttgttcactttagggatccttacaggttcaagactcgcaaagagcttttcattgcccctgaaggaatttatacaggtcaattcctgtactgtggaaagaaagccaacttacatgttggaaatgttatgcccgttggtactatgcctgaaggtaccatcatctgtaatttggaagaaaaaaccggagataggggtcgtctagccagagcttcaggaaattacgctatcgtaattgctcacaatcctgactccaggaggaccagggtcaagcttccatcaggagcaaagaaagtcattccctccaacaacagggctatggttggtattgtcgctggaggtggtcgtatcgacaagccagtgctgaaggccggtcgtgcgtactacaagtacaaggccaagaggaactgctggcctaaggttaggggtgttgccatgaacccagtagagcatccccacggtggtggtaatcaccagcacattggtaaagcttccactgtcaagaggggaacttctgccggtagaaaggttggtctcatcg

SEQ ID NO: 3436 - DNA, 261 bp, Piezodorus guildinii
gaggtgtaaagaagcctcacaggtacaggcctggaacagtcgctctcagagaaatcaggaggtaccagaaaagtaccgagctgctcatcaggaaactcccgttccagaggttggtgagggagatcgcccaggacttcaagaccgacctgaggttccagagctcagccgtcatggccctccaggaggccagcgaagcctatctcgtaggtctcttcgaggataccaacttgtgcgcaatccacgccaagagggtcaccatca

SEQ ID NO: 3437 - DNA, 746 bp, Piezodorus guildinii
ataatgacaatgcaaagccgacttgaatctgaaactcggctagttaggggactcgtccttgatcatggatcacgtcatcctaatatgcctaagaagctaactaatgcttatattttgacatgtaatgttagtttagaatttgaaaaaacagagattaatagtgggtttttctataaatcagccgaggaaagggaaaaactggtggcatctgaaagagagtttatcgagttgagggttaagaaaattattgctttgaagaagtctgtatgtgatggaacagacaaaggatttgttgtcatcaatcagaaaggaattgatcccgtctctttggatatgctagcccgagaaggtatcatggcacttaggcgagctaaaagaaggaatatggaaagactcactttagcttgtggtggagtagctatgaatagtcttgatgatctcacagaagattgtctagggcgagcaggtcttgtttatgaacatgttcttggtgaaaccaagtatacatttgtatctgattgtccaaaccctcatagtgtcactgtactagtccatgggccaacttcttatgccattactcaaatccaagatgctcttcgggatggtctgagagctgtcaaaaatgcagttgaagatggaggtatacttcctggtggaggagcagtagaattaaaattacgtcatgaattgaaaaaagttgctgagaacacaaaggaaaagtaccgtgttggaatcgaagctttctg

SEQ ID NO: 3438 - DNA, 792 bp, Piezodorus guildinii
aacaggctcttatcgatgacagaccgaaatctattgaagattgcatcgcttgggctagaaaccactggcaagaacagtattcaaatcagatccgccagcttcttttcaatttcccacccgatcagatgactacgaatggccaacctttctggtctggccccaagaggtgcccagttccacttgagtttgatgtgaataacgacctgcatttggattatattttagctgctgctaacctgaaggctgaagtctatggaatccctcaggttcgtgatagaaacttcattgctaaagtggtccagaacgtagaggttcctgaattcactcccaagtctggtgtgaaaatcgctgtaactgattcacagatggctaatggtgctggtgggcaggttgatcaagatagaattgggcagttgcagaatgaacttccatcgaaggagatgttcaacggcttgaatatcacacctctcgaatttgaaaaggatgacgataacaacctccatatggacttcatcgttgctgcatccaatctgagagctgctaattacaacataccacctgcagacaggcataagagtaagttgatagctggtaagattatacccgcgatagcaaccacaacatctgttgttgctggtttggtatgtattgagctcatgaagttagctaagggttacaaagatatagctttgttcaagaatggctttgtcaacttggctcttccattctttggattctccgagccgatttcagcccctaaattgaagtattatgagaacgaatggacattgt

SEQ ID NO: 3439 - DNA, 713 bp, Piezodorus guildinii
tgaagtacaacatgagtgcattcctcaagcagttcttggtatggatatactttgtcaagccaagtccggaatgggtaaaactgctgtgtttgtattagccacccttcaacaaatggagttgactgaaaaccaagtaacagttttggtcatgtgccatacccgagaattggcatttcaaataagcaaagaatatgagcgattctcaaaatatatgccaaacatcaaggttgctgtattttttggtggtttacctatacagaaggatgaagaagttttaaaaaataactgtcctcacattgtagttggtacaccaggacgtattttagctttagtgaaaaataaaaaactaaatttgaaaaaccttaaacattttgtattagatgagtgtgacaaaatgctcgagcagttagacatgaggcgtgatgttcaggaaatttttaggaatactcctcacagtaagcaagttatgatgttcagtgcaactcttagtaaagacataagaccagtttgtaagaaatttatgcaagatcccatggaagtatatgttgatgatgaagctaagctcaccctgcacgggcttcaacagcattatgttaagctaaaagaaaatgaaaaaaataaaaaattatttgatctactcgacatcttagagtttaatcaggttgtaatattcgtgaaatcagttcaaagatgtatggctttggcacaactat

SEQ ID NO: 3440 - DNA, 722 bp, Piezodorus guildinii
tgaactcactaaccagttggaaaaaatcagaggatttctgcatgctaggctccgaactgccactcttagaaatgattttgaaggtcaagcagttctaattaattgtctcttgagaaattacttacattataagttgtatgaccaagcagacaagttagtatccaaatcagtatacccagaatcagcaagtaataatgaatgggctagatttctttattatttaggaagaattaaagcagctcgtttagaatattccgaatcacacaaacatctagttcaagctttgagaaaagctcctcagcatgctgctgttggatttagacaaacagttcaaaagcttgctgtcactgttgacttacttcttggtgacattccggacagacagatctttcgacaagcaccacttcgtcgttctctcgcaccttatcttcagttaacacaagctgttagaactggcgatttgcaaagatttggtgaggttttggaaatgtttgggccccagtttcgttctgaccatacatttaccttaattcttcgtttaaggcataatgttataaaaactgctataagatgtattggtttatcttattcgcgtatcactcctaccaacatagcttcaaagctcggattagattcacccgaggatgcagaatttattgttgctaaagcaattagggatggtgtcatcgaagcaaccttagatcctgagcatggttatatgc

SEQ ID NO: 3441 - DNA, 753 bp, Piezodorus guildinii
cttatgctggatctgcagatgctgatgtggactatgctggagaaaactttgtgcgcttcactggtgatacattagagcatgcgaaagtgcaattgtttgcatgggaagcgcataataaaggtgttgatgtccatcctcttggagaacccaccaggctggaagttctcaagaaggaattcgtcggaataaaagaagagttcaaacaaaagggacaagaagacctcattaaaaagtatggtggagaagaacacctgaaagctcctcctaaagaacttttattagcacagacagaatattacgctgagtatactcgttacggcacagtcatcaagggccaagaaaaagaagttgtgagatcaaggtatgaggaagacgtgtttattaataaccatacgactgtatggggatcgttttggcattctggaaagtggggatataaatgctgtcattcttttattaagggatcttattgcaccggggaggctggtagactggcaacggctggagaggtggctgtcaaaggcccagcttttattccaccgcgtcccgctacaccaactgcctcatcctcctcgtcttcatcttctgattcttcatcgtcgtcatcttcatcatctgaggatgaagaagagaaggagaggaagaagaagaagcaggaaaagaagaaagcaaagaagaagaagcaaaaggtaaagaaactcaagaacaagaacaaaaaacctgaagaaaagacagaagaagaacagctgaagg

SEQ ID NO: 3442 - DNA, 519 bp, Piezodorus guildinii
ccatcaggaagaagaggaagtatgagttaggaagaccagcagccaacacaaagttgggccctaaaagagttcatttagttagaactcgaggtggaaataccaagttcagggctttgaggttggactacggtaacttttcatggggttctgaatgttgtaccaggaaaactcgtctaattgatgtagtctataatgcatcaaacaacgagcttgtacgtaccaaaactcttgtgaaaaatgccatagttgtcatcgacgcaacccctttcagacaatggtatgaagcccactacgctctgccattaggaagaaagaagaatgctaaattgtctgaagctgaggaagctgtcctatataagaagaggtctaggaaaactgaaaacaggtataaggcgaggcagaaactggccaaagttgaacctgccttagaagaacaattccagactggtcgtttgcttgcatgcctcgccagccgacctgggcaatgtggacgagctgatggttacatcctcgagggta

SEQ ID NO: 3443 - DNA, 734 bp, Piezodorus guildinii
catcagatgctcctgttgtagacacagcagagcaagtctacatttcttctctagcccttcttaagatgttaaaacatggaagagctggtgtccctatggaagttatgggtcttatgttgggagaatttgttgatgattatacagtgagagtaattgatgtgtttgctatgccacagaccggaacaggtgtgagtgtcgaagctgtagaccctgttttccaagcaaaaatgttagacatgttaaaacaaactggtcgaccagaaatggttgttggatggtatcactcacatccaggatttggttgttggttatcaggtgttgatattaacactcaacaaagctttgaagctctttcagaaagagccgtagctgttgtagttgatccaatccagagtgtcaaaggaaaagttgtcattgatgcttttagattaattaatcccaatatgatggttcttgggcaagaaccacgacaaactacctctaatttggggcatctgcaaaaaccttctgtgcaggcattaatccacggtttaaatcgccattactattccatcagcattaactacaggaaaaatgagttggagcaaaaaatgttgttaaatttacacaaaaagtcttggatggatggattgatgctctctgattattcagaaaattgcaaagttaatgaaactacagttggcgacatgcttgaattagctaagaattataacaaggcattggaagaagaagag

SEQ ID NO: 3444 - DNA, 758 bp, Piezodorus guildinii
gcgaagtagtgaaaccaatggacaagaagaaagttcttgtcaaagtgcatccagaaggaaagtttgttgttgatattgataaaaatattgatattaatgatgttactcctaactcccgggtggctttgcgaaatgagagttatactctacataagatcctgcctaataaggttgatcccctggtgtcattgatgatggttgaaaaagttccagattctacttatgaaatggttggaggtcttgacaagcaaattaaggaaatcaaagaagtaattgaactgcctgtaaaacatccagaactgtttgatgcattaggtatagcacaacctaaaggagtgttactatacggacctcctggaacaggcaaaacacttctggcaagagcggtcgctcatcacaccgaatgtacattcattcgtgtgtctggttctgagctggtacagaaattcatcggtgaaggatcaagaatggttagagaattattcgtcatggcaagggagcatgctccgtccataatatttatggatgaaattgattcaattggttcctcacgtattgagtctggtagtggtggagattctgaagtacagagaactatgttagaattattgaaccaattggatggttttgaagctacaaagaatattaaggtgatcatggcgacaaataggatcgatattctagaccctgctctccttcgccctggaaggattgatcgtaaaattgagttcccaccaccaaatgaggaggctcgatta

SEQ ID NO: 3445 - DNA, 461 bp, Piezodorus guildinii
attttcaaagaggaactgcccaagacaccatggcttttgctagtaaaacaatagttgaaaggactcagtctgcaaccagacagtctgtcaaagaaggagattatatatgccatgtgtatgtaagagctgacaatttagcaggggttgtgatatcaaaccatgaataccctcatcgagtagctcatacactaataaccaaagtattggatgaatttagcgctaaatatccaccttcaacttgggcatctgcaaatgaatccaatattgattttcctgcattggcagctcaccttcaaaagtttcaaaatcctaaagaagctgatgctcttatgaaaattcaaagtgagcttgatgaaactaaaatcattcttcataacaccattggagccgttttagagcgtggagagaaattagatgatcttatcatgaaatctgaaagtcttagctatcagtccaaagca

SEQ ID NO: 3446 - DNA, 623 bp, Piezodorus guildinii
gagggaaggttgtttcaagtggaatatgctatagaagctatcaagctaggttccacagcaataggtgtttgcaccccagaaggagttgttatgggagctgaaaagagaataaagtcccctttgatggaaccagaagctgtggagaagattctccaagtcgatgatcatattggttgcgctgtaagtggtttgatggctgattccagaaccttagtagagcatgctcgagtccagtgccttaatcattggtttgtttatgatgagaagatgccgatagagtctgctgctcaggccgtctctaacttggcaataagatttggtgatgctgatgaagatgctggcccagcgatgagtaggccttttggtgtggctgtcatgttcggaggatatgattacagaggacctcagctctatcatatggacccatcaggaacatttatctatttcgatgctaaggcaataggttccggtagcgaaggagcgcaacagagacttcaagaattgtatcataaaggaatgagcctcaaagaggccatgcagatgatcttgacaattttaaaagaagtaatggaagaaaaattgactgacaataatgtcgaaatagctgtagtaactgcagaaga

SEQ ID NO: 3447 - DNA, 758 bp, Piezodorus guildinii
gatcaggtcactcacaaagtagctcagtatcttggagaagttttggaggaccagaaagataaacttcaggaaaacttgatggctaataatacggatttatctacgtatattacaaaattccagtgggatatggctaaatatcctattaagcaatctcttcgtaacattgctgatatcataagcaagcaagttaatcagattgatgctgacttgaagacaaaatctactgcttacaataatctcaaaagcagcctccaaaatatggaaaagaagcaaagtgctagtttgttgacccggaacttagctgaccttgttaaaaaagaacattttattttagactctgaatatttgacgacattactagttgtggttccgaagtcaaacttcaatgattggaattccagctatgaaaaacttactaatatgattgttccacgttcaagtcagcttgtttatcaggattctgattttggtttgttcacagtctcgttatttaagaaagtggtaaatgatttcaaattaatggctagggaaaaaaaatttgttgttcgtgactttatctataatgaagaggaattagctgcaggaaaaaatgaaattacaaaattagttactgacaaaaagaaacaatttggccctcttgtacgttggctgaaggttaatttcagtgaatgtttttgtgcttggattcatgtaaaagcattgagagtttttgttgaatcagttttgagatatggtttaccagttaacttccaggc

SEQ ID NO: 3448 - DNA, 679 bp, Piezodorus guildinii
aacattttgaaagcccatgggggatcagctaaagaaagtatattggtcaatggatatgccctcaactgcacagtcgcatcaatgggaatgacaaagcgagtagaaaatgctaaaattgcctgccttgatttctctttacaaaagacgaaaatgaaattaggtgttgaagttctggtagaagatcctaatcagttggaagcaatcagagatagagaggctgacataacaaaagacaggattcagaaaattcttagtgttggcaccaatgtagtacttttgagcggaggcattgatgacatttacatgaaatatttcgtcgaagcaaacgcgatggtggtaaggagagttaaaaaatcagacttgaaacgtattgctaaagcaactggtgcctcttttgcaacatctctaactaatatggaaggtgaagaagcatttgatgctagtttattaggcgaggctgccgaggtatcccaagaaaggatatgtgatgatgaacttatccttgttaaaggtccaaaagcacactctgctgcctccataatccttcgtggaccaaacgattatttctgtgatgaaatggagagatctattcacgactcgctgtgtgcagtaaaacgtgttcttgaaagtaaaaccgttgtagcaggtggcggagccgttgaagctgctctttcaatct

SEQ ID NO: 3449 - DNA, 643 bp, Piezodorus guildinii
tggtaacacactcgatgataatcaagttaaaattattaaagctccggattttttaaccaggactttatatcccatgacaactacagcatctgtagttggaatcaaatttaataatggtgtagctatcgctgcagatgtcggtggatattatggatcattgaatcgtttcaagtctcttgataggctgtacaaagttaataacaatattgtaatgacaaccactggagattatgctgattttcaatacatcagagaattaatacaacaaaaagttatcagtgaggaaatcctggatgacagtttctctttaaaagccttttctcttcatacttggctcactcgcctgatgtacaacagaaggtcgaagtttgatcccttatggaacaatgttattgttgctggatttgatagcaacggacccttcttgggaatcgtggataaactaggaatgagttatgaagatagctgtgttgcaactggtatgggtgggtatcttgccactccacttttgagggatgtctatgaacgaggcaaaggaaatttgactaaacaagaagcccatgccgcccttcagaaatgcatggaaattttgtactacagggatactcaatcgcttcccaagtttcaaattgcaacagtcacc

SEQ ID NO: 3450 - DNA, 742 bp, Piezodorus guildinii
attgcggctttatcgtctatttcggaggtcatagaatcttgcccggatcttcttgatactccaggcagagaaattttgcacgaaggtgaccttgtggaactggaccctctggagaacacagctcttcatcgaactcgggctttactgttttctgatatgtttatgattgcgacttggatgtctgaaaggaaaggacaagcaaagtataagtttgaaagcagttacgatctgggtagcatggctgttgtaaatgtgagggatcttggacaagttaaacatgcttttaaacttttagtttttcctgataccagactttttcaatgcgtaaataatgaagccagggaagaatggctgaaaaagtttgatgaagctaagaaagcacgattgaattcagagcagaccaaaaaaaaaggtgaaaatgacaaagaatcttatacgattcgtgagcaatcgactaaaccccctgagagaactgattctgttgaattcggatctaatccatttgggtttgtgcttgatgatgatgcagacagcgatgctcttccagaatggttgaccgaagcagcggatgattttgatgtttccatagctcagaggcattttgaagaagcctatgcaatcattcagaaaactgaggagtattttgcatctgcgcaagacgatcaagggctggctgatataaaatccaaattggaaaataggaaagatgtattgatctgtgtcctcctatctgagttgaacg

SEQ ID NO: 3451 - DNA, 705 bp, Piezodorus guildinii
ggaatcggactaacgaatcaggacctcccggaatggaaaaagcacgttattggcggtaagaagagttcatttggtatgaagacgaacatgacactcttggaacagaggcaaagtcttcctatttataaactgaaggaacagctgattaaggctgttaccgaaaatcaaattttgatcgtcattggtgaaacaggatcaggaaagaccacccagatgactcagtatttggcagaagctggtttcacatcgagaggaaaaattggttgtacgcaaccgaggagagttgcggcgatgtcagtggctaagagagtggccgaggagttcggttgtcgtttaggtcaagaggtcggctacacgattcgtttcgaagattgtaccagcccggaaacagtcatcaagtacatgacagacggtatgttactccgagaatgccttgtggacttggatctgaagagctattcggttataatgttggacgaagcgcacgaaaggacaatacatactgatgtactctttggacttttgaaacaagctgttcagaaaaggtcagaactaaagttaatcgtcacatcggctaccttagatgctgtgaagttctcgcagtatttcttcgaagctcctattttcaccattcctggacgtacgttccctgtcgaagtactctatacaaaggaaccagagacggattacttagacgcatcgctt

SEQ ID NO: 3452 - DNA, 685 bp, Piezodorus guildinii
ggagttgcaaatggttttgaaatttttgaattgtcttatgatggaacccgtttttctgctgaagaagttattcgtcatgaaactgggtctaaagtggtgatgaattctgcttgttacagtgacaagaaaagtacgtttttagttgctggacaagaaagtcactgtcagttatacagagttggaattactgttgagaaggaggtttctgaagaaccaatgaatggcattctggaacctcctaatctaaggcaccgaaaaccttccagaaatcaccaaaatggtataagtgaagtgaagaatattgtcaaaaagaaattagtttttaaattcaactctggtgatagcatacaatctgactttagtgaaaacgaaccatgccaaagggtagttacaatatctcgttgtggtggctggatggcaactggtggaactgatggaatcgtaagaatctggtcattccctagccttcgattgattagagctcttaaggcccacacgaaagaactagatgatttacattttagccctgattcaaagcagatagccagtgtggcaaaagatggacaagcaattatttgggagctgaagtcaggaaaacaggttcataaacttgattggactcatcctgcaggaatcaaatatctcttcaaaagatgtcgctttggcattgttgaaggcaaaggtt

SEQ ID NO: 3453 - DNA, 654 bp, Piezodorus guildinii
gatcttgaagctgggataggaatagaagttcaactttgtaaagagtgtatagaatgggcaaaagatgaacacaggactttcctcaggcagtcactggaagccaggcttattgctctatatttcgacactggaatgttcacagaagcactccagctcggctcaagtctccttaaggaattgaagaagttagatgataaaaatttgcttgttgaagttcttttgttggaatccaaaacttatcatgctttgagtaatctttctaaagcccgggctgctctgacatcggccaggacaactgctaattcaatttattgtccacctaaaatgcaagcagccctcgatttgcagtctggtatattacacgcagctgacgaacaggatttcaaaacagcttactcatacttttatgaagcatttgaaggttatgatagtgttgacagcccgaaggctttggtagctcttaagtacatgcttttgagtaaaatcatgttgaatacgccagaagatgtgcagcaactagttagtggaaaacttgctcttaaacacgctggtaaagatatcgatgcaatgaaatcagttgctcaagctagccataagagatcccttgccgattttcagataactttaaagaattacaagaaagagctggaagag

SEQ ID NO: 3454 - DNA, 708 bp, Piezodorus guildinii
aggagaaaggaagaagcttgcagatgaaaacaaggctttggaaaatgaaagaaataaacttgcagtccagctatcagatacacgaaaacatttggaggaagaaactctccagagagtagatctagaaaatgctgtgcaaacattacgtgaagatttttcatttaaagaacagctacatgaacagcagttattggaaactcgtactaaaaagcaagtggaaattagtgaacttgatggtagattaagccaagagtatgaagaaagattataccagagtcttcaagaaatacgcgatcaatatgaatgcgatttagaaaataacaaggaagaaattaaaaaactgtacgaggaaaaaattcgaagtcttggaagtcaattgacacgaaacagcaatgctgctgcaatggctattgaagaaatgaaaaacatgcaagctaaactcaatgagcttaatagaaaattactagacttggaagcagacaggaatgcagcccagcaaaaggctagagatctggaaaagattttggaacaggctaaagctcaatatatggaagaatatagtcagagggaagctgaaatcactactcttcgtgaagagatggctcatcaagttcaagaatatcaagatttaatggacatcaaagttgcattagatttagaaatagctgcctaccgaaagttgcttgagggagaagaagccaggttaaa

SEQ ID NO: 3455 - DNA, 787 bp, Piezodorus guildinii
aactggacgtttagaggttcttcgaattcatacaaaaaatatgaaactagctgatgatgtcaatttagaacagattgctgctgaaacacatggtcatgttggagcagatttggcatctctctgttcagaagcagcacttcagcagatccgtgaaaaaatggatctaattgatttagaagaagagcaaattgatgcagaagttctaaactccttggctgttactatggataacttccggtatgctatgggcaaaagtagcccaagtgcccttcgtgaaactgtggttgaagttccaaatattacttgggatgatattggtggtctggataatgttaaaaaggaattgcaagaattggttcagtaccctgttgaacatccagaaaaattcttgaaatttggaatgcaaccttcccgtggtgttttattttatggaccaccaggttgtggtaagacattgttagctaaagctattgctaatgaatgtcaggcaaacttcatttcagtcaaggggccagaattattaactatgtggtttggagaatcagaagctaatgttcgtgatatttttgataaggctagagctgctgcaccatgtgttctattttttgatgaactggattccattgctaaatcaagaggtggaagtgttggagatgctggaggtgcagctgatagagttatcaaccaaatccttactgaaatggatggaatgggagccaagaaaaatgtttttataattggggctactaatagaccagacataattgatcctgctattctgagacct

SEQ ID NO: 3456 - DNA, 651 bp, Piezodorus guildinii
ttgtcttcagttgaccaacctttaaaaattgccattgataaaggggttggtaaggattatttattatgtgactacaatcgggatggtgattcatacagatcaccttggagcaatacttatgatccacctctggaggatggttcaatgccctctgaaaggctaagaaaactagaagtagaagcaaacgctgccttcgaccagtatagagaaatgtattttgaaggaggtgtgtcatctgtttacttgtgggatttggatatgactggttttgcaggtgctattttaataaaaaaggctggggatggttcaaaaaaaattaaaggttgttgggattcaatacacgtggttgaagttcaagaaaaaacaactggacgaaatgctcattataaattaacttcaactgttatgctttggttgcaaacaaataaaacaggttcaggaacgatgaacttgggaggtagtttaactagacagatggagcaagatgcagctgtatcagatgcttctccacacattgctaatattggccgaatggttgaagatatggaaaacaaaattaggaacatcctgaatgatatttattttggaaaaactaaagacatagtcaatgggttgcgaagtacacaagctttatcagaacagaaagcccag

SEQ ID NO: 3457 - DNA, 709 bp, Piezodorus guildinii
accattagcaagcaccaataagcctactgtacctcctgtctcttcagttgctcagcctgaacccgtgaaacctgtggtggtggcatctcatatcctccctccccaacctgcaaggccgaccgctacagcagccccgctgactaccgcaaagagggcatcgatccctacaccaggcacaaccttaggtataccacctaccgctccgaccgcccttgagacaggtcctattgagatcaaacaagaattggacgttcctgtgtcattagctcctgtgcctgaccatttggatttcaaaaaccttttggaagtgaagcctgagctgaatgatatcgtaacagggatgccttctgtttttgatccattgcctgactcacctcccatcattaaggaagaaaaacttcccatattacctcatcacactgatggacacttgaataactctcttccccccgtgagtaacgtgcctggcccgccagttatacctagtgctgcacttcctacaacacctcacatcttagatatgaacaaaaattctcagcctccccagcttcctcagacgccagttatgcaacacaacttcaagcctaagagtgttgaacaaaacctgaaaaatgccagttcatggtcttcattggcccaatcgccgacaccagctctaactcctactccacccactgcagcagcactgaaatcatcaatggctgacagt

SEQ ID NO: 3458 - DNA, 705 bp, Piezodorus guildinii
tatcaaggcctggtctgatattcagaaggtctacaaatctaaaagattccgtgctggtaaaggtaagatgcgtaataggagacgcattcagcgtagaggaccactcatcatctatgggcaagatcaaggtctaactcgtgctttccgtaacattcctggtgttgatcttatcaacgtttcacggttgaacttgcttaagctggcacctggtggtcatgttggaaggtttgtgatctggacccaatcagcttttgatcaacttaacgctctctatggcacatggaagaaaaaatcaactttgaaaaaggactacaacttgcctatgcccaagatggttaatactgacctgtctaggctgttcaagtctgaagaaatcaagagtgtccttaaagcaccaaggaagaccatagttaggagggttaggaaactaaacccattgaggaacactcgagcaatgctcaagctcaatccattcgctgcagttctgaagaggaaagccatacttgctgataggaaacttaagcttgagagggctattgagagatcaaagaaggaaggaattgagcttacccctcatcaaaagaggtatgttgctatgctcgagcgaaggaaagctcagatcaaagctgctaaggctgctaagcctaaaaaggtcaagaaaccaaaagctgaaaaaactgaagctgctgaagcaaagaaagctag

SEQ ID NO: 3459 - DNA, 715 bp, Piezodorus guildinii
caagagttaaggaacgggaagcagctaaagcaaaagctaggcaagagaagcaggtagatgaaaatggtgatccaatcgaaacagaagtagaggaacaagaggaacctcctcctcctgaaataccagcagtaaaacattctatacgttctggaccgtatgctatatgccgtaaagctggaataggtggtttggctaaacgatttggtttgaaacctgaacagtttgctgaaaaccttagggataattatcagcgccatgatgttgaacaggaaccatctttacctattgaattggccaaagaatttgtttcatcaaaatttcaatcaccagaagatgttttaaaagctgcaaagtttatggttgctacacaactgagtagagaacctcttgttcggcgttgtatgcgggatacattttttgaaaaagcaaaaattgatgttaaacctaccaaaaagggatcaaaggaagttgatgaaaatcatccttgttatgtcatgaaatacatgaaaggaaagcctgtaagagatttaaccgctgaccaatatctgaagctgcatatagctcatcaagataagcttttgaacgttagcatcagtgatcatattggaggtcatacaacgacatcctatattgaggaaattaagcaactctactaccgggatgagtttatgcaacatgtacaagaatggaataatatccgtcaagaatgtgttga

SEQ ID NO: 3460 - DNA, 781 bp, Piezodorus guildinii
catgaaatccttggactggaattggtcaccttattagtagaaaaccctacagatgattcgatcgaagtcgcagtcgcttttttaaaagaagcaggtcaaaaattaagtgaagtaaccagcaaaggcactaacgcaatattcgatatgttaagaaatattcttcatgaaggcaaattggaaaaaagggtacaatacatgattgaagttatgtttcaagtgaggaaagatgattttgcaacttttccatcggtaccggaagagctagaccttgttgatgaagaagatcagttcactcacttgattggtctcgatgatgccatagatacccaagacatacttaatgtattcaagcttgattcggaatatcaagcgaacgaggaacgttataaagaattgaggagcgaaatcctcgatactgattccgaggagagcggttctgaaggcgatagcagtggagaaggagaagacgatgattctgatgaggaagatgaagaaaagaaagtcacaatcgtcgataacacagaaacgaacttgatatcgctgagaaaaactatttacctgacgattcaatcaagtcttgactttgaagaatgtgctcataagctgttgaaaatggaaatcaagcctgggcaagagaaggaactctgtcacatgtttctagattgctgcgctgagcagaggacttacgaaaagttttttggtctccttgctcaaaggttctgccaagttaataatacttacatagcacccttcgaacagatattcgctgacacatattcga

SEQ ID NO: 3461 - DNA, 727 bp, Piezodorus guildinii
atgcctataaagctgacgagcctacgatgggggaagggccagagaagtctcgctcgcagctgctgatcctggaccgaggcttcgacgctgtctccccactcctccacgagctcaccctccaggcgatggcctacgatctccttcctatcgagaacgatgtttacaagtatgaagctacagctggagctccagaaaaagaagtgttgttggatgaaaatgacgaactgtgggtagagctacgccatcaacatattgctgtagtatcacagaatgtcacaaagaatctaaagaagttcacagagtctaagcggatgccacaaggagacaagcagtcgatgagggacctgagccagatgatcaaaaagatgccgcaatatcaaaaagagctcagcaaatattccactcatttgcacctcgcggaagattgcatgaacgcttaccaaggccatgttgataagctctgcaaggttgaacaggacctagcgatgggtaccgatgctgaaggagagcgtatcaaggaccacatgaggaacatcgtcccgatcctcctcgaccagtcggtctccaactacgacaagatgaggatcatcctcctctacaccctctccaagaacggtatttccgaggagaacttgaacaagctcgtccagcatgctcagattcagccgcacgagaagcaggccattgtcaaccttggcaatcttggtctcaatgttgtcgttgatgg

SEQ ID NO: 3462 - DNA, 709 bp, Piezodorus guildinii
atgttcccagatctagagctgttgaggcacaaaggctgatgacatattttagtgaatttcttagccctggacctgttctcgctagtgttttttcaaataaagaagaggtatttgaagctgctgatattatacagaagcttcatatgatctcacaagaacttccttctgataaatttaaagatgcaagatcaaaaataagtttaaaatatgatgaaattgaaagatcgttaattgaagaattcgtgaagtcacatagggttcatgaaacaagcagaatgaaagaaattgcaaatattcttatgcatttcaagtcttactcacagtgtattgatgcatttattgaagaaagtcaaatgggaacatttgctggaaaagatatttttaaggaaatattacctcttacaaaaaaaaattttaacatcatgaaagaagtttttagcaaccctgaacaagttatggctaaatttgttttgaatatttaccacttaaaactgcagaaacatattgtaagcaacctttctgacaagtctgattctaataaatatctaagaaacttaatggaattatatactaggactactgagctatctgttgaattgagttgttttaaaatggggtctgatgattcatatcttcaaaagctaactcataccatatttcaaaaatatttagaatcatacattagtgtagaagttaagggcttgaagga

SEQ ID NO: 3463 - DNA, 670 bp, Piezodorus guildinii
tcatggtcagagacaaatcgggaccgaagagagaggctgaggcaactagctcttgagactatcgatataaacaaggatccgtattttatgaaaaatcatttaggttcttatgaatgtaagctatgtctcaccctgcataataatgagggaagttatttagcccacactcaaggaaagaaacatcaagcaaacttagcgagaagagcagcgaaagaagctaaagattctccacaacaaccagcaccagataaaccaagaatagaaccaaaaaagtttgtaaaaattggtagacctggttatcgagttactaaacaaagagatcctgaaacaggccagcaaagtcttctttatcaagtagattatccagaaattgcagaaggaatcttacctaggcatcgttttatgtcagcttatgaacaaagagtggaacctccagacaggaaatggcaatatcttctgtttgctgctgaaccttatgaaacgatagcctttaaggtgcctagccgtgaagtagacaagtctgaaaacaagttttggactcattggaacaaggacacaaaacaatttttcctccagtttgcatttaagaatgaaccacttgctcctcctatgggtgcaccccacttaggtcaaatgagacctccgcacatgttaccaccacctatgagtg

SEQ ID NO: 3464 - DNA, 351 bp, Piezodorus guildinii
acctcttgttgttttcgagttgtgttttcatcatgtccatcggtgttcctatcaaagttttgcacgaggccgaagggcacatcgtcacctgcgagaccaagactggagaagtctacaggggaaagctcatagaagcggaggataatatgaactgccagatgaccggtttgactgttacctaccgcgatggacgagtagctcaattggaaaacgtcttcatcagagggtccaaaatacgctttctgatattaccggacatgttgaaaaacgcgcctatgttcaaaaaacaagggaataaaggcaatacgggcgctggtagaggtaaatcggcgatactgagagctcaagcag

SEQ ID NO: 3465 - DNA, 659 bp, Piezodorus guildinii
caagtgtttcaaaagtcccccttctgcagacattagcgaagagaacattcgcagctgctgcggctcctaaagctgctggatgtaaagctactgttgaagtttctactcttccgaataaggctattgtcacttctttggggtgtggacctaaaccctttgtacaagtagctgtagcattcagagctggaagtcgtaatgaatgttctgaaaactatggagcaagtcaccttctgaggagctctgctggtcttagcacttgtggtgcatcttcattctacatttgtcgcagtttgcaacaaattggtgctagcctaactgccacttctgaccgtgaaacgattgtttatgtcctggaatcttctgctagcaagataaatgaaggccttgatattttgaagaaggctattactggtcaagagttcaggccctgggaactttccgacaatgtttctcgaatcaaagtagaattggcatcactacctccacaagctaaagtgatcgatttgattcatacagctgcatttaggagtggactcggaaattctatttttgttaaagaattcaacataaaaaaacttagcagtgaaacgcttaaacattatgctgctacctatttaactggagacaaagcagttattggtggttgtggattacctcat

SEQ ID NO: 3466 - DNA, 194 bp, Piezodorus guildinii
aggaaaatgatcagatgaccaacaaactgaaagataaaataactgctttgaagcacctgtcgatcgacatcggtgcggaagtgaagtatcaggataagatgcttcatggcatgtcggaagactttgatcgtaccggaggctttttaggaaataccatgaatagagttttacgtctgaccaaaggaagtcacaat

SEQ ID NO: 3467 - DNA, 781 bp, Piezodorus guildinii
tacagactggtatctctgcaatagatgttatgaactcaattgctagaggacaaaaaattcccatcttttcagctgctggtttgcctcacaatgaaattgcagctcagatttgtcgacaagctggtttagtaaaattgcctggtaaatctgttcttgatgatcaagaagataattttgccatagtgtttgcagctatgggagttaacatggaaactgcccgatttttcaagcaagattttgaggaaaatggctccatggagaatgtttgtttgtttttgaacttggctaatgaccctactattgaacgtattatcacacctcgtctcgctctgactgctgctgaatttcttgcttatcaatgtgagaaacacgttttggttatattaacggatatgtcttcttatgcagaggcccttcgagaggtatcggctgccagggaagaggtacctggtagaagaggtttcccaggttacatgtacactgatctggccaccatttatgagagggctgggcgtgttgaaggcagaaatggaagtattactcaaattccaattcttactatgcccaacgatgatatcactcaccctattcctgatttgacgggttatattactgagggccaaatctacgttgaccgtcaattgcacaacagacagatttacccgccaattaatgtactaccatcactgtcccgtttgatgaaatcggccattggcgagggaatgacccgaaaggaccattcagatgtctcaaatcaattgtatgcctgctatgctattgg

SEQ ID NO: 3468 - DNA, 782 bp, Piezodorus guildinii
gtcaggcaaagaagaagagatgtatggcgatcaagacatgtttgacctggatcaaggatttactcagggttttacccaagagcaagtcgatgaaatgaatcaacaactctctcagacaaggtcccagagagttcgagctgcaatgtttcctgagacattagaagaaggtatagaaattccatctacacagtttgaccaggctcaagccacggcagttcaaagactagctgaaccaagccaaatgctaaaacatgctgttgttaatctcatcaattatcaggacgatgctgacctagccacccgtgctattcctgaattgattaagctgctcaatgatgaggatcaagtagtggtttcacaggctgctatgatggtacaccagctgtcgaaaaaggaagcctctcgccatgccatcatgaatagtcctcaaatggttgaagctttggtgagagcattatcaaacagtaacgacttggaaactaccaaaggagctgtaggaacattacacaatttgtctcatcacaggcaaggtctcttggctattttcaaaagtggtggaattccagctctggtgaagcttttgagttccccagtagaatcggttcttttctatgcaattaccactttgcacaacctccttcttcatcaagaaggaagtaagacggctgtgcgagttgctggaggattgcaaaagatggttgttttgctccaacgaaataatgtgaagttcttagccattgtgaccgactgtctccaaattctagcttatggcaatcaggaaa

SEQ ID NO: 3469 - DNA, 588 bp, Piezodorus guildinii
cgatcaagccaaacaaagaagaccctacttagcatctgaatgtactgatcttcaacaagctgagaaatggagaatgcaaatcattagagaaatagctcgtaaagtttctcaaattcagaatgctggtcttggtgaatttagaattcgtgatttgaatgatgaaatcaataaactactgcgagaaaaaggacattgggaagctcaaattcgagaacttggtggcccagaccactccaggtctgggccaaaaatgctggatgctgaagggaaagaagtgccaggcaataggggttacaaatactttggtgcagcaagacaacttcctggagtcagagagttgttcgagcaggctccacctccacctccacataaaacgcgtggcgagctaatgagagatattgatgcttcttattatggttatatggatgatgaagacggaatcattataccacttgaagaaattgaggaaaccaaagctattaaaaaagctgtagcagaatggactgttaagaaagaaaagtcaatggaaatggatgaagatgagaaagaagaagtcgaagaggataacatctacaaagctgcaggaaa

SEQ ID NO: 3470 - DNA, 502 bp, Piezodorus guildinii
acatttgtcaaacgccatttaactggtgaatttgaaaagaagtatgttgctacattaggggttgaagtgcatcctttagttttccacacaaaccgaggccctatccgttttaatgtttgggacacagcagggcaggaaaagtttggtggacttagggatggatactacattcagggtcaatgtgctattattatgtttgatgttacttcaagggtaacttacaagagtgtccctaactggcatcgagatttagtgcgtgtgtgtgaaaacattcccattgtactttgtggaaataaagtagacattaaggatagaaaagtgaaagccaaaagcattgttttccacaggaagaagaaccttcaatactatgacatcagtgctaagagtaactacaacttcgaaaagcctttcctgtggctggctaggaaactcatcggtgatccaaatcttgaatttgttgctatgcctgcattgttgccccctgaagtcaacatggatcctg

SEQ ID NO: 3471 - DNA, 386 bp, Piezodorus guildinii
tggatatccaaaccattgcaacgatatttattaaagttttaaaacttgtaatcaattttatcattttgatgctctaccgctatggtggaaaacaaggatttctcggagttggtggaacatggaacttgtatgaagttaaaagtgctgatgctgaaattattgcatctggagtttttgtgggattttttatatatacatctgtaatccttatttcatactgctttggaacaaccaaacacaaatatagtgcagtagatattataatgaacgtgagcggaaccatattgttcacagcagttggagggatagctttacactattgggttggcttccaggatgaaaatcattacgtgggaatctctcaagaaaagcaaataggacttgcg

SEQ ID NO: 3472 - DNA, 701 bp, Piezodorus guildinii
ggatacttcaagaagcccaaaatatgatggcattgagccacgtagatactccgctaaaaggaggtttgaatacacctctttacaactcagagtttagtgttcatccaccagcagagcagatcacaacaccaaacactgttctaactactccgttttccaatcgaactcatgaaggaaggactccaggctttcaaaccccgcaggacgtgaggaacagcctgaccactcctgtcagagataagttaaacatcaacccagaggaaggtggtgatacaccctatgcacctgtaaataatcaaaaacaggcgaaggaggaacttgctgctcgcctcaggtcactaccccagccgaagaacgattatgaaattgtggttcccgaagatgaagtttcatcggaaacgactgcagagggtgctggtttgccaagtgttgaagatcaagctgatattgatgctagaaatttgagtattctcgctcaacaacgtgaaaaagaattgaagagtagatcgcaggtaattcagcgagctttgccccgacctggagatatcaacatagtattacgtccagctaatacagatccacctttaacagaacttcagaaggctgaagagatgataaaagaagaaatgataacgatgctacattacgatgcggtgcatagcggtgaacctccttcctcgaggaaaataggaaccgtgagt

SEQ ID NO: 3473 - DNA, 344 bp, Piezodorus guildinii
ggtatgttgcacatcctgataaactgaagaaaaaaattacaagagagttaattacaaccattttggctaggaaacctaaaatgtgtagctttttggaatggaaagatttaaaaatagtgtataaaaggtatgctagtttatatttttgttgtgctatagagcaaaacgataatgaactgcttacattagaagtgattcatcgttatgttgaacttcttgacaaatacttcggaagtgtttgtgagttggatattatattcaactttgagaaagcatacttcattctagatgaactgttactcggaggagagattcaggaaacaagcaaaaagaacgtcctgaaa

SEQ ID NO: 3474 - DNA, 751 bp, Piezodorus guildinii
cattagtcaaactgcagcagctgtgaaacaggaattagatcaaactggaatccacgctcatgtttaccagcctccacgaaaactaaggagaagggtggaaataatgccagataacaaagcattgaaacctgacacagaaacattgggtattgatcttcataaagactcaaaatttttccaaagttggcaacaatttaaagacaataatgcttatatcaacaaagttcttgattggaaaatgaaatatgatgagagtgataatcctgtcattcgggcatctcgagtattcactgataaagtttcaagtgttatgggtggcctttttcagaaaacagaactttccgaaactctgactgagatatgtagaatagatccgaatttcgacagagctcagtttttgaaagattgtgagaaagatatcatcccaaatattcttgaagcaatggttcgtggagatttagacatattacaagattggtgtcatgaaggtccatataatgttcttgctgctccaattaaacaagcaaaagaagcccactttcaattttgttctaaaattttagatattgataatgttgatctggtaatgggtaaagttatggaccaaggaccagtgttagttattagtttccaatctcagcaattactgtgtatcaaagataaaaatggtaatatagttgaaggtgatccaaacaaagttttaagagttaattatgtttgggttctttgtagagatccatctgaactggac

SEQ ID NO: 3475 - DNA, 650 bp, Piezodorus guildinii
atactgaggcattgcaagaagcttttgcccgaggggatctcaagcccggtcttaatataccagtcaaagatagacccaggacaaacaatgttcctcttctgatggaagcattaagtgaaattaagcaggaactaccttggatcgaaagattagatgttacgaatgatcaggcacccttggccccagaacttgccctccagatcagggatgaagaaaaaggtcataatccgttggtgtacgatgagttgaagagagaaagtgtattctacaggcaggctcagaatgctgctttaaaagtcctaccgcagctgaaacagttaggccttagaactgaaagaccaggagactatttcgccgaaatggctaagtcagatcaacatatgcaaaaggttaaaggtgaagctatcaagaagaaacttatgatggaaaggattgaaaaattgagagaaatacgagcgcagaagaaagtccaaaaagctctccatgctcaagctaaagtcgccaaagtacagagtaagaagcaaatgctagatgaggtgaagaagtacaggaaaggggagaccaaaagcttagctttcctcgaacctggctacaagccaaaacccaaagccaataaatcccaaataaaacgacaacacaagaatgccaaa

SEQ ID NO: 3476 - DNA, 705 bp, Piezodorus guildinii; identical to SEQ ID NO: 3451

SEQ ID NO: 3477 - DNA, 697 bp, Piezodorus guildinii
gaatggccaatatgcgtatgcaacaaatgggacagatctttcctactggtggaactggaggctactttgttcctacattaccccagccgcaaagatttttcggtccagcccaaatggcccagatgcgccctcaacctcgttggccagcacagccacaagtcagacccagcacacaagccactgcatcaggcttccccaatatgcaaggtcctttcagaagcgggccacgaggccctggcgccgccggtggtggtggtggtccaggaagtgctgcagctgccgcggcagcaatgcgctcctctatcagtgctgccgcagctgcggtggctgccgccgggcgacccacagccaacgcagctgctgctgccgctgcagctgctgccaacccagctgttgcccgccaattggcccaaggagcttctcagggtgctccagtatctgtgtctgctcaaggccgtcctgcaaattacaaatataccgcaaacatgcgcaacccgcccccgattggaggtggcgctggagcaggtgcaggaggtcctccacaacaagcattgcacatccaaggacaggaaccgctcaccgcaagtatgttgtcatcagcaaacgctcaagaacagaagcaaatgctcggagagaggctattcccacttatcaggagcatgtatcccgatcttgctgggaagatcacaggaatgtt

SEQ ID NO: 3478 - DNA, 715 bp, Piezodorus guildinii
ttctatggatattggtggcgtttcagctcctcctccacctccaacgacatctgctcctgttgatcttttgggtctggattcacttcttggaggggtacctgaacccgttgtctctcagagtacaaccggtttgcttggagatatctttggtttgggaacagccgccgggcctacagcatattctccacccaaaaccatttggctctccagcgataggggtaaaggttgcgaaatatctggaacgttttctcggagaaatgggcaaatccaaatggatatgacttttgtaaacaaagctatgcagccgatgactggcttcgccattcagttgaataagaacagtttcggtgtgactccagccggaactctccaagttttgaacccactaccgcctggtacttcgcatgactgctcattgcccttagttacgactggagcagtacaaagaatggaacctttaacaaatctccaggttgctgtgaaaaacaacattgatgttttctactttgcttgcattatcccgatgcatgtatttttcactgaagatggacaaatggataagcgtgtattcctcgccacttggaaggacattccagctcaaaacgaagtacaatacacactgacaaatgttcagtctaatgctgatactgtcgttcaaaaaatgcaagaaaataatgtttttaccattgctaagcgaaatgttgagggacaggat

SEQ ID NO: 3479 - DNA, 377 bp, Piezodorus guildinii
tggtgaagtaggagctacatcctcccttgctcccaagatcggtcctcttggtttgtcccccaaaaaagtgggtgatgatattgccaaagctactgcagattggaaaggtctgaaaattacagtttgcctcacaattcaaaacaggcaagctgctatctcagttgtgccatctgcagcttccctcatcattaaagcccttaaagaaccaccaagagacaggaagaaggtgaaaggagttaaacacaatggtaacctcaccttcgatgaaatcctcactattgccaggtcaatgaggccaaggtccatgtctaggaaactagagggtactgttaaggaaattcttggcacatgccagtccgttggttgtacagttgatg

SEQ ID NO: 3480 - DNA, 777 bp, Piezodorus guildinii
aaacagaaccacttggaactgcaggtcctctggctctagcaaaagatattctttcatcgggtaatgagccattttttgttcttaattccgatattatttgcgaatttcctttcaaagaacttgtttctttccataaaaatcacgggaaagaaggtacgattgtagtgacaaaggtagaagagccttcgaagtatggtgttgttgtttataatgaaaagggttgcattgctagtttcattgaaaaacctcaagaatttgtttcaaataaaattaatgccggtatgtacattctcaatccttctgtattaagaagaatcaaactggaaccgacaagtattgagaaagaagtttttccgttcatggctgaggaaggagaattgtatgcaatggagttgaatggattttggatggatgttgggcaaccccaagattttcttacaggaatgtgcttgtatctcacatctctgcgccagaagtctcccgagaagttgtactctggccctggatgcatcggaaacgtcctggtccaccctacagcaaggataggcacgggctgttccatcggaccgaacgttacgctcggtcctggagtcattgtggaagacggtgtatgcataaaaaggtgtacagtcttggaaaatgccacaatcaaatctcattcttggctttccgggtgcatcgtcgggtggaaatctgttgtcggacaatgggttcgaatggagaacaccaccgttctcggtgagaatgtaaatatcaaagacgaactctacatcaacg

SEQ ID NO: 3481 - DNA, 670 bp, Piezodorus guildinii
tatattacattcgccaccgggagagtttaacgaagtttttaacgatgcaaggatattattaaacaacgatacccttttgaaagaaggagctctcggagtcttcgggcagtactgtaaagaccagctaacgcctgtgaagattaagaacagtgagtatccagttttaattacagaacataatgatcttggatccaacaggttttatgatgcaaggtcgaaacagtcatttaaatatgatccattaaggagggagacatctaattatgacacatgggatgctgaacctggtactgaaaagtggagatcagctttagaggttgaattagatgcatatatagctaaacacttcgaaagtggatctggtagtgtattttctaaaaaagaagatggtaaagtaagcttggttgcgtgcatagaagcccatttatttcagccaaaaaattgctggaatggttgttggcgatctcagtggtttgtgacaatagattctgataatgcagacgtgaaaggtgttttgaaaattcaagttcattattatgaagatggtaatgtacagctagtaagtttgaaagatattaatcaatcactcccagttgtcgacgaagagcagttaagtaaggctttaattaaaatattcgaagactctgaaacagagtaccaacaagcgata

SEQ ID NO: 3482 - DNA, 741 bp, Piezodorus guildinii
tcgtaaaaacgacccttcattcatcggaatattttacagtaagtgtaggattggacagttgggtctcaatgatgttgaccaaagagaaccaggagtttatttcaggatggaaagagatttgatatcaagaaaagacaaattcggcgtcgaaatgagggagcggctgaaatgggacatccgagagagtgttgttggctcagattcttttgaaccaaagcattcggttattgtgacttggaaaaatgtatcgtttgctggtggaattgaaaactcagtacaaacaacaaacacatttcaactggttcttgcaacagacgaagtgttcacttatgccatgtttaattatgttcaaattaagtggactacacacacggaagcaagaggagacacagtaaaaggggaaggcggtgtaccagcttacattggatttaatgccggcaatggtacgagaagttatgaatatcgaccatattctcagacatcaacaatcagagatttggttatgcgtggctgggctaatggtttccctggtagacatatttttagaattgatgaaaatatcctacctggaacttgcaacaaggatattgctggagcaagtttgcccctcgcatttgctcctgaaagtggcaatatgctaggtggtaccattgtcaatatcacaggaccttgttttgaacctaatatgaagatagtatgcagatttgacatgaaagctgtttatggaacagttgtggacag

SEQ ID NO: 3483 - DNA, 194 bp, Piezodorus guildinii
atcgagtctgattcagaacgagtaaacaaagtaatttctgaacttaaaggcaaaaatatcgaagaggtgatcgctgcaggaaaagagaagttggcttcagttccttctggaggtggcggagctcccgccgctgctgctgccgcacctgcagcagcctcccctgccaaagcagcagaggagaagaaggaagcaaa

SEQ ID NO: 3484 - DNA, 765 bp, Piezodorus guildinii
cgttcctctcctggttttaattgaagctgcgagagctggtaatgagaaggatgtcgaagagtacgcacttgtatttcaggagcatgctaataaactcgttgaggttgccaacttggcttgctccatgtccgggaatgaggacggagtgaagatggtgcgctacgcggcagctcagatcgacgccctctgcccgcaggtcatcaacgcagcccgcatcctcggggccaggcccaagtccaaagtggctcaggagaacatggacgtcttcagggactcctgggagtcgcaggtccgagtgctcacggaggctgtcgacgacattaccactattgatgatttcttagctgtctctgagaaccatatcttggaagacgttaacaagtgtgtgatggcgttgcaagagggagacggagactcattggacaggacggctggcgccatcaggggccgctctgcccgcgtggctaacgtggtcactgcggagatggacaactatgagcctggcatctacacagagagggttctcgaggccatcaaggtcctcagggagcaagtgatgccaaattttgctcaaagagtagaagttgcagtagatgctctttcttcaaaccctcctaaagatgtcgatgagaatgaattcattgatgcctcccgtttggtctacgatggcgtcagagaaattagaagggcagttctcatgaacaggacggatgaggaactcgatcctgaagaagttgagttagacgaacactacacgttcgaaac

SEQ ID NO: 3485 - DNA, 751 bp, Piezodorus guildinii
tcaagttggaacctctaagcagtctacaatgttcatgccacctacagcattgtctggtacaagtactccaaaaactacagcaacaggtactgcaacattgtttaatattacaactacaacagcttctgctcccatttccagtagttcagcaacaacatcagggttttcacttggttcttcatcagcagctagctctcagcagttcaaaccaccttctacatctcagccgatgcagttaaaaacaactgtatcaggtgcttctatgccattaactactggtttatcatccactggaggaaatacccaggcaactgccggcttgaattttggaagtaccgctaaatctacccctggatccactgtcttcagtcctgctaaaagttcactcccagctgcgagttctactacaacctcatccttaacattgccaccttcttctacaacttctctcactaattcattatcgaacaaacctgttactagtactggtgcttcgacttctcaacaaccaaataaccttacttttcaacaattagaagaattgattcttaataaatggacagccgaattgtacgaacaggaaaaagtgtttttaaatcaagctacacagatcaatatatgggacaaagttattaatgaaaatgctgaaaaattaactcaattacattctaccatggagaaagttaggaagcaacaagccaaaataaatgatgatcttgagatcatatttactcaccagaaagacttggaa

SEQ ID NO: 3486 - DNA, 438 bp, Piezodorus guildinii
gctggtaaaacaactcttctccataggttaaaagatgacagattggcacagcacgtaccaacactccatccaacttctgaagaactatccataggaaatatcagatttactacttttgaccttggtggacacactcaagctcgccgagtatggaaagattactttccggcagttgacgctattgtttttcttgttgatgcttgtgacacgagtcgattaccagaaagtaaagcagaattagatgctcttttaaccgatgagagtctcatcaactgtccagttctcattctcggcaacaaaattgatcttccaggtgcagcttctgaagatgatctcaggaattttttcaatctgtatggacaaacaactggcaagagcaaagttccacgaagtgaattatctggtcgtccattagaactattcatgtgttcagttctg

SEQ ID NO: 3487 - DNA, 688 bp, Piezodorus guildinii
acactgttcagagattgcataatatatcgccagacttcttaaaaatgccaatgtatcaaagggcagagcagaagtttgtttggaatgaatatcttttatctgaatttgcgcaaaactctggtgtctctaaattctgtcttcctatcatccatgggtatctctcaattacatcttgcattttaaatggaaaaacctttagtcttatcttggtctccagaagatccaaggaaagagctgggaccagattatttactagaggaatagattcaaatggaaacgttgccaacttcgtcgaaactgaacagatagttgaggctaaatttgaacgtgctagctttgtccagacacgaggttctatgccattcttctggcagcagtatcctaatctgaagctgaaaccacgacctgccataattcaagatgaaaatcattctgctgccttcagtaagcattttgaaacacagctgatggattacggaagacaagtcattgtgaatttggtcgaccattctggctctgaggggaagttggaagagttttatagaaagctagtgaacgaagcaaataatgctgatctgaaatatgaagcatttgacttccacagggaatgctcaaagctacggtacgatagattgaagattcttatagatcgtctggcctatgatttagagcagatgtcagtaacgat

SEQ ID NO: 3488 - DNA, 733 bp, Piezodorus guildinii
cgtgtaaagtactgcaacactttgcctgatattccatttgatccaaagtttattcaatatccatttgaatctactcgattcattcaatataatcccacttcactggaacgaaattataaatatgaagttcttactgaacatgatcttggggttactattgatctcattaacaaagacatgtatgctgctgatcacaatgcagttcttgatcctgctgatgagaaactacttgaagaagatatccttacacctcacgattctaaaaggtctagacatcattctcgatcagtttcatggcttcgtagaactgaatatatttccactgaacaaacacgtttccagccacaagttatggataaagttgaggctaaagttggatttagtattaagaaaagtctcaaggaagaaaccctttacatggatagagaaagccaaattaaagcaattgaaaagacatatgatgatgctaaactacctatagagaaacatcatagtaaacctaatgttgttccaattgaaattcttcctgtctttccagatttccagttatggaagtacccttgtgctcaggttatgtttgattcagaccctgcacctataggaaagacagtacccgctcagttagaacaaatgtctcaagctatgatcagaggtgtcatggatgaaagtggtgaacaattcgtagcttatttcttgcctactgattcaactttagaaaaacgcaggagagatt

SEQ ID NO: 3489 - DNA, 733 bp, Piezodorus guildinii
aagagcacgagaattcagttattgaagatgaagagcaagtgagtgggctatggcaggcaaagttagactacttgtgtagcattggggacaaggaaaatgccagtacattagccaatagcaagcttcaagacaaaacagtgcctaagactcatcgtatcgatgcagtttttgcattatttaggttatcatatttccacggttgcgatatcaaaggcatgtcttcagctattgagaaagctaccgaactgattgaagggcaaggcgattggagttcaaggaataaattgaaagcatatgagggagtgtggagttttgctgtaagagattatctacgggctgcaaagcttttcgttgatgtcgtacccactttcgaatcttacgagcttgctgacttcggaactatcattaaatacaccgtactctcgtgtatgatagcattgccgaggtgtgaattgaagaaaaaactcatgcaccacggtgttatggcccaagcacttcactctcaatatcgaaacttgaaggagtacttccagtccctttacgatggtcactacgcagacttccttgtcgctttggcacaggtggaatctgatatgaaacgcgaccctctccttcatccgcattatcgccactatgtacaggaaatgaggcttagggcctacaagcagatcttgcaagcctatcgctcactctctttggactatatggcagaagcatttggtgtttcttgtga

SEQ ID NO: 3490 - DNA, 683 bp, Piezodorus guildinii
ggtatgttttgggcctctaaagaaaacggcccgattcccagtccacctgaaggctttacattatacactagggaaagtggaatagttgtcctgaaaagaataaaaaagagaaatcttcaaaggcttggcattggtggtttcactactgtcaaaatgagaagctccagattaaaagaagatgatgaacatctataccctgaagaaaaacccaggaggaaacctcgagttccaaagaagaaaagcaaaattgctgaaagttatcctaggcatcttcaggaagctttttttggcaaagaattactagatacaactaaagaaacttcgcaagagttagagagcactggtgatgaatcagatgatggcaaaatgagggaggaagaaggtagcgatggtgaaacgttgaaggatattctacatctccctgaaaatcttctccacaatgatctagtcaacacaatcatgaatgaaagtgcagatagtatcaaatcagaaaatcttatgtcagagagtgggcacgaaggtagcagcagccaaaaagacgaactatgtgatattcttggacctcatttcaatatagaatctatggtgagggaaacaggtcttccaaatatggattccaaagatgttgaagaaattttcaaaggagttcttactgatgaggctcgtaatcaggcccatcataa

SEQ ID NO: 3491 - DNA, 700 bp, Piezodorus guildinii
tggttgatgtaccagttgagacttctcctattaagattaaagaggaaccaatagatgtcgatgagattcaagattacagttgtgatatgttcagtgacgactttgatcaagaagttattgaaatttctgatactaaagataatgaagtatgctcaagagatattaaagtagaacctgcttctcctgtaaaagatgcatctccagttaaaatggaaattgttaaagatgaagtaagtgaagagtgggacaagcaaattgaatttgattctcctgtaacttatgtcaatgtcgataaatctaaattacccctggtgaaaaatgaaagtggtcaagaggttttaagattctactattgggatgctgcagaggaaatgtactcacaaccagggactgtatttttctttggaaaaattctaattgaatcagctaatacttatgtaagctgttgtgtctcagtaaaaaatattgaaagacgtatatttcttctgccaagagaaaggaaaatgaatcttaagactaatgaagcatatggtgatcctgtgacaatgacagatgtttatcaagaattcagctcaactgtagcagagaagtataaaataaagcagttcaaatcccgaaaaatttccaagaaatatgcttttggtgatagtaacgttccttcagagtctgagtatctggaaataaggtatccgtgcacttc

SEQ ID NO: 3492 - DNA, 740 bp, Piezodorus guildinii
atggctggctctgaaatttacagtctcgaaatgagtaaaactgaagcccttacacaagccatacgtaagtctattggtatccggataaaagaagaaacagaaatcattgaaggtgaggttgttgagatacaggtagagcgacctgctacaggggtcggtgccaaggttggaaaacttacattaaagacaacagaaatggaaactgtttacgaccttggaaataagatgatagatgctcttactaaagagaaggttcagtcgggtgacgtaattacaattgataaagctaccggtaaaattagtagaattggaagatcatttactagagctagagattatgatgccactggcccccagacgaggtttgtccaatgcccagaaggagagttacaaaaaagaaaagaagtggtacatactgtatctattcatgaaattgatgtaatcaattctcggacccatggattcttagctcttttctcaggtgatactggtgaaatcaaaccagaagttagggaacaaatcaacacaaaaattgctgaatggagagaagaaggaaaagctgaaatttcacctggtgtattgttcattgatgaagttcacatgttggatatagaatgtttttcatttttaaatcgagcccttgaagatgagatggctcccgttgttattatggctacaaacagagggatcaccaatatcagaggaactaattacacatcaccgcatggaatacctattga

SEQ ID NO: 3493 - DNA, 735 bp, Piezodorus guildinii
actcagagcttcagaagttgaagatatcattgagggtaatgatgaaaaatacaaagctgtttcagtccattcttctgagacgcctattacaagttcttctaaacccaagaaagctatgccatgggtaccttcgcttccaaacagttctcatttagatgctgttccacaggcaactcctatcaataggaatagagttgttagcaagaaagttagaagtttccctctctgtttcgatgacactgatccatcatctatcatggaaaatgcttcccaaatggaagttctcgtacctattcgtctcgacatggaaatagaagggcagaaacttcgtgatacttttacctggaacaaaaatgagagtttgataactccagaacagtttgctgaaattctttgtgatgatttagatttaaaccctctcagttttgtccctgccatagcacaagcgattcgccagcaaatcgaaggttttcccactgataatattttagaagattcgagtgaccaaagagttatcatcaaactgaatatacacgtcggaaacacgtctctggtcgatcaaatcgaatgggacatgagtgaaaaagagaacagtcctgagcagtttgcgatgaagttgtgcgctgaacttggattaggaggagagtttgttacggccattgcttattcgattcgaggacagctcagttggcatcagaaaacgtacgctttcagcgaatctccccttcaaactgt

SEQ ID NO: 3494 - DNA, 534 bp, Piezodorus guildinii
gtgatggctgctatacgtaaaaaactagttatagttggggatggtgcttgcggaaagacttgtttgttgatagtatttagtaaagatcaattcccagaagtatatgtgcctactgtgttcgagaattatgttgctgatatcgaagttgatggaaagcaagtggagctagcattgtgggatactgctggacaagaagattacgatcggctaagaccactttcttatcctgatacagatgttattttaatgagtttttctattgattcaccagattcattagaaaacatacctgaaaaatggactcctgaagtaaaacatttttgcccaaatgtacctatcattcttgtaggaaataaaaaagatttgcgaaatgatccaaataccatcaaagagttggcaaaaatgaaacaagaaccagttaaacctgaagaaggtagagctatggctgataaaattaatgcctttgactatcttgaatgttctgccaaaacaaaagatggggttagacaagtatttgaaacagcaactagagct

SEQ ID NO: 3495 - DNA, 683 bp, Piezodorus guildinii
agtgtcgatgtcatctaagcataatggtctttatattttccttagccgaatgcttagaccagtttggttaagaagagttttagatgtcaattacaataaaaaacctatttatctaccaaccattacttgtgaagaactcagtttaaagacagttcaactttttgagcttcgttcatttcttgcaagatacaccttaagctcatcagacgttggctccagtttgcagccagccaacaatacaactgtggtttctccaagtggtcagcgcactcgccttcaagaagcactcattcaagaaaaagcatcgcttgatgccttaaggaatttcgttgagcgaatcacccaagttttctctctttggaaattattatgtgatcatgaattgcctctgattgtagaatctctttctccggaaagtcaagaccaattaatacatattacatttagagaactaattcttaaaggagaagatttatgtcatgagctcatttcaaaattagtcagtttatatttgaatgacaatgcttccgtcgatccaatcagttcaaagctgagagaagtttgtcctcttctttataaaaatgaagatgcaacttgtacaaaagtcaatgaaattcttcaaatggcattggaggaaattgatgaagaagccaagttgaacctgttacgatccgcaattgatc

SEQ ID NO: 3496 - DNA, 661 bp, Piezodorus guildinii
gcttttaggtgttggaatcgattatattcatgttgcagtcagtatattatttcaagtatgcttccactaggaatggtttggcttggagattacttagttttaattcaagaatgcggtttctcaatagttgttgatattgagccattagaactttttatgacaactggtgtaaagtcctcacaatttccacaagttggatatggctggttggtggaaagactgagggatattaatttagatccaggtattgagaagttagaattgagtcttcataccggagaatcaattgatgaactttctgttcttcaagaagctgctgatctcatttcaccttctaaacagcttgatgatgctctaagcatgttttatgaggaaggcttaagcagaagtttaaacagtcttattgaagaattagctgtgcctgaagattttaataaagatggatcttgggaatcattttgtagttatagtggtgttggtgctgtaacatctgcatttcgagactatgttgctgtgagattaaagatttgtgaaaaaatattattaattactgaactcgctatgagggatgatgatggtgctgcagataggactcaacataggagcttagctgccctttgtaaagcctattatattttaaaatggatctgcacatcaaagt

SEQ ID NO: 3497 - DNA, 696 bp, Piezodorus guildinii
acgcagatcttgaactctttgaagataacccggaggagtacattagaagagatattgaaggttccgatgttgagtcaaggagacggtcatcgtcagagcttgtcaaagtgctcgcaggtcacttcccagaaactgtcaggactatttttggtgctaggttacaggaaatgctcgctgaatacaatagtgatccagctaaatggaggttgaaaaacacagctgtatacattgtgacctctctggctgaaaggggttcaacggcaaagcacggggtaacaaaatcctctgaccttgtggaccttcatgattttgcagggcaatatattattcctgagctcaaaaaagatttgaatacgttgcctgttatcaaagcagattctatcaagtatcttatcacctttagaagcctccttgctccacaggtgctgataactgctttacctgatatagtgaagcaccttgcatctcccagccttgttgttcactcatatgctgcatcggctatcgacaagttgttgacactgaaacagaacaatcaaccattaataacacagaccctactgcagccgattgctggagatatcctcactggtctttttaatattctaaacttcaagggctcagaagagaatgaatacgttatgaaagctataatgagatctttcaacaccctggacgagtccgttattccattct

SEQ ID NO: 3498 - DNA, 465 bp, Piezodorus guildinii
gaatccgtttcaattcgaacttacattcgaatgtatcgaagaattgaaagaagatttagaatggaaaatgatctacgttggctctgccgaaagtgaagaatatgatcaagttttagacacaatttatgtgggtcctattccagaaggaagacataaatttgtctttcaggcagatcctcctgatgttactaaaatacctattgaagatgccctaggtgttactgtggttttactaacttgttgttatcgtggacaggaatttgtgcgagtaggatattttattaataatgaatattctgatccagagttgagagagaatcctcctccagtgccgcagtttgacaaggttgtcagaaacattttaggctctgaaccgagggttacaaggtttaaaatcaattgggatgattcagaatcacaagatcaacctagtcaagaatcagaagaacaacaacagacaacaga

SEQ ID NO: 3499 - DNA, 772 bp, Piezodorus guildinii
tgtccatcaacctgaagaagatcaacaaatattgcctatagcacaacagcagcaacaacaacaaatacaaccacctttgcaaatgccccctttactaccaatacaatcttcaattaatcaaccaaaacctatgaacacttatgccccttcaatgggttttacaacaccacagagtatgatgcatccacaaacaccacaaaatctcatgtcaccaatggtgaatagaatggaacagacgccgaacaatattataaatcccaccactcctggaccaatgacacccatgacaccatcatcggcagaccctggctttatgccgcagttacagaatatagtatctactgttaatttaggttgtaaattagatcttaaaaagattgccctacatgcaagaaatgctgaatataatcctaaacgatttgctgctgttatcatgaggataagagaacccagaacaacggcactgatttttagttcaggaaaaatggtttgcaccggtgctaagagtgaggatgattctaggctagcagcaagaaaatatgcccgaataatacaaaagttgggattccaggcaaaattccttgacttcaaagtacaaaatatggttggtagttgtgatgtaaaatttcctataaggttagaaggattggttttaactcatggacagtttagcagttacgaacctgaactgtttcctggacttatttatcgaatggtgaaacctcgtattgttttattgatatttgtatcaggaaaagtcgtactcacaggt

SEQ ID NO: 3500 - DNA, 343 bp, Piezodorus guildinii
gagatggcattcacatttgctgcagcaaataaggttttctatgccaattccaatgtgaagcaagttgacgtgccctctttcagtggagcatttggtatccttccgaagcacgttccaactcttgctgttttgaaacctggcgtcgttacagtttttgaacaagacggttcatccaagaaagtttttgtttccagtggaacagtcacaattaatgaagactcctcagtccaagtgctggctgaggaagcccacccagtggaggacctggacgcctccgcggcgagggagcagctctccaaggcccaggcagatctgtcgagggcgacctctgagatcgagaagg

SEQ ID NO: 3501 - DNA, 696 bp, Piezodorus guildinii
agatgctgctagatctttggttatagattcatttgagaaatatcagtcaaaagcgaatttggccgcagaaaggaaaagaacagaaaatgccgaagctgaaaagaaaaggaaagaaaggctcgctgctaaagccactcctaaagtgatggaaataagcgatgaagaagcacaaaaaattgaagatgaagaaaaaaagaggaaagaagaagaggaaaaagctttgtcgaaaccaattacagaaacagaaggtgaagatgatgaacaggacaaaggaaaactaatgccaaatgctggaaacggtgcagatcttgagaattacaggtggacccaaacacttcaagagttggaaatacgggttcctcttaagaccacattcactgtaaggtcaagagacttaatagtagatctgggcaagacacatctgaagataggattgaaagggcacgaaccacttgtggatggcgaattagagcatgaaatcaaaattgaagaatctacttgggtcattgaagacggcaagacgctgtttctgacagttgaaaaagttaacaaaatggagtggtggtccaagctgtttgctacagatcctgaaattgccacccgaaaaattaatcctgaaccgtcaaagttatctgatttagatggtgaaacacggggtttggtcgaaaaaatgatgtatgatcaaaggcaacgtga

SEQ ID NO: 3502 - DNA, 289 bp, Piezodorus guildinii
acccagcttatttgaacagtaaaaagactcgtgctgaaggtagaattgtcgcaaaagaaaaagctgtagaaaatccaacctaccaagaaataagggatgtgttatcagcagctggtttgaaagttggtgttgaaaacaaactttattgtcgagagaagagtaaagagcttctctatagaggtagaatacgggttcagttaaaaaatgataatggtactcctctcaacccagatttcgctaccagagaatctgtaatacttcatgcatgtgcaatgattccaaagctgaa

SEQ ID NO: 3503 - DNA, 700 bp, Piezodorus guildinii
catcgaaacatcaccctttggttaaaatacactgaaatggaaatgaggaatcgtcaaatcaatcatgcaagaaacctttgggatagagctgttacaatacttcctagagcgaaccaattttggtataaatatacttatatggaggaaatgcttggaaatgttgctggttgcagacaagttttcgaaagatggatggaatgggagccagaagaacaggcttggctaacttacattaaatttgaattacgttataaagaaatagaaagagctagggaaatttacactaggtttgttatggttcatcccgatgttcaaaattggaaacgatttgcaagttttgaagaaaggcatggattcatttctggtgccagaaaagtttatgaaagagctgttgaattttttggagaggatattatggatgaacgtctatacattgcttttgccaaattcgaagaaggacaaagagagcatgatagggcaagggtcatttataaatatgctcttgatcatcttcccaaagaacgaactgctgaaatatacaaggcctacactattcatgagaaaaagtatggggacagaactggcattgaagatgtaattgtgagcaaaaggaaataccaatacttggaggaagtaagaacaaacccgaacaattatgatgcctggtttgacttattgaggcttgttgaagaagagggta

SEQ ID NO: 3504 - DNA, 685 bp, Piezodorus guildinii
ttacttgacgaacttctgcagaagggttatggtcttggctctggaatctctctcttcattgccacaaacatctgtgaaactattgtgtggaaggcattttctcctgctactgtcaacactggtagaggcacagagttcgaaggtgctgtcattgcacttttccatcttttggctacaagacaagacaaagtccgtgctctgcgtgaagctttctatagacaaaatcttccaaatttaatgaacttgctggctaccattcttgtgttcgccatagttatatatttccagggattcagggtagatcttccaatcaaatcagctcgttaccgtggccaatacagcagctatcctatcaagctcttctatacttcgaacattcctatcatccttcaatcagctcttgtatcaaatctttacgttatatctcagatgctggctgtgaaatttcatggaaatgtatttgttaacatgctcggagtgtgggccgatgttggaggtggtggccctgcccgagcttatcctgtcgggggtctttgttattatctctcgcctcctgaaaatcttggtcacatcctggaagatcccattcacgctatgctctacattatttttatgcttggttcttgtgctttcttctccaagacttggattgaggtttctggctcatcagccaaagatgttgcta

SEQ ID NO: 3505 - DNA, 372 bp, Piezodorus guildinii
caagagcgaacaggaagagaccctgctgcactcctccacgctctatgtcggcaacctctccttctacacgacggaggagcaaatcttcgagctcttctccaagtgcggggacgtgaagaagatcgtgatgggactgcacaagttcaagaagataccctgcggcttctgcttcgtggagtactacgagaggcagagcgccgagggggcgatgaggtacgtcaacggcacgcgtttagacgaccggatcgtgcggacggattgggacgcagggttcgtggaggggaggcagttcggacgaggccgcagcggaggccaggtgagggacgagttcaggagggactacgacgcggggcgaggaggatacgggaagat

SEQ ID NO: 3506 - DNA, 682 bp, Piezodorus guildinii
aacattttcagattggcagcttttctactactaaatcatggtcaagagggaagaaagctttgtatacctcactcggtattttaactggaggtacaggcatgttgatatatgcccttgaaaaaagtcttcaagcaggagatcttgaactccatcctcccaaacttccttggaaccatagtgggtattttcaagcactggatcatgcaagtataaggcgaggttatgaggtgtacaagaatgtgtgtgcagcctgtcacagcttaagatatgtttgctatcgagatcttgtaggtgtttcacacactgaagcggaggctaaagcagaagctgaagaacaacttgtattagatggtccaaatgaacttggtgaaatgttcaaaaggccaggaaaactttctgatcatatgcctagtccatatccaaacgaagaggctgctagagcagctaataatggagcatatccccctgatctttcatatatagttcctggacgtcatggagaagaagattacatattccacttattaactggctactgtgatgctccagcaggtctggttttaagggatggccagtatttcaatccttattttcctggaggtgccattagtatggcacaagctttatataatgagattattgaatactctgatggaacgccagccactcaaagtcaattagc

SEQ ID NO: 3507 - DNA, 704 bp, Piezodorus guildinii
gctttaccacctgttgagtacaatccgctgaaattcattaaacctggttgcactgagatgactgtaaatcttaaatatgaagaactgtttgctgctgatgttgggcctgagaatccatatcttacagatcaacaaaaggctcccaaaaatattctctcaggttatgttgaagcagctcatatgagcgaatttcagtttgaaaatcagaggaaaacttttcaaagtttcggatatgctcttgatccttcgattgataatatgggtcgcagcgaagacggtatacccgttgtaggagcagtagaagttgcgaaggaaaccaatctcaagacagtttttgaatctacttccaagcgacctcttgatagaaggaaaagaaacaaaaacgacgatccgtctgatatcaatggcttcctcggcccgtgggggtcttacgttgatgagaagaaagttgttaaaccagatcctgaagttgctgctgaacttgaagaatacctcgctaagaggcaaaagctcggtaaaaaagttgaagataaacctctggaagagaagactgtccttcatatcaaagacccagtggattaccagggccgcaacttcttgcaccctcctcaggatgtcggcgtcaacctcaagtcagactctcctccggacaaatgtttcatccccaagtcagaaatacacgtttggaaaggacataccaaagg

SEQ ID NO: 3508 - DNA, 681 bp, Piezodorus guildinii
aaaagcaggaggttcagaaagttgtgaatcctctgtttgagaagagacccaggaattttggcattggtcaggatattcaaccttctagagatctaagtcgatttgttagatggcccaaatatattcgtattcagcgacagaaatctgtattacagaagaggctgaaaattcctccttcaattcatcaattttctcaatcattagataaacaaacagctacccagttgttcaagattcttgaaaaacatcgacctgaaactgcactggccaagaaacagaggttgaaggccagagcagaaggaaaaattaaacaaaaggaagaggttccaaccaaaaagactaatgttattaggtcaggtgttaatactgttaccagattggttgaacagaagaaagctctgcttgttgtgatagctcatgatgttgatcctatcgagctggtgcttttccttcctgcactatgcagaaagatgaatgtgccatactgcattattaaaggtaaggcacgccttggcaggttggttaggaggaaaacctgttcttcaattgcagtaacccagatggagggtaatgatcgtactgctttaaataaggtcattgaagctgttaggactaactacaatgaccgatatgaagaaattaagcgacactggggaggtggtttgcttggctctaagtcag

SEQ ID NO: 3509 - DNA, 790 bp, Piezodorus guildinii
gtacaacagagcacttgagaatgtctggtatgtactggattttaacaactttagcagttaccaagaagttagatgaagttgacaagaagcagtttattgactttatacttgaatgcactgatgagaaaacgggtggtattggtgcttgtgttggacatgatcctcatatcttgtatactctgagtgctgttcaaattgcttgtattttaaggtcattagaccaacttcccctagaaaagattgttagttttgtgtcaagtttacagaaagaagatggcagttttatgggtgataagtggggagaagttgataccagattttctttctgtgctgttgcttgtttatctttgatcggtcgcttagatgctatcaatcttgaaaaagcagtcaattttgtgttaagctgtcaaaactttgatggcggttttggttctcaacaaaattctgaaagccatgctggattaatctactgctgtgttggtgttctgtcaattacccagaacttgtatagaatagatgctgatcaactgggttggtggttatgtgagcgtcaactgccttcaggtgggctgaatggaagaccagaaaagctaccggatgtttgctattcctggtgggtcttgtcttcattaacaatgttaggaagactacattggattgataaacagcttttgaaaaaatatattcttgctagccaagattctgaaggaggttttagtgatcggcctggagatatgccagatcccttccatactctttttggaattgctgctttgtcactgttaggaga

SEQ ID NO: 3510 - DNA, 689 bp, Piezodorus guildinii
cgtttaaatcaggttctggccatggagcaacagattcaaagccactcagatagagcgcagtttaatgatctccagtcactcctctgtgccactctccagagtgttctaaggaaaatgaccccagaagatgcaccccaaatatctgatacaattatgaatgctcttcttcaaatgttcaattccaattcatgcaaatcaggttcagtgcaagaagatgcgataatggcagtctcaacactagttgaagttcttggtgatggctttataaagtatatgccagcattccaaccgtttctgtgcatgggcctcaaaaatcatgctgaatatcaggtttgttgtgctgccgtgggtctcactggagatatatgtcgggcattgaaaaacaaagttcttccatattgcgatgatattatgcggcttctccttgaaaatctcagtgataacagtgttcaccgttctgtaaaaccacaaatcctatcaacttttggagatgttgcattaagcattggtgctgattttaaaaagtacttggatgtagtacttcacacacttatgcaggcttctcaggcacaagttgatacgagtgacttcgacatggttgattggttaaatgaattaagggaaggaattgttgaagcctactccggtattattcagggattgaaaggggaagataacaacacagctgc

SEQ ID NO: 3511 - DNA, 718 bp, Piezodorus guildinii
gatggatgcaatggtcaaagagatgttgcataaaaaatcaagttatcgtgagcaaattaactcagatcacagactcaagatgcttcttgatcagtatatggagagcactcacaaactcaaggaactgtatgaagacaaggatggtataaggaaagatgaagttgctgcactttcaggtccaaatgaattttctgaattttattcaaggttgaagaccattaaagaattctatcgtagaattcctaatgaaatttcggttcctatgtctgttgaattcgaggagttagcgaaacttcgagaaaatcctactgaagaaacatcaaatttagtagaatttactgacgaagaaggatatggaaaatatctcgatcttcatgaatgttatgagaaatatatcaatttgaaaggagttgagaaagtggattatatcacatatcttactacatttgatcgactttatgaaatcccaaaagatagaaagagttctgagtacaaacgatatgttataatgctcctgaattatctttgtgattacatcgctaggatcaagccactacttgacctcgaccaggaattaactaatgttcaaaaggacttcacatcacagtgggaagctggaactttccctggttggcctaaagaaacaggcagtgtgttaagcaatgttggtgcccatcttgacttgagtgcattttcatctcctgaagaattggcttct

SEQ ID NO: 3512 - DNA, 487 bp, Piezodorus guildinii
ttgcaagattcaaggacattcataggcacctttaaagcatttgataaacacatgaatcttattcttggagattgtgaagagtttagaaaaattaaaccaaaaaataccaaacagccagagcgagaagaaaagagggtattaggatttgtattactaagaggtgaaaatattgtttcacttacggttgaagggcccccacctccagaagaaggattgcctagagtacctcttcctggagcaggtggaggaatcggtacggcaagacctgctggacgtggagttccagcccctggtactccagctgcacctggtcttcaaggaccagttcgtggtgttggaggcccatctgcacaagttatgactccagctgggcgaggcggacaagtttcagcacctcctcaaatgcgtgctccacctccaggaatgcccccaatgatgggagctcccccaatgatgaatatggcacctggaatggcaatgggtagag

SEQ ID NO: 3513 - DNA, 736 bp, Piezodorus guildinii
tttgggccaaagatttgttcctccaacgtcccagggttagagaaaccggaatttccgaagtattagaaagtgatgattttaaacttatgaggattacgcctgatgcattttataagttacttaagatggtgcggcctttaattaagaaaaataatactgttatgagagaagcagtcactgaggaggaacggttaattattactcttaggcatttagctaccggtaagagctatgctgatttgcaaaacagtactgcagtttctccatcgcttatgacttcagttattagagaaacttgtgacgctatttatctcagtctcaaaagtggaataaagatgcctactacagaacagcaatggcttgaggtcgctgatggttttgaaaagaagtggaacttcccgcattgcctgggctcttttgatgggatacacgtggcgataaataaaccagcgcatagcggtgcaatctttctcaactacaaaggatatccaagtgtcgttttgttggcacttgttgatgccaattatcagtttatgtatttaaacactggtgcaaatgggagtgcatcaggttcaactgtgttcgaaaacactattttttaccaaaaatatctgtcaggaaagctaaacttacctaaggacagtccactacctggtatggaagaaaaagtcccctatgtttttctgggagattgtgcattttcccttgatgaaaattgtatgaacacatttccggt

SEQ ID NO: 3514 - DNA, 737 bp, Leptinotarsa decemlineata
ttttgtcaacattcgtgtggaataaaaaattatcaaaggaaggactaataggtgtcagccacgaagaaatagaagcaagaaacagattcaagcaagaagaaaataaaagagaacttgagaaggtcaagaagagaagacaagaaagagaattagaaagacaaaagagggaagaagaaacacaacttttacagaggagtaaagaagcggcacaatttgaggagtgggagcgtcacgaagatcagtttcatctagaacaagctcgattgcgttctcacattcgaattcaggatggaagagcgaaacctatcgacctcctcgccaaatatataagtgctgaagaagaagtggatgcggtagaaatgcatgagccctatacatatcttaatgggctacatattaaagatctcgaggatctcgtagaagatataaaagtttataaagagctggagagaggaaaaaatttggattactggaatgacattactgtcattgtggaagatgaattacaaaaattgcgaaaactagaaaaacaagacgattttgatatgggtttgaacagacgtgaaggaattcatcaagcagttgcatcggatgttacttccatattcaaagggaaaacagcagttcagttggcagctttggagaaacaaatcgaggccaaaatcagtagtagagcagatggaattgatattggatattgggagtccttgttatctcagttgaaagctcatatggca

SEQ ID NO: 3515 - DNA, 686 bp, Leptinotarsa decemlineata
ggtgaggttggtcaagtattatcattcaaacttgtctttgatcgtgaaaccggtaaaccaaaaggttatggattctgtgaatatagggatcaagaaaccgccttgagtgcaatgagaaatttgaatgggtatgaaataggaggtcgtaacttgagagttgataatgcttgtacagaaaaatctagaatggaaatgcaaaatctgctcaatcagccacctgtagaaaatccttatggggagcctattcaagcagaaaaagcacctgaagcaataagtaaagctgtagcttctctacctccagaacagatgttcgagttaatgaagcagatgaagacaacaattcagaataatccaacagaagcaaggcagatgcttttgcagaatcctcaactggcttacgctcttcttcaggctcaagttgtaatgaaagttatcgatccgcaaacagcagctagcctattgcatcccatcaatcaagttccagcgactctgatgcctggtgataagaatgttccagttcaggttccaattagcaatcaatatagagaacctcctgcaccagtacagccgcccaggcaagaatttcagccagtaccagcgccagttttacatccaagtgcccagccttcagtgtttgcaggtcaagacatagatctaagatctattggaggctcaacagatctaag

SEQ ID NO: 3516 - DNA, 523 bp, Leptinotarsa decemlineata
gtttccagtgcaattgttgataaatacattggagaatctgctagattgataagagaaatgtttaattacgctaaagatcaccaaccttgtatcatttttatggatgaaattgatgccataggtggccgcaggttttctgagggaacttcagctgacagagaaattcaaagaaccctgatggaacttctaaatcagatggacggatttgattcattgggacaggtaaaaatgataatggccactaataggcctgatacattggatcctgctttgctccgcccaggtcgtttggatagaaaaattgagatacctctaccaaacgagcaagcaagacttgaaattcttaaaattcatgctttgcccatcgccaaacatggtgaaattgactacgaggcaattgtcaagctatctgactccttcaatggagcagatttgagaaatgtgtgtacagaagcagggttgtttgcaatccgggcagaaagagaatatgtaattcaggaagatttcatgaaggcagtgagaa

SEQ ID NO: 3517 - DNA, 634 bp, Leptinotarsa decemlineata
gcaatggaagctatatcccatgctggtacctgtctcggtattttagctaatgatgggattttattagcagcagaaagacgcaatacaaataaattattggatgaggtgtttgcttctgaaaaaatatataaactgaatgaagatatggtgtgtagtgttgctggcataacatctgatgccaatgttttaactaatgaattgcgtttgattggacagcgatatttattccagtatggagaatctatcccttgtgaacagttagtatcatggttatgtgatgtcaaacaggcctacactcaatatggaggaaaacgtccatttggtgtttcaatattatatatggggtgggataaacattatggatatcagctctatcaatctgatcccagtggcaattatagtggttggaaagcaacttgtattggaaacaatagttcggctgccatttccaacttgaaacaggagtataaagaaggagaaatgacactaaaggatgcaaaatctctggctataaaagttcttgtcaaaactttggatatggctaaacttacttcagaaaaagtggaaatggctactttatcacgtgtgaataataaaacagtaatcaacattttgagcagtacagaagtggaaa

SEQ ID NO: 3518 - DNA, 677 bp, Leptinotarsa decemlineata
atttgggaaaacaggaaggtatagatactattattgccactttggaagtcatacctgaacctttccggtcgatggctacaacaatggtggacatttgtgcctacgctggaacgggaaacgttctcaaagttcagaatttgctgcacatttgttcagagcattatgaaggctctgatagcaccgacaaaagctccaaagataaggacaaaaaggaaactgttaaagaaaaagatctatctaccaggcaggctgtagccgtacttggtattgcattgattagcatgggggaagatattggcagtgaaatggctttcaggacatttgggcatttacttcgttattgtgaaccagcgattcggcgagctgtacctctggctttgggactcatctccgtgtccaatccaaagttgggcattctcgacaccctcagcaagttttcacatgacagtgatgcagaggtcgcccacaatgctattttcgccatgggattggtcggagctggtactaataatgccagactggcagccatgttgaggcagttggcacaatttcatgccaaggacccaaacaatttgttcatggttcgcatcgctcaagggctcactcatctgggcaaaggaacacttaccttaagtccttatcacagcgataggcaactgatgagtcctgtagctgta

SEQ ID NO: 3519 - DNA, 682 bp, Leptinotarsa decemlineata
tgacttggaacatcaaggagactacactaacttgcagactgctcagtacaataacggatacaccgatgcttcgcagtatatggaacagcatcagtaccagaccctgtacactgagagaggagccgtggatagttctccaccggttttgtataggaacgatcccaatttggggtcttctaggtatcaaggcgactacgaaccgtccacgcaaacccaagtcagcctcctcaacccgtccagcgaaaccgtctactccacatttccctccacgagcagcgccacctaccaccagttctaccagaataaccccaacgtcctgcacccagcggacagcacccaggcgtatgggggggcgtacgtgaatacggcctggtccagtggcggcggcttggacgacgggcaccgggccagtcaagagatcggaaacagacgaaacggagttcagtgtgccaactgcaagacaaatacaacaactctttggcgacgaaataatcaaggggaaccagtatgtaatgcatgtggactatacttcaaattacacaatgttaacaggccgatcagtatgaaaaaagaaggcatccagacacgtaaacgaagaccaaagaattcttccagcgtttctagcgcaggagcatcgaatcaagttagattggcaccttatatgggttacctacaagtttcg

SEQ ID NO: 3520 - DNA, 691 bp, Leptinotarsa decemlineata
ttacactttgaagaggctcccaatttggaaaaacaagatacaggtctcttaagctcattatattcctacatggtttcagctgaaaatctctcgaaagtaccaacacctgaggaacaatattttattgaaataaccaaagaatgtataaaagattgtaatttggatcagttgataaccgactctaaatttctccatgaaaatgctcttctggaaatggttaaaactttgatagagttatccagaggacctgacattcaagaaagcctggggtacaactataatcagaatgtaacagtgtttttcttggaactccttataaaaattgttatgcaaaatagagatcgagtaatgtcaatatggcagaatgtacgagaccacatatatactattgtaatgaatgcatctctgtttgattaccagttccttctggagaggtcagtaataggattattacgaatagctatacgtttgatgagaaacgaagaaatgagtcatatagttctgcagtcacttcgaatgcttcttctgttgaaaagtagtacattaagcagaatatcccgacagatctcgtttggattatttgaattattgaaaacttctgcccagaatatacatactaatactgactggacgattattttcacacttcttgaatgtgtcggagcaggagcccaaccacctaagcctattt

SEQ ID NO: 3521 - DNA, 286 bp, Leptinotarsa decemlineata
ggagcagatacacgtctaagcgccggcttctccatctacactagagaccaaaataagttgtttcctctttcaaaaacaacggttctcggatgctcaggttgctggtgtgacacgctaacgttaactcgtattttgaagtctcgcatgcagatgtacgagcaagagcataataaagtgatgtcgaccactgcttgcgcgcagatgctctccaccatgctctactacaaacgcttttttccttattacatctctaacgttctcgtgggtctcgacaacgaaggaaaag

SEQ ID NO: 3522 - DNA, 665 bp, Leptinotarsa decemlineata
gctctaccagaagaacaacaaggaactgacggaactattcaggccgtatgttgaacgactgataacagcgctctgcaggcactgtcagatggagccagactgcgagggcctgcttgaggagggagacgagttcaaagatttccgattgaaggtatctgatctgattagagacgtcgtcttcattgtcggcagcagcagttgcttcaggcagatgttcatcaatctgcaggcacccggcgtgacgtgggattccagtgaagccgcccttttcgtgatgcaggccgtggcgaaaaacgttttaccgactgataacgaagtaattccgaatgtggtggaagccatcctgaacgtccccgagaacactcacatcgctgtcaaatatacgtcagtgttgctgctcggcgagctatgcgagtggatcgaaaagcacccgaacacgctggaccccatcctgaacttcctcgtgtgctgtttaccccaagcaggtattggcgctgcagctgctgtagccctgcagaacatctgcgctagctgcaatgatcatatgccgaggcacgttcccattttactacagctactgtaccaagtcgacacgttcgccataacgaacaacgccgtcattggtctcctgaaaggcgtcgcctctatagtaggtaggatgccgg

SEQ ID NO: 3523 - DNA, 674 bp, Leptinotarsa decemlineata
aggacttatatggccctgataatcacctagtagagtggcacaggactcttacaacacaagaaactgatgggttccaagtaaagcgtccaggtgataaaaatgtcaggtgcacaattctcctattattggactatcagcctttacaattcaaactagatcctagactagctcgccttctaggagttcatactcaaactagaccagttattatatctgccttgtggcagtatataaaaacccatagacttcaagatgctcatgaacgtgaatacattgtatgtgaaaaatatcttgaacaaatttttaattgttctcgtatgaagtttgctgaaatccctcagcgtctgaatcctttgttacatccaccagacccgattgttatcaatcacgtaatatctgttgaaggtggcgcagaaagcaaacaaactgcttgttatgatattgatgtagaggtggatgatactctgaagaatcaaatgaataattttcttttgagtacagcgagtcaacaagaaatacaaggattagattcaaaaattcatgaaactgtggacactatcaaccaactaaaaacaaatagagaatttttcctgagttttgctaaggatccacaacaatttattcataaatggattgtatctcaaactagagacctcaagacaatgaccgatgtt

SEQ ID NO: 3524 - DNA, 302 bp, Leptinotarsa decemlineata
acgaattggagcagaaaatgcgagaagccgagactgaatcccacgaagggaaaagaaagaacgaatctttgtggccaattttcaagatccaccatcagaagtcccggtatattttcgacctgttttatagacggaaagccatcagcagagaactgtacgagtattgcttgatggaaaacatcgctgacaaaaacctcatcgccaagtggaagaaacaagggtatgaaagtctttgctgtttacgatgcatccagacgagagacacaaattttggaacaaactgtatatgcagagtcccgaag

SEQ ID NO: 3525 - DNA, 753 bp, Leptinotarsa decemlineata
ggataagagatgtttgggcacacaatttggaagatgaatttcgaacaatcagacaaattgttcaaaaataccaatacgtagcaatggatacagagtttcctggagttgttgcgagaccgattggggagttccgtagttcagcagattatcagtaccagatgttgaggtgtaatgtggatttactcagaataatacaacttggactaacattcttggatgataatggaaagacaccaggaggatcatataccacctggcagttcaatttcaagtttaatttacaggaagacatgtatgcccaggacagtatagatctgcttcagaattctggcattcaattcaaaaaacacgaagatgaaggaattgagcctctcgagtttgccgagttgctaatgtcttctggtattgtcttgatggagaacataaaatggttatcctttcattctggctatgatttcggatatctcataaaactattaacggataacaacttgccacaagatgaaaatgaatttttcgatttattgaagttatatttcccaactatatacgatgtcaagtacctcatgaaatcttgcaagaatctgaagggaggactacaggaggttgcggaacagctagaacttgagagaattggaccacaacatcaggccggttcggattcattactaacaggaatggcatttttcaaaatgaaggagatgtttttcgaagacaccatcgatgactccaagttttctggccatctttacg

SEQ ID NO: 3526 - DNA, 793 bp, Leptinotarsa decemlineata
tctggtactggtaaaactgcaacgttttcaatctccattctacaatctctagatcttacaatgagagaaactcaagttttatgcttgtccccaactagggaattggcagttcaaattcaaaaagtaattctagctttaggagattttatgaatgttcaatgtcatgcttgtattggtggcacaaatttaggagaagacataagaaaactagattatggacaacatgtcgtcagtggaacaccaggaagagtgtatgatatgattcgtagacgagcactacgaactagatctgtgaaaatgttggtattagatgaagccgatgaaatgttgaacaaaggattcaaagaacaaatttatgatgtttatcgatttctcccaccctctacacaggttgttttgatttctgcaactttacctcatgaaattttggagataacttctaaatttatgacagatccaattcgtatactggtaaaacgtgatgaattgactctggaaggtatcaaacagttcttcgtagctgtggaacgtgaagagtggaaatttgacactctctgtgacctttatgatactcttactataactcaagctgttatattctgtaatacaaaaaggaaggtggactggctgacagaaaaaatgagagaaaacaacttcactgtgagcgccatgcatggagatatgccccaaaaggagagggacaacatcatgaaggagttcaggtcaggacagagcagagttcttattaccaccgatgtttgggcccgaggaatagacgttcagcaagttagtt

SEQ ID NO: 3527 - DNA, 787 bp, Leptinotarsa decemlineata
agctggagatggtactacatccgttgtcgttattgctggagcattattagatgccgcagagaagttgctacatcgtggaatccatcccactgcaatttctgagtcattccaaagagcagcagtgctagctcttgagatattgaatgaaatttcaactcctgttgagattacaaacagagaagaactgataaagagtgcctcaacttctctcaactccaaagttgtgtcacaacagtccagccatttagggcctttggcagtagatgcagtactcagaatagtggaacctggacgcgagcaggcttgtaatcttaacgatatcaaagttatcaagcaattagggggaactgtagaagacacagagttagtcgaaggaatcgtgttccctcagagatcttcaaatgtttctgggccaaaacgtattgaaaaagctaagattggattcatccagttctgcatttcacctcccaaaacagacatggaccacaacgttattgtgtcagactacgctgcaatggatagagttctgaaagaagaaagagcttacattctgaatatcgttaaacaaattaagaaagctggatgcaacgttcttctgatccaaaaatctatactgagagatgccgtatccgatttagcactacactttttggacaagataaaatgcatggtaatcaaagacatcgagagagaagatgtggaatttgtttgtaaatctctagggtgtcgccctattgcgtcgttggatcattttgtagctgaaaatctggtgtcagctgatctagta

SEQ ID NO: 3528 - DNA, 772 bp, Leptinotarsa decemlineata
gtccactacaggttccaattactttgttcgtattctctccacaatcgatcgggaacttttgaaaccttcagcaagtgttgctcttcacaagcacagtaatgcacttgtcgatgtgcttcctccagaagcagattcctccataagtatgctgcaagctgatgaaaaaccagatgtacagtatagtgatattggaggaatggatatgcagaaacaagaaattagagaggcagttgaattaccacttactcattttgagctatacaaacaaattggtattgatccacctagaggggtgttgatgtatggacctcctggatgtggaaaaaccatgttggcaaaggctgttgcccatcatacaacagctgcttttatccgagtagtgggatctgaatttgttcaaaagtaccttggagaaggaccccgtatggtacgagatgtgtttcgtttggccaaagaaaattctcctgccattatattcattgatgaaattgatgctatagcaactaagagatttgatgctcaaactggggcagatcgtgaagttcaaagaattttactagagttgctcaatcaaatggatggttttgaccaaactacaaatgttaaagttataatggcaacaaatagagcagacaccttagatcctgctctgctcagacctggtcgtttggataggaaaattgaatttcctctgccggaccgtagacaaaaacgtttgatattcagcactatcacatcaaaaatgaatttatctgaagaggtggatttggaa

SEQ ID NO: 3529 - DNA, 352 bp, Leptinotarsa decemlineata
gcaaaatgctcagtaaccatcaaaacaatgttggaagatctcggcatggacgacgaggacgaagaagttgtgcctttacccaatgtcaactctgccattttgagaaaagtgattcagtgggctacctaccacaaagatgatcctccaccaccagaagatgatgaaaacaaagagaagcgaacagatgacatatcttcttgggacgcagacttcctgaaagtggaccaagggactttgttcgagctcattttagctgcgaactatctggatatcaagggacttctggacgttacatgcaaaactgttgccaatatgatcaaaggcaaagctccggaggaaattcgcaaaactt

SEQ ID NO: 3530 - DNA, 745 bp, Leptinotarsa decemlineata
tgataaggcgtcctgtaaagaactggatcagtggatagaacagttaaatgactgcaagcagctaacagaaaatcaagtcaaaacactatgtgataaggcaaaagaaatattatcaaaggagtctaatgtacaagaagtaaaatgcccggtgacggtgtgtggagacgtccatgggcagttccatgatttaatggaactatttaggataggtgggcgaagtccggataccaactacttgtttatgggggattatgttgatcgtggatattactctgtcgaaacagtgactttgttagtagccctcaaagtgagatataaagagagaatcacaattttgagaggcaaccacgaatctcgacaaattactcaagtgtatggcttttatgatgaatgcttaagaaaatatggaaatgctaatgtttggaagttcttcactgatttgtttgattatttacccctgactgcacttgttgacagccagattttctgtctacatggtggtttgagtcctagcatcgatactttggatcacattagagccctagaccgtttacaagaggttccccatgaaggccctatgtgtgatctgctatggtctgatcctgatgatcgtggaggttggggcatttccccaagaggcgctggttacacttttggacaggacatttctgaaaccttcaatcatagcaatggtctcacccttgtttctcgagcacatcagttggtcatggagggttacaattgg

SEQ ID NO: 3531 - DNA, 206 bp, Leptinotarsa decemlineata
cttcacttggttcttcgactccgtggtggtatgcagatctttgtcaaaactctaactggaaagacaattactttggaagttgaaccatctgacaccatcgagaatgttaaagccaagatccaagataaggaaggaattcccccagaccaacaaaggcttatcttcgctggaaaacaactggaagatggccgaaccttatcagatta

SEQ ID NO: 3532 - DNA, 692 bp, Leptinotarsa decemlineata
ctagatattgtccacccagctgctaaaactctagtagatatcgccaaatctcaagacgctgaggtaggtgatggaactacaagtgtagtactattagcaggggaatttttgaagcaaataaagcagtacgtagaagaaggtgtgcatcctagaatcataatcaaagctgtgcgccagtcgctgcaaatctgtctcgataaaatatctgaattatctgtaaaagtaaacaagtccagtgctgaggagttcagatcattactggaaaaatgtgcagcaacggcaatgagttccaagttgatcaatcagcagcgtgccttcttctctaaaatggtcgtagatgcagttttactgttggatgacttactgccactaaacatgattggtatcaaaaaagttcagggtggggcattagaagattcaatgttagttgcaggcgttgctttcaaaaaaaccttttcatatgctggatttgagatgcaacccaaagtttacaaaaattgtaaaattgctcttctcaatattgaacttgaactcaaagctgaaagggataatgcagaagtaagagtggataatgttaaggaataccagaagattgtggatgctgaatggaatatattgtacaataaactacaaaaaattcatgaatctggagccaatgttgtactatctaaactacctattggagatgtggc

SEQ ID NO: 3533 - DNA, 678 bp, Leptinotarsa decemlineata
catgctgttgatgacttgtccttgaaacaatattcaaatcttcatatttgggtcagcaggctggatgaggaggttgagaaaaatttagctcgccgccttcaagctggtattgaagcatggactgatgctttgagtggtcagaagaaagatatagatcacagcatggacaccgatgccccagtgcaacctacacacaaacccgggggcgatccacaaatacaaattgtgattcatgaagttcgaataaccaatcagaccatgtacctatatccgagcatagaagaagctcgattccagattatgcaacagctgtttgcttggcaagctattgtaacttcacagcaacgacttcaaagcagtcgatatcaagtgggagttgataaaccagtgactgaaacctaccggaatatcttgacaaaacttcccggaggaccacaacctctgaataatgcttatagtgccatcgcttccaaaataaaagaggtgcaaaaatatgttaatgaatggttaacctaccaatctttgtgggatcttcaagctgaaaacctttatggcaaactaggtgaagacatcagtaaatggatggagtgtctgaatgatatcaagaaaacccgaactacctttgacacatcagatactcgacgtgaatttggacccattgtgatagacttcgccaaa

SEQ ID NO: 3534 - DNA, 735 bp, Leptinotarsa decemlineata
tggaaatgaagtggggtatgctatcagatttgaagactgcacttcctccagaactgttattaaatatatgactgatggtacgttacacagagaatttttatcagagcccgatttacagtcatatagtgttatgatcattgatgaggcccacgagagaacactacatacagatattttatttggccttgttaaggatattgccagatttcgaccagatttgaagttgttgatttcaagtgctacactagatgttgctaaattctcagaattttttgatgatgcacctatgtttcaaattccaggaagaagatttcctgtagatatatattacactaaagcaccagaggcagattatgtagatgcatgtgttatatcagtgttgcaaatacatgttacacaacctctgggggatgttttagtatttttgactggtcaagatgaaatagaatcatgtcaagaactacttcaggatcgagttcgaagattaggttcgaaagttaaggagatgattattttacctgtatatgctaatttaccgagtgacatgcaggcaaaaatttttgaacctactcctccaggatccagaaaagttatactggctacaaatatagcagaaacttctttaacaatcgataacataatttatgttatagatccaggatttgctaagcaaaaccattttaactcacgaacaggaatggaaagtttaatggtagtgccaatatccaaagcttc

SEQ ID NO: 3535 - DNA, 655 bp, Leptinotarsa decemlineata
ggatgaatcaggatttgccatacaatcagcagcaggtttggtcggccaagaacaagcaagagaggcagcaggagtagtagtggacatgataaaaagtaaaaaaatggctggtagagcagtgctcctagccggaccaccaggaacaggcaaaactgctatagctttggccattgcacaggaacttggaaataaagttcctttctgtccaatggtaggttctgaagtttacagttcagaaattaagaaaaccgaagtccttatggaaaacttcaggagagcgattgggttacggattagagaaactaaagaggtttatgaaggagaagttagcgagctaacaccagttgaaacagaaaatccttcaggaggttatggcaaaaccgtcagtcatgtcattattgggttgagaacagccaaaggtagtaaacaattgaaacttgatcctagcatttatgaggcacttcaaaaagagaaagtagaagttggagatgttatctatattgaagccacaagtggagctgttaaaagacaaggaagatctgatgcatttgctactgaatttgatctggaagctgaagagtatgtcccccttccgaagggagatgtacataaaaaaaaggaagtcgttcaggatgtcaccttgcatgatttggat

SEQ ID NO: 3536 - DNA, 674 bp, Leptinotarsa decemlineata
tacagttgtgtcacactcagggagagttgagcaaagtttccagtccaaaggttgtgcttgctagttcagcagatatggaaagtggctactccagggaactgttcctacagtggtgttcaaatcctgccaacagtgttattttgaccacaaggacatctcctggtactctagctagagacttagtggataatggaggagagaggaccgtagatttaacagtagaaaagagagtcaggttggaaggagcagaacttgaagaatacgagaaacgacagagagaaagatgtgaagacgatgaaaccaaagaagaaggtgattcagattctgatgatgacattgagatgtcagtcatttcgaaaggcaggcacgacattgtcataaaacaggaaggcaaaatttctacagggtttttcaaagtaacaaaaaaaatgtatccgatgtacccattccacgaggaaaaagtcaagtctgatgaatatggagagatcatcaggccagaagattataaattagcagatgtgcctttagaaggagaagataataaagaaaacttggtagttaaaaaagaagaagaggaaataactgagatcccggagatgccaaccaagtgcattgttcttcaaaggactgtccaggtcaattgtcaagtgcattatatcgactttgaaggtcgg

SEQ ID NO: 3537 - DNA, 725 bp, Leptinotarsa decemlineata
agatgttaggaaggacgagaaagtaatttgggatggacacacgagtagtgtggaaactgctactagagctgctagagctaacataacactggaagaacagatacaccaaatccataaggtcaaaggattactccctgatgaagaaaaagaaaaaattggccccaaaaatatagggtcaaaatctggcaagatcaacattcagagtgtaataactacaaaaccaccaaatcaaccaccgccacctaagcctcaggtttctctcattcagacgcaaccggctcctccaatggctatacctgtacctccccaacctactatgatggctacgcaaccaccaataatgatgatgactgctcctcctatgcctccaatgagacctcctcctataatgatggcagcaccacctcctatggccagctttgttactccaatgcctcctcctatgggacagccaatgggaatgccaatgaaacatccaaacgatggtatgttagatgatgaaccaagtaataaaaagttgaggaatgaagattctcttgtacccgaagaagtattcatgacaagaaatccaggtccagtgtctatcaaggtaacaataccacttttgcctgagaagtctgaatggaaattaaccggacaggtgatgagcctcacattacccttgggagaaagtgtggctaatttgaaggcaaaggtgcaggaagaaacaaatatgccaccagcta

SEQ ID NO: 3538 - DNA, 720 bp, Leptinotarsa decemlineata
gctttgcagttccttttgatgaagatgacaaagataaatccgtgtggtttctggaccacgactacctggaaaatatgtatggaatgttcaaaaaagtaaatgctagggagcgagtggtaggttggtaccacacaggtccaaaattagaccagaatgacatagcaataaacgaactaattaggagatactgtcccaattctgtgttggtaataattgatgccaaaccgaaggatctaggcctcccaaccgaggcatatcaagctgtggaggaagtccacgatgatggatcgcccacttccaaaacatttgagcatgtacctagcgaaataggggcggaagaagcagaggaggtgggagtggagcaccttctgagggatatcaaagataccacagttggcacgttgtctcaacgaataaccaatcaactcttaggtttgaaaggtctgcacctgcaactgcgggaaatccgagactacttgatacaagtctccgagaacaaactaccaattaaccatcaaatcatttaccagctgcaggatatcttcaatttgcttcccgatattaaccaagccactttcaactcatccttctatataaaaaacaatgaccaaatgttggttgtctatcttgctgctttggttaggtctatcgtggctttgcacaatttgatcaacaacaaacttaccaataaagatgcagaggagggaaagaaagaagagg

SEQ ID NO: 3539 - DNA, 744 bp, Leptinotarsa decemlineata
ttgaaaggtgtgatggtcaacaaggacgtgacacatccaaaaatgaggagatatatcaaagatccacggatcattcttttggactgtgcactggaatacaaaaaaggagaatctcaaaccaatgttgaaattacttccaacatggatttctcaagactactggagctcgaagaggaacacgtcaaacgtcagtgcgatgacattatcgccctcaaacctgatgtagtcttcacagagaaaggtgtttccgaccttgcccaacatttccttctcaaagctggcatcactgccatacgacgagttcgcaaatcagacaataatagaatcgcaagagcttgcggagctaccatcgtcaacagaacggaagaattacaggaatccgatttaggattgggagctgggctctttgaaatcaagaagattggagatgaatacttctgtttcattgtcgaatgtaaggatcccaaggcttgcaccatattgctacgtggcgctagcaaagatatcctgaacgaaactgaaaggaatctccaagacgccttgcaagtagcgagaaatatagttctgtccccaaggctggttcctggaggaggtgccatcgaaatggcggtagcccagcgattattgcaaaaggctagtcatggtccttacagggctttagcgcatgctttagagataatccctcgtacgttggcccaaaactgtggtgctaacacaatacgtacgttaacgactctaagagca

SEQ ID NO: 3540 - DNA, 286 bp, Leptinotarsa decemlineata; identical to SEQ ID NO: 3521

SEQ ID NO: 3541 - DNA, 719 bp, Leptinotarsa decemlineata
atgaaagacaggacgttgaaagaggaggaaaaattatcatgccaccttccgcgcttgagaagctgaccaggctgaacataaattaccccatgttatttaaacttgttaacaaaaaaactaatagagtcactcactgtggtgttttggagtttgtggctgatgaaggcaaagtttatctaccactctggatgatgcacaatttggtacttgaagaaggagatttggtacaaatggaaagtgtttctctgcccgttggaaccttctcaaagttccaacccttgaatccagattttcttgacatcacaaatccaaaggcagtgttggaaaattgtttgaggtcttttgcttgcctcactacaggggatgtcatcgcagttaaatacaatcagaaagcctatgagctgtgtgtactggaaactaaacctggagacgctattagcattatagaatgtgacatgaacgttgaattcgctgctcccgtgggttataaagagcctgaacaaaggaagaaagaagaagaagaagccgcagtggatcctgccgagctgatgccggagccttctgggtttgttgcttttcgtggaactggaaatcgtttggacgggaagaaacgaaaagattccacatctagtgatttcgcatcagccaaacccgtctatgtcagaggtataccagattatgactaccaaatcgggactttgaaatttatcaggcgacca

SEQ ID NO: 3542 - DNA, 793 bp, Leptinotarsa decemlineata
aaatggaaggaaaggttggtggaaagttggaagacagtacactcgttaaaggagtggtcattgacaagacaatgtctcatccacaaatgccgaaagaattgaagaatgtaaagttagctatcctcacctgcccatttgaaccaccaaaaccaaagaccaaacataagttggatgttaccaatgttgatgaatataaggaactacgacagtatgaacaagacaaattcaaagaaatagttggattggtaaaaaatgttggagccactttggctatctgtcagtggggtttcgatgatgaagcaaatcatttattacttcaacaggagcttccagcagtcagatgggtgggaggaccagaaatagaactcatagctatcgcaactggaggacgcattgtacctagatttgaagagttgagcccagagaaacttggcactgctggtctagttagggaaatatcttttggtaccacaaaagacaggatgctggtcattgaagagtgctcaaattctcgagctgtcactattctcgtacgtggcggcaatcagatgctggtagctgaggcaaagaggagtttacacgatgccttgtgtgttgttcgaagtttggttcaggaacccagagttgtttatggaggtggtgcagctgaaatttcgtgcagtctggctgtctctgcccaagcagatcagcttgctactctagagcaatacgctttccgtgcattcgctgaagccttagaaagcattccgttggctttggcagaaaacagtggattgtcatccgttcatgttct

SEQ ID NO: 3543 - DNA, 192 bp, Leptinotarsa decemlineata
taaaaagtggaatgctgtggcattgtgggcatgggatattgtcgtggataattgtgctatttgtcgtaatcatattatggacttgtgtattgaatgtcaagcaaatcaagcttcagctaccagtgaagagtgtaccgtagcttggggtgtatgtaatcacgcctttcatttccactgcatttcaagatggtt

SEQ ID NO: 3544 - DNA, 668 bp, Leptinotarsa decemlineata
gcccaaaggaatggataagattctagtatccagcggaagaaatgcaggatctgtagaagtaactaacgatggtgccaccattctcaaatctgtcggtgtggataatcctgctgcaaaaattctcgttgacatgtcgaaagtgcaagatgatgaagtaggtgatggaaccacatctgtcacagttttagctgctgaacttcttagagaagcagaaagactgatcgaacagaaaattcatccccaaacgattattgctggttggaggaaagctgttgatgtagccagaaaagccctgcgggatgcttcaatggataacagcgataatctcgaaaaattccgtgaagatctgttgaacattgccaggacaactctgagctcgaaaattctctcacaacacaaggaacattttgcaaaactatccgttgatgcggtactcaggttaaagggatcaggagatttacaagctatccagcttatcaagaaaactggtggtactctggaagactcatttctagacgaaggtttcttattggacaaaaaaccaggagtccatcaacccaaaacagtggagaacgccaaaatactcatcgcaaacactcccatggactctgacaaaattaaagtattcggctcccacatcaaagttgactcaatggccaaaatagctg

SEQ ID NO: 3545 - DNA, 676 bp, Leptinotarsa decemlineata
gcgtcttcatcaggtagaatatgcaatggaagccgttaatctaggttcagcgactgtaggtttgaaaagtaaaactcatgcagtgctcattgctcttaaaagagcctcttcggagctctctgcctatcagaaaaagatcatcaacatcgacgagcatattggaataactatttcaggactcactgcagatgctaggatccttagtcgatatatgaggaatgagtgtttgaattacaaatattctttagatgcccatatgcctctgaatagactcataagcacgttaggtaataaaatgcagcactgtactcagcgctatgaccgtagaccatttggagttggtcttctagttgctggctatgatgagtcaggttctcatatctatcaaacatgtccgtcagccaacttttatgactgcaaagctatgtcaataggtgctaggtcccaaagtgcgagaacttacctcgaaaaacacctagatgaacttccttcctgttccctggagcaactcgtcaaacacggtttacgtgccttaagagataccttgcccccagaggtagacttgactacaaaaaatgttgcgattggttatgttggtaagggacagcctttccaaatattggaagaaaatgaaacggctccatatttggccctgattgagggagaggaaagaaga

SEQ ID NO: 3546 - DNA, 718 bp, Leptinotarsa decemlineata
gcagcatgatattcctgagactgctgtccgggtattcaggaggtactggaaactgtgtccagaaaatgctgaggaatatgtggactacctcacagaaataggtcggcttgacgaagctgcccaagtattggcaaaaattgtcaatgatgaaaattttgcttcccagaaaggaaaatccaagcatcaactctggaacgagctttgcgaactcatatcaaaaaatcctgacaagattcgttccttaaatgtggatgctatcatcagaggaggcctgagacgctatactgatcaactgggccacctctggaactccttagcaaactactatgtacgcagtggcctattcgaaagagcaagagatatttatgaggaagctattcaaacagtcactaccgttcgtgatttcacccaagtttttgattcttacgcacagtttgaggaattgagtctcagcaagaaaatggaagaggttgctaatcaggctaatcctacagaagatgatgatacagatctggaaatgaggctatccaggtttgaaaatctcatggaaaggagattactgttgcttaactccgtacttctgagacagaacccgcataacgtccaagaatggcataaaagggtccaactgtatgaagataaaccactggaaataatcaacacttacacagaagcagtgcaaactgtggatccaaaactagctgtgggtaaacttcac

SEQ ID NO: 3547 - DNA, 743 bp, Leptinotarsa decemlineata
cgggtaactatgatgcatcagggatatggattcgttgaattcatgggcgaagaagatgctgactatgctattaaaataatgaatatgattaagttatatggaaagcctattcgagtcaataaagcctccgcacaccaaaaaaatttagatgttggggctaatatcttcataggaaatttggatcctgaagttgatgaaaaattgttatatgacacattttctgcattcggagtcattttgcaaactcctaagattatgagagatccagaaacaggtaactccaaaggatttgcattcataaatttcgccagttttgaagcttcagatgcatccattgaagcaatgaacggccagtatctctgcaatcgacctatttctgtatcgtatgctttcaaaaaggactccaagggtgaaaggcacggttctgctgcagaacgtttacttgctgctcagaatcctctctcacaagcagacaggcctcatcagctctttgccgatgctcctccaattggtatgatgcccatgacgatagctccaccacctcctcctgttattttaacagggatgatgccacctcccactcccgcaaacatgcaccctcctccgccaccaccagttcctcctccaagtggatttccttcaggtataccgcctcctccattaccaccatcccaaccaccgttacctccgggagctcctcctccacccccaatttcggcctccactggatctacacctagacc

SEQ ID NO: 3548 - DNA, 641 bp, Leptinotarsa decemlineata
gagcaccaaaattgcgttatttggacttttctgagcgacatggatatattaaaggtgtcgttaaggaaataatgcacgatcccggccgtggcgctccattagctatggttcatttcagggatccctataaattccaaacaagaaaagagttattcattgctcccgaagggatgtatacaggacaatttctgtattgcggaaagaaggctagtttgcagattggaaatgttttgcctgttggaaccatgccagaaggtacaatcgtatgtaacttagaagaaaagactggcgatcgtggtcgtcttgcaagggcatctggaaactatgcaacagttattgcccacaatcatgacacaaaaaaaaccagggtcaagttaccatctggtgccaaaaaagtcattccttccaacaatagggccatggttggtattgttgcagggggtggtcgtatcgacaaaccaattcttaaagctggacgtgcctatcacaaatacaaggttaagcgtaactgctggcccaaggtacgtggtgttgctatgaatcccgtcgaacatccccatggtggtggtaaccatcaacacattggtaaagcatccactgttaaaagaggtacctctgctggtcgtaaggttggtctcatt

SEQ ID NO: 3549 - DNA, 269 bp, Leptinotarsa decemlineata
tactaaagcagctcgcaaaagtgcaccggctacgggaggtgttaaaaaacctcatcgttacagacccggtactgttgctctccgagaaattcgacgttatcagaagagtactgaattgttgattaggaaattaccctttcaacgtttagttcgagaaatcgctcaagatttcaaaaccgatttacgattccaaagttcagccgtcatggctttgcaagaagctagcgaggcgtatttggtaggactcttcgaagatacgaatttgtgcg

SEQ ID NO: 3550 - DNA, 660 bp, Leptinotarsa decemlineata
tggctgtcaatatttctgctgctaaaggaatccaggatgtaatgaaaaccaatttgggccccaagggaactgtaaaaatgttggtatctggagctggtgatatcaaaataaccaaggatggaaacgtgctgttacatgaaatgcaaatccaacacccaacagcctctcttattgcccgagcctcaactgctcaagatgacatgactggtgacggaacaacatctactattcttgtcataggtgaacttctcaaacaggccgatatttatgttgctgaaggtttgcatcccaggatacttacagaaggatttgataaagctcgggctaaagcgttagaagtgttggaaaaaatcaaaattcctgttgaaatcaacaaggaaagtttgaccgacgtttgcaggactagtttgagaaccaaggttcatcaaaaacttgctgatgtattgacagatgtttgtgttgatgcagtactagcaatcaaacaaggcgataaacctgtagatcttcatatggttgaattgatggaaatgcaacataaaacagaaacagacacccaactcgttaaaggtctggttcttgatcatggtgctcgtcatcctgacatgccgaagagccttaagaattgttacattctaacttgtaacgtgagcatggagtatg

SEQ ID NO: 3551 - DNA, 767 bp, Leptinotarsa decemlineata
cagtactcgaaccagatcaggcagttgttgttcaactttcctccggatcagctcacaaccaccggccagttgttctggtcggggccaaaacgttgcccggaagcgctcactttcgatatcaataatcctctccatttggattacgtccttgcggctgctaatttgaaagcgcaggtgtatggtattccgaccaacagggacagggcatatattgctgaagtggtcagcaaggttgaggtaccagagtttgtgccgaagtctggcgtcaaaatagctgttacagactcccaaatggccatgaacggtaacaacgtcgacttggatcgagtaactcaaattaaagaggagctaccctccgtcgaagaactgaacgggctccgtcttactccgctagaattcgaaaaggatgacgacaccaatttccacatggatttcattgttgctgcttctaacctccgagcagcaaactataaaatacctcccgcagacagacacaagtctaagctcattgcaggtaaaatcatcccggctattgctaccacgacatccgtcgtaggggggctcgtctgcttcgagctgtacaaactgacacgaagcatgaagagtttagaaccattcaaaaacggctttgtcaacctcgcgctgcctttctttggcttctccgagccgatcgcggcccccaagatggagtactgtggcaacgagtggacactgtgggatcgcttcgaggtccaaggagagatgacgctcagcgagttcttaacgta

SEQ ID NO: 3552 - DNA, 646 bp, Leptinotarsa decemlineata
gactaccactgagacaacagctaatgaagcacaaaagaaaggggtcaagggcacttacgtatccatacacagttcaggcttcagagattttttattgaaaccagaaattctaagagctatagttgactgcggttttgaacacccttcagaagttcaacacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggccttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgttaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatc

SEQ ID NO: 3553 - DNA, 683 bp, Leptinotarsa decemlineata
agtgttttggagattcgtgagcatgccaggcaaatagagaagtccgtcactagtaaagaaaaccgttttattctaagagttctacggtgtttacccaatacaagaagaaaactgaatggtgtcgttctgagaagtcttatcaatcaaatctatccagtctccgaacgtgaagctctgctgaatttcactgaagaagctgttggagatttagacaccacccaggcaagggccagatctgccaccaaatcgccattaccagaggttgatacatatataaatttattgattttggttcgtctcatcgataccaataaactacaagaagcagaaaggtgttctcaggcactaatgaacaaaataacaactcaaaatcgacgtaccatagatcacatagctgccaagtgttacttttatcactctagagttgctgaactttcaaataaacttgatacgatcagagctttcttgcactcacgtcttcgtactgctacgcttcgaaatgattttgaaggtcaagcagttcttgtcaattgtttactaagaaattacctgcattactcgttatatgatcaagcagataaactggtgagcaaatgtgtatttccagagacggccagcaacaatgaatgggcaagatttttatactatttaggtcgtatcaaagcggctcgattagagtatag

SEQ ID NO: 3554 - DNA, 669 bp, Leptinotarsa decemlineata
tgccaaagcccaattatttgcttgggaagcatatgaaaaaggagtcgacgtccatttactggctgaaccgacaaaacttgagctacttaaaaaagagtatgagaaaaaaaaagaacaaatcaagaccaaaattcagagcaatgttctggaaagatacggaggtgaggagcacttagaagaacctcctagaagtctgctgcttgctcaaacagaagattatattgaatactcaagatcaggcaaaattattaaaggagctgagaaggaggtgatcaaatccaagtatgaggaggatgtttacataaataatcatacttctgtttggggatcgtattggcgtggaggccagtggggctataagtgttgtcattcatttatcaaaaattccttctgccttggagaagccggtagaaattcggagattgttaagcctcacgagctgccagaaagtagaggtgatgtgaacgaagatatacctgatgataagaaagggaatagtgatcgagatgagagcagctccagttcatcggacgaaaaatctaagaagaagaaacagaaaagagaaaagaaaaaactcaagaaaatgaagaagaaactgaggcaagaaaaacacataaccaacaaaatggaagaaacagaagaaatcatggatgagagaaaacgaccgta

SEQ ID NO: 3555 - DNA, 496 bp, Leptinotarsa decemlineata
gaagtttgaattaggtcgccccgcagctagtactaaactaggacctcgcaggatccactatgttcgtaccagaggtggtaatttgaaatatagggctctaaggctcgacactggaaattttgcctggggtagtgaaggaactgcgagaaaaacccgtattattgatgttgtctacaatgctagcaacaatgagttggtgcgtaccaaaacattagtgaagaatgcaatagttgttgtagatgccactccattcagaatgtggtatgagaatcattacatcctgcctttgggtcgcaagaagggagccaaactgactgccgaagaagaggctcttttagcgaagaaacgtagtaagaaagtacaaaagaagtacgaaactcgtcagaagacttctaaagtagaacctgctatcgaagagcaattcacaactggaaggttgttggcttgcttggcgtctcgaccaggacagtgtggaagggcagatggctacatttta

SEQ ID NO: 3556 - DNA, 702 bp, Leptinotarsa decemlineata
aatggggcttatgttaggtgaatttgtagacgattacacagtcagagttattgatgtatttgcgatgccacagacaggtacaggtgttagtgtagaggctgtagatccagttttccaagctaagatgttggacatgttacggcagactggtagaccagaaatggtggtgggctggtaccattcccatccaggattcggttgttggctgtcgggtgtcgatatcaatacccagcaaagttttgaagccctttccgaaagggcagttgctgttgtagtagacccaattcagtctgttaaaggcaaagttgtaattgatgccttcaggttgataaaccctaacatgatggttttgggtcaggaacctcgacaaacaacctccaacttaggacacctccagaagccttcagtgcaagctctcattcacggtttgaataggcattattactcgataagtatcaattatcgaaaaaatgaactggaacagaaaatgcttctcaacttacacaaaaagtcctggatggatggccttaccttagcggactatgcagagaactgtagtgtaaatgaaaaaaccgtgtctgacatgctggatttggctaaaaattataacaaagctctggaagacgaggaaaagatgacaccggagcaactagcgatcaagaacgtcggcaaacaggatccgaaaaggcatttggaggagaa

SEQ ID NO: 3557 - DNA, 677 bp, Leptinotarsa decemlineata
tcgtctacaagcacaaagaaatgaactaaatgcaaaagttcgaatgttgagagaagaattaatgctgcttcaagaacaggggagttatgttggtgaagtagttaaaccaatggacaaaaagaaagtcctcgttaaggtgcatcctgaaggaaaatttgtagtagacattgacaaaaacattgacattaatgatgtgacaccaaactgccgagttgcattgaggaacgagagttatactttacataaaattttacctaataaagtcgatccccttgtatctttgatgatggttgaaaaagtacctgattcaacttacgaaatggtgggaggcttagataaacaaataaaagaaatcaaagaggttatcgaattacctgtgaaacatcctgaactattcgatgcccttggtatagcacagcccaaaggggtgcttctttatggaccaccaggaactgggaaaactcttcttgctagagctgttgctcaccatacggaatgtacttttattcgtgtatctggttccgagttagttcaaaaattcattggagaaggttctcgcatggtgcgtgaactattcgttatggccagggaacatgctccttctatcatattcatggatgaaattgattctattggatcatctcgaattgaatcaggttctggtggtgattctgaag

SEQ ID NO: 3558 - DNA, 513 bp, Leptinotarsa decemlineata
tatacaagggccctacttcagctacatggttaaaatctgcattcgaattgcaaacatttaattttttccaaagagggtctgtccaagagtttatgacttttttttgtaaaaccatcgtggaaagaaccatacctgcttctagacagtcagtcaaggaaggagaatatctgtgtaatgtgtatgtccgttcagataatttggctggggtcgtaatatcggaccatgagtatccatccagggtatcacacactttaataacaaagcttttagacgagtttgcagaaagaatatcacctgcaaattggcctaaccttcaagagaaagatgtggcatttccacaagttactacttatttagcaaaataccaaaaccctcgagaggctgatgcattaactaaaatacaagaagacttagatgaaactaaaataattttacataatacaattcaggcggtgttggaaagaggggagaagttggatgatttggtatctaaatcagaaggattgagcatgc

SEQ ID NO: 3559 - DNA, 668 bp, Leptinotarsa decemlineata
aggacgtttattccaagtggaatatgctattgaagccattaaattgggttctacagctattggaatatgcaccagcgaaggagtcgttttagctgttgagaaacgtataacatccccgttgatggaacccactacaatcgagaaaatagtcgaagtcgacaagcacatcggttgcgcagtgtctggccttatggcagattctcgaacaatgatagacagagcccgtgtagaatgccagaaccattggtttgtctacaatgagaacatgagtgtagagtcatgcgcccaaggtgtgtccaacttggctattcagtttggggattctgatgatgacggagcggctatgtctagaccatttggtgttgccattttattcgctggtattgatgagaagggacctcagctgtaccacatggacccatctggcacatttgtccaattcgatgcaaaagccattggttctggctccgagggggctcagcagagtctgcaagaagtgtatcaccgcagtatgacactggaagaagctatgactgcagccttgacaattctcaaacaagttatggaagaaaagttgaacgcttcgaatgttgaagttgccacgatgacttcaaaagatttattccacatgttcacgaaagagcaagtggaagaggtgctgaaatgta

SEQ ID NO: 3560 - DNA, 747 bp, Leptinotarsa decemlineata
atctcaccagcaaacagaataatttgtgcacaaattataagttccacattcctgatttgaaggttggcacactggatcagttggtaggtctgtcggatgatttgggtaaactggatgggttcgtggaacaagttacccgaaaggtagctcagtacttgggggaagtattagaggatcaaagagataaactgcaagaaaacctgatggccaataacaccgatttgccaaattatctaacgagattccagtgggacattgccaaatatccgataaagcagtctctccgtaacattgccgatattatcagcaagcaggtcggtcagatcgacgccgatctcaaaaccaagtcttcggcgtacaacaacttgaaaggcagcctccagaatttggaaaagaagcaaacagggagtttattatctcgcaacttggcagacttggtgaagaaagaacactttatattggattcggaatatttgcaaacactcctagttatcgtgccaaaacagcagttctcggagtggaacgccacttatgaaaagatcaccgacatgatcgtaccccgttcgacgcagctcatcacccaggacaacgagtacggactctataccgtgacattgttcaagaaagtcgtggaggagttcaaactgcacgccagagaaaagaagttcatcgtgcgcgactttatttataatgaggaagagttggctgcgggcaagaatgaaatcacgaaactcgtcacggataaga

SEQ ID NO: 3561 - DNA, 767 bp, Leptinotarsa decemlineata
gatgttggagaagtaacggtgacaaacgatggggccaccatcttaagactcctggaggtcgaacaccctgctgctagggtgttagtcgaattggcacaacttcaagatgaagaagttggcgacggtactacttctgttgttgtcattgcagctgaattgctgaagaatgcagatgagctggtcaagcaaaaaattcaccccacttccatcataagtggttacagactggcttgcaaagaagcctgcaggtatatacaggaccgtcttaccataccagtcgaggatctgggaaatgattgcattataaatgttgcgaaaacgtcgatgagctcaaaaattatcggagcagatgcagacctattttcatccatagtagtagacgcagcaaatgccatcaaagtaacggactcgagaggtaatgcgatgtaccccatcaaggctgttaatgttctcaaggcccatggtaaaagtgccagagagagcttcctcatccaaggatatgctttgaactgtacagtagccagtcaagccatgccaaaaaaaatcgtaaatgccaagttggcgtgcttggacttctccctgcagaaggccaagatgaagatgggagtccaggtgttgatcacggaccccgaccagttggaaggcatccgcagccgagagttggacataacgaaggaacgcatccagaagatcctctctacaggcgtgaacgtggtcctcgtctcgggcggcattgacgacctctgcctgaagtacttcgtggagag

SEQ ID NO: 3562 - DNA, 637 bp, Leptinotarsa decemlineata
accaagtgaaacccaatgattatttcacacatactcagtctccagttacaacggcaacttctatcgtcgcaattgcgtacgacaaaggggttttgatagcaggagatcttttggcttcttatggatctttggcacgatatagaaattgtcccagagtgattgaagtcaactccaatattatactgggagctggtggtgattacgctgatttccaatatgtcaaatcattcatagatcagaaaataatcgatgaagaatgtttggacgatggtttgaaattcaaacccaagtcaatgtattgttggcttacaaggattatgtaccagagaaggagcaaatttgatcctttctggaataatcttgtgattggtggaattcaggatggtgaacccttccttgggactgtagacaaactaggaacagcctatgtcgataaggcaatttgtactggatatggagcacatattgcacttccaatgcttcgtgacgcaatggataaaaaaccaaacctcaatcaagctgaagccagagccctcgtagaaaagtgtttggaagttttgttctacagagatgccaggagctttcccaaatatcagttgggcatcattgataaagatgaaggtgttaagatcgaggg

SEQ ID NO: 3563 - DNA, 653 bp, Leptinotarsa decemlineata
agattagcacaagagcaacaaaaaagagaatcagttgtagaaaaatccccgtctcgttcagcttcgatggaatcaccaagtttcaatccattcgatgaggtagaagaggatacaggactggttcatccagaatggtttatagatttaccagaagaacttgatgtatgtgttgcacaaagacactttgaagaagcgttggttttattacagaaagccaaagattatattaatgagtgtcttaccacgaatgaccaattagatcacgtaatgattgatatccaaaggaaggtggaacaaagacaaaataatctcacagaagttttcatgaaggaacttgaagttaatcccgataaatctttgcaaggtggtttacgagcagcaagaagagcagtgagattactaaatcagttaggaaggtcaacgcagtcttgcaacctgttcctcaaactatgtagcagtatgttaaaaaatcaatgtaagagggttaaaagagagggatctactgcaacctatgtcagacatctttcaagtgtagtgtttacaaacatgtgtcacatgtctgaagaatttttgagagcatttcaagattcacccacttgtgcttcagcatatgttatgtgggccagcagtgaattgtctcttttcacaaccca

SEQ ID NO: 3564 - DNA, 777 bp, Leptinotarsa decemlineata
gtactgtttgggctactcaagcaagctgttctgaaacgaaaggagttaaaactgattgtcacttctgctacactggatgcagtcaagttttctgagtattttttcaaagctcctatttttaccattcctggtaggacttttccggttgaagttttatatacaaaagagccagagactgattatttggacgctagcttggtgactgttatgcagattcatttgagggagccgcctggtgatattcttttgtttttgactggacaagaagaaattgacactgcttgtgagattttatacgagcgaatgaaatctttaggtcctgatgttcctgatctaatcattcttcctgtttactccgcacttccttctgaaatgcagacacgaatttttgaacctgcaccaccaggcagcaggaaggttgtaattgctactaacattgcagaaacatcacttaccatagatggaattttctacgttgtagaccccggattcgtgaagcaaaaagtttataattctaaaactggaatggattctttagtcgtgacacccatatctcaggcacaagccaagcaaagggcaggacgagctggacgaaccggccctggaaaatgttacaggctttatacagaacgggcatatagggacgaaatgttgccaaccccggttccagaaattcagcgaacgaatctaacaaccaccgtactccaactcaaaacaatgggtatcaacgacttgctgaattttgatttcatggatgcaccaccagttgaatcacta

SEQ ID NO: 3565 - DNA, 798 bp, Leptinotarsa decemlineata
attgctgaggaagttaccaggcatgaaactgggggaaacgttgtgatgtattgttccactttcactgataacaaacgttcatatgtagtagcaggtcaggaagatcactgtcaactatatcatgtgaatagtgaacttgtcagcgaagaagttgaaaatattgatcataactcgcccgagactcgacaaagaaaaccgcaaaaaactgataggaacaaaaatttgaaaaagagtttgaagtttgtcatgaaacccagtgatagtatacaaactgatttcattggtccagaacctctatctagagtagctaggatacatcataatggtaaactcatggccacaggaggaactgatggacacataagattatggaaatttccgagtttgcaacccttaaccgtgttgaaggcgcacgagaaagaaattgatgacattgactttagccagtttggaaattttctgattactgtagcgaaggatggcttggggattctttgggactgtattaaaggaaaagaatacagtaggttgaattggaaacagcctgaaggttccaaatatttgtacaaacgatgtagatttggtgtaatcgaaggggaagataaaaagtctgcgttatatacaatatccaatcctactggcgttgcaaaaaaacagaaatcttatcttcaacagtggctccctgaagatggactactaaaaaaagttgcagaattcgacgaatgtctttccgctttggcagttagagatgatggtagatttgtagctgtgggtaccatgttcagcggatcagtttta

SEQ ID NO: 3566 - DNA, 672 bp, Leptinotarsa decemlineata
gattctggaatccaccttgttgaaagaattgaaaaagttggatgacaaaaatttactggtagaagtacagttgcttgaaagtaagacatatcacgccttgagtaacctgcccaaggctcgtgccgcattaacttcagctcgtacaacagccaattccatctattgccctcctaagatgcaagctgcgcttgaccttcagtctggagttctgcatgcagctgatgaaaaagacttcaaaactgcctattcatacttttatgaggcatttgaagggtttgacagcgtagaatcaccaaaagcgttgacagctttgaaatatatgcttctttcaaaaattatgatcaacagtccggaagatgtacaacaaattgtaagcgggaaattagccatcagatatgctggtcaagacatagaagcaatgaaagctgttgcacgagcttctcacaagagatccttggcagattttcagttagcggtgaagcagttcaaacatgaactagaggatgatgttatcgtcagagcccatttaggaactttgtatgataatatgttggaacaaaatctgtgcaggattatagaaccatattccagagtacaggtggactatgttgcaaaaacaatcaaacttccaatgttacaagtggaaaagaagctctcgcagatgattcttga

SEQ ID NO: 3567 - DNA, 668 bp, Leptinotarsa decemlineata
acgccagaaagttgttagatgaaactcaccgagagaaagcccgtttggaaattgatgttaaacgtctgttagatgaaaacgaagagctaaaagctgatttagccaaaaaaagcaaagatttggttctggctgagaattctgccagaatttatgaaactaggtgcaatgaattacaactcaaagctaatcaggcagctgcagatgctaaaaaagctgctacagatgctagagaccttgaaaaggaaagggataagctaagaaagctccttgatgaacatcgtaagcaactggaggaagaatccttagctagagttgaagtagagaactccaaccagagtctcagagaagaactatccttcaaagaccaagtgtaccaacaacagcttaccgagacgcgcactcgtcgccaggtggagatcagcgaaatcgacggtcgtctcgctgaaaagtatgaagccaagctccaggatgctctacaggaactccgagatcagtatgaatcccagatggcaaccaatcgtcatgagatcgaattgctctacgagcagaagattaaaaacctgcaggcggccaacgatagacaccagtcgtctgctgtaggcgctcttgatgaactgagacaggtcaggaccaggatcgatactctgacttcgaggatctcagacttg

SEQ ID NO: 3568 - DNA, 676 bp, Leptinotarsa decemlineata
aagagctcacatgtcattgtcatggctgccacaaacagaccaaattccatcgatccggctctgagacgtttcggcaggttcgacagggagattgatatcggtattccggatgcaacaggcagattggaagttttacgtatccacacaaagaatatgaaactggccgacgacgtggatttggagcaaattgccgccgagacacacggtcatgtgggtgctgatttggcttcgctgtgctctgaatctgctctccagcaaatccgagaaaaaatggacctcatcgacttggaagacgaccaaattgacgccgaggtactgaactctcttgctgtaacgatggaaaacttccgctacgccatgacaaagagcagccccagtgctctcagggaaacagttgttgaagtaccaaatgtctcttgggaggacattggtggtctcgaaaacgttaaacatgaactgcaagaactggttcagtaccccgttgagcatcctgacaagttcctcaagttcggtatgcaaccttctcggggtgtgctcttctacgggccgcctggttgcggtaagacgctgctggctaaggccatcgccaatgagtgtcaggccaattttatatccgtcaaggggccagagctgctcaccatgtggtttggtgagtctgaggctaatgtcagggata

SEQ ID NO: 3569 - DNA, 654 bp, Leptinotarsa decemlineata
cagtagaccagcctttgaaaattgccaaggacaaagaaactggaaaggattaccttctatgcgactacaaccgagatggagactcatacagatccccatggtctaatacctattatcctccattagatgacggttccatgccttctgaacgtttgagaaaacttgaattagatgcaaatcatgcttttgatcagtatagggagatgtactttgaagggggagtttcgtctgtttacttttgggatttggatcatggttttgctggagtaattttaatcaagaaaactggcgatggaagtaagaaaatcaaaggttgttgggactctttacatgttgtagaagttcaggaaaagagttcgggtcggaattcacattacaaaatgacttcaactgccatgctgtggcttcaaactaataaacagggttctggaacaatgaatcttggcggtagtctaaccaggcagatagaacaagatgccacagtaaatgaaatcaacccacacattgccaatattggcaggatggtagaggacatggaaaataaaattcgtaacactcttaatgaaatctacttcagcaaaactaaagatattgtaaatagtttgaggtctgtccaatcgctgactgagagccgtcaacagcaggctctaagag

SEQ ID NO: 3570 - DNA, 761 bp, Leptinotarsa decemlineata
acgtttacaataaaccgggagaagatgttgtcgtaatggcacaaactttagaaaaagtgttcttgactaaagtagcggacatgcccaaagacgaatttgtagtggaaacacctacgaaaggactcaagggaaagaagggaagaacaagtacaggccctgctggtcctgtttcaagtgtgggaaggggtagaccacctgcgacagtatcttcaaccagtgctacaccagtggctactactacaggttcctccggcctgcctttgggaactcaggctccggcaactgtccctggtagcaccgccaccacaacgatagctcctgctaccactaatagctctcttccttctcaacctccagcacaaccttccaattttcatggtgcaccctccatagttaattctttagattcgaatgtgaatccgggggtgctaccgggaagtgttgtacctccttcacaaccagctaaggtgaaaaaaggggtgaagagaaaggccgacactacgacacccacggctactgcatatgattatgcaccaccgttggagtcaaagtcggcaaaaatatcaacaagacgtgaatcaggtagacagatcaagaaaccggtaaggccagaattggatggccatgttccccagccagcatcacagaaactgaaagagaaactttctgaatctttgaaagcgtgtaatgaaattttgatggaattgttctccaagaagcatgctaattatgcttggccattttatcagcctgttgatgct

SEQ ID NO: 3571 - DNA, 787 bp, Leptinotarsa decemlineata
agaagtcgtcaaagaaacgagcattgcccttccggcagtattcaaagcccccatcaggcctgatgtagtcaactttgttcatcaacaagtatcgatgaaccatcgtcaaccctacagtgtcagcgacaaagctggtcaccaaacttccgcggagtcttggggtaccggtcgtgctgtcgcccgtattccccgtgtcaggggcggcggtacccaccgttccggtcagggtgctttcggcaacatgtgtcgcggaggtcgcatgttcgctcccacaaagccatggcgcaggtggcaccgcagggtcaacgtcaatcagcgccgatacgccctggcttcggcagtcgccgctagcggagtgcccgcccttgtgatgagcaaagggcacgtcgtcgaccagatccctgagctgcctctggtggtgtccgacaaagtgcaggagatgagcaagaccaaggaggctgtgcagttcttgaggaggatcaaggcatggtctgatatccaaaaggtatacaagagccagagattccgggctggaaaaggtaagatgcgtaatagaagacgcatccaaaggaaaggacctctcgtcgtttaccacaaagatcaaggcctccgccgtgccttccgtaacattcctggcatcgatctggtcagcgtggagaagctcagcttgttgaaactcgctcccggtggtcacgttggacgtttcgtcatctggaccgaatctgccttccaacgattggacaaactgttcggcagctggaagaccccttccttggaaaagaagggt

SEQ ID NO: 3572 - DNA, 739 bp, Leptinotarsa decemlineata
gtatgacataagggcggaattgaactgcagatacaaagatttgaggcaaccgtttcgttcagctaatcctgaggagttgttcgatatactcacgaagcagactcccgaaactttctatataggtaaaatggtcacggcttcagttatcggtatcgctagaagaaaacccaaaccggatcaactagatcaagcgaatcctgtcagaaatgatgaaactggcctctggcaatgtcctttctgtttgaagaatgattttcctgagttgtctgatgtgtggaatcattttgatgctggctcttgtctaggacaagcgactggtgtaaggttaaggcttgataacggtgtattaggttatatttatataaaaaatatcagtgacaaaccagtatcgaatcccgaagaaagagttaaagtaggccaactcattcattgcagaatacaaaagattgatgtagaacggttcagcgttgactgtacttcaaaatccagtgatcttttggataaaaaccatgaatggaggccccctcgagatccttattacgatcaagaacaagaagataaagacaaaggcatagaagcggagagaaaaaaagacttacaacgtaaaacgtacgtgaagcgaatcatagttcatcccgccttccacaatatttcctatgctgaaacagaaaaatgcatggccaatatggatcaaggggaagtcattataaggccttcaagtaaaggcttcgaccatttg

SEQ ID NO: 3573 - DNA, 656 bp, Leptinotarsa decemlineata
atgtttatgctgcccttgtagcagttataaattctaaatttccaaatataggtgaactcttattgaagaggttagtacttcaattcaaaagaggatttaaacaaaataacaaggtcatctgtatatcagccacaacatttgttgcccatttggtaaatcagaaagtggctcatgaaattttagcattggagattctcactctgctggttgaatcaccaaccgacgattctgttgaagtggcaatttctttcttgaaggaatgcggacaaaaactcacagaggtatccagtaaaggtataacagctatatttgaaatgttaagaaatattcttcatgagggaaagttggaaaaacgaattcagtatatgatagaagttatgttccaaattcggaaagatggcttcaaagatcatgcagctgtcttggaagaactggacatagtggaagaggaagatcagttcacccacttgattaccttggaagatgtgaagcaagttgatactgaagatattttgaatgtcttcaagtttgatgacaagtatgaagaaaatgaaggaaagtacaagacactcagcaaagagatactgggaagtgatagcgagtcagggtctggatctgaaggttctgaagacggttccgaagacgatgaagaagat

SEQ ID NO: 3574 - DNA, 707 bp, Leptinotarsa decemlineata
tgtcaagaagaatggtcctgttgcacaacaacagtctcatggcgttgaatggaggatcttagtggtggatcaacttgccatgagaatggtgtctgcatgttgtaagatgcacgacatatcggctgagggaattactttggtcgaagatataaataaaaaaagggaacccctaacaactatggaagctgtttacttgatcacgccttctgaaaaatctgttcgtgccctgatgaatgattttgaatcgcctcgatacatgtataaggctgctcacgtctttttcacagaagcatgtccagaccaattgttcaatgagttatgccatcacccaatagcaaaacacatcaaaaccttaaaagaaatcaacatagcatttattccatctgagtcacaggtgttttctttagattcgccagatacattccagtgcagttacgatcctacctttgctgcagctcgtaacggcaacatggaaagaatggcggagcagattgctacactgtgtgcaaccctcggagagtatccccacgtgagatatcgtagtgattgggaaagaaacgttgagcttgctcagttgattcagcagaaattggacgcatataaagcagatgagcccactatgggagaaggtcccgaaaaagctagatctcagttgatcattttggatcgcggcttcgattgtgtttcccccttgttacacgaactaa

SEQ ID NO: 3575 - DNA, 694 bp, Leptinotarsa decemlineata
ctcaaagaaagatgttccgccaatttacaaaagtattatgaatccaaacaccaccagaaaaaacagatccagtctggaggattccaagacctgcgaagggacttacaagccgtcataggtaccagagccaatataaacattgcgcaaatagaaaactatggaggcgagacttttttgtcagaagaagttgccatcatgatactccaagataccaagcaagccttccaacgttgtcagttgttatcaaaacctaaagagaaagaatcaaatgctacgcagattttggacagacttatcaacagccttttgatcgaacacgtagattacgccgtagaattaggactccaagctgtcccagttgtcgaaggcgctaaaagtcctccagttctctatttttttaacgtagttcatcagagtaacaatattacgcacttgatggagaagcagttcacggatctggtcgtgcctctagtcgagaatacaccgaaatataatgactgcatacagaagaaaaagtttgttttggaagacattgaaaggaaaataaatacaggcttggacagatgtctcaatgccgttgctacttgggcaaaactgtacctgcagtcggaacagaagaagagtgacttcaaacctgagactgacgattttgacacagtagcgtctccagcctgcaaaaccgttctgaactacg

SEQ ID NO: 3576 - DNA, 318 bp, Leptinotarsa decemlineata
cttggtcagaaacaaatcgggaccgaagagaaaggctgagacagctagctttggagaccatcgacttgcaaaaggatccttattttatgaaaaatcacttgggatcttatgaatgtaaactttgtttaacactacataacaacgagggaagctatttggcccatactcagggcaaaaaacatcaagccaatttggcaagacgagcagccaaagaagctaaagattcgccgtctcttttacaacctgaaaaaccaagagttgaacccaagaaatttgtgaagattggaagacctggttatcgggttacaaaacagagag

SEQ ID NO: 3577 - DNA, 356 bp, Leptinotarsa decemlineata
cctgtgaaactattaccggtgaagtctacagaggaaaactaatagaagctgaagataatatgaattgtcaaatgacacaaatcactgttacataccgagatggcagggtagcccagttagaaaatgtttatatcagaggatcaaaaatcagatttcttattctaccggatatgttgaagaatgctccaatgtttaaaaagcagacgaaagcgggaactgcagggagaggaaaatctgcaatacttagagcacaagctcggggaagaggacgggggcagcagcctcagatgcgtggtggtcggggaggtacttggcagaaccagcaaggtggtgcacctaccggtcgtggaagataa

SEQ ID NO: 3578 - DNA, 775 bp, Leptinotarsa decemlineata
ttggttcgagtttcggttatattcagggcaggtagccgatatgagtccagtgataatttaggagtcacacacgtattgcgtactgcagcagggctgtcaacaaaaaatgcttcccagtttgccattattcgtaacattcagcaagttggtgctaacttgacagctacatctgatcgtgaaactatttcatatactctagaaggtacaagacaagcagttgaaaaagttctcccattccttactgaagtcgcaacccagcaaatattcaaaccctgggaggtttcagatatcacttccaggctccaattagatattgcaacgagatctctaccgttgagagcaattgatctactccacaatgctgcatttcgtactggtttgggcaattcaatgttcatccctaaatcacagattgggaaaatatccagtgagactctgcagcactatgttgccagcaattttctatccgggcgtgccgctgtaattggatttggtatcgatcagtctgaactcattcattatgcacaaactttaaacattgagtctggggagggatgtaataattcctctagttataaaggtggtgaattgagatcaaacaaaggtggagatgtagcttttgtcactgtagctggagaaggcgcctctttgaaagaccccaaggaagctctagcttttgcaattcttcaaaaagcaattggtgttggacctcaagtgaagtggggtaataataatggaatttttagcagagttgtaggtactggagagcatacat

SEQ ID NO: 3579 - DNA, 185 bp, Leptinotarsa decemlineata
tcgaatgactcaagaactacaagagaaaattggtgttctgaaatctttatctattgatattggcaatgaagtgaaatatcaagacagattacttggagatgttgatgatgacatggatagaactagtggattcttgggaacaactatgaaaaaggtgttgaggctatccagaggatctcacaact

SEQ ID NO: 3580 - DNA, 765 bp, Leptinotarsa decemlineata
ttgacgtgatgaactccattgctcgtggtcagaagatccccattttctctgcagctggtctgcctcacaatgaaattgctgcccagatctgtagacaggctggtttagtcaagattcctggtaaatctgtacttgatgatcatgaagataactttgctattgttttcgctgctatgggtgttaacatggaaacagctaggttcttcaaacaggatttcgaagagaacggttctatggagaacgtctgcctgttcttgaatttggccaacgatcctaccattgaaagaattattacaccccgtcttgcgttgacagctgcggaattcttggcttaccaatgtgagaagcacgtcttggtcatcttgacagatatgtcttcgtatgcagaagctttgcgtgaggtatcggctgccagagaagaagtgcctggtcgtcgtggtttcccaggttacatgtacaccgatttagctaccatctatgaacgtgccggccgtgttgaaggacgtaacggatccatcacccagattcctatattgactatgcccaacgacgacatcacccatcctattcctgatttgactggttacattactgagggacagatatacgtcgaccgtcagctccacaacaggcaaatctaccctccgattaatgtgttaccatctctttctcgtctcatgaagtccgctattggtgaaggcatgaccaggaaggatcactctgatgtgtctaatcaactgtatgcttgttacgctatcggtaagg

SEQ ID NO: 3581 - DNA, 748 bp, Leptinotarsa decemlineata
aaattctggcctacggaaatcaagaaagtaagcttattattttggcttcgcaaggacccatcgaattggtaaggattatgagatcctatgattatgagaagcttttgtggaccacttcaagagtcttaaaggttttgtcagtttgttccagtaacaaacctgctgtggttgaggcaggtggcatgcaggctttggccatgcacttaactaattccagctcaaggttggtgcagaattgtctttggacactccggaatttgtcagatgcagcaacaaaagttgatggtttggagagtttactccagtctttggtccaagtacttgcttcttcagatgtgaatgttgtgacgtgtgcagctggaattctttctaatctcacatgcaacaatcaacgcaataaagtgacagtctgtcaggttggtggggtagatgccctggttcgcaccatagtgagtgctggggatcgtgaagaaatcaccgagccagctgtctgtgctttgcgccacttgacttcaaggcatgttgagtcagaaatggcccagaacgctgttagactaaactatggagttcaggtcattgtaaaactattgaacccaccatctcgttggccattggttaaggctgtaattggtttgataagaaacctcgctctatgtccagcaaatcatgctcctctgagagaacatggagctatacaccatctggtacagttattgatgagagcattccaagatacacagaggagagc

SEQ ID NO: 3582 - DNA, 366 bp, Leptinotarsa decemlineata
gttgggagaaacagaaaagcacaaaaaaaggaggccttacctagcatcggaatgtaaaagtttatatgcttgtgaaaagtggcgaatgcagatcattagagaaattgccaagaaagttgctcaaatccaaaacgcgggtcttggagaattccgaataagagacctgaatgatgaaattaacaaacttcttcgagagaagcaccattgggaggatcagattgaagagctgggaggaccagattatcagagagtggggcctcgtatgctggatcatgaaggaaaagaggttccagggaataggggttacaagtatttcggtgctgcgaaagaattgccaggggttcgcgagttgtttgaacaagagcc

SEQ ID NO: 3583 - DNA, 520 bp, Leptinotarsa decemlineata
cgacatttgtgaaacgtcatatgactggtgaatttgaaaaaagatatgtagccactttgggagttgaagtccatcctctggtcttccatacaaacaggggccctattcggttcaatgtatgggacactgccggtcaggagaagtttggtggtctccgtgatggatattacattcagggacagtgtgctattatcatgtttgatgtaacttccagagttacatacaagaatgtaccaaattggcacagagatcttgtcagagtctgtgaaaatatcccgatagtactttgcgggaacaaggttgacatcaaagatagaaaagtaaaagcgaaaagtattgtctttcataggaagaagaatttgcagtactatgatatctctgccaaatctaactacaactttgagaagcctttcctatggctagctaggaagctcattggtgatcccaatctagaatttgtagccatgcctgccttggtgcccccagaagttcaaatggatccacaatggcagaaacaaat

SEQ ID NO: 3584 - DNA, 332 bp, Leptinotarsa decemlineata
gggaatttttgggagtaggtggaacatggaatttgaacgaagagaagaatccggatgcagaaatcgtggcctccggtgtttttgttggttatataatatataacattgtcagtatgatcagcttttgcttcgccactttggatcacaaatacaacttcacagatatcctgatgaatataattggtcttttgctgtgggtagcagtaggagcaactgctatccactattggcacggttatttggccgaacataaatatacccacgtcgactcggagagatcggttggattggccatggggtccctttgcgtcctgaatggtgcagcatatttg

SEQ ID NO: 3585 - DNA, 695 bp, Leptinotarsa decemlineata
cagtactgttgggttcatgactcccagaagcggcgcagttgtgccagtaggtgctcagggtgcttatgtaccatctgtcagagataaattgaatataaacccggaagacggaacagttgacgtgaccactactccagcaacccagaaaatgtatcaaaattctgtgaggagtcacgtaaaagtaggtctcagtagtttaccgcagccaaaaaatgactatgaaattgttgttcccgagcatgaagaccaggagatgccagaacaagcccaagagcagttggttgaagatcaggcagacatcgacaaaaaaatccaagaggaactgaaagctaaagcagcacgggagcttgcaagtcgatcgcaagtaatccaaagaggcttccccagacctcaagaagttaacatgtctgtgttacgtcctccccatgagagctattctttgacagatctccagaaatccgaggaactgataaaatgtgaaatggtgacaatgctgctacacgacaatctgaaaaacccggtaccaaactcgaataagaggtctaatttatcacaagctgaacaactggctttcctggaacaacatccgtatgaaaacttccgagacgaagacatagccatcgcaaaaaatatgttgaaacgcgagatggatattgtaaaagtcggcatgagccacggagaacttcccttagatg

SEQ ID NO: 3586 - DNA, 348 bp, Leptinotarsa decemlineata
tgtggctcatcctgataaactcaagaaaaaaataactagagaattaatcaccacgatcttggcgaggaaacccaaaatgtgtagtttcttagagtggagagatttgaaagttgtatataagagatatgccagcttatacttctgttgtgcgattgaacaaagcgacaatgaactgctaactttggagatcattcaccgttacgtggaacttctcgacaagtattttggcagtgtatgtgaactggatatcattttcaatttcgagaaagcatacttcatcctggacgaacttttgttgggtggggaggtccaggagaccagcaagaaaaatgttctcaaagccattgc

SEQ ID NO: 3587 - DNA, 689 bp, Leptinotarsa decemlineata
ggaaccattaaagacagggttaagggtgttatagatgaagccagtaaatcagatatagcgaaaaaagctggcaaattcactgaagaagtaggaaaacagactcatagaataagtgaaaaggcccaagaaataagtaaaactggtgcttttcaaagtatttctcaggctacacaagctgttaaaaaggaaattgacaccacaagcatggaaggtagagtttaccagagtcccacaaaattacgaaagcgaaccgaaactggtgcagtagtgcaccaaaaatattatgagccaaacgtagatgctactggagttgaacttcacaaggattcaaagttctacgagtcgtggcaaaacttcaaagataacaacccctatgtccacaaagtgatggactggaaattgaagttcgatgaaagtgagaatcccgtcattcgtgcatcaagagccctcactgaaaaagtgggtgatatcatgggtggtctgttccagaaaacagaactttcagaaactctcacggaaatctgtaagattgatacgactttcgaaacgaaacgctttttaaaacagtgcgagaccgacattattcctaatgtacttgaagcaatgacgcgaggcgatttagaaattctcaaagactggtgtcatgaaggccccttcaacctgttcgctgttcccatcaaagaggctta

SEQ ID NO: 3588 - DNA, 488 bp, Leptinotarsa decemlineata
gctgcagtatcagaagctattcccaaattgaaaggcttgggattgttgacaaaaaggcctgatgattactttgcagagatggcgaagacagacgaacacatgcaaaaaattcgggaacatttgatgaagaagcaggaacagcaaaagagaagtgaaagggtcaaacaacttcggcaacagaggaaagaggggaaaatggttcaaattcaaacgaaactacaaagacaggaagaaaagaaagaaatgttgaatcaggttaagaaagttcgaaaggggatgtctaaagatcttgattttcttgatggtaaaaaaaataaatctattggaagaaaatctatggaaaagaggaaaatgaaagataaaaagtttggctttggtggaaaaaaaagcggcatgaaaagtaatacaaaggatagtgctgctgatattagtgaattcagaaatcctggaaaatctggtaaaaaattccccaaaagaaacagcaaaca

SEQ ID NO: 3589 - DNA, 651 bp, Leptinotarsa decemlineata
tagggttaaacgacaaggacgtagctgaattcataatacatttatctgaagaaaacaatactcttgagagttttacaaaagtaatcaaagataatgacattgaattgtcggattctttcattgctgatctgcttcatattattcaagacaataatggtagaatcgctaaaatgagtgagaaagctcctactactgaaaagatgaatgaagtagaaaaattggaatacctgtctcttgtatcgaaagtgtgtacagaattagaaaatcatcttggactcaatgataaagacgtagctgaattcatcatacatttatctgaaaaaaacaatacgcttgaaacattcaccaaagcactcgtggactgtgggtctggattttctgattcttttattgctaatctactacgaattattcaacacatgaaacccccaaaaaatcagtcgaaggaagaggctgccattactcaaaaggaagtattagccaagaaatttccaggattatccattcctaatgagcctcagaaaccacttgatcttgaagggaatgaaaatgacagcattgatacagatattgtagcagatatgatgaaacagtttgaagcagatgcaccttcaaaaaaagataacattgaaaaggattcaagccgaagta

SEQ ID NO: 3590 - DNA, 798 bp, Leptinotarsa decemlineata
acatctgccaaagtcatgatggaagagggccgaagcaagggattcggttttgtctgcttctcttcaccagaagaagccaccaaggccgtcaccgaaatgaacggcagaattgtagggtccaagcctttatatgtagccttagcgcagcgtaaagaagaccgaaaagctcatctgacttcccagtatatgcaacgcatggcaaatatgcgtatgcaccagatgggacaatttatccagccgggagcttcaagcggttacttcgtacccaccattcccacctcccagcgcttctacggtccagctcaaatggcacagatccgtacaagtccaagatggcctgcccagacaccggtgagacccgctggtcaaggaggcactgccgcttacacaggcatgcccaacacatacagagcagcagctaggcctccaaatcaatccactgccatgcgcggaaatattagcgtgccaagacccattacaggccaacaaccacaaaccatgcagggacgtccattagctggacaaggtgttgtacctgctacgggaagtcgaacaaacttcaaatacacctctaacatgagaaatccaccacaagccttaactttgcaaggagctgctgctcctgttcaacaagctgtccatatccaaggccaggaaccactgacctcaactatgttggcctcagctcctccacaagagcaaaagcagatgttgggcgaaagattgttccctctcatccaacgcatgtatgctgatatggctggaaagattactggaatgttgctggaaattgacaac

SEQ ID NO: 3591 - DNA, 761 bp, Leptinotarsa decemlineata
gctgtttgtgttgctaaactttatgatatttcctcaggattagttgaagatcaaggatttctggaacagttgaaagaattattgagtgattctaatccaatggtggttgctaatgcagttgcagcactgtctgaaattaatgaaagcagcccaactggtcaacctcttgttgaactcagcaccaacacaataaacaaactgctgacagctctcaacgaatgtactgaatggggtcaagttttcattttggattccctttccaactatactccaagagacgaccgtgaggcccaaagtatttgcgaacgtataacaccacgtttggcacatgcgaatgctgcagttgtactgtcagctgtcaaagttctgatcaaaatgatggagattctagcaggggatactgaattctgcaccactatgagcaagaagcttgcaccacctctggttacgctacttagttctgaacctgaagtccagtatgttgcattgagaaatataaatttgattgtgcaaaaaaaaccggatattctgaaacatgaaatgaaggttttctttgtcaagtataatgaccctatctatgtcaaactagagaagcttgatatcatgattcgtctagcctctcaagttaacattgcacaagttctgagcgaactgaaagaatacgcaactgaagtggatgtggactttgtgagaaaagccgtgagagccattggaagatgtgccattaaggtagaaccttccgcagaaagatgtgttgctac

SEQ ID NO: 3592 - DNA, 348 bp, Leptinotarsa decemlineata
gaagtgggagctacatcttccttggctcctaaaatcggtcctctaggattgtccccaaaaaaaattggagatgatatagccaagaatacagccgactggaaaggtctgaaaatcactgtccagctgaagatccaaaacagacaggccaccatttccgttgtaccttctgctgcctctctcatcatcaaggccttgaaagagcctccaagagataggaagaagcaaaagaatattaaacacagtgggaatatcagttttgatgaaattatttccattgccaagcagatgagacctcgatcgatggcaaagcaactgtctggaacagtgaaggaagttttaggaactgcc

SEQ ID NO: 3593 - DNA, 664 bp, Leptinotarsa decemlineata
ttggtagaagctggtgtaaccgaagtaattcttgctgtgtcctacagggccgaacagatggaacaggagctgacggcagaggcagctaaacttggaataactgtagtgttctcccatgagactgaaccattgggaacagcaggacccatagctttagctagagaacacctctcaaaaagcacaaagccattttttgtgctcaattctgatgtcatttgtgattttccttttagagatttggctcgtttccacgaggcacatggaaaagagggtacaattgttgtgacaaaggtagaagagccttcaaaatatggagtggttgtatacggtaaggacaactgtatacaaagtttcgtagaaaaaccacaagagttcatttctaataaaatcaatgctggcctttacgttctcaatcccagcgtaatagatcggatcgagctgcgacctacttctatagaaaaagaggtttttcctggcatggcagctgataagcagttgtttgcttttgacctacagggcttttggatggatgtgggacagcccaaggattttctcactggaatgtgcttgtatttgaagcatttgagatccaccaatggaagcaaattatataaagggccaggtgttgttggaaatgttctagtggatccatctgccaaaattg

SEQ ID NO: 3594 - DNA, 701 bp, Leptinotarsa decemlineata
gatttcattctccattcgccgcctggcgaatttaatgaagtctttaacgacgtacgaaaactcctcaataatgacgacctactaaaggagggcgccagcggggcattcgcccagtacaacaaagaccaactgaccccagtgaaaatagaaaactccgataacttagtgctcatcaccgaatacaacgatcagggaaacaacagatttttcgacccgcgaagcaggcagagctttaagtatgaccacctgcgaaaagaggcctccgactaccagacgtacaccccggatccagcggcggagccctggcgctccgctctcgacgctgagttcatccagtacaccaggaatcattaccgggacggggtgtgcagtgtggtgggcaggaaccaagggggcaacgtggtcttgacagcttgcatcgaagaccaccagttccagccaaagaacttctggaacggcaggtggaggtcgcagtggtcgatctctctgaatggaggatccgtggcagaagttagaggtgtgttgaaggtgcaggtacactactacgaggaaggcaatgtccagctggttagcacgaaggaaatcaaagagtcagtggtggtaacgaacgaggctcaaacggcgaaggaaatagtccaggtcatcgaaacggcggagaacctctatcagacggcgatttcggagaactaccagacgatgtc

SEQ ID NO: 3595 - DNA, 722 bp, Leptinotarsa decemlineata
cttgaccactaacgaaaacgctaacattcgcatctccttatggggttacagagaaacaacaataaggccaacgttcgtttacatcactgatatcgcagacagtctccaaaatactggagagtataccatcgtaccgtcccaatatagaacaaaagttaatgagtttctcacggatatcaaatttggtttcttgcaaattaacttgactgaatctatcaaagtgaacacttatacatctgtacaaagatcggtggaaatagttcctgttgtatggagtcgacccattcccctaggatggtactttcagttccaatgggaaaatatgtatggacgaagctggcccaaagcactctgcgatgactggctaagaacagacagatacctgaaaaactttgctcatgagttacctcaatgcccttgcactgtagaacaggctttggcagacaaagggaggtatatgcccgactttgattgcgacaaggactcaaatcccgtatgctactacaataaccaagctctgcactgtgtgaaaacaggatcaccaacgttggagggatcagaacagcagtgctgctatgacaaaaacgggtatctcatgttatcatacgatcagcagtggggttcaagtccacggcgttgccacaatctgggaaaaatgccctacaacgaagcaacaaaagttccaaccttatcgcaatggttcaacgatatggtaccgaagt

SEQ ID NO: 3596 - DNA, 177 bp, Leptinotarsa decemlineata
tctttcttttcttcggcggctgctggtgctgcagaagctgctgcagcagcaggagcagctcctccagctggcatggagctcaatttctcacgtccttgggcgatgagttcatcaatagattttccacctagttcagcaatgacctttttcagccgttctccttcagcttcaattcct

SEQ ID NO: 3597 - DNA, 790 bp, Leptinotarsa decemlineata
ggagaccaatgtaccattgttggttctcattaaggctgctcaaaatggaaatgaaaaagaagtggaggaatatgcagttgtcttcactgaacattccaataaattggttgaagtcgccaacctcgtttgcagcatgtctaataatgaggatggcgtgaaaatggtccgttacgcagcagctcaaatagaaaatctctgccctgaagtaataaacgctgctcgtatcttggcagccagacctcgtagcaaagttgctcaagaaaatatggctgctttcaaacagtcttgggagaatcatgtcagaattctcacggaagctgtcgatgatataacgactattgatgactttttggctgtctcggagaatcatattttagaggatgtcaataaatgtgttttggcattacaagaaggggatgctgacacattggaccgtacagccagtggtattcgtggaagatcgaacagggtttgcaatgttgtttctgctgagatggacaattatgagccgtgtatatacacgaagcgcgtactggaagctgtcaaagtgctcaacgatcaagtaatgccaaaattcactcaaagagttcaggttgcggtgcaagcattaggaaacaatccaccaaaagaagttgatgaaaatgacttcatagatgcgtctcgcttggtttatgatggagtgagggaaatacgtagagccgtgttgatgaatagagctgacgaagatttggacccagaggatgttgaactggatgaaaactatacattggagaacagaagcaaatcgagt

SEQ ID NO: 3598 - DNA, 727 bp, Leptinotarsa decemlineata
acctaccactactacaggactttctttgggcgtcccttctgtcaccagtacggctgctggtattacaactacttctgcaaccaaattgagtttcggactatcatcaggatcatctactactacagctgttgtgacaacatcaggaacatcttcaaccattgttccagctgcaaccacggtaacatcgtcaacttcgataattccagcaactgggttactaacttttagccaactagaagactctataaataaatggacaatagatttagaagaacaaggaaaatttttcataaatcaggcaaaacagttaaatgcttgggattctttattgatttcaaatggtgaacaaatattgaatttgaatggcagtgtagagcgtgtcaaacagcaacaacaacaactagatcaagaactggactttgtacttgctcagcaaaaagaattggaagagcttatagctcccttagagaaggaattatgggacatacctgttactgatattgatagaaatcaaatgtaccagttttcagaaatgattgattctcagctaaaacaaatgtcggaagacttgaaggaaatcatcgaacacataaatgagtctaatagaaatgaagcggcatctaatccaattgcccaaatcagccgcatcctgaatgctcatatgaactccctacagtggatagatagaaacacttcgcaaataagttctcatttggagcaaatcacc

SEQ ID NO: 3599 - DNA, 447 bp, Leptinotarsa decemlineata
ggacaatgctggaaaaacaactttactgcatatgctcaaagatgataggctggcacagcatcttcccactttacatcctacatcagaagaattgtcaatcggcagcatgaggttcacgacttttgatttgggaggccattcacaagcaaggcgagtgtggaaggactacttccctgctgttgacgccattgtctttttagtagatgccaatgataggaacagattcaaagagagtaaacaagaattggattcgctactcacagacgagactctttcgaattgtccggttcttatattaggtaacaaaattgatttgcctcaagcagcttcggaagacgaactaagaaattactatgccttgtatggccaaacaactggaaagggaaaggtggcaaggtccgatttgccaggacgtcccctcgagctcttcatgtgctccattctgaa

SEQ ID NO: 3600 - DNA, 494 bp, Leptinotarsa decemlineata
ttgtgttactttattgcgtgtaatttttctgatggatccaataaacttgttagagagccgtattgaaaatctggaaattcagattttcggagataaattaccaactacaaatactaaaaatgttactagtttacttttggaaactcatgcaatgattacttcagctttaagttgcagagaagtaattagttccatgcttcaccatttgtctattataaatgaatatctagatccaaaccttggagtagatgagctagaagctgaagctaagaggtatcacttactccaattatactcggaattgaaagatactgtacagaagattggaactttagagtcactgttacccttcattgattctgagaacatagcgaaagtaactgaactatcaggaaatatagagcagctggcagttggtaatatgaatacatattctgaatgccaagaagttactcagaatgtattgaaatctttgcgaaattacaatgagatca

SEQ ID NO: 3601 - DNA, 730 bp, Leptinotarsa decemlineata
cagagcagatagtggagttcctaggcgaccgcgctagcttcgtacagataagaggatccatacccctgttctggcatcagaacccggatttacggtacaaaccaccgcctacacttctggatgtggacccccaggagcagcaggctgcgtgtctacgtcacttggaggaaatgactgctatatacggcaagcaagttctggtgaatctcatcgatcagactggtagagaaggtggaattgagaaggccttcagggataccatcagtattttagggtttgcttctgcaagatacgagcctttcgatttccaccacgagtgtagaaagatgcgctgggataggctctcaatcctcatcgacagaattgctctggaccaggatgaaatgggcttcttcctgattcttcgggacggctctttgagctctcttcaggacggagtgttcagaacgaactgcatcgactgcctggataggacgaacgtggtacaaagtatgctcgcccacagaaatttggatgtggtgttgaagaaactgaatattctgcatccgaatcagaggttggacgagcagtcatcgttcgagatgctatacaagaacgtgtgggccgacaacgcggatttcatcagcattcagtactccggaactggagctctgaaaacggacttcactaggacaggaaagcgcacacagctgggattgattcgggacgggatcaactctctcgtgaggta

SEQ ID NO: 3602 - DNA, 737 bp, Leptinotarsa decemlineata
gatgagagtggtgaacagtttgttgcctactttcttcctacggaggaaaccttgcagaagcgaagggaagattttgcaaatgaaataccctatcaagatgatgaggagtatgaatataaaatggctagagaatacaattggaatgtcaagagtaaagcaagcaaaggatacgaagagaattacttctttgttgttagacaagacggtatttattataacgaattggaaactagggtaagactgagtaagaggagacagaagattggccaggcacccagcaatacgaggctcattgttaagcacagaccaatggatgccaatgagtttaggatgcaacgctacagagagaaacaacttgaacctccgggtgaagaagacgaagaaatggaggtagaggaaacccaggaggagactcaggaagagactcaggaagggcaaggcaatgacagtcaagcagaatctgatcaggaaaaccgagaaaaagcaggaagcggaaaggaagaaggttcacgagcctcttcgagatcttccaggaaatcaaaatcccgttcaagatcccgatccaattcatcagcaaagtcacgttcaagatctagatcgaaatcagcttccaaatcgaggtcccaatctagatcaaggtccaggtcaaaatctaagtcaaggtcacgttctgtatctaggtctcgatcaagatcaaagtctggctcaaaatctccgtcgaggtctagatccagatc

SEQ ID NO: 3603 - DNA, 757 bp, Leptinotarsa decemlineata
atttgtaaggactctggctggaaagtggatcagaacttattgaaagccatgaaaatgaaaaatgatgaacaaataaaacttttggatgaggccattgaagatgctgaaaaaaacttaggagaaatggaagttagggaagcatatttgagaaaggcagagtacttcagtcgaattggtgataaagataatgccgtgagcacatttaggcaaacttatgataagacagtttcgcttgggcacagactggatattattttccatttaataagaataggcttattcttcatggatcatgatctcatcactagaaatattgaaaaagcaaaaactttaatagaggaaggtggtgattgggataggagaaatcgcttgaaagtatatcagggtgcttactgtatggcagtaagagattttaagactgcagcaaacttgtttatagacacagtcagtactttcacatcttatgagttgatggattataaagcatttgtccgctacacagtttatacatctatcattagtcttccaaggaaccaacttcgagataaggttgttaaagggtcagaaattctggaggttcttcattctgaaccattcgttaaggattatttattttcactgtacaattgccagtatgcagaattcttctcaaatttagcggaagtagaaaccactctcagaaaagactacttcatgaatcctcattatcgctattatgttcgagaaatgaagattttggcctacacacagttactag

SEQ ID NO: 3604 - DNA, 314 bp, Leptinotarsa decemlineata
aacctacaatcagcgttcttctgaaaaaatgaaagccgacgaagggttgggaaaaggagctaccatttctgcagtcctgtatgctaatgttaatcatcctgagtggaaaaaagagttccctagttggtcagataggtacaaacagataatcaaaaaatggaggactttgagtcaggatcagaaggctccatttttgcagctcgcgagggataataggagccaattgaggatgaagaagtcccaacaagatcaggacaagatggccctacagcaaaaatctgctcgagaggcggaacaagagaggcagtggaaac

SEQ ID NO: 3605 - DNA, 795 bp, Leptinotarsa decemlineata
gtcctgccttacacaaactaaatatgctgttgacaaaaaacctccaaatcctccattccagcaacatttttgtgttttttcatgtcctgcacagcaagttctacctcttaacattcatgaggctctgggaaattatagggtaacgaaagtacaaaaaatggactctgaacgagcgctcctcaactatttcattacacagttttccaaaatcgatccagaccttatagtagggcatgatctgcaaggatatcaaatcaatattttagctgatcgtcttacaaaacaggacaacaaaactttcagtaaattgggaagaataaaaagatccgaaaagaaaagactggaaaagcatttatttgctggtagactcgtatgtgatatcaaaatatcagccaaagaactaataaaatcgcgatcatacgacctagatgctctttgtcaagtcattcttaaactcaaagaaaatcaaagaattgaactagaacctgaagacattcccaaaatgtatcagtcaaccaaggatctactgaaactgatatcatttacagtgcaagatacatcgtacattctcaaaatgatgtacgacttgaatgttattcctcttgccttacaaatcacaaacatagctggtaatataatgtcgaggactttgatgggtggtagatcagaacgaaacgagtttttactattacatgcattttcagaaaagaattatatagttcctgataaggaatataagagaaaagataccacactgtcgagttcagcaagaaagaagccaacttattcaggagg

SEQ ID NO: 3606 - DNA, 758 bp, Leptinotarsa decemlineata
agactgaagctataacgcaggccattagaaagagtattggcgttagaataaaggaagagagcgagatcatcgagggtgaagtagttgaggtacagattgaacgaccagctactggggtcggtacgaaagtagggaaactcattttgaaaaccaccgatatggaaaccgtctatgatcttggtgggaagatgatcgacagtattttgaaggagaaagttcagtctggagatgtaatcactatagataaagctacaggaaaaatcactaggttaggcaggtcctttgcaagagctagagattacgatgctactgggcaacaaacgaggttcgtacaatgccctgaaggtgaactccagaagagaaaagaagtggtccatactgttacattgcacgaaatcgatgtcataaacagcagaacgcatggtttcttagctttgttttcaggtgataccggagaaatcaaagctgaggtccgcgagcaaatcaacggcaaagtagcggaatggcgagaggagggtaaagccgaaattattccaggggttttgttcatcgacgaagtccacatgctcgacatcgagtgtttctcgttcctgaacagggctctggaaaacgaaatgtccccgatcgttatgatggcaacgaacaggggcatcaccaagatcagagggacgacctacaagtcacctcacggcatcccattagatctgctggacaggacgataatagtgcctactcagccatacgaggagaaggagttg

SEQ ID NO: 3607 - DNA, 792 bp, Leptinotarsa decemlineata
tcttccgagggtctctttataaaaaatatcctggaatgttcagaagatctataaccaatgaagaaagaagacgattgatagatcttggcttgagccaacatgttttagctagtagcgtttctttgttgaaagcaacagaagttgaagatatcatagaaggcaatgacgagaagtacaaagctgtatcagttcacacgtctgaacctcctgctcccagagagagcaagtcaaagaagaacatgcaatgggtaccttccttaccaaattccagtcacttagatgcagttccccaagctacacctattaatagaaatagagttgcatctaagaaggttagaacttttccattatgttttgacgatacagatccacaaattaatgttgaaaatgcttgccaaggagaagtattggtacctataagactcgacatggaaattgaaggacaaaaattgagagataccttcacatggaataaaaatgaaagtttgattaccccagagcagtttgctgaggttctttgtgatgaccttgatttgaatcctctgacgtttgtaccagctattgcacaagcaatcagacaacaactggaggcttttccagctgaaccttcaagcattattgaggaaacttgtgatcagagagttattatcaaactcaatatccatgtcggaaatacttctttagttgaccagattgaatgggatatgagtgaaaaacaaaataatgctgaggaatttgcactgaaactttgcgcagaacttggcctaggtggcgaattcgtaacggctattg

SEQ ID NO: 3608 - DNA, 479 bp, Leptinotarsa decemlineata
ttggttattgtcggtgatggagcctgtggaaaaacatgtctgttaattgtattcagtaaggatcagtttccagaggtgtacgtaccaaccgtgtttgaaaattatgtagcagacattgaagtcgatggaaagcaagttgaactcgccttatgggataccgctgggcaagaggattatgatcgtctacggcccttatcgtatccagacaccgatgtgattttaatgtgcttctcggtagattcgcccgattccttggagaatatacctgaaaaatggactccagaggtgaaacatttctgcccaaatgtgccaattattctggtgggcaacaaaaaggacctgagaaacgatcctagtaccattaatgaactaaagaaaatgaaacaagaaccagtcaaacctcaggatggtcgatctatggcagaaaaaatcaatgcttttgcttatttagaatgttctgctaaaagtaaggaaggtgt

SEQ ID NO: 3609 - DNA, 728 bp, Leptinotarsa decemlineata
aggggtgcttattcgaaatttcttatcaggccgaaagcggctggtttggcaaacgatgtaagaaagtcaatttatccactagttctttctccttcttagttccttccttcttgaacgccgccctcagcgaagatgatggcatcacccaaatttctatagacaacagcagacatattctgtacactctcaccgaaaaaggaaccatcgaagtatgcgatctgggagaaaaaggaaattcattttcgaggatagcgaaaatgactcaaaacactctggtcaaccaggccatgaacacagttaagactttggacagtcaaaacttccgtcccatcatcagcatctccgccatagaatcgttcgagtctgcaaatctgaaccttgtcgcagtatcccaaacgggaatcagattctacatgtcggtggtgagcctttccaactttctgccgaatcagagaccatacactttgactctcgttcacgtgaggatgcctcctggatattctgccaacgtaacggtgagacccagggcggtccacgtgtctcaatacagggataggaattcattgttgatctcaactgttaatgagaaagacgttttgtggtgtataagttcggatttatttcctttcagtcaaacgctgatggaagcctatactacggtgaatttggatggacctgctctggctgtggctgaggttcatcaatccgtacctttattgtccacgcaa

SEQ ID NO: 3610 - DNA, 694 bp, Leptinotarsa decemlineata
tgaggaagccttctttgtactagcttatccgtctacagaactcttacttatcaaacagaaccctgatgatggacaagttgtcgccacagaattgaaaggcgaatctctgatgcccagatttttgtcgggacttgcagagaaatttcgacagaaaaattcagatggaagcaatatagtcagtctcttattctacgtggtggattatgaaacatatgtgttaactctaagcagggacggacatttgaaattctggtcttgtgctaaaggacagtgtgtggcagtagttgatattctcgaaaaatcaggggaggtctcaagaaccaggatccaatcagcaagtttaaggaaagctgtcgacggaaacagcagcgaaagtctgttggctgtgtttttgagttttgctaatggatgtcagtttcaaattttgagccccgttataagaggacaggaaattacagtggatcgtttggatacgagacattctccagagagtgacctcatcgattttgctctccaaacaaatcgtttgtggacagcatggagatgtgaagatggcgaatgtgtggtatacactacttctcttcaaccaggaatgagccaatcttctcgccactcgggtttgttacaatctagtaactgggcccccgttgtcttggaaacaataccagacgcaaatcaagcacctgtcaatgat

SEQ ID NO: 3611 - DNA, 722 bp, Leptinotarsa decemlineata
gagtcagatcgagcagaaattaaaaattcaattgtaactctaatgttgagttcaccagaaatgatacagaaacaattgagtgaagcaataagtattattgggaagattgattttcgcatggaatggccaaacttgattccacaaatggttgaaatgtttgccacaggcaacttcaatgtgattaatggtgtgcttcgaacagcacattctcttttcaaaaagtatagatacgagttcaaatctcaaaaactgtggatggaaataaaatatgtacttgagaaaatagcgcaacctcttaccgatcttttcattgcaacaataaacctttcccaaactcatgccaatgatgtaaatgcattgaaagtaatctatagttctttagttctcatatgcaaagtgttttattctttaaatttccaagacttaccagaattctttgaagataatattcaagtttggatgtcaaattttcacactttgcttactgtggaggtaaaaagtcttcaaaataataacagtgaagaagctggagttattgaacaactgaaatctcaagtatgtgataacattgctctgtatgctcaaaaatatgatgaagaatttcaaccttttctgcaacagtttgtgactgatacttggagccttctagttggaaccggtctcgaacctaaatacgatctgatagtttcaaatgccctacaatttttgtcgtcagtagcaga

SEQ ID NO: 3612 - DNA, 477 bp, Leptinotarsa decemlineata
tcgaatgcatagaagaactgaaagaagatctagagtggaaaatgatatatgtaggctctgctgaaagtgaagagtatgatcaagtattggattcagtatttgttggccccattccagaaggaaaacatatgtttgtatttcaggcggatcctccaaatgtatctcgaattcccgagaatgatgccataggagtcactgtcgtgctattaacatgttcatacagaagtcaagaatttattagagtaggatattttattaataatgaatacagtgacccagaattgagagaaaatcttcccagcccaccacagtttgataaggttgtaagaaatattttagcatcggaaccaagggtaactagatttaaaataaactgggaagagacaaacccacaagaaaatgtgacacatacggaacaaactgcgacagggtcgtcagttaatgtagaaaataacagcagtactccagctgatgtac

SEQ ID NO: 3613 - DNA, 735 bp, Leptinotarsa decemlineata
caacctagcacttctcaagttccacccttggcaccaatgggtggtctaacgccaactttgggtctcggcatgggccatgccatgtctatgaccccaactaagtatgttactggattcgctcttccaatgagtaccattacccagcaaactccacaacatactatgatgagtcctctggttaacttggggggatcagtagttaccggatcaacacccaccatggctccagcaaccccttctccattgactccaatgactccacattctgctgatccaggaataattcctcaactacaaaatatcgtatcaacagttaatctgaactgtaaattggacttgaaaaaaatcgccctccacgcaagaaatgctgaatacaatccaaaacgttttgctgccgtcataatgaggatacgagaaccccgtaccactgcattaatcttctcctccggtaaaatggtgtgtacaggcgctaaaagcgaggaagactccaggttggctgcaagaaaatatgccaggatcatacaaaaacttggtttcaatgcgaaattccttgatttcaaaatccaaaacatggtcggcagctgcgacgttaaatttcccattagattagaggggctcgtgctcactcacagttctttcagtagttacgaacctgaattgttccccggattgatctaccgaatggtgaaacctaggatagttctgttgattttcgtttccggaaaggttgtgtta

SEQ ID NO: 3614 - DNA, 354 bp, Leptinotarsa decemlineata
acaactgcgaagagaagttatgctgatatgagcttcacttttgctgctggaaatcaggtctattacgatgctaaatcagttaaacaagttgatgtcccatcattttctggcagttttggtattttaccagctcacgtacccacactagcagtccttaaaccgggagtagtgacagtctatgaagaaggaggcaatgtcaacaaaatttttgtgtctagtggaactgttaccatcaatgaggattcttcagtacaaattctagcagaagaagcacaccctgttggaaacctagatgcttcagcagccagagaagttcttagcaaagcacaaagtgaattatcgtcagccacaact

SEQ ID NO: 3615 - DNA, 729 bp, Leptinotarsa decemlineata
attcgtcagttttctcggaaggaaaacagatttcttcactggaggaaaagagggggaatgggagaagctagttatgaatacattcagaaagcatgaaaaacaaagtagagaaaagcaagaagctgagctgaaagagaaacgtgagagggaagctcgagcaaaagcagctgcagcaaaaaaagctgaagctgaaagagttgagcctgccaaaataacagaactaactgatgctgaagccgaacagcttcaggccgaaataaacgcaaagaaaaatccgtcatcgtccagttcacaacctgctgcccctatcggagataaaatcaaggaagacgaagatgaatcagaaaaggggaagattttgccgaacaaaggaaatggctgtgatttggacaagtacaagtggactcagactttgggcgatattgagcttcgagtgccactaaacgtcaacttcagagtcaagcagaaagatcttgtggttaaccttacgaagaaacatttgacatgcggaatcaaaggtcaaccgcctatcataaacgacgattttccttatgaaatcaagctagaagaatccacttgggtcatagaagatggaaaatcactgttgttcaatttagaaaaggtgaataaaatgaactggtggaacaaactagttaactcagatccggaaatcagcacaaagaaaataaacccagagccgtctaagttgagcgatctagatggtgaaac

SEQ ID NO: 3616 - DNA, 362 bp, Leptinotarsa decemlineata
gccccgataagaaacatagtgatagagaaaggtggatatgtatttacccagcttatatcaataataagaaaacgttagctcaaggaagaaagataaataaggataaatgcgttgaaaacccaacacaccaagaaattagagatgtattagtggcagcaaatcttaaaataggagttgaaaataaattatatagcagagaaaaaagcaaggaacctctttatcgaggcagaattagagttcaattgaggaatgatgacggaagtttgttcaatagcgctttcccaaccagagagagcataatgtatcatcttggtgaaatgattcctaaattaaaatctagacaaaataaaggtgcaggggaa

SEQ ID NO: 3617 - DNA, 676 bp, Leptinotarsa decemlineata
accatgcaagaaatttgtgggatcgagctgttacgatattacctaggattgatactttttggtacaaatacacttatatggaggaaatgttggaaaatgtacctggagcccgtgctgtctttgaacgatggatggagtggcagcctgatgagcaggcatggcaaacttacatcaattttgaacttcggtataaagaaattgatagagctagacaaatatatgaaaggtttgttatgactcacccagaagttaaacactggattaagtatgcaaaatttgaggaaaaacatggtttcattcattctgctcgcaaaatctttgaacgtgctgttaatttttttggtgacgatcatttggacgaaaatttgtacattgcttttgctaaattcgaagaaaatcagaaagagcatgaaagagcaagggtaatctacaaatatgcgcttgatcacatacccaaagaccagactaaagaactctataagtcatacacaatacatgaaaaaaaatatggagacaaaagtgacatagatgaggtgattgaatcgaagcgaaaatttcagtacgaacaggaaattttgcaaaatccaactaattacgatgcttggtttgattatattaggttagtagaaggtgaaggagacttagaatttatcagagagacgtatgaaagagccat

SEQ ID NO: 3618 - DNA, 732 bp, Leptinotarsa decemlineata
agggagaaggtactatggaccgcaataactctattcatcttcttagtttgctgccagatccctctatttggtataatgagttcagattctgcagatcccttctactggattcgagtaattctagcatcgaatagaggtactcttatggaattgggcatatctccaatcgtgacatctggattaataatgcaacttttggctggagccaaaattatagaagtaggcgacactcctaaagacagggctctgtttaatggtgcacaaaaattgtttggtatggttatcactgtcggtcaagcgatcgtttatgtaatgaccggcatgtatggagaccctgcagaaatcggagcgggagtctgtcttctgatcatcatccagctctttgtggccggtctcatagtgctgctgctagacgaacttcttcaaaaaggctacgggctcggttcgggaatttccctctttatcgccactaacatctgcgagaccatcatttggaaggctttctctccagcaactgtcaacactggacgcggaaccgagttcgagggagcagtcatcgctcttttccacttgcttaccacccgacaggacaaaatcagaggactcagggaggcgttttaccgtcaaaatctacccaatctgatgaatcttctagctacagtctttgtatttgctatagtgatatacttccagggattcagagtagatttacccatcaagagtgctaggtac

SEQ ID NO: 3619 - DNA, 361 bp, Leptinotarsa decemlineata
gtactagagctgagcaagacaaactattgagagttacttctactttgtatgtaggaaatctttctttttatacaactgaggaacaaatttatgaactattctcgaaatgtggggatataagacggatagtgatgggtttggataagtacaaaaaaactccatgtggtttttgctttgtagagtattatactcgaattgatgcagagaactgcttaaggtatattaatggcacccgtctggacgatagaatagtacgaactgactgggatgctggtttcatagagggacgacaatatggtagaggaaaaacgggtgggcaggtaagagatgaatataggacagactttgactctggaagagg

SEQ ID NO: 3620 - DNA, 292 bp, Leptinotarsa decemlineata
actacatcttcgccctactaacaggctactgcgatcctcccgcgggcgtggtgctgcgagaaggccagtacttcaacccctacttcccaggaggggctatttcaatggcgcaagccctgtacaacgaagccatcgagtattccgatgggacgcctgcaacggccagccagttggccaaagatatatccactttcctgaaatggaccgcggaacccgagcacgacgacaggaagaaaatgctcatcaaatgtataggcatattcgcgatgctggcaggtctttgctactacat

SEQ ID NO: 3621 - DNA, 657 bp, Leptinotarsa decemlineata
cgtaaaagaaatgctgaccctagcgacattgatggttttttgggaccgtggggtggttttgtcgatgaacaaaaaattgctaagcctagtgaagaagaacaagcagaattagatgaactaatatctaaaaagaacaaaagaggtaaacctacagaagataaacctgttgaagagaaatctgttcttcacatcaaggacgctgttgattatcaaggtcggtcattcttgcatgctccacaagatgtaggtgttaatcttaaatcagacacaccaccagaaaaatgctttttgccaaaatctcatattcacacctggtcaggtcattccaaaggaattgcagccatacgatggtttccaagaacagcacatttatttttatcagctagtatggattgtcgtattaaactttgggaagtgtataatgaaagaagatgtgtaaggacatattatggtcatcgacaagccgtaagggatatcaatttcaataactccggaaaacacttcctctctgctggttatgacagatatatcaaattatgggatacagaaacagggcaggttctctcaagattcaccagcaggaaaattccttactgtgtcaagttcaatcctgataagaataagcagcacttatttgttgcgggaacttcagataaa

SEQ ID NO: 3622 - DNA, 657 bp, Leptinotarsa decemlineata
tggcagtcaagaaagtagagtccaagaaggaggttaaccctcttttcgaaaagagggtaaggaactttggaatcggtcaggatattcaacctccacgtgatttatcgaggttcgtcaaatggcccaaatacattcgaattcaaaggcagaaggccgttttgcagaagagattgaaggttcctccgccaatcaatcagtttactcaaaccgttgacaaacaaacagccacccagttgttcaaactcctagagaaatacagaccagagacggctctccaaaaaaggaataggctgaaggctaaagccgaagctaaagtggccaagaaagaggaagcccctaccaagaggccaaacaccctcagggctggaactaacactgttactaaactcattgaacagaagaaagctcagctggtagtgattgcccacgacgtggaccctattgagttggtgttattcttacccgccctctgcaggaaaatgggtgtaccatattgcatagtgaaaggaaaagctagactgggacttttggtgaggcgcaaaacttgcactgcagtagctcttacccaggttgattctggtgacaggtccaacttcaacaaggttgtggaggtcatcaaaaccaacttcaatgaccgctcagacgaaatcaggagac

SEQ ID NO: 3623 - DNA, 679 bp, Leptinotarsa decemlineata
gaagtacatcaaaagctgccaagacccggaaagtggaggaattagtgcttgtcagaaacatgatcctcatatcctccacaccttgagtgctgtgcagattctttgcatttatgacaacttggatgctgtagacattgaagccgtcgtttcttatgtagccagtcttcagctacctgatggtagtttcatgggcgataaatggggagaagttgatacgagattttccttttgtgcagttgcgattctgtccttgttgaataagatggatgtaattgatgtgaacaaagcagtggatttcattgcttcgtgcaggaatttcgacggtggtttcggttcaagacccttatcagaaagtcatgctggtcttatttattgctgtgttggatttttatctatcaccaataggttagatatcgttaaccgtgatactttagcctggtggctttgcgagcgtcaacttccttccggtgggttgaatggtcgccctgagaaactcccagacgtttgctattcatggtgggtcttatcaaccctcactatacttggaagactacattggatcgatgcaagtgcactaaagaacttcattttggcatgccaagactctgaaacaggaggatttgctgataggcctggcgatattgctgatccgttccatactttgtttggtttagcagca

SEQ ID NO: 3624 - DNA, 650 bp, Leptinotarsa decemlineata
atagcaaatctggtcagcaatgtatgccaaggaaactctacagaaatgcagaaagaagctaccctggaggccatcggctacatttgccaggagattgattctgatgtactcgtaacccagtcgaatgatatattaactgccatcgttcacggaatgagagccaccgaaccaagcaatcacgtacgtttggccgcaacgcaagctctgctcaactctctggaattcaccaaagccaactttgaccaacctaccgagaggaattatataatggaagttgtgtgtgaggcaactcagtctcccgagtctcaaataaaagtcgccgccctccaatgcttggttaagataatgtcgttgtactatcagcacatggaaccatacatggctccggcgctctttccgatcacgctggaagcgatgaaatccgaaaacgatgccgtggccttacagggcattgaattctggtcgaacgtgagtgacgaggaagtagatctcgcgattgaagattccgaggctactgaagcgggaaggcctccagctagagtttccagacattatgcaaagggagccctacagtacatcgttcccatcctgcttcagaaactcaccaaacaagaagaactcgatgatgaagacgattggaatccgagtaa

SEQ ID NO: 3625 - DNA, 713 bp, Leptinotarsa decemlineata
tccaaatgaaataagcgtgcccatgtctgtagagtttgatgaatttgctaaggcaagggaaaatccaaacgatgatatggccaattttgtggaattcacagatgaggagggatacggaaagtatttggatctgcacgagtgttatgaaaaatacataaatctaaaaggaattgagaaagtagattacatcacgtaccttggaatgtttgatcaactttatgacattcccaaagaaagaaaaagtggtgaataccgaaaatatttattatgtcttatagagtatttgatgtggtttgtccaaaggatcaagccattaatggatttagaaagtggtttacaggaagaagttgatagagttattgctacatgggaaagtggcacagtacctggatggcctaaagaaacgggttctgctttagccaatgttggtgcacatttggatctttctgcattttccagctgggaagaattggcttctttaggtctggatcgtcttaaatctgctcttatggcattagggctgaaatgcggagggactttggaagaacgagctcaaagattgttttcaaccaaaggaaaaggttctttggatccttctcttatgactaaaaccaataaaggaaaagctagcaaagaaaaggaacaacttcgtcaaagggagctagctacattggaggcacaggtttacagattggcagaattagttgctgttc

SEQ ID NO: 3626 - DNA, 528 bp, Leptinotarsa decemlineata
caggactcccgaacatttattggaactttcaaagctttcgataaacatatgaacatgatcctaggtgattgtgaagaatttcgtaaaatcaaacccaagaattcaaaagtggaaagggaagagaaacgagttttagggtttgttttggtgagaggggagagtattgtctcattaactgtggaaggcccgccacctcctgaagagggcttgcccagagttcctattccaggagcagcacctggaccaggaataggtagagcttccggaagaggcatgcccccaggaatgggaggagtacccgttggtttgcagggaccggtaagaggggtcggtggaccatcgcagcaagtcatgacaccaggtggaagaggacaggtgtctgccccaccccaaatgaatcaaggtcccccaaggatgggtggtccaccaccaggtgtaatggggccccctccaggaatgatgggaatgcctcctcaaatgggcatgggacgaggaggccctccacctccgatgggaatgagaggacct

SEQ ID NO: 3627 - DNA, 772 bp, Leptinotarsa decemlineata
gctcaaaagccgatatcaacagaggaaaaacttgcagttttcttgagatatttggcttctggagacagctacaaaagtattgcttataactacctgttgggagatcgaacagtgtctaatattgtccaagaagtagctaccgctatatggaataatatgcaaccagtctatttagccgaacccaaaacagaaacatggaaatctatagctttacggtttgaggatagatggcaatttccacactgcgtcggtgctgtcgacggaaaacatattgttattaaaaaaccaggcaaaagtggatcatcatactttaactataaacatacattctctattattttaatggcaacagtggacgcggattataaatttatcacaatagatattggagcgatgggaagatttagcgatggaaatgtatttgcaagtagtggattgggcaagaaaatgatcaaacacactatactacttcccaatcctgaacaaatacctacgattgccgagcctctgccgtatgtttttgttggagacgaggcttttcctttatcggaaaatctaatgagaccatatccaagaaggcaaataactggaaattatcaacaccaagttttcaatgcacgactttctcgagctcggcaaacagtggaatgtgccttcggtatactgtcttcgcggtttcgcgtattccgaagaccatttgaaagtaaagtggacactgtgagagatgtagtaaaagccgcttgtgttttgcacaactacttacgaccctcag

SEQ ID NO: 3628 - DNA, 789 bp, Leptinotarsa decemlineata
ccatactggcgaactattgaacatgcacggcgcgccggaatcgccggatcaagaagagatgactgcagaaccatctcctgaagcaatcgatgaagaaggcttgaataattatgacggttctgagttgctgattattgatcaaaataacaagtctcccgaagattcgatttcgacaaaagaagatttcgaggaacttattgacgaaggatccagaaaaaataacttgtctaaaagagaaattaccactaaacacttgaacgactttcacaagtatgctaatattttcaattataccaaaaacgttcaaaccatacaaactccaccgcaaaatactggtagagttaccaatgtaccacagaaaatgactccaaaaatttctctcatcggcaattctgtagtacatagcgccaagacggttgcagacaaacttatcctaacaccttcagcgacaacggttataaacacaacgcaagcatcaaaagttacaagcatcattttaactcacaactctgctgttaggggaaatgttatcaatgtcacaaaggttgtgagcaccgtatcaccagctataactatagttactgctagcacttcacaaatagcctcaattttgccttccaaattcacggtgcccgtcataagtgctagcgctgtgcgacacctatcgaacgttaaagtaatagataagccatcgtcctctctatcgctcacttcccacgacagtgccttgcccaacaagatatttgaagatgactccgtttctccagatagttccaatttcgaagacga

SEQ ID NO: 3629 - RNA, 697 nt, Sitophilus oryzae
cacgaaccguacacauaucuuaauggacuucauauaaaagauuuggaggaucuuguugaggauauuaaagucuauaaagaacuggaaagaggaaagaauuuagauuauuggaacgauauuacaguuauuguugaagaugaguuacaaaaaaugagaaagauucaaaaggaacaggacuuugaugcugggguugguagaagagaagguauaaaucaagcaguagcucaagauguuacaucaguuuuuaaaggcaaaacagccauucaguuggcagcccuucaaaaacaaauugaaaguaaaauuucugguaaagcagauggaaucgauaucgguuauugggaaucuuuauugucccaacuuaaagcucacauggccagggcaagacuuagagacaggcaucaggaaaguuugaaaaggaaacuacaaguuuuaaaagccgaacaggcgguugcuuugccugaaaacaaccagaauauugaaaguacuaaacauagcgauaaugagaaacccaguaccucccaagagucuacagaagauagccaaagugauacagaagcuaaugagaaugcagcaaaugauauuuugaaugaaugcuuuauuuuauaucaaaauggaggguacaguccuaaauuauuaaguccugacgagauugaaccaggcacuauaguagugacagaagaggaugacacaaacagac

SEQ ID NO: 3630 - RNA, 719 nt, Sitophilus oryzae
uaugaagccaccgaagaaaaacucaaagauaucuuuggugaggucggucaaguuuugucguucaaacuuguuuuugaucgagagacuggcaaacccaaaggauauggauucugcgaguaucgugaccaggaaacggcacuuagugccaugaggaacuuaaacagcuacgaaauaggcgguagaaacuuaagaguugauaaugcuuguacagagaagucaagaauggaaaugcagaaucuucucaaucagccaccaguggaaaauccuuauggagagccuauucaagcugaaaaagcuccagaggcuaucagcaaagcuguggcuucacuaccuccugaacaaauguuugaacuuaugaagcaaaugaaaagcacaauucaaaauaauccuacagaggcuagacagaugcuauuacaaaauccacaacuugcauaugcuuugcuacaagcucaggugguuaugaaaauuauugacccucauacagcagcuucacuucugcauccaguaaaccaagugccagcuacucugaugccuggagacaagaauguuccuguucagguaccaauuagugcucaguuccaacagccuccaacuccaguugcaccucccagacaagaguuccaacccguuccugcuccaauuaugcacccaaauucccauaacgcccccguauuuacaggccaagauguugacuuaagaucucuagauccucgugguac

SEQ ID NO: 3631 - RNA, 676 nt, Sitophilus oryzae
  misc_feature (478)..(478): n is a, c, g, or u
cagcucacagaagagaaguuuauuguaaaagcaacaaacggaccccgcuaugucgugggcugucgcaggcaauuggacaaggccaaauuaaaagcagguacucgaguagccuuagauaugacuacuuuaacuauuaugagguaucuuccucgugaaguugauccucuaguauacaacaugagucaugaggauccaggugaugugaccuauucugcuauuggaggauuaucagaacaaauccgugaacuaagagaaguuauugaacugccacuccucaauccagaacuuuuuaugagaguugguauuacaccuccaaaaggcugucuuuuauaugggccuccuggcacugguaaaacauuacuugccagggcgguggccucccaacucgaugcaaauuucuugaaaguugucucuagugcuauugucgauaaguauauuggugaaucggccaggcugauuagagaaauguuuaacuaunucgauaaguauauuggugaaucggccaggcugauuagagaaauguuuaacuaugcuaaagaucaucaacccuguaucauauuuauggaugaaauugaugcuauuggaggucgacguuuuucugaagguacaucugcugauagagagauucaacguacguuaauggagcuucugaaucagauggacgguuuugauucac

SEQ ID NO: 3632 - RNA, 638 nt, Sitophilus oryzae
gccauuucuuuagcaggaaccugccuaggaauuuuagccaacgauggcauuuuauuagccgcugaaagaagaaauacuaauaagcuuuuagaugaaguauucacuucugaaaaaauuuacaaauuaaaugaugacaugguauguaguguugcugguauaacaucggaugccaauguucuaacuaacgaacuaagauugauuggucagagauacauuuuccaauauggagaaucaauuccaugugaacaguugguuucuugguugugugauguuaaacaagcuuauacacaauaugguggcaagaggccauuugguguaucuauucuuuauauggguugggauaaacacuauggcuaccaguuguaucagucugacccuagcggaaacuauaguggauggaaagcuacauguauugggaacaauaguucugcugcuauuucaagcuuaaaacaagaauauaaggagggagaaaugacacugaaugaugcaaaaaguuuggcugugaaaguauugaguaaaacuuuagauaugacaaagcuaacaucagaaaaaguugaaauggcaacacuaacuagagugaauaauaaaacaguuauucauauucuuacugcuaaagaaguggaagaguugaucucaca

SEQ ID NO: 3633 - RNA, 757 nt, Sitophilus oryzae
uguugauggagauugaacgucuugauuugcuugaagaauauguugaugacaauauuuauccuagaguuugcuuauaucuuacaaguuguguaccauauguagcugacccagagaauacaacuuuacuucagacagcucuguuauuauuuaggaaguuuaaucaguauccucaguccuuaagacuagcuuugcaguuaaaugaccaugcacuuauagaagaaauauuuuugucgugcaaagauacgacaauccaaaaacagcuugcauucauguuggggcgucaacagauuuauauugaaauuccugaaacuacuccagaauaugaggaccuugcugaaauaauggcuaacugucauuugaauaaccauuucuugaauuuagcaagagaacuugauauuauggaacccaaaacucccgaggauguguauaaaucccacuuagaaaacaccagacccucuuuugguggaagccaaguugauucugccagacagaaucuagcugccaguuuuguuaaugguuuugucaaugcugcuuuuggccaagacaaacuguuaauggaagaugguaauaaauggcuuuacaagaacaaagaacaugggaugcuuagugcuacugcaucucuugguuuggugcuuuuaugggaugucgauggagguuuaacaccuauugauaaauacuuguauucuucugaagaucacaucaaaucaggagcacuucuagcuugugguauuguaaacugugguguuaggaaugagug

SEQ ID NO: 3634 - RNA, 331 nt, Sitophilus oryzae
ccgggaaacaauauggaagaugguggugcuagcgugggcacuucuggcggccaacaccagcagcgaucuggcacagagacuggcaacagaagaacaggaguuucaugugcgaacuguaaaacagugaacacgacacuuuggagaagaaauaaucaaggugaacccguaugcaaugcuugcggacuauacuucaaguuacacaacgugaacagaccaauuagcaugaagaaagaggggauccaaacgagaaaaaggaggccaaaaaauuccaacagcaaucagcaacaucccaacaguccaaccacauccggcaugcaccaacaaagaauga

SEQ ID NO: 3635 - RNA, 731 nt, Sitophilus oryzae
ucggcagaaaaucucucaaaaguaccaucgccagaagaacaacaauucauagccauagccaaagaaugucugaaggauuguaacuuagaucagcuaaucacagauucgaaauucuugcacgaagaggcucugcuggaacuggcaaaggccuugauugaacuguccagagguccagauggacagagaagcguagaguauggcuauaacgagagcgagacuguguuuuuuauggaauuacuuuucaaaaucgucauucagaacagggaucguguuaugacaguuuggcaaccugucagagaccacaucuacacccuaaugaugaacgcaucacuguuugacuaccaguuccuccucgaaagaucgguaauaggcuuacugcgcauagcgauucgccugaugcgcaacgaagacauguguccaauaguaauacagucgcugcgcauguugcugcugcucaaaggcacgacuuugugcaggauuuccaagcagauuucuuucggguuauaugaacuacucaagacuucugcgcagaacauccauaccacuaccgauuggacgauuauuuuuacuuugcuugaguguguuggagcuggagcucagccuccuaagcccauuguggacgauggagucagucauguugauccugguacaaagucagaaggcgagaaccaaauaaacagcgacgacgaaaguaucguuucggacagaggcuacaccucugauaccgaacu

SEQ ID NO: 3636 - RNA, 473 nt, Sitophilus oryzae
agaagauuugguauccaggcccaaacugucgcgacaaacuuugagaaaaucuucgaaauggguccccaauuauacguaggccuuccugguuuagccacugauacgcagacgguuauggagaaacuccguuuccgaaagaaccucuacgaacugaaagagaaucgaucaauuucaccuaagguauuuagcgcuaugguaucucauauguuguaugaaaagcguuuuggcccauucuucgucgaaccggucauagcugguuuggauccgaaaacuuaugagccuuuuaucuguaauauggacuugauugggugcauaaaucaaccaaaagauuuuguugugggaggaacagccagugcacaacuuuacgguaugugugaagcuuugugggaaccaaacuuagguccagaugauuuauuugagaucacuucucaagcccucauuaaugcuuucgauagagaugcuaugucugguug

SEQ ID NO: 3637 - RNA, 720 nt, Sitophilus oryzae
agcgcaccuaauaauaugcaucacucugugaaaauuuuagauuuaguguugaugugcgugggacaucacgauuaugaaguugccgagauuacuuuuaaucugugguaucuucucagcgaacagcucuaccaguugagcaacaauaacauaagugaccuuuuuagaccguauauugaaagauugauuacugcgcuguguaggcauugccagauggaacccgauugugaaggaauauuagaggauggagaugaauuuaaggacuuuagaauaaaaguaucugagcuaauuagggacguugcauuuauaguaggaagcaccaguuguuuuaggcagauguuucucaauuugcaaaauccgggugugaccugggaucagacugaagcggcucuuuauauuaugagggcuguugguaaauauguauuaaguucugaaaaugaggucguuccaaauguaauagaagcaaucauaaauauuccagaaaccacucauaucgcagugcguuacacuucaguuuuacuacuaggagaauuaugcgaauggauugaaucccauucucaagucuuagauccaguuuuaaauuuucuaauucaugcucuugcccaaccugguuuaggugcugcagcugcuaaugcauuacagaacauuugcgcaacgugcagugacaauuugucuagacaugugccgauucuuuugcaauuguugcaccaaauugacacuuuc

SEQ ID NO: 3638 - RNA, 683 nt, Sitophilus oryzae
  misc_feature (610)..(610): n is a, c, g, or u
augccaagaaugaucccaauaaggucaaaagaaaauucucuucauucuuuaaaucacuagugauagaauuggauaaggaauuauaugggccagauaaucaccugguggaauggcaucgcaccuuaacuacccaagagacagauggguuucaagucaaacgaccaggagauaaaaauguccguuguaccauacuacuccuucuagacuaccaaccguugcaauuuaaauuggauccuagacuggcacgguugcugggcguucacacucaaaccagaccugucauuauaucagcucuguggcaauacaucaaaacccauaagcugcaagauucacaugagagggaguauauuguuugugauaaauaucuggaacagauuuuuaacuguucaaagaugaaauuugcugaaauaccgcagagauuaaauccauuguugcacccaccagauccgauaguaauuaaucacgugaucucggucgagggcggagcugagagcaaacagacugccuguuacgauauugacguugaaguugaugauacguuaaagacccagaugaacaauuuccuguugagcacugcuagccagcaagagauucagggauuggauucganuucgaaaauucacgaaaccgucgauacaaucaaucaacugaaaaccaacagagaauuuuuccugagcuuugcc

SEQ ID NO: 3639 - RNA, 305 nt, Sitophilus oryzae
gaaccaaccuuagaugagcuagaacagaaaaugagagaagcugaaacugaaucgcacgaggguaaacgaaaaaacgagucguuauggccuauuuucaaaauccaccaucagaaauccagauacauuuacgaccuguuuuauagaagaaaggcaauuuccagagaacuguacgaguauuguuuaaaugaaaauauagcggacaagaaccuuauagcgaaauggaaaaaacaaggauacgaaaacuuauguuguuuaagguguauucaaacgagggacaccaauuuugggacuaauugcauuugucg

SEQ ID NO: 3640 - RNA, 745 nt, Sitophilus oryzae
  misc_feature (582)..(582): n is a, c, g, or u
gcacuaucagacagaucguucagaaauaccaguauguugccauggauacugaauuuccaggaguuguggcucggccuauaggggaauuuagaaguucggcugauuaucaguaucaaauguuaagauguaauguugauuuguuaagaauaauacaacuuggucuuacauucuuagacgauaauggcaagacaccugguggaucauacacuacauggcaauuuaacuuuaaauuuaauuuacaagaagauauguaugcacaagacaguauagaccuguuaaccaacuccggaauccaauuuaaaaaacaugaagaugaggguauugagccauuagaauuugccgaacuacuuaugucuucuggcauuguuuuaauggauaauaucaaaugguuaagcuuucauucgggguacgauuuuggauaucugaucaaauuacuuaccgauaauaacuugccucaagaugaaaacgaauuuuuugacuuguugaaauuguacuuuccaacaauauaugauguuaaguaccucaugaagucuugcaaaacuuuaaaaggggguuuacaggagguagcugagcaacuugagngggguuuacaggagguagcugagcaacuugaguuggaacguguaggaccccaacaucaagcuggaucugauucucuacuuacuggaauggccuuuuucaagaugaaggagauguuuuuugaggauacuauugacgauucuaaauuuucuggucaccuguaugg

SEQ ID NO: 3641 - RNA, 752 nt, Sitophilus oryzae
gaagauguggacguuaucgauaaauucucuaaaaugaaccuuaaagaagaacuaacuagaggaauauacgcauacgguuucgagaagcccucggcuauucagcagcgagcuaucaagcccauuaucaaaggcagagacguuaucgcacaggcccaguccgguacaggaaaaacagcaacauuuuccauuucaaucuugcaaacacucgaccugaccguucgugaaacucaagucuugugcuugucucccaccagagagcuggcaguacaaauucaaaagguaauucucgcucugggcgauuuuaugaacgugcagugccaugcuugcauuggggggacuaauuuaggggaggauauuagaaagcuugauuacggacagcaugugguuaguggaacgccagggagaguuuacgauaugauaagaagaagagcacuucguacucggucaguuaggaugcuuguccuugacgaagccgaugagauguugaauaagggauucaaagaacagauuuacgauguauacagauuccuaccccccucaacucaagugguccuaauuucggcaacacuaccccacgaaauccuggaaauaaccucaaaauucaugacggauccuaucaggauccuggucaaacgugaugaauugacucuggaagguaucaaacaguucuuuguggccguggaaagggaagaauggaaguuugacacucuuugugaccuguacgauacacugacaauaacacaggcgguuau

SEQ ID NO: 3642 - RNA, 681 nt, Sitophilus oryzae
gacuaugccgcuauggauagaguuuugaaagaagaacgagcauauauuuuaaacauuguuaagcaagugaagaaagcuggcuguaauguguuacuuguacaaaaaucuaucuuaagagaugccaucucugacuuggcuuuacacuuuuuggauaaaauuaaauguauggugguuaaggauauugagagggaagauauagaguuuguuugcaaaacuuuaggcugcaggccuauugcaucuuuggaucauuuuguagcugagaauuuagugucggcagauuuagccgaagaaguuggauuuggagcaaacagaauggucaaaauaucagggauucagaauccuggacguaccaucacccucuuggugcgggguucaaacaagcugguccuugaagaagcagagcgaucuuugcaugacgccuuauguguaguuagaugucuuguucguaaaagagcgguaauagcagggggcggggcccccgaaacugaacuggcucugcgauuggcugcucuugcagauaaaauggaaggagucgacgcuaucugccuuagggcauaugcuggagcccuggagauuauuccauuuacuuuggcagaaaaugcugguuugaacccaauucagacuguaacugaauuaagaaauaggcacgcaaagggagagauuucugcaggaaucaacgua

SEQ ID NO: 3643 - RNA, 710 nt, Sitophilus oryzae
  misc_feature (319)..(319): n is a, c, g, or u
cagcaaugccuuaguugauguauugccucccgaagcugauucaucaaucagcaugcuucaagcagaugagaagccugauguuagcuacagugauauuggugguauggauaugcaaaagcaggaaauucgugaagcaguagagcuaccccuaacucacuuugaauuauauaaacaaauugguauugauccuccaagggguguguuaauguauggaccaccaggguguggcaagacuauguuagcuaaagcuguugcucaucauacuacagcugccuuuauccgaguuguugguuccgaguuugugcaaaaauacuugggnggcaagacuauguuagcuaaagcuguugcucaucauacuacagcugccuuuauccgaguuguugguuccgaguuugugcaaaaauacuugggugaaggucccagaaugguaagagacguuuuucgucuagccaaggaaaacucuccagccauuauuuuuauugaugaaaucgaugccaucgcuacaaaacguuucgacgcucaaacgggcgccgaucgugaaguucagagaauucuuuuggaguuguugaaucaaauggacggauuugaucaaacuacuaauguuaagguuauuauggcuacaaacagagcugacacccucgauccugcccuucuuagaccuggucguuuagauaggaagauagaauucccgcuaccugacagaagacaaa

SEQ ID NO: 3644 - RNA, 442 nt, Sitophilus oryzae
  misc_feature (310)..(310): n is a, c, g, or u
cgguuaccaucaaaaccauguuggaagaucuagguauggaugacgaagaggaagaaauagugccucugcccaauguuaauucagccauucuucgaaaaguccuacaaugggcuaccuuccacaaagaugauccaccgccacccgaagaugacgaaaguaaagaaaaaaggacugacgacauuucaucgugggaugcugauuuccugaaagucgaucaaggaacacuguucgaacugauuuuagccgccaauuaucuggacauuaaaggccugcuagaugucaccugcaaaacuguugccaauaugaucanucaaggaacacuguucgaacugauuuuagccgccaauuaucuggacauuaaaggccugcuagaugucaccugcaaaacuguugccaauaugaucaagggcaaagcgccugacgaaauucgcaaaacguucaa

SEQ ID NO: 3645 - RNA, 739 nt, Sitophilus oryzae
aggggcuuauuaauauggcgauugacgaaaaggcaucauguaaggaguuggaccaguggauugaacaacuaaacgauugcaaccaauuaacggaaaaucaagugaagacccuaugugauaaggcuaaagaaauauuguccaaggaauccaauguacaggaaguaaaauguccagucacaguauguggagauguacauggucaauuccaugacuugauggaauuguucagaauaggcggacgaaguccugacacaaacuaccuguuuaugggagauuaugucgaucguggauauuauucaguagagacagucacauuguuaguagcuuuaaagguucgguauaaggagagaauuacaauucuaaggggcaaucaugaguccagacaaauuacucaaguauauggcuucuacgaugaaugucuccgaaaauauggaaaugcaaauguuuggaaauuuuucacugauuuguucgacuacuugccacugacagcucuaguugauggucaaauauucuguuugcaugguggguuaagucccagcauugacacuuuggaccauauucgugcauuggaucguuuacaagagguaccucaugaaggaccaaugugugaccuuuugugguccgauccugaugaccgcgguggauggggcaucaguccucgaggugcgggauacacuuuuggacaagacaucucugaaaccuuuaaucauucuaauggauuaaccuuaguuucgagggc

SEQ ID NO: 3646 - RNA, 754 nt, Sitophilus oryzae
guuaaggggagguaugcaaauuuuuguaaaaaccuugacuggcaaaaccaucacuuuggaaguagaagccucugauaccauugaaaacgucaaggcuaaaauccaagacaaagaagguauuccaccagaccaacagcguuugaucuucgccggcaaacaguuggaagaugguagaacccuaucagacuacaacauccagaaagagucuacccuucacuugguacucagguuaagaggagguaugcaaaucuuuguaaaaaccuugacuggaaaaacaaucacccuagaaguagaacccucugauaccauugaaaaugucaaagccaaaauucaagacaaggaaggaauuccuccagaucagcaacguuugaucuucgccgguaaacaacuggaagauggcagaacucuuucagacuacaacauccagaaagagucuacucuucacuugguacucagguuaagaggagguaugcaaaucuuuguaaaaaccuugacuggaaaaacaaucacccuagaaguagaacccucugauaccauugaaaaugucaaagccaaaauucaagacaaggaaggaauuccuccagaucagcaacguuugaucuucgccgguaaacaacuggaagauggcagaacucuuucagacuacaacauccagaaagaaucuacccuucacuugguacucagguuaagaggagguaugcaaaucuuuguaaaaaccuugacuggcaaaaccaucacuuuggaaguagaagcc

SEQ ID NO: 3647 - RNA, 657 nt, Sitophilus oryzae
  misc_feature (428)..(428): n is a, c, g, or u
ucuggcaaggcuacaauaucuaaugauggagcuacuauaaugaagcuccuugauguaguucauccggcugcaaaaacucugguagauaucgcaaagucacaagaugcugaagucggagauggcaccaccaguguuguucuuuuagcgggugaauuuuuaaaacauauaaagccauauguugaagagggaguucaccccagaauuauuaucaaggcuguuagaaagucccugcaacucugcuuggagaaaauacaggaaauuucugugaaaauuaauaaauccaaugcuuuagaauucaggucauuauuagaaaaaugugcuucaacugcaaugaguucaaaacucauuagucaacaaagggcauuuuucucuaaaaugguaguagaugcuguauuauuguuagaugaucucaugccauuaaauaugancucuaaaaugguaguagaugcuguauuauuguuagaugaucucaugccauuaaauaugauuggaauuaaaaaggugcaagguggaggucuugaagacucaacucuaguugcugguguggcuuuuaagaaaacguuuucauaugcaggauuugaaaugcagccuaaagucuauaagaacuguaagauugcauugcucaauauugaacuugaauuaaaggcugaacgggau

SEQ ID NO: 3648 - RNA, 687 nt, Sitophilus oryzae
aaacuuccugucaaccuguuacgagccggaagaauauuuguauuugagccuccgccaggcaucagagcuaacuuauuaagaacauuuagcacaguaccagcaagcagaaugaugaaagcucccaacgaaagagcaaggcuguacuuccuucucgcuugguuccaugcaauuguucaagaaagacugagauacuguccguugggaugggcuaaguauuacgaauuuagugaaucugaucugaggguugccugugauacucuugacacuuggauugaugcuacggcaaugggaagaacaaauuugccaccagaaaaagugccaugggaugcuuugguuacucuucuuucucaaucuaucuaugguggaaaaaucgacaacgguuucgaucaacgacuucugcaaucauuccuuaacaaacucuucacuuucaaaaguuuugaagcugauuuugcucugguugcuaacauugauaauggaccuaacgguacuagacacauuacuaugccagauggaaccagacgcgaucauuucuuaaaauggauugaaagucuagcggauaggcaaacuccugcauggcucggacuaccaaauaaugcugaaaaagugcuguugacaacaagagguacugaucugauugguaaauugcuuaaaaugcagcaguuagaagacgaugaugagcuugcauau

SEQ ID NO: 3649 - RNA, 696 nt, Sitophilus oryzae
gcucaggaaaugggaguuaaauuaggcaaugaaguuggauaugcaauaagauuugaagacuguacaucugaaagaacuauaauuaaguauaugacagaugguacuuugcacagggaauuuuuaucugagccagacuuacaaucauacaguguuaugauaauugaugaagcucaugaaaggacuuugcauacagauauuuuauuugguuuaguaaaggauauugccagguuuaggccugacuuaaaauuauugauaucuagugcaaccuuggaugcucaaaaauuuucagaauuuuuugaugaugcuccgauauuuagaauaccaggaaggagauuuccaguugauauuuauuauacuaaagcuccugaagcugauuauguagaugcaugugugauuucaauuuuacaaauacaugucacccaaccauuaggugauauuuuaguauucuuaacuggucaggaagagauugaaacaugucaagaauuauuacaagaucgucuaagaagacuggguucuaaaguaaaggaacuaauuguuuuaccaguuuaugcaaaucugccuagugacaugcaggcaaaaauuuuugaucccacaccaccaggggccaggaaaguaguauuggcaaccaacauugcagaaacaucauuaacuauugauaauauuauuuauguuauugauccuggauuugcuaagcaa

SEQ ID NO: 3650 - RNA, 762 nt, Sitophilus oryzae
cgaacucacaccuguagaaacugagaaccccgcuggaggcuacgguaaaacugugagucacgucgucaucggucuaagaacggccaaaggcaguaaacagcugaaacuggaccccagcauuuacgaggcacuccagaaagagaagguugaagugggugauguuauuuauauugaggcuacaaguggggcuguuaagagacagggaagaucggaugcuuaugcuacugaguuugauuuggaagcugaagaguauguuccuuuaccgaaaggugauguucauaagaagaaagaggugguucaagauguaacacuucaugauuuggacgcggcaaaugcaaagccucaaggaggccaggaugucuugucgaugaugggacaacuuuugaaaccaaagaaaacagaaauaacugacaaguugaggaaggaaauaaacaaaauuguugauaaauacauugaucagggaaucgcagaguuaguaccaggaguucuuuuuauugaugaaguucacaugcuagauauugagacuuuuacauaucuacacagggcacuagaaagugccauugcuccaauaguuauuuuugcuacaaacagaggaagaugucuuaucagagguacggaugauauuuuuucaccucacgguauaccucuggaucuucucgacagacuuuugaucauuaggacugugccguaugaucggccugauauggaacaaauuuugaaacugagagcuaaaacugaaggccuggaaauugacgaagaagc

SEQ ID NO: 3651 - RNA, 659 nt, Sitophilus oryzae
aguagugcugacuuggaaagcggguuuucgagggaauuauucuugcagugguguucuaauucaaacaauaguguuauuaucacuacaagaacauguccuggaacucuagcgagagaucuaauagacaacaacgaaaaaggcagaaccaucgauaugauuguagaaagaagagugaaauuagaaggugcagagcuggaagaguuugaaaaaagacagcaacaaaggacgcauauaagcaacgggaccaaagaugauguagauucagauuccgauagugauauagagaugucgguuauauccaaaggaaggcacgauauuguuauaaaacaggaagguaaaguuaguggaggauuuuucaaagugaccaaaaaacaguauccuauguauccguuucgugaggacaagauaaagugugaugaauauggagaaauuguuaaaauugaagauuacaggcuggccgauguuaauccugaagcugaagauaauaaagaaaacuuagagguuaagagagaggaagaagaagaagaaauaauugaaauucuggaaguuccaucgaaauguaucgcucuggagaggacgguucaagugaacugucaaguacaauacaucgauuucgaaggccgguccgacggggaaucccugaugaaaauccuguccca

SEQ ID NO: 3652 - RNA, 746 nt, Sitophilus oryzae
agaaauggacgagcuuuucuaacacaacucaugaaucgcgaacagagaaacuuucaguuugauuuuuugagaccucaacauucacucuuucaguauuuuaccaaguuacuggaacaauacacuaaggucuuaaucccaccaaaaacgaugcaacaaaaacugaaagaggaagucaaaaguaccaaaaccguucuggaacaggugaaguaccgggcggaauggcaaaaguaccaggaagcccagaaagccaaagaagaagagauauuggaaagagaaagaaucgcguacgcucaaaucgauuggcaugauuuuguaguaguggaaacugucgauuaucagccguuugaaauuggaaauuuuccaccuccaacaacaccggaagaggugggggcaagaauucuaauucaagaaaggcuugaagauggggacgauauugagaugcaacuggaaagcgacgaagaagaugguggucaggaggaucaaaguuuaagcuauauggaagaucguaccaauacgaacagaaaagaugcgagggauaauaaucaagugcaagauauggacgaggagaguucagaugaugaagaucaggauaaacguucagaucaaccgucaauucagccuccacuaccgccaguucccgauaaaguuuugguuaagaaauacgauccuaagcaagcuccuaaagucacucggccgacuguuggugacgauuaucuaguaucaccaaucacuggggagaaaauucc

SEQ ID NO: 3653 - RNA, 776 nt, Sitophilus oryzae
auuggcaaucaaaaacguguuguggguguuuuauuaggcuguuggagagcuaaagguguuuuggauguaucgaauagcuuugcaguuccuuuugaugaggacgaaagagauaaaucuguaugguucuuagaucaugacuaucuagaaaauauguauggaauguuuaaaaaaguuaaugcuagagaaagagugguugggugguaucauacaggaccuaagcuccaucaaaaugauauugcuaucaaugaacuuguuagaagauauugcccuaauucuguucuuguaauaauugaugcuaagccaaaggaccuuggguuaccuaccgaagcuuaucaggcuguggaagaaguccacgaugauggaucaccuacuucaaaaacuuuugaacaugugccaagugaaauuggcgcugaagaagcugaggaaguaggaguugaacauuuauugagggauauuaaggauacuacagucgguacuuugucacaacgaauuaccaaucaacuuuugggauuaaaaggguuauauucucaguuaagagauauacgugacuauuuaauucaaguuagcgaagaaaaacuuccaauuaaucaucaaguaauuuaucaguuacaagauauauuuaaucucuuaccagauauaaaucagaugcaauucaauaaaucuuuuuauguaaaaaauaacgaucaaauguuagucguauacuuagcagcuuuaguucggucuauaguugcuuuacacaaucuaauaaauaauaaguuaacaaacagagaugccga

SEQ ID NO: 3654 - RNA, 707 nt, Sitophilus oryzae
uacaaaaagggcgaaucucagaccaauguagaaauaacugccgaaggcgauuuuaccaggaugcuagagauugaagaagagcaugucagaaaacagugcgaugauauuauagccuugaagccugacguaguguucacagagaagggugugucagacuuggcccaacauuuccuuuuaaaggcuggaauaagcgcaguucggagaguucgcaaaucugacaauaacaggaucgcccgagcuuguggggccgucauagugaacagaacggaagaacuacaagccucggacauuggaacuggagcgggacucuuugaaaucaaaaaauugggugacgaauacuuuuguuacaucacuaaaugcaaaaauccuaaggccuguacuaucguucugcguggggccagcaaagacauccugaaugagaccgagaggaaucuccaggacgcgcuccaaguggccaggaauauuguuuugaaaccccgucugguuccuggggguggggcuauagagauggcuguagcucagagacuuuuacagaaagccacucacgggccuuacagggccuuagcccaugcuuuggagauaauaccucgaacgcugucccaaaacugcggcgcgaacacuaucaggacuuugacggcuuugagggcgaagcacgccaaucauaccgaucaaaacaguccuuguacgugggguauugauggugaaag

SEQ ID NO: 3655 - RNA, 549 nt, Sitophilus oryzae
cuuaugccgauaauggagggagcauaguugcuaucgccgguaacgacuuuguaauuauuggagcugauacacgucuuagcgcaggauucucuauuuauacaagagagcaaaacaaauuauuuucauugucugguacaacaguacuaggauguucaggaugcuggugcgauacacuaacuuuaacgcguauuuuaaaguccagaaugcagauguaccagcaggaacauaauaaaguuaugucaacugaagcaugugcacaaauguuaucaacaaugcuauauuauaagcgauuuuuuccauacuacauauccaauguauuaguuggauuagauaaugaagguaaaggaugugucuacagcuaugauccaauuggacacugugaaaaagcaacauacagagcuggaggaucugcaggagcucuuuuacaaccacuuuuagauaaccaaauugggcaaaagaauaugcuaaaugucaaacccgaaucgguaacaaaagaaagggcauugucaauuauuaaagauguguuuaucucugcugcugaaagagaua

SEQ ID NO: 3656 - RNA, 709 nt, Sitophilus oryzae
uuaacauguucccggacauucccaggcccuuuaacguuacguaccacuguuauuccguggcuaugcuuccaggaaacgaacgacaagauguagaaagaggaggaaaaauuauuaugccucccagugcucucgaacaacuaacaagauuaaauauuaacuauccgaugcuguuuaaguuaacaaauaaaacaaccagcagaguuacgcauugugguguauuagaguuuguagcggacgaaggaaaaguuuaucugccauuauggaugaugcacaauaugacacuggaagaaggugauuuaguacaaauggaaagugucuccuuacccgucgggacauucucgaaauuccagccuuuaucucccgaguuuuuagacauaaccaaccccaaagcagucuuggaaaauugccuaagaucauuugcuuguuuaaccacuggagaugucauugcaguucaauauaaucaaaaaguauaugagcuguguguuuuagaaaccaaaccgggcgaugcuaucaguauuaucgagugcgauaugaauguagaauucgcagcucccguugguuauaaagagccugaaauugaaaggaaaauugaagaugaagagauggcagucgauccuucagauuuaaugccugaaccaucggguuuuguugcuuuuaaaggcgcagguaaccgucuggaugggaaaaaacgcaaggauucuguaacaac

SEQ ID NO: 3657 - RNA, 652 nt, Sitophilus oryzae
  misc_feature (171)..(171): n is a, c, g, or u
ccuguuucagacaaaaacccagaaccuuugauuaaaguugcaaugacuacuuuggguucaaaaauaaucaacaagugucacaggcaaauggcugagauugcagucaaugcaguauuagcuguagccgauuuagaacaaaaagauguuaauuuugaauuaauuaaaguggangcuguagccgauuuagaacaaaaagauguuaauuuugaauuaauuaaaguggaaggaaaggugggugguaaacuugaagauacaguauuaguuaaagguguugugauugauaaaaccaugucacauccucaaaugccuaaagaacuuaagaaugugaaauuggcaauucucacaugcccauuugaaccaccaaaaccaaaaacaaaacauaaguuggauguuacugauguugcuggauauaaagagcucagacaguaugaacaagauaaauuuaaggaaauuguuggccuugugaaaaaggccggagcuaccuuagcuauaugucaguggggauuugaugaugaagcuaaucaucuuuugcuacagcaacagcuuccugcugugcguuggguuggagguccagaaauugaauuaauagcaauugcuacugguggacgcaucgugcccagguuugaagaacucagcccugaaaaguuaggau

SEQ ID NO: 3658 - RNA, 209 nt, Sitophilus oryzae
cucuaaaggcgaccgaaaacgcuucgaaguuaaaaaguggaaugcugucgcuuuaugggcuugggauauugucguugauaauugugcuauuugucgcaaucauauuauggauuugugcaucgaaugccaagcaaaucaagcuucugcaacuagugaggaauguacaguugcuuggggaguaugcaaccaugcuuuccauuuucauugca

SEQ ID NO: 3659 - RNA, 725 nt, Sitophilus oryzae
ggguaggguugaaaaugcuaaaauucuaauugcaaacacucccauggauacagauaaaauaaaaguuuuuggaucgacaaucaaaguagacucuauggcaaaaauugccgaauuggaaucagccgaaaaggaaaaaaugaaggacaaaguagccaaaauacugaaacauaauuguacuguguucauuaaucgucaguugauuuacaauuauccggaacaacucuuugcugaugcuggagugauggccauugagcaugcagacuuugauggaauugaaagguuagcauuaguaacuggaggugaaauagucucgacuuuugaucagccagaaagugucaaacuuggaacuugcgaucuuauugaacaaauuaugauuggagaagacacauuacuuagauuuagugggguugcuuuaggagaagcuugcucgauuguuauucggggugcaacacaacaaauuauugaagaggcagaucguucucugcaugaugcauuguguguuuuggcugcuacagucaaggaaagccgcauuguguauggaggagguugcagugagacacugauggcgguagcugugaguaaagcugcacugaguacagcaggaaaagaagcaguugcuauggaagccuuugccagagcuuugcugcaacuacccacaauuauugcugauaaugcugguuaugauucagcucagcuuguaacugaacuuagagcagcccauacua

SEQ ID NO: 3660 - RNA, 672 nt, Sitophilus oryzae
  misc_feature (309)..(309): n is a, c, g, or u
gcuguaaauuugggaucugcaacaguuggccuuaaaagcaaugcauaugcaguacugauugcacuuaaaagggcuucuucggaacuuucugcguaccaaaaaaagguuauuaacauugaugaccacauuggagugacuauaucaggauuaacagcagaugcaagaauuuugagucguuauaugagaacugaauguuugaacuauaaauauucgcaugauacuuauuuaccuuuaaauagacuuauaacaacauuaggcaacaagaugcaaguauguacucaaagauaugaccgcagaccauauggugunaaauauucgcaugauacuuauuuaccuuuaaauagacuuauaacaacauuaggcaacaagaugcaaguauguacucaaagauaugaccgcagaccauaugguguagggcuuuugguagcugguuaugaugauaaaggaacucauauauaucaaacauguccaucagcuaauuauuaugacuguaaagcaaugucuauuggcucacguucucaaagugcaagaacuuaucuagaaaaacauuuagaucaauuuucuaauaguagccuugaagaauuaauuaaacauggacuuagggcauugagagauacgcuaccuccagaaguugauuuaucaaccaagaaugugucaaucgguuauguuggu

SEQ ID NO: 3661 - RNA, 680 nt, Sitophilus oryzae
uauggcuguguaugaacgagcaacaaaagcuguuccagaaaaagaaauguuugaaguauuuaauauuuauauuaaacaagcggcugauauauauggaauaccuaaaacucgagaaauuuauaaaaaagccauugaaguucugccugacgauaaaacgagagaaauguguuuaagguuugcugacauggagacaaaacuuggcgaaauugacagggcuagagcgauuuaugacuauuguagucaaauuugcgauccaaggguaacagucgaauuuuggcaaacuuggaaagaguuugaagugagacacggcaaugaagauacaaugagggaaauguuaagaauaaagagaagcguucaagcgauguauaauacacagguuaacaugaugucugcccaaaugcucaguucugccgggucauuaacgggaacuacggccgaucuugcgccaggugaaaaagauggaaugcgucuuuuggaagcaaaagcugcagaaauggcuggugcugguacaucaggaauaaguucccgaccagguaauauaauguuugugagaggugaaacucaaggcgacaagaaagauaaagucguuaauccagaugaaauugauaucgacgaugaugacgaggaggaagaagacgaaguugaaguaccccuugagaaacaagcuguaccuucugaag

SEQ ID NO: 3662 - RNA, 677 nt, Sitophilus oryzae
agauaaugagagacccggaaaccggcaacuccaaaggcuucgccuucaucaacuucgccagcuucgaagccuccgacgccucgauugaagccaugaacggccaguaccucugcaaccgacccauaucggugucauacgccuucaaaaaagacuccaaaggcgaaagacacggcucggcagccgaaagauuacuagcagcucaaaacccacucucccaagcagacagaccucaccagcuguucgccgaugcaccuccgaugggcaugaugggcauggccauggcuccuccaccuccuccuguuauuuuagggggucuuaugccuaugccuccuccgacggccauggcuccuccaccuccuccuguuauuuuagggggucuuaugccuaugccuccuccgacgccggcgaguauggcgccuccaccaccgccuccggugccuccgccaucgucguuucccucggggauucccccgccaccuuugccucccagucaaccuccgcugccgccuggagcgccgccuauaucugcugcgggggcagguggagcgccuaggccuccgcugccugcaggagggaugccgagggggaugaugccuccgccgccgccguggcaggcuggagggaugccuccacugccuacuucaggacaagcagcugcuaacagcaauuucccgaac

SEQ ID NO: 3663 - RNA, 640 nt, Sitophilus oryzae
gccccaaaacugagauaucucgacuucucagagcgacauggauacauuaaaggugucgucaaggauauuaugcacgauccuggcagaggagccccguuagcuguugugcauuuccgugauccuuacaaguucaagacgagaaaggaacuguuuauugccccugaaggaauguacacaggacaguuugucuauuguggaaagaaagcuaacuuacaaauuggaaauguuuugccuguggguacuaugccugaagguacuauuguauguaauuuagaagaaaagacuggcgauagaggucgguuggccagagcuucaggcaauuaugcuacaguuauugcacacaaccaugauacaaaaaaaacuagaguuaaauuaccaucuggugcaaagaaaguuauuccauccaacaacagagcuaugguugguaucguugcuggaggagguagaauugacaaaccuauucuuaaagccgguagagcguaccacaaauacaagguuaagcguaacugcuggccuaaggugcgugguguugccaugaaccccguagagcauccucacgguggugguaaccaucaacacauugguaaagcuucgacagucaagagagggaccucugcugggcggaaaguuggucuuauug

SEQ ID NO: 3664 - RNA, 264 nt, Sitophilus oryzae
gaaaacaguuggccacuaaggcugccaggaagagcgcucccgcaacaggagguguuaaaaaaccacaucguuacaggccuggaacuguggcgcuucgugaaauccgucguuaucagaagaguaccgaauuguuaaucagaaaauugcccuuccaacguuugguucgugaaaucgcccaggauuucaaaaccgaucuucguuuccaaaguuccgcuguuauggcuuugcaagaggccagcgaagcuuauuuggucgggcuuuuug

SEQ ID NO: 3665 - RNA, 662 nt, Sitophilus oryzae
uaacagauguuugccguacaagucuuaggacuaaaguucaucagaaauuagcagauguucuaacugacguuuguguugaagcuguuuuggcuuugaaaucgcaagauaaaccuguugacuuacacaugauugaacuuaugcaaaugcaacauaaaacugaaacugauacaacucuuguaaaagguuuaguauuagaccaugguucucgucauccugauaugccaaaacguuuggaaaauuguuacauuuuaaccuguaaugugagcuuggaauaugaaaaaagugaaguuaacucuggauuuuuuuauaaaacagcagaagaaagagacaagaugguagcagcugaaagagaauuuauagaucaaagagugaagaaaauuauugaguuaaagaaaaaaguaugugcugggaacaauaaaucuuuuguaguuauaaaucaaaaagguauugacccaaugaguuuggaucaguuggcuaaagaaggaauuauugcauuaagaagagcuaaacgucguaauauggaacgguuagcauuagccuguggugguguugcaaugaauuccuuugacgaucuuucggagucuguucuuggauaugcugguguaguuuaugaacacguacuuggugaaaauaaauauaccuuuguagaggacugcaagaac

SEQ ID NO: 3666 - RNA, 780 nt, Sitophilus oryzae
agcagcuuugguugaugauaggcccaagucguucgaagaguguauuguuugggcucgaaaacauuggcaggaccaauaucacaaucaaaucagucagcugcucuacaauuuuccaccagaucagcucacaaguaccggucaguuguucugguccgguccaaaacguuguccaguaccacucaccuuugacauaaaugacacguuacacuuggauuacgucauagccgcugcaaaucugaaggcgcagguguaugggauucccacgaauagggauagagcguauaucgcaggaguggcuucaaaaguugaggucccaccguucguaccaaaauccggcguuaaaauugccguaaccgacucacaaauggcagcaaacggcaacagcaucgacauggaccgcauuacccagcucagaggugagcuaccuccucccgaagaagucgcagguuuagugcugacuccucuggacuucgaaaaagacgacgacagcaauuuccacauggacuucaucguugcagcgucgaauuuaagagcggcgaacuauaaaauuccuccagccgauagacacaaaucuaagcugaucgcagguaaaauuauuccugcuaucgcaacaacaacguccgucguagccggucuagccugcuuggaacuguacaaguuggcucguucauugaagagucucgaaccguuuaaaaacgguuucgucaauuuggcguuaccguucuuuggauuuagcgaaccgaucgcagcgccgcagauggaauacugcggaaacaagug

SEQ ID NO: 3667 - RNA, 684 nt, Sitophilus oryzae
uucuuacgccucaauucacaguucaggauuuagagauuuuuuguuaaaaccagaaauuuugagagcuauuguagauugugguuuugagcauccaucugaaguacaacaugaaugcauuccccaggcuguucuuggaauggauauucuuugucaagcaaaaucugguaugggaaaaacagcuguuuuuguuuuggccacuuugcaacaacuugaaccgaccgaaaauguuguguauguucucgcgaugugccauacgcgugagcuagcuuuucaaaucagcaaagaauaugaaagguuuagcaaauauaugcccaacaucaaaguugguguauucuuuggaggaaugcccauucaaaaagaugaagaaguuuugaagaauaauuguccucauauuguugucggaacgccuggacguauuuuggcccuaguaagaucgaaaaagcugaaucuaaaacauuugaagcauuuuauucuugacgaaugcgauaagaugcucgaagugcuagauaugagacgugauguucaagaaaucuauagaaauacaccacauggcaagcaaguuaugauguucagcgccacacuaaguaaagagauucguccagugugcaagaaguuuaugcaagauccuauggaaguuuauguugaugaugaggcuaaacucacuuuacauggucuucaacagca

SEQ ID NO: 3668 - RNA, 685 nt, Sitophilus oryzae
  misc_feature (120)..(120): n is a, c, g, or u
cagcuacaaagaguccaguuccugaaguagacguuuacauuaauuuacucauauugguucguuuaauugauacaaacaagcuggaagaggcuucuagauguucucaagcauuaaugaaunugaauaaaauaacgagucaaaaucgucguaccauagaucaucuagcagcuaaaugcuauuuuuaucacucaagaguagccgaauuaacaaacaaguuggacuccauaagaaguuuccuacaugcgagauuacgaacugcuaccuuaagaaaugauuuugagggucaagcuguucuaaucaauugucuucucagaaacuacuuacauuauucucucuaugaucaagcugauaaauuaguuucaaaauguguuuucccugaaacugcuaguaauaaugagugggcuagauuuuuguauuauuuaggaagaauuaaagcugcuagguuagaauacaguguugcucacaaacauuuaguacaagcuuugaggaaggccccacaaaacacugcaguagguuuuagacaaacugugcaaaaacuauuaguggucguagaacuucuuuugggagauauuccagaaagacaaguauucagacaagcucaaaugcgucauucucugaguucauauuuucaacuuacccaggcaguucguaugggcaauuuacagagauucggugaaguuuugga

SEQ ID NO: 3669 - RNA, 686 nt, Sitophilus oryzae
cgagccuacaaaauuggaacugcuacaaaaggaauaugacaaaaagaaggaacaguucaaaaccaaaguucagucuaauauuuuagaaaaauauggaggagaagaacauuuggaagcuccaccaaaaacuuuauugcuugcccaaacagaagauuauguugaauauucaagaucagguaaaauuaugaagggccaagaaaaagaggagauacguuccaaauaugaggaagauauuuauauuaacaaucauacaaguguuugggguucauauuggaaagguggucagugggguuauaaaugcugucauucuuuuaucaagaauucauauuguuugggugaaucuggaaaaaguacuaacaaugacacagaauuaaaaaauaguucugaugcuaauauuaaccaaagugaauguauuaauaauacaucagaaacuacacaagaaagugaauugacuugugauaaagaaucagaugauuccagugaagaugauaucagaacaaagucugaaaaaaagaaaaagaaaaauaagcauaaaaagaaaaagcacaaagagaaaaaagccgaaaaagacaaauuaucagaggcuuuaaaagcugaagaacagcaucaaaaacaagccgauuauuuguugucuuuggaugaaagaaagcgaccuuacaacaguauguuugaagcaaagaaaccga

SEQ ID NO: 3670 - RNA, 483 nt, Sitophilus oryzae
ucuccguaagaagaggaaguucgaauuaggucgcccagcggcuaauacgaaacuaggagcuagcagaagaguucacuauguaagaacucgagggggcaaccuuaaauacagagccuuaaggcugacccauggcaacugggcuugggguagugaaaguaucacccgagaaagccguauuaucgaugucguuuauaaugcaaguaacaaugaauuaguacguacaaaaacauuggucaagaaugccauuguaguuguugaugccacaccauucagacagugguaugaaggucauuacauucuaccgcuaggacguaagaagggugcuaaauugacugcggaagaagaugcagcauuuaacaaaaaaaggaguaagaagauucagaaaaaauaugaaaccagacagaaaaccgcuaagguagaaccagcuaucgaagaacaauuucacacugguagauuauuagcuuguauuucaucgagaccagg

SEQ ID NO: 3671 - RNA, 650 nt, Sitophilus oryzae
  misc_feature (569)..(569): n is a, c, g, or u
uacuggagugaguguagaggcugucgacccuguauuucaagcaaaaauguuagacauguuaaggcaaacaggccggccagagauggugguaggaugguaucauucucaccccggguuuggaugcuggcuuucagguguugacauuaauacacagcaaucauuugaggcuuugucagagagagccguugcuguaguuguagauccuauacaaucaguuaaaggaaaaguuguuauugaugcauuuagauuaauuaauccaaauaugaugguucuuggucaagagccuagacaaacaaccucaaauuugggacauuuacagaaaccuucagugcaagcuuuaauccauggauuaaauagacauuacuauucaaucaguauaaauuauagaaaaaaugaacuugaacaaaagaugcuucuuaauuuacauaagaaauccuggauggacgguuuaacuuuggcagauuauucagaaaauugcacuacuaaugagaaaacuguugcugauauguuagaauuagcaaagaauuauaauaaagcucuugaagaagaggaaaaaaugaccccugaanauauguuagaauuagcaaagaauuauaauaaagcucuugaagaagaggaaaaaaugaccccugaacaacucgccauuaaga

SEQ ID NO: 3672 - RNA, 776 nt, Sitophilus oryzae
cucccucaugaugguugaaaaaguaccagacucuacuuaugagaugguuggugguuuagauaagcagauuaaagaaauaaaggaaguaauugaacucccugucaaacauccugaacuauucgaugcucuuggaauugcccaaccaaaagguguacuguuguaugguccaccaggaacaggaaagacacuuuuagcucgugccguagcccaccacacugaauguacauuuaucagagugucggguucggaauuaguacaaaaauuuauuggagucagagugucggguucggaauuaguacaaaaauuuauuggagaaggaucucgaaugguuagagaauuguucguuauggccagggaacaugccccuucuauaauuuuuauggacgaaaucgauuccauugguucuucacguauugaaucagguucgggaggugacucugagguacaaagaaccauguuggagcuucugaaucaacuggacggauucgaagcuaccaaaaauauuaaaguuauuauggccacuaaucguauagauauuuuggauccggcccuccucagaccugguagaaucgauaggaaaauugaauuuccuccaccaaacgaagaagcucgauuggacauuuugaaaauucacucuagaaaaaugaauuuaacgagaggaauuaauuuaaggaaaauugcugagcuuaugcccggugcuagcggugcagaagucaaggguguuuguaccgaagcugguauguacgcuuuaagagaaagaaggguucacguuacuc

SEQ ID NO: 3673 - RNA, 488 nt, Sitophilus oryzae
uacuuggcuaaaauccgcauucgauuugcagagcguaagcuuuuuccagcggggaucuguacacgaauuuaugcaguuuuguugcaagacugucguagaaagaacacucccggccucaaggcaaucaguacagcagggugacuacuuuugccauguguauguuagaucugacaaccucgcuggcguaguaauaucagaucaugaauauccacagaggguaucacauacuuuacucacgaaaauucuugacgaguucucagaaaaaauaccagccucgaauuggccaaaccuacaggaaaaagauguggcuuuuccacaacuuaacaccuacuuagccaaauaccaaaacccgcgagaagcagaugcuuugacgaaaauccagaaugaacuagacgaaacuaagauuauuuuacauaguaacauucaagccguauuggagagaggugaaaaacuagaugauuugguugccaaaucggaggugcuaagua

SEQ ID NO: 3674 - RNA, 687 nt, Sitophilus oryzae
  misc_feature (595)..(595): n is a, c, g, or u
ggucgucuuuuucaaguugaauaugcuauugaagcgauuaaauuaggaucuacagcaauuggaauaucuacaagcgaaggaguuguuuuagcaguugagaaacgcauuacuucuccucuaauggagccaacaacaauugaaaaaauuguugaaguggauaagcauauugggugugcauuuucuggucuuauggcagauucaagaacaaugaucgauagagcgcguguagaaugucagaaccauugguuugucuacaaugaaaacaugaguguagaaucuugugcucaagcuguuucuaaucuagcaauucaguuuggugauucagaugaugauggggcagcuauguccagaccuuuuggaguggcgauacuauuugcuggcauugaugaaaagggaccucaacuauaccauauggacccuucagguacauuuguucaauuugaugcuaaagcuaucgggucagguucugaaggugcucagcaaagucuucaagaaguguaucaucguaguaugacuuuagaagaagcuacaacugcagcuuugacgauuuuaaagcaagucauggaagaaaaguugaauucaucaaauguagaanugaauucaucaaauguagaagugaugaccaugacuccaaagaaucuguuucauauguuuacuaaagaacagguggaagaggccuuaacaaau

SEQ ID NO: 3675 - RNA, 752 nt, Sitophilus oryzae
ugggaaacgaugaacaaucucacggccaagcaaaauuccuuguguguaaauuauaaauuucaaauuccggaccucaagguugguacucuggaucagcuggugggucucuccgaugaccuuggcaagcuggacggauucguugaacaggugaccaggaaggucgcuucguauuugggggaaguacuggaagaccagagggauaagcuucaagaaaacuugacggcuaauaacacugaccugccgagcuaccugaccagguuccagugggacauugccaaauacccgaucaagcaguccuugagaaacaucgcugacauuaucagcaaacaagugggucagaucgaugccgacuugaaaaccaagucuaccgcuuauaacaacuugaagggcagcuuacagagcuuggaaaagaaacaaacuggcaguuugcugacccguaaucuggccgaucuagugaagaaggaacauuuuauuuuggacucugauuaucugcagacuuuguuggugauugugccuaaagcgucuuuugccgauuggaaugccaccuacgaaaaaaucaccgacaugaucguuccuagaucgucucaguugaucacgcaagacaacgaauauggccuguacacagucacgcuguucaagaaggugauugacgaguucaagcaucaugcucgcgagcgcaaguucaucgugagagacuucacuuacgacgaggaacaguuggcggccggcaaaagcgagaucacuaaguugac

SEQ ID NO: 3676 - RNA, 667 nt, Sitophilus oryzae
augcccuaaauugcacuguagcuagucaggcuaugcccaagaaaauuguaggugcaaaaauugccugucuugauuuuucauugcagaaagcuaaaaugaaaauggguguccagguuuuaauaaacgacccagaaaagcuugagggaaucagagcccgagaguuagacaucacuaaagaaagaauccaaaaaauuuuauccacugguguuaauguuauacuaacuucaggaggaaucgacgauuuauguuugaaguauuuugucgaagccggugcuaugggagugcgaagaguuaagaaggucgauuuaaaaagaaucgcgaaagcaacaggagcgacauuuuugacgucuuuaucuaacauggauggugaugaaucuuuugaugcuaguauggucggagaagcagcugaaguauaucaagaaagaguaucugaugaugaauugauuauuauuaaaacaccaaaacagcguacagccgcaucuauuauuuuacgugggcccaaugauuucuauugugaugaaauggaaaggucaguucaugacgcucuguguguugucaagagaguuuuggaaucgaagaccguuguuguuggugguggagcaguugaagcugcucuuuccauuuacuuggaaaacuuugccacgacacugaguagcagggaacaauu

SEQ ID NO: 3677 - RNA, 680 nt, Sitophilus oryzae
gcuccaggaaguuucuacaacuuucccaauuugcaaccacaaguacaacaaccucaagauuucagacaacauucucagucuccaguaacaacaucaacaucuuugguuggaaucacauacgauaaggggauucuaguagcuggcgauuugcuagcaucauacgguucucuugcacguuacagaaacuguccuagaauaguaaaaauuaacgagaacaucauuuugggugccaguggagauuaugccgauuuucaauauguaaaagacuuuguugagcaaaaagucauaagugaagaaugucuagaugauggucuugcuuuaaaaccaaaaucucuguauuguugguugacuagaauucuauacaauagaagaagcaagauggacccauuguggaacaacuuuauaguagcaggaauucaagacggacaaccguuccugggaacaguugauaaacaugguacugcuuaugcugauaaaguuaucugcacagguuauggggcacauauugccacaccuuugcugagggacaguuuggacaagaauccccaauuaaauuuagccgaagcuaaggcuuuaaucgagaaaugucuggaagucuuauacuacagggaugccagaaguuauccaaaguaucaguugggaauuauugaugucgaacaaggagugucuauugaaggacc

SEQ ID NO: 3678 - RNA, 699 nt, Sitophilus oryzae
uccugauucaguugacugugccucugcuuauguagucugggcgaguggagaacuuaaucuauucacuacacauuuuaucaaacaaguuuuuaugccacaaacuagucuuucuacaaucacugaaugcgugcuguuaguaagaucucagugugaaagguuauguucauacgguguugauuuucguuaucaguuagauggggcauuaagaucuucauuuguaaaagcauugagagauacaagggagaaacuuguagauucaaugaaguugagagccucugaagacaaauggauuccaaugaauuuaguaucaaaagccaguuuggccaaauaucuacaagaauacagcaauaugggacuuaaauuagacuucuauguuacuggagacguguggcuucaauuaacaucauguaauguagcuuucacaaaaauuuauuugacauuaguugacgauugccuaaaacugaaaaccacugaauuacuacacgugauagaagaaacgcuuuauauuguuuuugagucccaaaugaggcacaauguuguuucuuacaauaaugagcaacaaauagagcaaaaaagguuuauuuugaagaacauugaauuuuuguuaguugcuguucuugaacuggugcagaaaaaauucaagggcgaaacaggauacgaaucagaacauuuaaacaaacucuggaacgaguauucugg

SEQ ID NO: 3679 - RNA, 665 nt, Sitophilus oryzae
gacaaagaucguaauccggauagaccaaugcauagcagcacaucaguacugagacuuccuguaaaucuagaugaaggugaagaagauucuagaaaaaggguuaccaggauaucaaguccugaaaggugggaaauaaaacagaugauaucuucuggauguauagacaaaagcgaauugccugacuuugaugaugaaacuggacuccuucccaaagaugaagaggauggugaagcagacauugaaauugaauuaguagaagacgagccuccauuucugcaaggucaugguagagcuuugcaugaccuaaguccugucagaauuguuaagaauccugauggaucccuugcucaagcagcuaugaugcagucagcacuagcaaaagaaagacgcgaacaaaaaaugcuucaaagagaagccgaaguugauucacaacccucugguaaaaauaaaacuuggauagauccuuugccugaagaggaauccaaagaugugucagcaaggggaauugguuugcagucccaagacuuaccagaauggaagaaacacauuauuggugggaaaaaaucuuccuuugguaaaaaaacgaaccuuucuaucauagaacaaagacagucgcugccuauauauaaacugaaagaggaacuucguaaggcgguuacugauaa

SEQ ID NO: 3680 - RNA, 712 nt, Sitophilus oryzae
uaccguccaaaugcuuacaaacagacauguauuaguuggugggggcggaggcucagcaaaaacugguguugcgaauggauuugaaauuuuugaacugucgcaugacggaaacaaauuccaugucgaggaaguaacuagacaugaaacagguccuaauguuguuaugaauugugcaguggcuuuaaaaaauaaucauacuuauuuaguugcuggucaagagagucauugucaauuauacaauguaaacucugaauugguagcucaagaaaacggugauauugaaaaccuuggaacugaccaccauacuaaugguaaacugaggcacagaaaaucagcgccuaccaguaaaaauaaugacauuaauaagaauuuaaggaaaagguuaaaauuuauuuuaaguccgucagauaguguacagacugauuuuaaugagccugaaccuuuauguagagugguaaggguacacccagaagggaaucuaauggcuacagguggaacagauggcacuauacagauguggagauuuccaagucuuaagccucuaaccaaauuaaaaggucacacaaaagagauagaugauauagauuuuaguuuauucgacaauuauauuauaacaguggcaaaagauggucaagcaauuuugugggacuguguuagaggaaaagaaauuaaaaaacuaacauggaaucaaccgcaggguucgaaauaucua

SEQ ID NO: 3681 - RNA, 738 nt, Sitophilus oryzae
aagaagguaaggccaaagagcuugcagaccugaucaaacaaacacguccuuucuuaagugaaauuaguaaagcaaaagcagcaaaauuaguuagaucucuaguagauuucuuuuuggaucucgaggcgggcauugguauagaaguacaacuuuguaaagaauguauagaaugggcgaaagaggaaaaacgaacauuuuuacgucagucauuggaggcgagauuaguagcccuauauuucgauacuggaauguucucggaagcucuucaauuaggaucaacuuuauugaaggaauugaaaaaauuagaugacaaaaauuuauugguagaggugcaacuguuagaaaguaaaacguaccaugcuuuaaguaauuuaccaaaagccagagcagcucuuaccucagcccguacaacugcaaacgcuaucuauuguccaccuaaaauacaagcuucuuuggaucuucagucagguguuuuacaugccgcagaugaaaaagacuuuaaaacagcuuauucauauuuuuacgaggcuuuugaagguuuugacagugucgaaucuccuaaagcauuaacagccuuaaaauauauguuguugucaaagaucaugcuuaauaccccugaagauguccaacaaauuguaagcggaaaguuggcaauuaaauacgccggucgggauauugaugcaaugaaggcuguagcucaagcaucucauaaaagaucguuagcggacuuucaacaag

SEQ ID NO: 3682 - RNA, 669 nt, Sitophilus oryzae
cgggaaauucaaacaacacaggagacuguuacuagagaaguguccaacauaaaaucuauguacgaucaugaacuaagcgaugcacguaaacuauuagaugaaacacacagggaaaaagcacgauuagagaucgaugugaaacguuuguuagacgagaaugaugaguuaaaacaggaacuagccaagaagucgaaggauuuaacguuggcagagaauucugcucgaaucuacgagacuagguguaacgaguugcagcugaaauacaaccaggcuaaugccgaugcuaaaaaagccaucggugauuugaaagaucuggagaaggaacgggacaaacuuaaaaaacuucuagacgaacauagaaaacagcucgaggaagaaucucuggcuagaguggaaguugagaaugccaaucaaagucuaagagaagaauuauccuuuaaagaccaggucuaccaacagcagcuaaccgaaacacguacacgucggcagaucgaaauuagcgagauugacggacaguuggcugaaaaauaugaagccaagcugcaacaagcuuugcaagaucucagggaccaguaugagagccaaauggcuagcaacaggucagagaucgagcugcucuacgaaaauaaaaucaagaaucuccaagcugccgcaaauagacagucaaac

SEQ ID NO: 3683 - RNA, 718 nt, Sitophilus oryzae
  misc_feature (349)..(349): n is a, c, g, or u
uucaaagugguggaaacugauccugcuccguauuguauuguagccccagauacagugauucauugcgauggagauccaauuaaacgugaggaggaggaggaagcucugaacgcugugggcuacgacgacaucggaggcugucgcaagcaacuggcccaaaucaaagaaaugguugaacugccccuacgucacccaucccucuucaaagccaucggcgugaaaccgccgcguggcauccucuuguacggcccccccggcacaggaaagacccucauugcccgagccguagccaacgaaaccggcgcuuucuucuuccugaucaacgggcccgaaaucaugagcaagcucnucuuccugaucaacgggcccgaaaucaugagcaagcucgcuggcgagucggaaaguaaccugagaaaggccuuugaggaagccgacaagaauucuccggcuaucauuuucaucgaugaauuggacgccauugcuccaaagagagaaaaaacccacggcgaggucgagagacguaucgugucucagcuguuaacccugauggaugguaugaagaaauccucccauguuauugucauggcggcuacgaacagaccuaauuccaucgacgcggcuuugagacgcuuuggacgguucgauagggagauagauaucgguaucccggacgcuacaggaagacuggagaucuugcgaauccacacgaagaacauga

SEQ ID NO: 3684 - RNA, 663 nt, Sitophilus oryzae
auuuaguucccagcuugugugaggauuuguuaucaucuguugaucagccuuuaaaaauugcuaaagauaaccaaaauggaaaagauuauuuauugugugacuacaacagagauggugauucauacagaucuccaugguccaauacauauuauccaccacuggaugauggucaaaugccuucugaaagauuaagaaaacuggaacucgaugccaauaaugccuuugauuuauauagagaaauguauuuugagggugguguaagcucaguuuauuuuugggauuuagaucauggauuugccgguguuauucuaaucaagaagacuggagauggcaguaaaaaaauuaagggauguugggacucuuugcauguuguugagguucaggaaaagaguucuggucguacuucucauuauaaaaugacaucuacggcuauguuauggcuacaaacuaauaaaccaggaucuggaacuaugaaucuaggaggaaguuuaacuagacagacagagcaagaugcugcaguuaaugaaaauaauccucauauugcuaauauaggaaaaaugguugaagacauggaaaauaaaauucgaaauacacuaaaugagaucuauuuuagcaagacuaaagacauaguaaacagcuuaagaucaguucagcccuuaacug

SEQ ID NO: 3685 - RNA, 783 nt, Sitophilus oryzae
aguagagacacaagccaaaggugcaaaagguaaaaaagguagaacuaguacuggaccuacuggaguuacuaccccagguagaggaagaccaccagcaacugugucauccacaguaucaaauccuguagcuacaacaacagguucuauggguauuccuuuggguaccagcgccccagucacaguuccgggcaguaccgcuaccaccaccauagcacaacccaacaaugcccaagucacgccuauuacuccuacggggcccucuuacgcugcugcucaggccauggacacuccaguauccgcgcugggcgugguaccuccugcccagccggccaagagcaaaaagggcguuaagagaaaggcugauacuaccacgccggccacagcuuaugauuaccuuccaucuggcgcugauucgaauuccucgucguccgcgagcaagaucuccaaacgucgagaauccggucgccagauaaagaagccucuacguaaucaggagcuggacgguuuggggccuuauggagguucagcggcggcuggugcuguaccaucaccagcagcucaggccggggcgcacgcgcuuaaaaacaaggaaaaacucaaugacacauuaaaagccugcaaugagauacugaaagaacucuuuucaaagaaacauuguaguuaugcuuggccuuucuacaaaccgguagaugcggaacuguuagguuuacaugacuaccacgacauuauaaagaaacccauggaucucggaacagugaaggaaaagauggacaaucgcgaaua

SEQ ID NO: 3686 - RNA, 683 nt, Sitophilus oryzae
uuggcacagacguguaaauaucaaccaacgucguuuugcccuagcagcagccauugcugccaguggcgucccagcuuugguaaugagcaaaggacacgucguugaccaaguuccagaacucccauugguugucucugacaagguacaggaauucaagaaaaccaaggaagcagugcauuucuugagaagguugaaagcauggccugauauacaaaagguauacaaaagucagagauuccgugcugguaaggguaaaaugcguaacaggaggagaauucaacguagagggccauugguuguuuaccaucaagaucaagguuugcguagggcuuuccguaacauccccggcaucgaccuaaucagcguagaaaaacugaaccuguugaaguuggcuccaggcggucacguuggccguuucgucauuuggaccgaaucggccuucaaaaaauuggauaaagucuucgaaaacuggaaggcaccaucgacgaagauguccaauaccgauuugucaagauuauucaagucggaagaaaucagagcaguacuucgugcaccacaaaagaagauuguucgacguguacgucgucucaauccauugaauaauaccagagcucuauuggcucugaacccauacgcugccguucuuaagagacaagcugucuuggacgacaagaagagaaguu

SEQ ID NO: 3687 - RNA, 683 nt, Sitophilus oryzae
gacgccugaaagauugaaagaucuugaccucgacgcauuugcugaagaacuggaacgucaaggauuuggaaacaagagcauuacucuauacgacauaagagcggaauuaaacucuagauauaaagauuuaagaacaccuuacagauccgcgaauccagaagaguuauuugauauguuaacuaaagaaacaccagaaacauuuuacaucgggaaauuaguacaagcuucgguaauaggaaucgcuaggagaaaaccacaaggcgagcaacuggauucagccaauccaguccguaacgaugaaacuggacuguggcaauguccauucuguuuaaagaaugauuuuccagaauuaucggauguauggaaccacuuugaugcugguucuugcccagggcaagcuacugggguuaaauugagauuagacaaugguauuucuggcuauauuuauauuaaaaauuuaagcgacaaaaccguuuccaauccagaagaacgcguuggaauuggacaacuuauacacuguagaauaaugaaaauagacguagaacgauucuccguggauuguacaucaaaaucaagugauuuguuagauaaaaaucacgaauggagaccuccuagggauccauauuaugaccaagaacaggaagacaaagauaacagaacugaggcagagaagaagaaagaca

SEQ ID NO: 3688 - RNA, 698 nt, Sitophilus oryzae
aaggaguguggacaaaaacuaacagaagugucuagcagagguaucaaugcaauuuuugaaauguuaagaaacauucuucaugagggacagcuugaaaaaagaauacaauauaugauugaaguaauguuucaaaucagaaaagauggauuuaaagaccaugcugccguaauugaagaacuagaugugguggaagaagaugaucaguuuacgcaucugauaaagcuugaugacgucaaacaagccgauucagacgaaauuuuaaaugucuuuaaguuugacgaugacuaccaauuaaaugagggaaaauauaagauucugaguaaagaaaucuuacaaacugauagugaaucugguuccggaucagaagagggaggaucggaugaugaagaggaugauagugaugacgaagaagaggaaggcgaagaagccaaagucaaagacacuauuauugauaauacggaaacgaauuugauugugcugaggagaacgauauacuugacuauacagucuaguuuggacuuugaggagugugcucacaaguugcucaagauggaguugaagccuggccaagagauugaacugugucauauguucuuggauugcugugcugaacaaagaaccuacgaaaaauucuacggacuucucgcucagcgauucugucaaaucaacaaaacuuacguggaaccguuucaacaaau

SEQ ID NO: 3689 - RNA, 786 nt, Sitophilus oryzae
acccuuugugcuacuuuaggagaauauccuucaguacgcuacagaagugauugggacaaaaacguggaguuggcacaacuaauccagcaaaaacuggaugcuuacaaagcugaugaacccacuaugggagaaggaccagaaaaagccagaucucaacuacuuauucuggauagggguuuugacugugucucuccccuguuacaugaacucacauuucaagcuauggcauaugauuuguugaacauccaaaacgacgucuaugaguaugaagcaucugcagguguuaaaaaagagguacugcuagacgaaaacgacgacauguggguggaacuucgccaucagcacaucgcugucguuucacagagcgucacgaaaaaucucaaaaaauucaccgauuccaagaggaugaccgccagcgauaagcaguccaugaaagaccuuucuacgaugauuaaaaaaaugccacaguaccaaaaggaacuguccaaauacgcgacucaucuucagcuugccgaagacugcaugaagcaauaucagggauauguugacaagcucuguaaaguugaacaggauuuagcuaugggaacugaugcagaaggugagaaaaucaaagaccacaugaggaauauuguuccgauuuuguuggaccccaaaaucaccgaucaguaugauaaaaugaggauuauugcuuuguaugccaugacgaagaacgggauuacugaggaaaaucuucaaaaacuugccacucacgcccagaucagucagaaacagaccauugccaauuug

SEQ ID NO: 3690 - RNA, 678 nt, Sitophilus oryzae
gggaagucacggauacuuacagaugcucuaugaguuauacucaaagacaaaucaauuuucuaacgagcucagugucuauaacuuggggaaugacaagaacuauuuaacaaaauuaacaucuaacauauuuacaaagcauauuagugaauauauccaaauugaacuuaaaucauuaaaagacagaugugcuacaaaccuucagagguauuacgauacaaaaaaucaccagaaaaagcagauucaaaguggaggauuucaagacuuaagaagagacuuacaagcgguuauagguacaagagcaaauauaaacauagcccaaauagagaauuaugguggggaaacguuucuaucugaagaacuagcgauuaugauacuucaagacaccaaaaaugcuuuuucuaggugccaauuauuaucaaaaccugaagaaagagcuggcaaugcuucaaaaauucuuaacaccuugguaaauagccuucugauagagcaugucgacuaugcuguugaauuagggcuccacgcuauuccugugguugagggggcuaaaaauuccccuguucuuuauuucuuuacuguaguucaucaaaguaacaacauuacacaucuugcagaaagacaauuuauggauuugguagucccauuaguucauaauaccccuuaccacaaugauugcaucca

SEQ ID NO: 3691 - RNA, 662 nt, Sitophilus oryzae
ggcaauuggcuuuagaaacaauagauuuacaaaaagauccuuauuuuaugaaaaaccauuuaggcucuuaugaauguaaacuauguuuaacuuuacauaauaaugaaggaaguuauuuagcccacacucaggguaaaaagcaucaggccaauuuggcaaggagggcagcgaaggaagcuaaggaugcucccucauuacuucagccagagaagccuagaguagaaccuaagaaauuuguaaaaauuggucguccagguuacagggugacuaaacaaagagauccagaaacaggacaacaaaguuuacuauuucaaauugauuauccagagauuagugaccauguuuuaccaaggcauagguuuaugucugcguacgagcagaaaauugaaccaccagaucguaaauggcaguaucugcuuuuugcugcagaacccuaugaaacuauugcauuuaaggugccuagcagagaaguggagaaaacugauaauaaauucuggacucauuggaacagggauacaaaacaguucuuuuugcaguuugcuuucaaaacugaaaauaagaagcagccaacuauuauuaauagacaaacaaugaucacuggaguaccaccgccuccaaugcuaccaguaccaccaccaccaagaccuccuauguucaauccc

SEQ ID NO: 3692 - RNA, 276 nt, Sitophilus oryzae
ccggugaaguuuauagagggaaacuaaucgaagcggaagauaacaugaauugccaaaugacucaaauaacuguaacuuacagagaugguagaguugcacaacuagaaaacguuuauauuagaggaucgaaaauuagauuuaugauacuuccggauauguuaaagaaugcaccuauguuuaaaaaacaaacaaaaucagguacugcgggacgaggaaagucgggcauucuucgagcccaagccagaggaagggguagagguggaccuccuacuagag

SEQ ID NO: 3693 - RNA, 664 nt, Sitophilus oryzae
cucaaguggcuccaguuaaugguaucgccaauuacgauuugaaaaccacuacucucacuaacaaacugguaguuguagcagcagaaaaugaauccgcuuugaccagaauuuccgucacguucagagcuggaucgcguuacgaaaccagcgauaaucucggugcuguacacguuauccguaccgccgcuggauuauccacaaaaaacgcaucccaguuugcuauuauccguaacauacagcaaguuggggcuagccuaacugcuacagcagaccgugaaacuaucucuuauacuuuggaaggcaccagaaaagcuguagagcaaguuuuaccuuucuugaaagaaguggcuacugagcaaguauucaaacccugggaacuauccgaacuuggagaucgguuaaagauugacuuggcaguucgaccauugcaguuacgugcacuugacuuacuucacaaagcugccuacagaacaggguugggcaauucccaguuuguucccaaauuucaaauagguaaacuuuccugcgaaacauugcaacacuacguugccaauaccuucacuucaagcagagcggcuguaguugguuuuggaauagauaauuccagucugacgcaguucgcucagucuuugaacuuggagcccaaugaaggugucuccaaucc

SEQ ID NO: 3694 - RNA, 190 nt, Sitophilus oryzae
agaaaaugaacguauggcacaggaccucucagacaaaaucggggugcuuaagucuuuaucaauagauauaggaaacgaaguaaaguaucaagacaggcuacucagagauguugaugaugauauggaacguacaggagguuuucuuggucgaacuaugcaacgaguuguuaaacugucuagagguucacaa

SEQ ID NO: 3695 - RNA, 789 nt, Sitophilus oryzae
uucaaguauucgaaggcacaucaggcauugacgcuaaaaacacacuaugugaguucaccggagauauuuugagaacuccuguaucagaagacauguugggaagaguuuuuaacggcucaggaaagccuaucgacaaaggaccuccaauuuuggcugaggacuucuuggacauucagggacaacccauuaacccuuggucgcguauuuacccagaagaaaugauccaaaccgguaucucugcuauugaugucaugaauucuauugcccguggucagaaaauccccauuuucuccgcugcugguuuaccucacaaugaaauugcugcccagaucuguagacaggcuggucuaguaaaaguaccgggaaaaucaguacuagacgaccaugaagacaacuuugcuauuguguuugcugcuaugggugucaacauggaaaccgccagauucuucaagcaagauuucgaagagaaugguucuauggagaauguaugcuuguucuugaacuuggccaacgauccaacuauugaaagaauuauuacaccgcguuuggcuuugacagcugcugaauuuuuggccuaucaaugcgagaagcacguacugguuauauuaacugacaugucuuccuaugcugaagcuuugcgugaaguauccgccgccagagaggagguacccggacgucgugguuuccccgguuacauguacaccgauuuggccaccaucuacgagcgugcuggccgugucgagggcaggaacgguuccaucacccagauucccaucuugacuaugccua

SEQ ID NO: 3696 - RNA, 177 nt, Sitophilus oryzae
agcaauauucaaggaccagguucuagaguuuauuaugaauauucuacuggaucaucccgaagacauuauggaauacggccaaagcuauuuuaaaaaaguagaagaaaacaggcguaccaccauaguuuaugauuuagucaaaguuagcaaugaaaauuuaacuggagguggucaaag

SEQ ID NO: 3697 - RNA, 724 nt, Sitophilus oryzae
agaggaacaacaccaaguuuuuggcuauugucaccgacuguuugcagauuuuggcguuuggcaaucaggaaagcaagcugauuauucuggcuucgcaaggacccauugagcuggucaggauaaugaggucuuacaauuacgagaagcuguuguggaccacuucaagaguuuugaagguuuugucaguuugcucuagcaacaaaccagcuauaguugaagcgggcgguaugcaagcccuagccaugcacuugggcaguggaagucagagauugguccaaaacugccuguggacuuuaaggaauuugucugacgcugcuacaaaagucaacggacuggacacucuccugucauccuugguacaagucuugucaucgccagauggcaauguagucacuugugcugcaggaauuuuaucgaaucugacuuguaacaaucaguuuaacaaagagacuguuugucaguaugauggcauuuccgcguuggugaggaccaucgugaacgcuggagaucacgaagaaaucacagaacccgccauaugcgcucucagacauuugacaucgagacacgauaaaucagaacucgcacaaaaucaagucagaguuguuggugguauucccguaaucguaagauugcugaacccuccgucucgcuggccuuuggucaaggcagucauuggacugaucagaaaccuagcuuuauguccugacaauuucuugccucuucg

SEQ ID NO: 3698 - RNA, 661 nt, Sitophilus oryzae
ccaacugggagagaaugaaaaaguuaaaaagcgacggcccuaucucgcaucggaaugcaaaagccucuaugccugcgagaaauggagacugcagauuaucagagagauugcgaaaaagguggcccagauucagaacgccggccugggcgaguuccgaauucgugacuugaacgacgaaaucaacaaacuguuaagagaaaagcgacauugggaggaccaaauuaaggaauugggcggaccagacuaucaaaagguaggaccucgaauguuggaccacgaagguaaagagguuccaggcaacaggggcuacaaauacuuuggagcagcaaaggaacuaccagguguaagagaauuguucgaacaagaaccuccaccaccucccagaaaaacacgggcagaacugaugaaagauaucgaugcagauuacuaugguuauauggaugacgaugauggcauuuuaauaccuuuagaaaucaaagcugaaaagauagcucugcaaaagguggacgccgaauggaaaucuaaaaaagaacaagcaauggaaacagauaccccagaagaggaauacgaagaagagaauaucuauaaaguccaugauucugacgaagagcaagaaaaagaaauuguugaugguucccaacaaagauucguugcacauguc

SEQ ID NO: 3699 - RNA, 511 nt, Sitophilus oryzae
cuugacuggugaauucgagaaaaaauauguagcaacuuugggagucgaaguccauccauugguuuuccauacgaacagggggccuauuagauuuaauguaugggauacagcgggucaagagaaauucggaggucuccgugacggauacuacauccagggacagugugcuauuguuauguucgauguuacaucucguguaaccuacaagaauguaccgaauuggcauagagauuuaguuagaguuugugaaaacauuccuaucguauuguguggaaacaaaguagauauuaaggauagaaaagucaaagccaagagcauuguauuucacagaaagaagaauuuacaguauuaugauauuucugccaaaucaaacuauaacuucgaaaaaccuuuccuaugguuggcaagaaaacugauuggugauccuaaucuugaauucguggccaugccugcuuuggugcccccagaaauccagauggauccccauuggcagcaacaaaucgagaaggau

SEQ ID NO: 3700 - RNA, 495 nt, Sitophilus oryzae
  misc_feature (304)..(304): n is a, c, g, or u
gauuccaaggcgauuuucugggaguugguggaacauggaacuuguacgaagacaaaaacucagauguggaaaucauugcuucggguguauucgugggauacauggucuacaacaucgucucucuuauaagcauguguuuugcagacagcgaaaacaaaagcaccuuuacggauauucucaugaacaucguugguauauuuuuauggguggcugugggagcaacagcccuucacuacuggcaugguuaccuggcugaacacaaauauacauacgucaauuccgagagacagguuggguuggcaunaauauacauacgucaauuccgagagacagguuggguuggcauuaggaucucuauguguccucaacggugcagcuuaucucguggauucagucuuaucaguuauuuucauuauaaaggccaaaaugcaauaguaaacgaauacaaaguguuauacgaacaaguucuaguguuaaguagaucaucauccuuca

SEQ ID NO: 3701 - RNA, 731 nt, Sitophilus oryzae
gauaaaaugcgaaauggccacuaugcuacauuucgacaacuuaaagaaucccauacccaaucaaaguaaacaaucuaccaagucgcaagcacaacaguuagcauuuuuagaagagcauccguaucaaaauuuuagaccagaugaacuggaacugucgaaaaaaauguuaaaaaaagaaauggaaauugucaaaaugggaaugaaucauggugaauugcccauagaagcguacacucaagugugggaggaguguuugggucaaguguuguuuuuaccaaaucaaaacagauauacuagggccaauuuagcuaauaaaaaagacagauuggagucugcggagaagcguuuggaacagaaucgaucgcauauggccaaagaagccaaacgggcugcaaaaauggagaagaaauugaaaauuuuaacuggagguuaucaaucuaaggcccagguacucauuaaacagcuccaagaugcuuacgagaauauugaucaagcuaauuuggaauugaacacuuuuaaguuuuugcaagaacaagaaaagaaugcuuugccuagaagggucgagucauuaacugaagacguugaccgacaaauggaacgagaaaaaggauuacaaaagcgguauaacgaucuucagaacgaaaucagggaauuacaagagcaauacaaguaugugcaacaggaaguguacgaggagcaaagccaacaaaacguugugacagaugaaacug

SEQ ID NO: 3702 - RNA, 354 nt, Sitophilus oryzae
agaaaaucacgagagagcugauuaccacaauauuagcucgaaaaccaaagaugugcaguuuucuugaauggagggaccucaaaauugucuauaaaagauaugcaaguuuguauuucuguugugcaauagaacaggaugauaaugaacuguuaacuuuggaaguuauacauagauauguugaguugcuugauaaguauuuuggaagugugugcgaguuggauauaauuuuuaacuuugagaaggccuauuuuauuuuggaugaauuaauguuagguggggagauucaggaaaccaguaagaagaauguauugaaagcaauagcugcucaggaucucuuacaagaggaggagacac

SEQ ID NO: 3703 - RNA, 708 nt, Sitophilus oryzae
aggaaauugggaaaacuggugcguuucaaagcauuucuaaagcaacagaggcugucaagagugaaauagauaccacuaguaugcaaggaaggguuuaugucagccccacaaaacuuaggaaaagaaaagaaaccacagcuguacagcaucaaaaguauuaugagccaaauacagaagcuuccgguguagaauuacauaaagauucaaaguuuuaccagucguggcaagacuucaaagauaacaacccuuauguacauaaaguuauggacuggaaauugaaguaugacgagagugagaauccacuaauucgugcaucuagagcuuuaacugaaaaaguaucagauguaaugggagguuuauuucaaaaaacagaacuaucugaaacuuuaacagaaaucuguaaaauugacaauacauuugauaccaagcgguuuuuaaaacagugugaaacugauauuauucccaauguacuugaagcuaugacaagaggugacuuagaaauauugaaggauuggugccacgaagggccuuauaauguuuucgcaauaccaauuaaagaagccuacaaaaaagguuauaaaauugagucaaaaauauuagauauagauaacguagaucuagucaugggaaaaguuauggaccaaggaccaguuuuaaucauuuccuuuaccucgcagcaaguuauggucguaaaggacuuggaaggaa

SEQ ID NO: 3704 - RNA, 660 nt, Sitophilus oryzae
aacuuggcuagaaagacuggauaguguaaacgaucaggcaccacuagcaccugaauuagcagcccaaauguuagcccacgaacauaaacgugaaaaccaguugaagaauaacaagaaauugccacaauuuucacccaccgaagauccaguguugaaugauuucaaacgagagaugugcuuucaucgucaggcacaggcaacaauuuuagaggcuauucccaagcuuacaaaauugggauuaccuacuagaagaccagaagauuacuuugcugaaauggcuaaaacugacgagcacaugcaaaaaaucagggaacaccuaaugcaaaagcaacaacaacaacaaagaagugaaagagucaaacaacuaagacaacaaaggaaagaaggaaaaaugcuacagauucagacaaaacuacaacgaaugcaagagaaaaaagaaauguuggaccaaguuaaaaaguacaaaaaggguguuucaaaggacuuggacuucuuagauuccaaaaagaacaccaguagcaaagcaauuucuagaaaaucuuuagagaaacggagacagaaaaauaagaaguucggguuuggugguaagaaaaagggcaugaagcugaacacaaaagacagugcugcugauauaagugaguacaggaaaccuucaaaggg

SEQ ID NO: 3705 - RNA, 474 nt, Sitophilus oryzae
agaacuagagaaucauuuggguaugaaugauaaagauuuggcugaauuuauaauauuucuaucggagaaaaauaauacuguggauacauucaagaaagcccugacagaaaauggagcagaguuuucagauucauucgucucaaauuugcuucgaauuauucaacacaugaggcccaaaaccaaagaugcuuccagcgaaauaaacgaugaagauaaaauugaaaaaagcuuuuuagcucaaaaauuuccgggccuugcucuuccaaacgagccgcaaaaaccucuaagugaugaugaaguggaaaaagaugaagagacuaauaaugaagaaggugauauuguagccgaucuuauggcacaauuugaagcagaugcuccuucugcuguuaagaaaacuaaauccaaagaaacagaaagggauagacacagaucuaggucucgccauagagauaaaucaagauccagaucaaggga

SEQ ID NO: 3706 - RNA, 683 nt, Sitophilus oryzae
uggcgugggaaauguauuuauuaaaaacuuggaucgguccauugacaauaaggcuauguacgacaccuuuucugcauuugguaauauucuuaguugcaaaguagcucaagaugaaaauggggcaagcaagggcuaugguuuuguccauuuugaaacugaagaagcugcuaagaaguccauagaaaagguuaacggcauguuguugaauggaaaaaaaguuuacguuggacguuucauuccccguaaagaaagagaaaaggaacuuggagaaaaagccaaacucuuuacuaacgucuauguaaagaauuuuggagaagacuuaucugaagaacaauugcgcaacauguuugagaaguuuggaaaaauuacuaguuacaagaucaugagcaaagaugaugggaaaucuaagggauuuggauuuguugcauuugagagcccugaagcagcagaagcggcuguggaaaauuugaaugguaaggaaaugguagaaggaaaaucucuuuauguaggccgcgcucaaaagaaggcugaacgucaacaagaacugaagcgucgcuuugaagcacugaaaauagaaagauugaaccguuaccaaggagucaaucucuaugucaaaaacuuggaugacacuaucgacgaugaacgucuacgcaaggaguuuucuccauuuggaacgaucacuu

SEQ ID NO: 3707 - RNA, 685 nt, Sitophilus oryzae
uuugaaacguccucagcauacucaaggacuaguucagcacgugcuuaguuuggccacucaagauucggacaacccagaucuaagagacagaggauucauuuacuggagauuauuaaguacggauccagcugcagcaaaagagguagucuuagcugacaagccucucauaucagaagaaaccgaucuucucgaaccaacguugcuugaugaacuuauuugccacauuucuucuuuggccaguguuuaccacaaaccacccacugcuuuugucgaaggcagaagcgcagguaucagaaagacccuuccuguucgccaagggucagacgaagcuccggcucaggaagcuacagucauacccaaucaggagagccuuauuggagacuuguuauccauggaucuuggugcaccuacaauuccauccggucccgcaccuaccacagcuccgauaaguaauguggaucuacuuggaggcggauuagauguauuguauggaggcacggaacuuaguggugcuccuacagcugcugcuccuucaacuacagggcuuuuaggagauauauuugguaucaccacaacaccaacuauguauacuccaccaaaaacauuaugguuaccagcugauaaagguaaagguuuggaaauacggggaacuuuuucaagaaaaucuggacaaguacacauggaa

SEQ ID NO: 3708 - RNA, 351 nt, Sitophilus oryzae
aaaucgguccuuuaggucugucuccuaaaaaaguaggugacgauauugcaaaaggcacagcugacuggaaaggucuuaaaaucacuguacaguugaaaauccaaaaucgucaagccagcauuucaguaguacccucugcagcuucccugaucauuaaagcucuuaaagaaccaccaagggauagaaagaagcagaaaaauauuaaacacaguggcaacauuuccuuugaugauguuuuggcuauugcaagacaaaugagaccgcgauccauggcuaaagcacugucaggaacaguaaaagaaguuuuagguagugcucagucuguugguuguacaauugauggaaaagcgc

SEQ ID NO: 3709 - RNA, 741 nt, Sitophilus oryzae
  misc_feature (492)..(492): n is a, c, g, or u
cagcagagcauuugacaaaagauaacaaaccauucuuuguauuaaacuccgacauuauuugcgacuuuccuuuuaaaaaacuaauggacuuccacaaagcucacgguaaagaagguacaauaguagugacaaagguagaagaaccuucaaaauauggugugguaguguacgaugaaacaaaguguauagaaaguuucguugaaaaaccacaggaauucauuuccaauaaaauuaaugccgguuuauacauuuuaaauccuaguguuauuaaucguauagaauugaaaccaaccucuauugagaaagaaguauuuccaaauauggcagcugaaaaagaacuguaugcuuucgaauuacaaggcuuuuggauggacguuggacagccuaaagauuucuugauagggaugugucuuuaccucaaacauuuaagaacuacagauccggagagauuauacagugguccuggaguuguuggaaaugucuugguacauncuacagauccggagagauuauacagugguccuggaguuguuggaaaugucuugguacauuccacugccaaaauuggaaaaaguugucaaauaggacccaaugucguuauugggcccgguguaguuaucgaggaugguguauguauaaaaaggaguacaauacuggaagaugcuacuauccguucaaauucgugguuagaaagcuguauuauuggauggagauguauaguuggacaauggguuagaaugg

SEQ ID NO: 3710 - RNA, 661 nt, Sitophilus oryzae
ggcgaguuuaaugaaguguucaacgauguccggaagcuccuggacgacgacgaccugcucaaagagggggccagcggggccuucgcccaguacaacaaagaucagcucacgccagugaggauagauaacgccgaucauuuaguuuugaucaccgaauacaacgauuuaggcaauaacagauuuuuugauucccguuccaaacaaagcuuucgguacgaccauuuaagaaaagaggcuucagacuaucaaccuuucacgcccgacgcaacagcagagcccuggagaucggcacuugacgcggaauuuauucaguacacgcguaaucacuauaaagacggagucaguuuggugguaggccguagugagggaaacacgauaacuuuagcugccuguauugaggaccaucaguuccaaccuaagaauuucuggaaugguagauggcguagucaaugguauauuucacuaaaugguaccucuacagcugaguuaaggggcguuuuaaaggugcaggugcacuauuacgaagaggguaacguccagcuaguuaguacuaaggaaauuaaggaaacuauaacuguuucgucggaaacgcagacugcaaaggaaauugugugggcuaucgagaaugcggaggacuccuaucaaacugcuauuucgguga

SEQ ID NO: 3711 - RNA, 652 nt, Sitophilus oryzae
auccccacauuguaaccuucgacgauuuggaguacacguuuaauggaaaaggagaauuuguuuugauaaaguccaacgccagacuagauaacauugaaguucagggccgauuugaacagauggauccuaaccuauauggugaaguuagagcgacucaacugacaucuguaguagcaagaggcaauucuucuacugugguagaaguuaggagaagaccagaauacgcaagauggagauacagacuagauguuauaacagauggaaaaaggguuuacuuugacagaccguccuuaaaauuccaacauuuuccuggugugaccguuuauacuccgaccuacauuuugaaucagucugaagugauuaugauguuugacaauggaguuggaguggaggucuuggacaaucaagguuauaugacagccagaguauaucugccauggucauucauuaacaaaaccgccggucuacuuggaaauuggaguuuuaauaaagaagacgauuuuacuuuacccgauggcucuagaguaagcguaguuucaaauaucaacgacaugcagagaguauacaccgauuuuggaucaaaauggaugauagaugauguauuagauucacagaaaggcagagcacuauuccuucgagaaaauggcuugac

SEQ ID NO: 3712 - RNA, 233 nt, Sitophilus oryzae
ggaucauugcgacauugaaaaaauucuuggcucgguaggaauugaagcugauggagaaaaacugaaaaggguuauuucagaacuaaauggaaaaucuauugacgaauuaauugcacaaggucgggagaaacugagcucaauuccagcugguggugguggagcugcuccagcugcagcugcaggaggugcugcaccagcugcugaagaaaagaaagaugccaagaaagaggaag

SEQ ID NO: 3713 - RNA, 794 nt, Sitophilus oryzae
gaaugaagcagacacauuggaacguaccgcagcggcaaucagaggccguacugggcguauugcuguuguggucgcggcggaaauggauaauuaugagccuuguauuuacacgaaacgaguuuuggaggcagugaaggugcugaaugaucaggugaugccuaaauucacacagaggguccagguggcaguucaaacaauuuugaguggccagcaaggacaaccugcgaaagaacuggaugaaaacgaauuuauugacgcuucccgucuggucuacgauggugugcgugaaauucgucgugccguacuuaugaaucgggccgacgaagacuuagacccugaagauguggagcuugaugaaaauuacacauuagaaaccaagagcaaaucaagugcccauacaggagaacauaacguggaugaauauccggagauaagcgguauaacgacagcucgcgaagccaugggcaagaugccugaggaagauaaacagaagauccuccaacagguggaauauuucaggagcgagaagcugaaguuugacagggaaguggccaagugggacgacacgggcaacgacaucaucguucuggcgaaacacaugugcgucaucaugauggagaugaccgacuucaccagaggucgcggcccguuaaaaaccacaauggaugucaucaacgcggcgaaaaagauauccgaagccggcacaaagcuggauaaacucacccggcaaaucgcagaccaguguccagaaagcucaacgaagaaagauuuguuggcguauuugcaacguauag

SEQ ID NO: 3714 - RNA, 665 nt, Sitophilus oryzae
caccaucgccuauuacuucaacaggacccucgacaggucuucaguuuaauuuugggggugcgucaacaacuccugcaaaugcuaauacaucuuugacaaccaguuuuacuccaauuuuagcuccagccagugcagcuacuaauacagguauuacauucgguacaccagcagcaacaguuggugcuucuacagcuacauuuggugcaccaacaacgacauuuggugcaccaacaacgacauuuggugcgccaaccacuacauuuggugcuccaacaacaacauuuggugcaccaacaacgacauuuggugucccaacaacaacaacaacugcaguaguuuugggucaaacuacaucaguagcuccuguuacaacuucugcuccuaguuuuccuaguagaucuauagcagcaucuaauguagccccgacaguaacuacaaccacgacaacaucaauuccagcaacaggaucuuuaacuuuuguucaacuggaagaucuaaucaauaaauggacgauugauuuagaagagcaaggaaaguauuuuguuaaucaggcuaaacaguuaaaugccugggacacuuuguugauuuccaauggugaaaaaauuuuaaacuuaaacagcagcauugaaagaguuaaacagcagcaaucgcagcuagaucaagag

SEQ ID NO: 3715 - RNA, 494 nt, Sitophilus oryzae
  misc_feature (474)..(474): n is a, c, g, or u
aggcaaaaccacuuuauugcauaugcugaaggaugaucgacuugcuguacaucuucccacacuucaucccacauccgaagaacucucaauuggcaacaugagguuuaccacauuugauuuagguggacacguucaagcaagaagaguauggaaagauuacuucccagcuguugaugccauaguauuccuaguugaugcaagcgauagaaugagguucgacgagaguagacaagaacuaauauccuugcugacagaugaaaguuuggcaaacugcccuguauugauuuuggguaacaagauugauuugccaguugcagcuucugaagacgaacucagaaauguauuugcauuguuuggccaaacaacaggaaaggguaaaguaccaagguccgauuuacccggucguccccuagaauuguucaugugcuccauccuccagagacagggauacggagaagguuuucgcugguuggnuguucaugugcuccauccuc

SEQ ID NO: 3716 - RNA, 474 nt, Sitophilus oryzae
aauucagauauggaugccguugacuuauuagagaaacguauagaagcuuuggaacugcaaauauugccaaaagacaaaucaguucucaguaacaaaucucaaaccauugccgaucuuuuaacugaaacccaaacaaugauaucuucagcucuuagcugcagagaaucgguuacaucgcucuuacaacauaugcacacaaucaaugaguaucucgacccaucgaguggugaauaugauuuagaagcugauauaaaaaagcaguauuuguugcagauauauccagaguuaaaggcaagaguugaacucauuaaaacguucaacaaucucauucaguuuacuaauucggaaagucuucaaaaaguuacugaauuaucagguaaauuacaaacuuuggcugguucaaacguggaaauuuaugaagaauguaaagagguuaacgaaaauguccucaaagccuuacaggaguacaauaau

SEQ ID NO: 3717 - RNA, 655 nt, Sitophilus oryzae
ggagaaggcauuuaaggacaccauaagcuauuuaucucauccgucaguucguuacgaaccauuugacuuccacgccgaaugucgaaaaaugaaauggcacagacuauccauauugacagauagaguugcuuuagaucaggaugauaugaguuauuuccuaauucuuucugauggaacauuuucuucuuugcaagaagggguguuccgaacaaauugcauugacuguuuggauagaaccaauguuguucagagcauguuggcucauaggaacuuagagauuguauugaggaaauuuacgaucuugagcuaugaucagaaguuagaagauuaucggacuuuugagucauuguuuaagaacguaugggcugaucaugcugauuugauuaguauacaguauucaggcacuggggcuuuaaaaacggauuuuaccagaaccgguaaaaggacgaaaucgggcaugauccaagaugguaucaacucgcugauccgguauuacaagaacaacuuuaacgacggcuccagacaagacucuauagauuuguuucuggguaauggaaaggugguaucuccuuuggccccacccccugguuggagauacauuaccuucccuucuguuuugcuaguggccacagcaauguuugucgcuucugucaua

SEQ ID NO: 3718 - RNA, 767 nt, Sitophilus oryzae
uuuccuacccuuuugagucguccagguuuauucaguacaauccuacaucuuuagaaagaaacuaccgcuaugaaguguuaacagaacaugaucuaggcguuaguaucgacuuaaucaauaaagauauauaugccgucgaucacggggcuacuuuagacccggcagaugagaaauuacuggaagaagacauccugacgccacaggauucgaaaagaucccggcaccaugcaaaaucuguguccugguugcguagaacugaauauauuucgacggaacagaccagguuccagccucaaacuauggacaaagucgaggcaaagguuggauuuaguauuaagaagucauuuaauagugaaacacuuuauauggaccgugauucucaaaucgaagcuaucgagaaaacauuuuccgauacaaaggugccuauugaaaagcauuauaguaagccaaauguuacgccuguugaaguuuugccucuguauccugacuuuaacuuguggaaauauccuugugcucaggucauauuugauucugauccugcuccaguaggaaagcagguuccagcucagauugaagaaaugucacaagcaaugauucgaggugugauggaugaaagcggugaacaauucguugcauacuucuuaccaacugaggaaacauugacuaaacguagagaagacuuugcuaauaauguaacguaucgggaugaugaagaauacgaauauaaaauggcuagagaauacaacuggaaugucaaaagcaaagcu

SEQ ID NO: 3719 - RNA, 781 nt, Sitophilus oryzae
gacaaaacaguccaugcaaaaaucaccgaagcuauaaaaaaagaugauauggcuccuugguaugaguuaauuugucaagaaauuggcuggaaauuggacgagaaauuguugaaaaccaucaaagcgaagaacgaugaacaagugaagaaacuaaacgaagcuauugaggaugcagagaaaaaucuuggcgaaauggaaguaagagaagcuuauuuaagaaaagcagaguauuacaguagaaucggcgacaaagaaaacgcuuuaagcaccuucagacaaacauacgacaaaacagucucucuaggacaucguuuagacauuauuuuccauuuaaucagaaucggguuguuuuuuauggaucaugauguuaucacaaggaauauugauaaagcaaaaacucuuauugaggaaggaggcgauugggacagaaggaaucgguuaaaaguauaucaaggagcuuacuguauggcuguaagagauuuuaaaaccgccucaaacuuguucuuagauacugucaguacuuuuacuucguaugaacuuauggauuauaaagcauuuguuagguacacuguguauacuucgauuauaaguuuaccucguaaucaguuaagggauaagguuguaaaaggcucagaaauauuggaaguucuacauucugaaccauuugugaaagauuauuuguucucacuguauaauugucaauaugcagaguuuuuuggaaaucucgcaaaaguugaagaaguucuuaggaaagauuauuuucuaaauccccacuaucggu

SEQ ID NO: 3720 - RNA, 731 nt, Sitophilus oryzae
aaaaacacggaguuggaaacguugggagaugagggagaauugucacaaacccugggaagcacggaaagcuccaaagaugccaaagaugaacuuagugauauuuuaggaccucacuuuagcuuggaguccauacaaaacauuaacagcaaagacguugaagacauuuucaagggcguuuuaacugacgagucgcaagaaucgcaacugucccaagaaacuaacauauuuccuccuauacaaucaaguacgcaggcgauguucgccggaagcaugucgcagccuucgcccguuucgauuccgcaaaugccacaaauuacgucuggcgcugugcguccaaccgcuuuaccggguguacaacacgccaguuuuccuccaucuccauaucacucugaguauagcaauaguccacaauuuaguccagccuuuuccgaaccgccuaguccuugggugagcaugagcgaggguguugaaauugacaguaccaguguuggaguagcauccacguauaaucaacggucgucggagaaaaugaaagccgacgaagcucuagguaguggagccaccauaucagcgguacucuacgccaacaugaaucaucccgaauggaagacugaauauccugcguggucugacagauauaaacaauuaauuaaaaaauggcguacucuaagucaagaacaaaaggcaccuuaucuucagcaagccagagacaaucgaagccaguugagaau

SEQ ID NO: 3721 - RNA, 321 nt, Sitophilus oryzae
gaguuggugcaaguuugaaguaaauuguguaguaaaaaauauuguuaaagucgaugaacaguuagaaagaccgccauuaguuguguccgcuuuaaacuuucgucauuaucgaaauccuagaacgcaccagaaugagauuuugaugauaucuuguauuacucaaacuaaauauucuguggauaagcaacaaccuaagccaccuuuuaaugaacauuuuuguguuuuuacaucuccagccaaacagccccuuccaaugaacauuuacgagugccuaaaaacuuauaaaggaaccaaaguacaaaaaauggacuccgaaaaagc

SEQ ID NO: 3722 - RNA, 714 nt, Sitophilus oryzae
auugaaagaccagcuacagguguagguaccaaaguuggaaaauugauccuaaaaacgacugacauggagacaguauaugaucuugguggaaaaaugauugacaguauuuugaaagaaaaaguucagucuggugauguaauaacuauugauaaagccacaggcaaaaucacccgccugggaagaucauuugcgagagcucgugauuaugaugcaacaggacagcaaacaagauuugugcaguguccagagggugagcuucaaaaaaggagagagguuguacauacuguuacuuuacaugaaauugauguaauuaauaguagaacucaugguuucuuggcucuauuuucuggugauacaggagaaauuaaaccagagguuagagagcagauuaauggcaaaguggcugaauggagggaagagggaaaagcagaaauuauaccagguguuuuauuuauagaugagguucauauguuagacauugaauguuuuucuuuccuaaacagagcguuagagaaugaaauggcgccuauaguaauaauggcuacaaaucgugguauuacuaaaaucagaggaacuaauuacaaaucgccucaugguauuccauuggaucugcuugauagaacuauaauagucccuaccacaccuuaugaugagaaagaacuuaaagaaauucuuaguauucguugugaggaagaggauugccaaaugucagau

SEQ ID NO: 3723 - RNA, 741 nt, Sitophilus oryzae
cagcauugucuugcaaguagugucucuuuacuuagagcuacagaaguagaggauauuauagaagggaacgaugacaaauauaaggcuguuucgguucauaccagugauccuccucuaccacgcgaagguaagagcaaaaagaauuugcaauggguuccauccuuaccaaauucaagucauuuggaugcaguuccucaagcgacaccuauuaaccguaauagaguugcugccaaaaaaguaagaacauuuccgcuaugcuuugaugauacagauccacagcuaaaucaagagaaugguugucagcacgaauugcuuguuccaauucgacuugauauggaaauugaaggucaaaaacuaagagauacuuuuacguggaauaaaaaugaaagucucauaacaccagaacaauuugcugagauuuugugugaugauuuagaucugaauccucuuacuuuugugccagcgauagcucaagcuauccgucaacaacuggaagcuuuuccuaacgaaccuccuaguauuauagaagagaauucugaucaaagaguuauugugaaauuaaauauccauguugggaauacaucauuaguugaucaaguugaaugggauaugagugagaaacaaaacaauccugaagauuuugcucugaaauuauguucagaauuaggucuaggaggugaauuuguuacagcuauugcauauucuauaagggggcaacuaagcuggcaucaaagaacuuac

SEQ ID NO: 3724 - RNA, 583 nt, Sitophilus oryzae
cgaaagaaauuggugaucgugggcgacggugcaugcgggaaaacuugccugcugauuguuuuuagcaaggaccaauuuccagaaguguacgugccaaccguuuucgagaacuauguggccgauaucgaagucgacggaaaacaagucgaauuggcccuaugggauacagcaggacaggaagacuacgaccgucugcgucccuuauccuauccagauaccgacgugauccuuaugugcuucucuguggauucuccagacucgcuugaaaauaucccggacuuauccuauccagauaccgacgugauccuuaugugcuucucuguggauucuccagacucgcuugaaaauaucccggaaaaauggacuccggaagugaaacauuucuguccgaacgucccuaucauucugguagguaauaagaaagauuuacguaacgaccccacaacuauaaacgagcuaagaaagaugaaacaggagccugucaagccucaggacggucguucgauggcagagaaaauuaacgccuuugcuuaucucgagugcucagcuaaaaguaaggaaggugugagggaaguguuugaaa

SEQ ID NO: 3725 - RNA, 656 nt, Sitophilus oryzae
gguuuggaaaacgcuguaaaaugauuaaucuuuccacaagugcauuaucauuuuugguaccuucauuuuugaaugcugcucuuagcgaagaagacaguaucguucaaauugcuauugaugacagcagaaauauaauguauacuuuaacagaaaagggaucaauugaaguaugugauuuaggagagaaaugcaacacuuucucaaggauuaguaaaaugacacagaacacuuuaguuacucaagcaaugaauacugucaagacauuagauagucaaaauuuuagaccaaucauuaguauuucuccgauugagucuuaugaaucugcaaaccuaaaucuuguagcugucacucaaacagguguuagauuuuaucuaucaguuguaggauuaucuaaucaacagccuaaucagaggccuuauacauuaacuuuagcucauguuagauugccaccagguuauucagccaauguuacuguuaggccaagaaguguucauaugagucacuacagagacagaaacuugauuuuaauauccaauguaaaagauaaggauguuuugugguguuuaaguucugacuuauuucccuucagucagucuuuaauggaagcuuauacuacaguuaauuuagauggcccagcucuagcuuuagcagaggug

SEQ ID NO: 3726 - RNA, 257 nt, Sitophilus oryzae
auaacauuacacacagggggcacccagagcacauugcaggacauaaaaaucaccgaacgagcuaauggguacaguuacuuagauuccacaagacauuauacaagaaaucgguuuauauauuggcgaauuagcucggauaccuuggagcuaauugagcagaguuuagauauaaaccuuacgggaaacacugugagguacagguuuauggauaguccgauaauugaugguauuucaguacaagaaacugaagaaaacgu

SEQ ID NO: 3727 - RNA, 650 nt, Sitophilus oryzae
  misc_feature (425)..(425): n is a, c, g, or u
agacagcaacaaucaagcuauaguuucaggaggucauauucaaccguuugccaaggauuugauuagucaauuauuggagguguuggagagaccuguaucagaggaaaaugaauauauuaugaaagcuuuaaugaggacauuuucgacucuacaagaacugguuauacccuacuugggcguggcauuaccgaaacuuacugaaauacuuaaagcuguuacgaagaacccaucucggccacauuucaaucauuacuuguuugaaacguucucccuuucagucagaaucguauguaaaucuaaucaggcugcuguaaaaucguuugaggacauuuuguuuccgauuuuccaaggaaucuugcaacaagauguacaagaguucauccccuacgucuuccaaguauuaucaaugcuauuggauuacaccnuacaagaguucauccccuacgucuuccaaguauuaucaaugcuauuggauuacaccccuucaggaucguuaucugaugcauacaugcaacuuuuaccauguuuguuggccccuguacuuugggaacgaccugcuaacaucagcccguuaguacgauuguuacggucguugguaagccaggcggcccaacagauuauugcucaggauaaauugccuggcuuuuugg

SEQ ID NO: 3728 - RNA, 508 nt, Sitophilus oryzae
acauuugaaugcauugaggaacuuaaagaagauuuggaguggaaaaugauuuauguuggaucugcugaaucugaagaauacgaucaaauuuuggauucgguauuuguuggaccuauaccagagggcaagcacauguuuguuuuucaagcugauccaccaaaugucucaagaauaccagaaaaugaugccuuaggaguuacaguuguauuacuaacauguucauaccgugcucaaguacuaacauguucauaccgugcucaagaauuuauacgaguugguuacuuuauaaacaaugaguauaaugauccagaguuacgagaaaauuugccaaguccaccucaauuugauaaaguuacgagaaauauucuggcaucugaaccuagagugacaagguuuaaaauuaacugggaggagccuaaugcacaagaaguugugucaaauuuagagaauacagaaaauaguucgauuacgacugaacaaaguaauaaugcaacucaaucccaaauuc

SEQ ID NO: 3729 - RNA, 670 nt, Sitophilus oryzae
accaaaugcauuacaacagcaacaacagucccaaccugccaccagucaaguaccaucuuuagcuccgaugggaggucuaacgcccacauuaggccugggcaugggaaaugccauguccaugccacacacaaaauacguuacagcuuaucaaaugccuauguccacuaugcauaguggaaugaccccucaaacaccacagcacacuaugaugucaccuaugguaaacuugggugguucgggggguaguggugccacuccaaauguuggcggcccugcuacuccuucuccuaugacuccgaugacuccacauuccgcagacccaggaauuguaccacaauuacaaaauauuguaucaacuguaaacuuaaacuguaaauuagacuuaaaaaaaauugcguugcaugcuaggaaugcagaguacaauccgaaacguuuugccgcagucauuaugagaauuagggagccuagaacuacagcacugauauuuaguucgggcaagaugguguguacaggggcgaaaagugaagaggauucuagauuggcggcuagaaaguaugcuagaauaauacaaaagcuuggauucccagcgaaauuucuggauuuuaaaauacagaacaugguaggcaguugugacgucaaguuucccauccgucuagagggcuugguauug

SEQ ID NO: 3730 - RNA, 337 nt, Sitophilus oryzae
acuuuugccucaggaaaucaaauauuuuaugauggaaaaagcguuaaacaaguagaugucccuucguuuucugguaguuuugguauccuacccaaacauguuccaacuuuggcaguuuuaagaccaggagucgugucuguauaugaaaacgaaggagcuguuaagaagaucuuuguauccagugggacugucacaauuaaugaugauuccucuguacaaauuaucgcagaggaagcucauccuguugaaaauauagaucuaucagcugccagagaucuuuuaaguaaagcucagagucaauugucuucagcagccaaugaucaggcuaaggcugaag

SEQ ID NO: 3731 - RNA, 788 nt, Sitophilus oryzae
ggauuucucggucgaaaaacugauuucuucaccgggggaaaugaaggggauugggaaaaacuugucaugaauacauuuaaaaaacacgaaaagaucagccguucucggcacgacgcugaaguaaaggagcguaaagauagagaagccgcuaaaaaagcgaaaaaggcugaagcggaagcuguaaaaccagcagaaauuacugaauugacagaugaagaagcugaccgucuucagaaagagauugauaagaaaaagggaauugaugcugucccuucugugauaaacaacgaagaaucuaauccuuccacgucugcaaguucugcagagaaaauugaagaggacgaagaugaguccgagaagggaaaauuaaaaccuaauaaaggaaaugggugugauuuggagagguauaaauggacacagacucugcaggauauugagcuccgagugccccuagaaaucaacuuuagagcgaaacaaaaagaucugguagucaaucuugccaagaaacacuugacgugcggcgucaagggucagccaccaaucauagacgacgacuuacaacacgagaucaagcuggaagaguccacgugggucaucgaggauggaaagguuuuauuauuuaauuuagaaaagguaaacaaaaugaauugguggggaaaacugguacaguccgauccagaaauuagcacgaagaaaaucaauccugaaccuucgaaacugagcgauuuggauggugaaacccgggguaugguagagaaaaugauguacgaucagcgacagaaagagau

SEQ ID NO: 3732 - RNA, 316 nt, Sitophilus oryzae
uggauuuguaucuaucccgcuuacauaaacagcaaaaaauccaucgccgaggguaggaggauugcaaaaaguagggcaguugaaaauccaacuuaucaggagauacgagauguuuuaguugcuucaggauuaaauguuggcguggaaaacaagcaauauagucgcgaacgcagcaaagaacuucuaugcagggguagaaucaggguacaguuaaaacacgacgaugguucacucuacaacuccucauuuccuaccagagacaguguauuguugcauuugggugacaugauaccgaaacugaagacccgacuuagua

SEQ ID NO: 3733 - RNA, 741 nt, Sitophilus oryzae
aguguauaaggccuguuuggagcuacucccccauaaaauauuuacuuuuucuaaaaucugguuguuauucgcaaaguuugaaauaagacagaaaaauuuaacagcagcucgaaaaauauugggcacuuccauuggauuguguccuagagauaaacuguuucggggauauauugauuuagaaauacaacuucgagaauuugaucgcaguagaaaacuuuaugaaaaauuuuuagaauuuggaccagagaacugcgugacuuggaugaaauucgccgaacuugaaacucuuuugggugauauugacagagccagagcgauuuacgaacuggcaguaaaucaaccuagguuagauaugccagaacuuuuauggaaagcauuuaucgauuuugaaauaucccaagaugaaucagauaaugccagacaauuguaugaaagacuucuagagaggaccacucaugucaagguguggcuaucauaugcuaaauuugaauuaaaucaacaaacggaugaugguuuaaauauuaggcuugcucgaagaauuuuugaaagaggcaaugacaaucugaaaaauucaguagagaaagaaagcagagcucuuuuacuggaaaacuggaaggaauuugagcucaaccauggcgaugagucuucccaagcaacaauaaauaguaaauugccuaagagaauuaagcguagacaaaaaguugucgaugaggaugguaaugaacaagguugggaagagau

SEQ ID NO: 3734 - RNA, 657 nt, Sitophilus oryzae
caggacaaaauuagggcucuuagagaagcuuucuaccgacaaaauuuaccaaacuugaugaaccuucuugcuacaguuuugguguucgcuauagugauauacuuccaaggauuuaggguggauuugccaaucaaaagcgcuagauacagggggcaguauucuagcuacccuaucaagcuguuuuauacaucaaauauuccgauuauucuucagucugcguuggugucgaacuuguacguaauuucacagauguuggcuguuaaauuucaaggaaauauccucauuaauuuguugggaguuugggccgauguuggggguggugggccagcuagaucuuacccuauaggaggucuguguuauuaucuaucaccuccugagaguguaggacauauacuggaggacccucuucaugcuuuguuauauauuauuuucaugcugggaucuugugcguucuucucaaaaaccuggauugaaguaucaggaaguucagcuaaagacguagccaaacagcugaaggaacagcaaaugguuaugcgaggacaccgagauaacucaaugauucacgaauuaaacagauacaucccuacugcagcggcguuugggggguuguguaucggagcccugucggucuuagcugacuuuuugggugcuauaggg

SEQ ID NO: 3735 - RNA, 370 nt, Sitophilus oryzae
auuucaaagguacacgagcugagcaggacaaauuauuaaggcucuccacuacacucuauguagggaacuuaucguucuuuacaaccgaagaacaaauuuaugaacuauuuucaaaguguggagauauaagaaggauuauuauggguuuggauaaauauaaaaaaacuccuugugguuuuuguuuuguagaauauuacacuaggccugaugcugaaaauuguuuaagguauguaaaugggacacgucuugaugauagaauuguuaggacagauugggaugcuggauuuauugaaggacgucaauaugguagaggaaaaacugguggacaaguaagggaugaauacagaacagacuaugaugcaggaagagg

SEQ ID NO: 3736 - RNA, 789 nt, Sitophilus oryzae
ggccuuguuugagucagauaagcuccuauuccacgacgagagaauggucgagaggcaaaaaagcacuuuugggaaguuuagguguaauugcugggggagccggagccuuaaucauagcucuggauaagucaguacgagcuucagaacucauacugcauccucccaagaauccauggagucauaacggcugguucaaugguuuagaucaugcgagugugagacgugguuaugaaguuuauaaacaaguaugugcugcgugucacucuuuacguuauguugcuuaccgugacuugguugguguuacacacacugaagaagaggcuaaagcugaagcugaggaacaguuagugacagauggcccagaugaggcaggaaauauguuccaaaggccaggaaaguugucagacuacuucccuaguccuuauccuaaugaagaagcagccagggcagccaauaacggugcuuuucccccagauuugucuuacauuguaccugccagacauggaggugaagauuauauauuugcucuacuuacuggauauuaugaugcuccagcggguguuguuuugagagaaggucaauacuacaaucccuauuucccuggccccuauuucccuggcggugcuauuucuauggcacaagcuuuauacaaugaaguuauagaauaugcugaugguacuccagccacugccagucaacuagcuaaggacauaggaacguucuuaaaauggaccgccgagccugaauuagaagaccgaaaaauaaugacgauucgggccauugguauau

SEQ ID NO: 3737 - RNA, 728 nt, Sitophilus oryzae
cucugggaaguuuacaacgaaaggcgauguaucaggacuuauuauggccacagacaagcaguuagagauauuaacuucaauaauaguggacaucauuuccuaucagcugguuacgauagauauaucaaguuaugggacacugaaacuggacguguuauaucgcgauuuacuaguagaaaaauaccuuacugcguaaaauucaaucccgaucauaauaagcagcaucuguuuguagcugguacgucugacaagaaaauuauuuguugggauacaagaucaggcgauauuguucaagaauaugauaggcauuugggcgcuguaaauaccauaacuuuuguugacgaaaacagacguuuuguuacuacuuccgaugacaaaucauuaagagugugggaauggaauauaccaguugauaugaaauauauugcugauccgacuaugcacaguaugccagcuguaacuccaaguccaaaugguaaaugguuagcaugucagaguauggacaauaaaauugugauuuuuucugcauuaaauagauuuaaacuaaacaggaaaaaaacauuuacaggucauaugguagcaggauaugccugccaauuagauuucucaccugaucuuucguauuuggucucaggagaugcugacggaaaauguuuuauaugggacuggaaaaccaccaaauuguacaaaaaauggaaggcacaugaugguguguguauugguucucu

SEQ ID NO: 3738 - RNA, 659 nt, Sitophilus oryzae
cccugguuguuaagaagguugagcccaaaaaggagguaaacccucuuuuugaaaagagaccaaggaacuuuggaauuggucaggauauucaaccaucucgcgaucucuccagauuuguaaaauggcccaaguacaucagaauucagagacagaaagcagugcuucagaaaagauuaaagguuccuccaccaaucaaccaguucacacagaccuuagauaagcaaacagcaacacaguuguuuaaaauauuggaaaaauacagaccagaaagcauuauucaaaggaaugaaagguuuaaagcuauagucgacucgaggaaacaggauaaggaauauguuccuagcaagcgcuuguuuguacguuuuggcacaaacaccguaacaaaacugguugaacagaaaaaggcacaacugguagucauugcgcaugacgucgacccaauugaguugguccuguuccuuccagcccucugcagaaagaugggaguaccauacuguauaguaaagggaaaagcucguuuaggcgugcuggucaggcgcaagaccugcucgaccgucgcucugacccagguggauuccggcgaccgguccuccuucaacaaggugguggaggcgaucaagaccaacuucaacgaccgcggcgacgagaucagaaggcac

SEQ ID NO: 3739 - RNA, 651 nt, Sitophilus oryzae
cagugaaccaguacaaggaaaagauaaaauuguugaauauauaaaacaaugucaggauccacaaaguggaggaauuagugcaugcauugggcaugacccucauauacuucauaccuuaagcgcaauucaaauuuuagucauguacgauagacuagcugcaauagauauugaaggcguaguccgguauauucaaggacuucaacaagcugaugguaguuuugcuggagauaaauggggugaaauagauaccagauuuucauucugugcuguuaaugcacugucuuuacugaagaaaauggauguaauagauauugaaaaggcuguugaauuuguagcaaguuguaaaaacuuugauggugguuuuggaucaagacccuuaucugaaagucaugcugguuuaauauauugcuguguaggauuuuuaucuauuacuaauagauuagauauaauagaucaagauacauuagcuuggugguuaugugaaagacaauuaccaucagggggauuaaauggcagaccugaaaaauuaccagaugucuguuauucaugguggguucuuucuucguuagcuauauuaggcagauuacauuggauagacacugaagcuuuaaaaaccuuuauauuugcaugucaggauacagaaacaggagg

SEQ ID NO: 3740 - RNA, 752 nt, Sitophilus oryzae
uggagguguucaagaagaugcuauuauggcuguuucuacuuuaacagagguuuuaggagaugguuucuuaaaauacauggacgcuuucaagccgauuuuauaucuuggccugaaaaaucaccaagaguaucaaguuuguggcacugcagugggucuuacuggugacaucuucagggcguuaaaaauuaaggccuugccuuauugcgaugagaucaugacacuuuuguuagaaaaucuuggggagccuaccguucaucggaguguaaagccacagauccucucaguuuuuggugauauugcucugagcauaggaaccgaauuuaaaaaauauuuagacauaguuuuagcuacucuagcccaagcaucccaagcgcagguaaagguugaucguaccgacuacgauaugauugacuaccuaaaugaauugagagagggcguucuagaugcuuacacugggcucauucaagguuuaaaaggcgacaguaacacuccuucuggcgacauuucccucuuagaaccccacauaccguucauuauccaguuuaucacaguuguugcucaagauucugagcauucugauggcaccauggccguagcugcaggcauuauuggugauuuauguguauguuuuggagcacccaugcucccucugcuagauuuggaaccgaucaaugagauguugucucaagguagaagaucgaggguucaacgcacaaaaggccuguguaauugggcaacuaaagaacugagga

SEQ ID NO: 3741 - RNA, 671 nt, Sitophilus oryzae
aguuagcuucucuggguuuggacagguugaagucagccuuguuggccuugggacuuaaauguggagggacacuggaagaaagggcucaaagauuauucucuacuaaagggcagaguucuuuggauccaucucuaaugacaaaaucaacuaaaggaaaagcuaguaaggacaaggaacuuuugcgucauagagaguuggcuauguuagaagcccagaucuauaaguuagcugauauugucaguccucaaagaggggcaaccaaagagaacgugcaacgcaaacaagcaagaaccgacggagaaagagacgacagcgaaaacgaagaguccgaagaugacagucccgaugaaaaugacgaugacgucccuuacaaucccaaaaaccuuccuuuggguugggacggaaaaccuauaccauacugguuauacaaauugcauggucuaaacauaaguuacaacugugaaauuugcggaaauuacguguacaagggucccaaagcguuccagaggcauuuugcugaguggagacacgcccacgggaugaggugucuggggauaccaaacaccgcccauuuugcuaaugucacgcaaaucgaagaugcucuugcacugugggaaaaacugaaaguucaaaaacaggcggaaagguggcagccugaaacugaagaagag

SEQ ID NO: 3742 - RNA, 496 nt, Sitophilus oryzae
aauuacgcuucaggacucucggacguuuaucgguacuuucaaagccuucgacaaacacaugaacaugauuuugggagauugcgaggaguuucgcaaaguaaaaccgaaaaauuccaaaguagaacgggaagagaagagaguacuaggguucguacuucuucgaggggaaagcauuguuuccuugaccguugaaggcccaccuccacccgaggaagguuugccaagaguaccgauuccuggagcaacuccuggaccaggaauggggagagcagccggccgugguaugccugcaggcaugagcggagucccuguagggcuucaagggccuguuaggggugucgguggacccucgcagcaaguaaugacuccgggaggaagaggucaaguaucagcgccaccucaaaugaaucacggcccaccuagaauggguauuccaccacccggcaugauggggggucccccaccaggcaugaugccaccuaacgcuauggguaug

SEQ ID NO: 3743 - RNA, 685 nt, Sitophilus oryzae
ucagacuaauuguucggcaaacuuguguggcaguauggaauaaaaugcagccguuggaaaugccacagcccgaugcggaauuguggacgaaaauagcagaagaauuuuacagaaaaaguaauuuucccaauuguuugggagccaucgacggcaagcauaucagacuuguuugcccuccgaauacagggacgcaguauuuuaacuacaaaaaauauuucucgauuguuuuauuggcaguaagcgaugcagauuauugcuuuaccgcaauugacgugggagcuuacggcagagaagcagauaguaauauuuucaaaucuucaguuuucggucgaagguuggcacaaaagaaucuugaucuaccaggaaacagaccgcuuccaaacaccccaaauauuucacucccucauguuuuuguagcugaugaagcauuugguuuaggugaaaacgugaugagaccuuaugcacggaauaaucugucaauugaaaagagaguauuuaauuaucgauuaacucgagcucgcagauauguugaauguacuuuugguauacucgccaacaaguggagaguauuucacacaaauauacugguuucggaagauuuugccacugacguaacaaaagcugcuuguuuguuacacaauuuuguacgaagaagagauggaguugaaucaaacgacgaaucgag

SEQ ID NO: 3744 - RNA, 436 nt, Sitophilus oryzae
aucaagaugcaacuaccgaaccuucuacggagcccgaagacgaagagcugacacaaccuuuugaagaaucugaaguaguuguuauagaucaaccuguuaagucaccagaggagcaaauaucaacaaaagaggacuuugaagaauuaauagacgaagguucgaggaaagaaaaacuaaugaaaccugauccuaaacaaauugcagauuuucacaaauacgcagcaccgacaaacguguucaguuuuccaccuaaagcgcaggccacaauuagacccgcuaauguuauuggaccgaauacgaaaaugccucagaaaauuucgcucauuacuaccccgaucauacagaauuuuacaaauagaucugacgguucgaagccaacuuuggaaacccaacaauuaauuuuaacaccuacaacaaaaauaaacaccacagcagc

SEQ ID NO: 3745 - RNA, 720 nt, Diabrotica virgifera
gcagaggagaagagaaugaggcggcucguaaagaaggagaacaaagagagauccaggaaagagagaaugggcugggauaacgaguauuuacauuauacaaacagugacaauccuuucggggauggaaacuuguugucuacauuugugugguccaagaaguuaaacaaagaaggauugaaagguguuagucaagaagaaaucgaagcaauaaacaggaugaaacaagaagaaaacaaaagagaacuggaaaaaguaaaaaagagacgucuagaaagggaauuagaaagacagaagagggacgaagaaacccagaugcuccaaagaagcaaggaagcagcacaauuugaagagugggagaggcaagaagauaaguuccaucuggaacaagcaagacugagaucacauauaagaauccaagauggcagagccaaacccauagauuuguuagccaaauauauaagugcggaagaagagguagaugcuguugaaaugcaugaaccuuacacauaccuaaacgguuuacauaucaaagauuuagaagaucuaguagaggauauuaaggucuauaaagaguuagaaagggggaaaaauuuggauuauuggaaugauauaacuguaauaguggaagaugaguugcagaagcuuaggaagcuggaaaaacagaaugauuuugauuuagguuugaauagaagagaagguauacaucagucaguagcugga

SEQ ID NO: 3746 - RNA, 729 nt, Diabrotica virgifera
gugaaacuggaaaacccaagggauaugguuucugugaauauagagaucaagaaaccgccuugagcgcaaugaggaauuuaaacgguuacgaaauaggcggaagaaauuuaagaguggacaaugcuuguacugaaaaaucuagaauggaaaugcaaaaucuccucaaccaaccuccaguagagaaucccuauggagaggcaguucaagcugaaaaagcuccugaggcuauaaguaaggcuguugcaucucuaccuccugaacaaauguuugaauugaugaagcaaaugaagacaacuauucagaauaauccaacagaagcaagacagaugcuuuuacagaauccgcagcuugccuaugcucuuuuacaagcucaaguuguaaugaaaauuauugacgcagcuacugcaguuaguuuacuucaucccgugaaccaagugccagcgacacuuaugccuggagacaagaauguuccuguccaaguaccaguuaauaaucaguacagggagccuccagcaccuguucaaccgccuguccauccaagacaagacuuccaaccuguuccuccuccuguuaugcauccaucucaaaaucaaguauuuccaagucaagauauagaucugagauccauugguggugugccagaucuaagaaaccuaagacccaugggugaccaggauaugagacaaaugccaucugcuauucaaaaucccuuaccaccaacuaucggag

SEQ ID NO: 3747 - RNA, 654 nt, Diabrotica virgifera
gaagaucccggagauguuacuuauucugcuauuggugguuuaucugaacagauuagagaacuucgagagguuauugaacugccuuuguugaauccagaauuguuuaugagaguuggaaucacuccaccuaaagguuguuuguuguaugguccuccagguacuggcaaaacucuacuagcuagagcuguagcaucucaguuagaugcaaacuuccucaaagucgucuccagugcuauuguugauaaauauauuggagaaucugcaagacugaucagagaaauguuuaacuaugcuaaagaccaucaaccuugcauuauuuucauggaugaaauugaugcuauuggugguagaagauuuucugaagguacuucagcugauagagaaauccaaaggacucuuauggaacugcuuaaccaaauggaugguuuugauucauuaggacagguaaaaaugauuauggcaaccaacagacccgauacucuagauccugcucugcuccguccaggucguuuggacagaaaaaucgagauaccucuuccaaacgagcaagcccgucuugaaauuuugaagauccaugcccucccgaucgcuaaacauggagaaaucgauuaugaagccaucguaaaauuaucugacacauucaauggagcugau

SEQ ID NO: 3748 - RNA, 630 nt, Diabrotica virgifera
ggcuauuucucaugcagguacuugucugggcauuuuagcaaaugauggaauuuuguuggcugcugagaggcguaacacuaacaaauuauuagaugaaguuuuuauuucagaaaaaauauacaaacuaaaugaugauaugguuuguaguguggcuggaauaacaucagaugcuaauguuuuaacaaaugaauugagacuuauaggucaaagauauuuauuucaguaugccgaaucuauuccuugcgaacaguuaguuuccuggcuuugugaugucaagcaggcauacacucaguauggagguaaacguccauuugguguuucaauauuauauaugggaugggauaaacauuauggauaccagcuauaucagucagaucccaguggcaacuauucugguuggaaagcuaccugcauaggcaacaacaguucagcagcaauuucaaguuugaaacaagaauauaaagaaggucaaaugacuuugaaggaugcaaagacguuagcaguaaagguucuggcaaaaacauuggauauggcaaaacuaacuucagaaaaaguggaaauggcuacacuuacccgcaaaaaugauaaaaccaugauuaaaauuuuaagcggcaaggaaguagaagaacu

SEQ ID NO: 3749 - RNA, 794 nt, Diabrotica virgifera
cugguaacucacaugugacaacaucaauaaugcaaguucuuauggaaaaguccgaaauagaauuaaaggacacuuacgccagauuuuugccucugggucuuggauugugucauuuagguaaacaagaaagcauugacacaauuauagcagcauuagaaguuauaccugacccuuucagauccauggcgacuacuauggucgauauuugcgcuuaugcaggcacaggaaauguuuuaaaaguacaacauuuguuacauauauguucagaacauuacgaugcuccugaaacuccugacaaaacuucaaaggacaaagauaaaaaagaagcagagaaagaaaaagauaaggaucuuucagcuagacaagcuauugcgguuuuggguauagcuuuaauuagcaugggagaagacauugguagcgagauggcuuuccggacauuuggucauuuacuaagauacugcgaaccagcgaucagacgugcuguucccuuagcccuaggcuuaaucucaguuucaaauccaaaauuaaguauucucgauacuuugaguaaauuuucacaugauagcgaugcugaaguggcucauaaugccaucuuugcgaugggucuggugggagcugguacuaacaaugcaagguuagcagcuaugcuaagacaguuagcacaguaccaugccaaagaucccaauaauuuauuuaugguucgcaucgcccagggucucacucaucuuggcaaaggaacuuuaacucucaguccauuccacagugauaggcagcugaugaguccaguagcugua

SEQ ID NO: 3750 - RNA, 798 nt, Diabrotica virgifera
uucaacuccacaggaacaaaguccuguggaacauaaaauugagccaacagagacaacaacuuaucaagaucugcgcauggaaacgcaucaaagggaacaguuuacggaaccaaaacaguacacaguagaaaugccagcagaaagcuucucaggacaaaacuuuucacaggauaucgguuacaccaguaauauagcuacuguuaauauagaagguaaugaggugccuauaacgauaucuucggaaauagaucaacccggaggugauuauacaagucugcagacagcccaauacaauaacgguuauaccgacgguccacaguauuuacaacaacaucaguaucaaaauuuauacguugacagaggcaguguugaaaauucaccuccagcaacuuuauuguuuaaagacgaucccaauuuagcaacagcuagauauccgacaaacuacgacguaucuagcagucaaucgcagcugaaucuucuuccaaaugacaccuacuucaccacaacagccaauugggcuucaacgagcaccggauccuaccaacaacaauacagcaauaccaucaacauccuucaccaagcggacaguacgcagucauauggaggaggucccuacgugaauacagcauggucauccaguccgauggaggauggacguccaccaagccaagagguacuagucaaagagugcgugaauuguggugcuaguguuacaccccuuuggcguagagacgguaccgggcauuaucuauguaacgcgugcggguuauaccacaaaauuaaugggguucacagacc

SEQ ID NO: 3751 - RNA, 752 nt, Diabrotica virgifera
auaaucaugcucaacgucgaccaacauaacgaaaaugccaaaaaacaaacgacucccaugucggcuaaugcuuucaagaaaaauuugaaaggcguuaacggagguaacgacuuugacgaagaaauguuagaugauauauauacaacaauaaaaaacgaagaaauaguuaugcccgccgaacaagccggguuaguuagggaaaauuauuucuggaagaucuugcugagaaagggacagacgaaagauggcaucuacauccaugauaauagugguacuuaugauucugagcuuuuccagauuguuuauggaccuauaguagcagcucugucuucuguuuacgagaaggcugaaaacgaaaguguacauaaaaaaguuaugcaaggauucgaaagaugcgccuuuauugcugcaaaucucaauauaucuacaaauuuggauaugcuuauucuaggcauuuguaaauucacuguguucuacaaucaacagaaacagaacaacauuguggugcaauuuggaaugaacagcaaggcucaguuggcacuuaggacgguauuuucucuaauucaucaacacggaaacaccaugagggagggauggaaacauuuauuugaucucuuguuagcgcucuauagcaacggacuguugucaaaaacguuuguagagguagaagacuuuauugaaccaaguggcaaauuaaugcuagucuacaaggaagcaccaucugcggcgaagcaggauaccgguuuacugag

SEQ ID NO: 3752 - RNA, 469 nt, Diabrotica virgifera
uguagcaauugcagcagauaggcgguuugguauucaagcccaaacaguagcuacaaauuuccaaaaaaucuuugaaaugggaccacauuuauaugugggucuuccaggauuagccacagauacccaaacaguuauggaaaaacuccguuuccgaaaaaacuuguacgaacuuaaggaaaaucgaaaaauaucuccaaaaguauuugccucuaugauaucaaauauguuguaugaaaaaagauuugggccauuuuuuguagaaccuguaguagcuggacuucuaccuaauacuuaugaacccuuuaucuguaauauggauuuaauugguuguauaaaccaaccuucagacuuuguuguugguggaacagcgucagcacaguuguaugguaugugugaagcacuuugggagccuaaccuaggaccugaggaucuuuuugaaaccaucucucaagcucucaucaaugccuuu

SEQ ID NO: 3753 - RNA, 731 nt, Diabrotica virgifera
ggauccaguaauguggcuagauagacuuagugcggugcuuagauauguuaauguacauauuccggaagguguggaaaacccuuguaaaccgguaauucucgaaguguggccgguauugucucgcacguucgauaaauuccaaagugacauuaggauaauggagagauguugucgugccgugcguuucaugcugcggugcgucgcgcaagaagugcgugaacucuuagaaagccuaguuggacaaauagugaggaucuauacguuauaccaacauucguguuuucucuaugucgguaguauacucguggacgaauacgcaauagauccgauaugcgugccaggucugcuggauaugcugcaagcguuucuggaaccuaccuuccacguguugcaggaggagaacgggcugaagaaucaucccgauacaguggaugacuuuuuuagguugugugcaagauuuaugcagagggcgccuuuagcauuuuuaaaauguucuuccuugguccacaucuuacagugugcccuuuuggcuucuucccuggaccaccgagaagcgaauaugucugugaugaaauucuuuuacgauuugauaaaccagggccagagugggagagcugaucccgaauucaaucaacgacagauguuaguuaaaagcauccucgacgaguauggccaacaacuagucucaaaucuaauccauucuugugucuucuaccuccauuccuacaugc

SEQ ID NO: 3754 - RNA, 744 nt, Diabrotica virgifera
caauccuccaccaccaaauauaccaucuaguggcgguacgaugauucaaagaccugcuggugcucccuauucaccaaugagagguggaauuauuccgccacagcaaggaaauaaaaggccugcagacaauaggacucaaaugcaacagaaaaguaaugaauacagccauaguacaaguaagaagaagaaaaagcuggcggauaaaauccugccacagaaagucagagauuugguuccagaaagucaagcuuacauggaucuauuagcauuugaaagaaagcuagacucuacuauuaugagaaaaagauuggacauccaagaagcucuuaagcguccgaugaagcaaaaaaggaaguugagaauauuuauuuccaauaccuucuauccugccaaggaaccucagccugaaggacccgauggaccaugucaggaaggcacuguugcaucuugggaauuaagaguagaaggucgucuuuuagaagauccaaagaacgauccaaauaaaguuaaacgcaaguuuucuucuuucuuuaaaucucugguuaucgaauuggauaaggagcuguauggaccggacaaucauuuaguugaauggcacagaacccuaaccacccaagaaacagaugguuuucagguaaaacgcccuggugacaagaaugugagauguacuauuuuguugcuucuugauuaucaaccucugcaguuuaagcuugauccuagacuagcuagacuuuugggaguuca

SEQ ID NO: 3755 - RNA, 285 nt, Diabrotica virgifera
gaacccacauuagacgaguuagaacaaaaaaugagagaaguugaaacacagucacaugaggguaaaaggaaaaaugaaucauuguggccaauuuucaaaauccaucaucaaaaauccagauauauauuugaucuuuuuuauagaagaaaagcaaucagcagggaacuauaugacuauugucuuggugaaaacauugcagauaaaaauuuaauagcgaaguggaagaagcaaggauacgagagucuuuguugucuaagauguauucaaacgagagacaccaacuuu

SEQ ID NO: 3756 - RNA, 702 nt, Diabrotica virgifera
ggaggaugaauucagaaccaucagacaaauaguacaaaaauaucaguauguugcuauggacacagaauuuccugguguaguugcgaggccuauuggagaauuuagaaguucugcagauuaccaauaccaaaugcugaggugcaaugucgauuuauugaggauaauacagcuugggcucacauuucuugaugauaacggaaaaacuccagggggugccuauacuacauggcaauucaacuucaaauucaaccuucaggaagacauguaugcacaggauaguauagaccuccugcaaaauucuggcauucaguuuaagaaacaugaggaugaagguauugaaccucuugaauuugcggaauugcugaugucaucugguauuguccugguggaaaauauaaaauggcuguccuuccauucugguuaugauuuuggcuaccugauaaaacuguuaacggacaacaacuuaccucaagacgaaacagaauucuucgauuuguuaaaauuauauuuuccuaccauauaugauguaaaguaccuuaugaaaucaugcaaaaaucuuaaagggggauuacaagaaguggcagaacagcuagaacuugaaaggauuggaccacaacaucaagcagguucugauucucuucugacaggaauggcauuuuucaagaugaaagagauguucuucgaagacaccauagacgacuc

SEQ ID NO: 3757 - RNA, 738 nt, Diabrotica virgifera
ucugguacugguaaaacagcuaccuuuuccauuucgauuuuacaagcuuuagauuugacaaugcgagaaacgcaaguuuuaugcuugucuccuacuagagaauuggcuguacagauucaaaaaguuauucuagcuuuaggugacuucaugaauguucaaugucaugcuuguauuggaggcacaaaucuuggggaagauauuagaaaacuugauuauggacagcaugucguuaguggaacaccuggaagaguuuaugauaugaucagaagaagagcucuaagaacaagaucuguaaaaauguugguuuuagaugaggcugaugaaauguuaaauaaaggauucaaagaacaaauuuaugaugucuacagauuccuucccccaucaacacaaguuguacucauuucagcuacacugccucacgaaauuuuggaaauuacuuccaaauuuaugacagauccuauuaggauuuugguaaaacgugaugaauugacauuggaggguauaaaacaguucuuuguggcuguggaaagggaagaauggaaauuugacacccucugugaccucuacgauacauuaaccauuacacaggcuguuauuuucugcaacacaaagaggaagguagacuggcugacggagaaaaugagggaaaacaauuuuacaguuaguucaaugcacggagauaugccacaaaaggaacgugacaauauuaugaaagaguuuaggucaggacagaguagg

SEQ ID NO: 3758 - RNA, 727 nt, Diabrotica virgifera
cugguagagaacaagcuuguaauuuaucugauaucaaaguuauuaagcaacuuggagguacaguagaagauaccgaauuaguagaaggaauuuguuucccucaaagaucugcaaaugucucuggaccaaaaaggauugagaaagcuaaaauugguuucauccaguucuguauuucaccuccaaaaacagauauggaccacaaugucauuguuucugauuacgcugcuauggauagaguauuaaaagaagagagagcauauauuuugaauauugucaagcagauaaagaaagcuggauguaauguacuuuugguucaaaaaucaauuuugagggaugcaguuucagaucuugccuuacacuuuuuggauaaaaucaaguguaugguuauuaaggauauugaaagagaagaugucgaauuuguauguaaaucuuuaggaugccgcccuauugcaucuuuggaucauuuuguugcugaaaacuugguuacugcugauuuaguugaagagguuggauuggcaggaaauagaauggucaaaauuacaggugcacaaaaugcaggcaggacaguaacucugcugguuagaggauccaacaaauuaguucuugaagaggcugauagaucucuucaugaugcucucuguguaauucguugucuuguucgcaagaaggcacuuauugccggaggaggagcgcccgagguugagguggcucuuaaacuagcggcuau

SEQ ID NO: 3759 - RNA, 718 nt, Diabrotica virgifera
aacacagcaaugccuuaguagauguccuaccaccagaggcagauucuucaauaagcaugcuccaggcugaugaaaaaccagauguucaauacagugacauuggagguauggauaugcagaaacaagaaauuagggaagcuguagaguuaccuuugacucacuucgaauuguauaaacagauugguauugauccccccagagguguguugauguauggaccuccuggaugcgggaagacuauguuggccaaagcuguugcucaucauacuacagcugccuuuauucguguagucggaucagaauucguacagaaauaucuuggugaagguccucgaaugguuagagacguguuccgucuagcaaaagaaaauucuccagcaaucaucuuuauugaugaaauugaugcaaucgcuaccaaacguuuugaugcccagacaggugcugaucgugaaguccagagaauuuuauuggaacugcuuaaccagauggaugguuuugaucagacaacaaauguuaagguuaucauggcaacuaacagagcugauacauuagauccugcacuucugagaccuggucgucuggacagaaaaaucgaauuuccuuuaccagauagaagacaaaagcguuugauuuucagcacuaucacaucuaaaaugaauuugucagaggaggucgacuuggaggacuauguagcuagaccagacagaauaucaggagc

SEQ ID NO: 3760 - RNA, 371 nt, Diabrotica virgifera
augcuccgucacuaucaaaacuauguuagaagacuugggaauggacgaagaagaagaagaagugguuccuuuaccaaacguaaauuccgccauacucaggaaagucauccaaugggcgacuuaccacaaagaugauccaccaccaccagaagaugacgauaacaaagaaaaaagaacagaugauauuuccucaugggacgcagacuuccuuaaagucgaccaaggaacccucuucgaguugauuuuggcugcuaacuaucuggauaucaaggggcucuuagaugucacauguaagacuguugcuaauaugaucaaagguaaagcuccugaagaaaucagaaagacuuucaacaucaagaaugacuucacgg

SEQ ID NO: 3761 - RNA, 696 nt, Diabrotica virgifera
gaaugcaagcaauuaacggaaaaucaaguuaaaacacuaugugauaaggcuaaagaaauauugucaaaagaaucaaauguacaagaagugaaaugcccaguaacaguauguggagauguccauggacaguuccacgaucugauggaacuguuuaggauaggagguaggagcccagacacuaauuaccuguucaugggagauuauguagaucguggauacuauucuguugagacugucaccuuauugguagcacugaaagucagguacaaagagagaauuacaauuuugagaggcaaccacgaaucaagacaaaucacacaaguuuacggauuuuacgaugaaugucuaaggaaauacggaaacgcgaauguauggaaauucuucaccgaucuguucgauuauuugccccuaacagcgcucgucgauagucaaauuuucugucugcacggcggauugaguccuagcaucgacaccuuggaucacauuagggcgcuugaucguuuacaagagguaccucaugaaggccccaugugcgaccuucucuggucagacccugacgaccgcgggggcuggggcaucuccccccguggagccggcuacaccuucggacaggacauuucagaaacguucaaccauaccaacggucugucuuuaguaucuagggcgcaucaacucgucauggaggguuacaauugg

SEQ ID NO: 3762 - RNA, 715 nt, Diabrotica virgifera
ugaucuucgcugguaaacaacuugaagaugguagaacucuaucugacuacaacauccagaaggaaucuacccuucauuugguccuuagauugagaggaggcaugcagaucuuugucaaaaccuugacaggcaagaccaucacccuggaaguugagccauccgauacuauugaaaaugguagaacucuaucugacuacaacauccagaaggaaucuacccuucauuugguccuuagauugagaggaggcaugcagaucuuugucaaaaccuugacaggcaagaccaucacccuggaaguugagccauccgauacuauugaaaauguuaaagcuaagauccaggauaaggaggguaucccaccagaucagcaaagauugaucuuugccgguaaacaauuggaagauggaagaacuuugucugauuauaacauccagaaagagucuacucuucauuugguacuuagauugagaggagguaugcagaucuucgucaagacacuaacuggaaagaccaucacuuuggaaguugaaccaucugauaccauugaaaacgugaaagcuaaaauccaagauaaagaagguaucccaccagaucagcaaagauugauuuuugcaggaaaacagcuagaagaugguagaaccuugucugacuauaacauccagaaagaguccacucuucacuugguacugagauugagaggagguaugcagaucuu

SEQ ID NO: 3763 - RNA, 685 nt, Diabrotica virgifera
ggauuugaaaugcaacccaagguauacaaagauuguaaaauagcucugcuaaacauugaauuggaacuuaaagcugagagggauaacgcagaaguaagaguagauaauguaaaagaauaucagaaaauuguugaugcagaauggacuaucuuguacaauaaacuucaaaaaauuuaugagucuggagcuaauguuguuuugucaaaauuacccauuggagauguugcuacccaauacuuugcugauagggauauguucugugcuggucguguucaagaagaugauaugaaacguacccugaaagcauguggaggugcuguaaugaccacuguuaaugacaucagcgauucuguacucgguaaaugugagcuguuugaagaaaaacaaauaggaggagaaagauuuaauuucuuuaaaggcugcccaaaugcaaaaacguguacuuuaauuuuacguggaggagcagaacaauuuuuagaagaaacugaaagaucacuucaugaugccaucaugauuguuagaaggacuauuaaaaaugacgcaguuguagcuggggguggugcuauagagauggaauuaucaaaaauuuuacgggaucauucucgcacaauugccggcaaagaacagcuucugauuggugcaauagcuaaggcauuagagaucauccccagacaauuaugcgaua

SEQ ID NO: 3764 - RNA, 722 nt, Diabrotica virgifera
ugggucucacuagaacguauccaauuugucggugccuguaauccuccaacugaucccggcagaaagccucuaucccaccgauucuugcgacacguucccgucauuuauguagauuaucccggagagacaucuuugaaacagaucuacgguacuuucaccagggcuauguuaagauuggcgccuggucugaaagguuaugccgaaccauugacuaaugcuaugguggaauuuuauuuggcaucucaagauagauuuacucaagauaugcaaccacauuauguuuauucuccaagagaaaugaccagauggguaagaggaauuugugaagcaauaaggccucuugauaaucuugcuguggaggguuugguaaggcuuugggcucaugaagcucuccgucucuuccaagacagauuagucgaagacacagaaagacguuggacuaacgaaaacauugaugcuguagcuuuaaaacacuucccaucagcuaacugcgagaaagcuuuggaaagacccauucuuuacagcaauugguuauccaaggauuauguaccuguuggaagggaacaacuaagagaauauguaaaggccagacugaagguguucuaugaggaagaacuugauguuccuuugguguuguucgaugagguguuggaccauguuuuaaggauugacagaauauucagacaaccucaaggucacuuacuacugaucggaguuucugg

SEQ ID NO: 3765 - RNA, 772 nt, Diabrotica virgifera
auagaaacgugccaagaacuuuuacaagauaaaguucguaggcuagggucaaaaguuaaagaauuacuuauauugccacuauaugcaaauuuacccagcgauaugcaagguaaaauuuuugaaccgacgccuccaggugcuagaaaaguuguuuuggccacaaauauagcugaaacgucuuuaacaauagacaauauuauauacguuauagauccuggguuugcgaaacaaaaucauuucaauucgagaacagggauggagaguuugaugguaguaccaauauccaaagcuucugcaaaccagagagcuggcagagcugguagaguagcagcuggaaaauguuuuaggcuauacacugcuuggucuuauaaacaugagcuagaggacaauacuauaccggaaauccagcggauaaauuuaggaaacgccguacucauguugaaggcgcuaggaauaaaugauuugguacauuuugauuuuuuggauccaccuccucaugagacuuugguguuagcauuagaacaauuauacgcuuugggggcuuuaaaucaucacggagaauugaccaaauugggcagaagaauggccgaguuaccgguggaucccaugauggccaagaugauauuagcuucggaaaaauacaaaugcucugaagaaauagucaccauaggagccauguuaucaguaaauggugccauauuuuaccgaccaaaggauaaaauaauucacgcugauacugcucgaaaaaauuucagucacuuagcaggagauc

SEQ ID NO: 3766 - RNA, 672 nt, Diabrotica virgifera
gguaaaacagcaauugcacuugcaauagcccaagaguugggaaauaaaguaccuuuuugcccgaugguaggaucugaagucuacaguucugaaauaaaaaagacugaaguucuuauggagaacuuucgaagagcaauugguuugaggauuagggaaaccaaagaaguuuaugagggggaagucagugaauugacaccaguagaaacggaaaacccugcuggagguuauggaaaaacuguaagucauguuaucauuggucuaagaacugcaaagggaaguaaacaacucaaacuggaucccgguauauaugaagcacuccagaaagagaaaguugaaguaggagacgucauuuauauugaagccacaaguggugcaguuaaaagacaaggaagaucugaugcuuaugccaccgaauuugacuuagaagcugaagaauaugugccauuaccaaaaggagauguacauaaaaagaaagaaguuauucaggacguuacauuacacgaucuagaugccgcuaaugcuaaaccucaagguggacaagacguuuugucaaugaugggccaacuucuaaaaccaaagaaaacagaaaucacagauaaacuuagaaaagaaaucaacaaaauaguagauaaauauauugaucaagguauugcagaauugguuccuggugua

SEQ ID NO: 3767 - RNA, 742 nt, Diabrotica virgifera
uuaaaugguugugagcucgauagacugcaaaaaccuuccuuacuuauuacugaugcguuuaaugcuacuuaucaacaagccagaagaagggcuagagaugaaaaacuaaugaccaauauucuucaaacucuucggaacaaugguaacguacuuauagcaguagacacggcaggcaggguucuggaguuggcucacauguuggaucagcuauggcguaacaaagaaucuggccuauuggccuacucuuuagcguuuuuaaacaacgucaguuauaacguuauagaauuugccaaaucccagauagaauggaugagugauaaguuaaugagaaguuuugaaggcgccagaaauaaucccuuucaauuuaaacacuugcaguggugucacaguuuagcagaauuaaguaaaguuccuaguccaaagguuguucuugcaaguucacccgauuuggaaaguggguucuccagagaguuguuccugcagugguguucuaauuccaauaacaguauuauauuaacaacaagaacauccccugguacuuuagcuagagacuuaauugacaacggagcagaaagaaauauagauuuaacgguagaaaggcgaguaaaacucgaaggcguagagcuugaagaauaugaaaaacgacaacgagcgcgaggucaaaauguagaaaaggaagaugcagauucggacucugauucugacauagaaaugucuguuaucaccaaagguagacaugaca

SEQ ID NO: 3768 - RNA, 738 nt, Diabrotica virgifera
aacagcccuuuauacccaaggaaacaccuucagaauuugaauuuauagcugaucccccaucaauuucagcucuagauuuagauauuguuaagcuuacagcucaguucguagcuagaaaugguagagcuuuucugacacaauugaugaauagagaacagagaaaucugcaguuugauuuuuugagaccucaacacucuuuauuucaauacuucaccaaauuacuggagcaauauacaaagguucuuauucccccaaaaaguaugcaugaaagccugcgaaacgaggcuaauaguccgaagaauguguuagagcaagucaaauaucgugcagaaugguugaaguaucaagagcaacaaaaagcuaaggaagaggagcuuuuagaacgagaaaggguugcguaugcacaaauugacuggcaugaguuuguagucgucgaaacuguugacuaccaacccuucgaaauuggaaauuuuccggcuccaacuaccccugaagaagucggagcccguauuuuaauucaagagaggauagaagaaggggaagauaucgaaaugcaauuagagagugaugaggaagaaccaccaguuauggaagcugguuuaagcagcaugcaggacaaaaccaaucggaagacacgcgacgauaccagaauucaagauauggaagaagaaagcuccgaugaagaaaaagaagaagaagaggaauuagcuuuaccuccaccaccaccaucuauucaac

SEQ ID NO: 3769 - RNA, 793 nt, Diabrotica virgifera
uuaaucgcaugggcaaaaucggcaaucaaaagcguguuguugguguucuucuuggcuguuggcgugcuaaaggagucuuagauguuucuaacaguuuugcaguuccuuuugacgaagaugacaaggauaagucugugugguucuuggaccaugauuacuuagaaaacauguauggaauguucaaaaaaguuaaugccagggaacgaguaguagguugguaccacaccggccccaaacuucaucaaaaugauauugccauuaaugaguuaaucagaagguauuguccaaauuccguucuaguuaucauagacgcuaaaccaaaagauuuagguuuaccaacugaagcuuaucaagcuguagaagaaguacacgaugacgguucaccuacaucuaaaacauuugagcauguuccuagugaaaucggagcugaggaagcugaagaaguugguguugaacacuuauugagagauauuaaagacacaacuguugguacuuugucacagagaauaacgaaucagcuuuuaggguuaaaaggucuccauucacaguuacgugauauuagggacuauuugguacaagugugugguaaccagcuuccaaucaaucaccaaaucaucuaccaauuacaagacauauuuaaucuuuugcccgauauaaaucaggaugcauuuaauacaucguuuuacgugaaaaauaacgaucaaauguuagucguuuaucuagcagcuuuaguuagaucuauugucgcucuacacaaucuuauuaacaacaaacuaacaaauagagacgcgga

SEQ ID NO: 3770 - RNA, 742 nt, Diabrotica virgifera
cgacaaucauaauucgccaguacagacaagcacucgaagauaugauucaguuauuggaagguccauuaaguauaccagucgauagaaacgauaaaaaugcucuugcccaagucgugaaaggcugcauuggcacaaaauucauaaguaaauggucagauuuggcaguaaauauugcuuuagaugcaguaaauacaguauuauuagaagaaaauggcagaacugaaguugauaucaagagguaugccaaagucgagaagauuccuggaggauccauugaagaaucuaaaauuuuaagagguguuaugcuuaauaaagauguaacccaucccaaaaugaaaagauauauacagaauccgagaauaauacuuuuggauugugcauuagaauauaaaaaaggggaaucucaaacaaacguagaaauuucagcagaaacagacuucaccaaacuauuagaacuggaagaggagcaugucaagcgucaaugugaugagauuauugcacucaaaccugacgucgucuucacagaaaaaggaguaucagauuuggcccaacacuuuuuacugaaagcugguauuaccgcuaucaggcguguucgaaaaucugauaauaacagaauugccagagccuguggagccacgauuguuaaccgaacagaagaauuacaagaaagcgauguuggcuuaggagcuggacucuucgaaaucaagaaaauuggugaugaguauuucugcuuuguggucga

SEQ ID NO: 3771 - RNA, 566 nt, Diabrotica virgifera
augcaacgucaaauuaaccccuaugcagauaauggagggaguguaguagcaauagcaggugaagacuuuguaauaauuggugcagauacacguuugaguacuggauuuuccauuuauaccagagaacaaaacaaacuuuucccacuaucaggcacuacuguuuuggguugugcaggauguuggugugacacucuaacauuaaccagaauccuuaaaucucgcaugcagauguaccaacaagagcauaacaaaacaaugucuacaacugcaugugcccagauguugucaaccaugcucuacuacaagagauucuuuccuuauuauauaucaaacauucuaguagguuuagauaaugaaggaaagggcuguguuuacagcuaugauccuauuggacauugugaaaaagcuacguauagagcaggugguucagcuggagcucuucuucagccucuguuggacaaucaaauuggacagaagaacaugcuuaaaacaucuggggaaccucuuagucaggagaaagcuuugucuacccuuaaagauguauuuauuucugcugcugaaagaga

SEQ ID NO: 3772 - RNA, 691 nt, Diabrotica virgifera
gcuacucaguggcuauguuuccuggcaaugaacgagaagacguugaaagggguggaaaaauuauuaugcccccaucagcuuuggaacaauugacuagguuaaauauaaacuaucccauguuguuuaaacuugugaauaaaaagacacaucgcacaacucauuguggaguuuuagaauuuguugcugaugaaggaaaaguuuauuugccacuuuggaugaugaacaacuuaguacugacugaaggagauuugguucaaauggaaaguguuucccuuccaguuggcacauuuucaaaauuccaaccucuuaauccagacuucuuggacauuacuaauccuaaagcagucuuagaaaaugguuugagaucuuuugccugccuuacaacaggagaugucauugcaguaaaguacaaucaaaaggcuuaugaguuguguguucuagaaaccaaacccggagaugccauuaguaucauugaaugugacaugaauguggaauuugcugcuccuguuggauacaaagaacccgaacaagucaaaaaggaagaagaagaaauggcuauagauccugcagauuuaaugccagaaccuucuggauuuguagcauucagaggugcaggaaaucgacuugauggcaaaaagcguaaagauacuucaggaacugauaguucaguggccaaaccaacuuaugucag

SEQ ID NO: 3773 - RNA, 726 nt, Diabrotica virgifera
accacagguguuguaguuuuggcuggugcccuguuagagcaagcaggaucuuuauuagacagagguauucaucccauaaggauugcugaugguuuugagcuagcuugucaaacagcuguagcucauuuggaaaaaauugcagaacuauuuccaguaucagcagaaaacacugaaccauuaauaaaaguugcaaugaccacucugggaucuaaaaucauuaacaagugucauaaacagauggcagaaauagcuguuaaugcagucuuagcuguugcagauuuagaacagaaagauguuaauuuugaacuuauuaaaguugaaggcaagguugguggaaaauuggaagacacaacauuaguuaaagguguaguuauugacaaaacaaugucccauccacaaaugcccaaagaacuaaaagauguaaaauuggcuauucucaccugcccguucgaaccaccaaaaccaaagaccaaacauaaguuggaugucagcaguguggaagauuauaaggaacuaagacaguaugaacaagaaaaguucaaagaaaucguugguuugguaaagaaagcuggagcuacauuagcaauuugucaauggggcuucgaugaugaagccaaucacuuauuguuacaacaagaauuaccagcuguaagauggguuggagguccagaaauugaacuuauagcaauagcuacuggggguaggauaguuccccguuuugaagag

SEQ ID NO: 3774 - RNA, 198 nt, Diabrotica virgifera
aggagaaaagaaacguuuugaaguaaaaaaguggaaugcuguagcuuugugggccugggacauuguuguggauaacugugccauuugccgaaaucauauuauggaucuauguauugaaugccaggcaaaccaggcgucagccaccagugaagaauguacuguagcuugggguguuuguaaucaugccuuucacuucca

SEQ ID NO: 3775 - RNA, 774 nt, Diabrotica virgifera
gauagccaacacuccuauggacacagauaaaaucaaaguauuugguucucacauuaagguagauucaauggcuaaaauugcagagcuggaaucugcagaaaaggaaaaaaugaaagauaaagugaacaaaauucuuaaacauaaugcuaauguauuuauuaauagacaguugauuuacaauuauccugaacaauuguuugcugaugcaggaguuauggcuauugaacaugcagauuuugauggaauugaaaggcuagcacuugucacaggaggagagauugucucaacauuugaccauccagaauugguaaaacuuggaacuuguaagcuuauugaacaaaucaugauuggagaagauauccugcuccguuucagugguguugcucuuggggaagcuugcacaauuguuaucagaggugcuacacaacagaucauugaugaagcugaccguucccuucaugaugcuuuguguguauuagcagccacagucaaagagagucgaauuguguauggaggagguugcagugaaacccuaauguccacagcgguaucaagagcugcugcuaacacuccaggaaaagaagcuguagcaauggaagcguuugccagagcuuuguugcaguugcccacaauuauugcagacaaugcagguuacgacucugcccaauuggucagugagcuuaaggcagcacauaacaguggccagagcaccaugggacuuaacauggaaaagggugaauugggggauaugaaaaccuugggaaucacagaauc

SEQ ID NO: 3776 - RNA, 728 nt, Diabrotica virgifera
gcaucagguagaauaugccauggaagcaguuaaccuagguucagccacagugggacugaaaaguaaaacucaugcuguacuuaucgcuuugaagagggcuucuucagaacugucugccuaccagaagaaaauuaucaacauagacgaucacauugguaucaccaucucgggacuuacagcugaugcuaggauccuuaguagauauaugcgaaacgaaugcuugaauuauaaguacucuuuggauacuuauaugccauugaauaggcuuaucaguauuuuagguaacaaaaugcagacauguacccaaagauacgaccgcagaccauucgguguaggucuucuaguagcugguuaugacgaaucugguucucauaucuaccaaacgugcccuucugcuaauuucuacgauugcaaagcuauguccauuggagcucgaucccagagugccaggacauacuuagaaaaacaucuggaugaauugccaucuaguucuuuagaagaacuuaucaaacauggauugagggcucuuagagauacucuaccuccagagguugaccucacaacuaaaaaugucuccauaggcuacacuggaaaaggccagaccuucaaaauccuugaagaagaagaaacuucccccuacuugucccuuauugagggugaagaacguagaggaggaggagcugcagcugcugcaauugaggaccuuccugcagauccauugagagaug

SEQ ID NO: 3777 - RNA, 687 nt, Diabrotica virgifera
ucaaaguagacgauuuggcaacaguguggugugaaugggccgaaauggaaauaaggaacgagaauuaugaugaagcuuuaagacucaugcauaaagcaacuguuaugccuagucgaaaaguagcauaucaugaugacacugaaacaguucaaagucgacuauauaagucucucaaaguuugguccauguacgcagauuuagaagaaaguuucggcaccuuuaaauccuguaaagcuauuuacgacaaaauaauagauuugaaaauugcaacaccucaaauuauuauaaacuaugggauauuucuagaagaaaauaauuauuuugaagaggcauucagagcguaugaaaaaggaauaucucuauuuaaauggcccaauguauacgacauauggaacaccuauuugacgaaauuccugacucguuaugggggaucaaaacuagaacgugccagagaucuguucgaacaaugcuuggauggaugcccacaacaguuugccaaacaucuuuaccugcucuacgcgaaacuagaagaagaacauggaauggcuagacacgcuauggcuguauaugaaagaucaaccaaagcuguuccagagcaagaaauguucgacguuuuuaauauauauaucaaacgagccgccgaaaucuaugggauucccaaaacgaggcagaucuacgaaaaggcua

SEQ ID NO: 3778 - RNA, 664 nt, Diabrotica virgifera
ccuuauugugggagcucuuuguacaagcagggccuuuagucaauguacauaugccaaaagaucgaguaacgaccaugcaccagggcuauggguuuguagaauuuaugggagaggaggaugcagauuaugcuauuaaaauuaugaauaugauaaaauuguaugggaagccuauaagaguaaacaaagcuucggcucaucagaaaaacuuagacguaggagcuaacauuuuuauuggaaauuuagacccagaaguagacgaaaaauuacucuaugauacuuuuuccgcauuuggaguaauauuacaaacaccuaagauuaugagagauccugauacuggcaacuccaaaggguucgcuuucaucaauuuugcaagcuucgaagcaucagaugccuccaucgaagccaugaauggccaauauuugugcaauagacccauaucagugucuuaugcuuucaagaaagacucaaaaggagagagacauggaucugcagcugaacgucuucuugcugcucagaauccauuaucacaggcugauaggccucaucaacuguuugcugaugcaccuccaauagguuugaugcccauguccauggccccaccuccuccaccagucauaaugacaggaaugaugcccccaccgccuccaacacuaucaaacuugcc

SEQ ID NO: 3779 - RNA, 643 nt, Diabrotica virgifera
agcacccaaacuacguuauuuagauuucucagaaagacaugguuacauuaaggguguuguaaaagauaucauacaugacccuggccguggugcuccauuggcaguaguacauuucagagaucccuacaaguuccaaacuaggaaggaauuguuuauugcccccgaaggaauguacacuggacaauuuuuguacuguggaaagaaagcuaaccuucaaauuggaaauguauugccuguaggaacuaugccugaagguaccauuguaugcaacuuagaagaaaaaacuggugaccguggucggcuagcucgugcaucuggaaacuaugcuaccguaauugcccauaaucacgacacaaagaaaaccagaguuaaguuaccuucuggagccaagaaaguuauuccaucaaacaacagggccaugguggguaucguugcuggagguggucguauugacaaaccaaucuugaaagcaggucgugcuuaccacaaauacaaaguuaaacguaacugcuggccuaagguacgugguguugcuaugaacccuguugaacauccucacggaggugguaaccaucaacacauugguaaagcauccacaguuaagagaggaacaucugcuggucguaaagucggucuuaucgcu

SEQ ID NO: 3780 - RNA, 295 nt, Diabrotica virgifera
aaacaguuggcaacuaaagcugcucgcaagagugcaccugcuacuggaggagucaaaaaaccucaucguuacaggccagguaccguagcccuucgugaaauuagacguuaccagaaaaguacugagcuacuuaucagaaaacuaccuuuccaacgucuuguccgugaaauagcucaagauuuuaagacagacuuacguuuucagaguucggcaguuauggcuuuacaggaagcgagugaagcauauuugguagguuuauucgaagauaccaacuuaugcgcuauucaugcuaaga

SEQ ID NO: 3781 - RNA, 669 nt, Diabrotica virgifera
cguuggaaguacuggagaaaaugaagauuucaauugaagcgaacaaagaaacuuuaacagauauuugcaggacgaguuuaagaacaaagcugcaucaaaaacuggcugauguuuugacagacguuuguguggaugccguucuagcuauaaagaaagaugacaaaccuguugaucuucauaugguugaauuaauggaaaugcagcacaaaacagaaacagauacucaguuaauuaaggguuuaguccuggaccauggcucccgucauccagauaugccuaaaagucucaacaacugcuacauuuuaacauguaaugucagcauggaauaugaaaaaagugaagucaauucaggauucuucuacaaaacugcagaagagagagaaaaauuagugacugcagagcgugaauucauugagcagagaguuaagaaagucauugaacugaaaaggucacucuguaauggaacugauaagacuuuuguuguuauuaaccaaaaagguauugaccccaugagccuggauaugcuugccaaagaaggaauaauagcucucagaagagcuaagagacguaacauggagcgucuaucauuggcuugugguggaguagcuaugaacagcuuugaugaucugcaagaaucucaacuugguagagccggacauguauaugaac

SEQ ID NO: 3782 - RNA, 710 nt, Diabrotica virgifera
agcccaagaaguaaugaaggcauguucuggaaaauuccaucccauuuuccaaugguucuacuaugaugccauagaaugccuaccacaagauaaaucagaaaucacugaagaacuagcugcacccacugguagcagauaugauggccaaguugcuguuuuuggaaaagaauuccaaaagaaguuagcaucacugaaauauuuuauuguuggugcuggagcuauugguugugaauuguugaagaacuuugcuaugauggguguaggaacacaaggagaaguuacaguaacugauauggauuuaauugaaaaaucuaauuugaacaggcaguuccuuuucagaccacauaacguccaacaaccaaaaucugccacagcugcaaaggucauuaaaaagaugaauccugauaucaauguuguugcacaugaaaaucguguuggacccgaaacugaaagugucuacaaugacgauuucuuugaaaagcuugauggaguugcuaaugcacuggauaauguagaugcuagaauuuauauggauagaagaugugucuacuaccgcaagccucuucuagagucuggaacccuaggaacuaagggaaauacucaagugguggcaccuuuccucucugaaucauacaguucuucucaagauccuccagagaaaagcauuccaaucuguacuuuaaagaauuuccccaaugcuaucgaacaua

SEQ ID NO: 3783 - RNA, 641 nt, Diabrotica virgifera
agguacagaaaaagggugucaagggcacauauguaucaauacacaguucuggguuuagagauuuucuguuaaaaccagcaauucucagagcuauaguggacugcggguucgaacauccuucagaaguucaacaugaauguauuccucaagcugucauuggcauggauauucugugccaagcuaaauccgguaugggaaaaacggcuguuuuuguauuagcuacacuccaaguaauagauccuacagaaaauguuguauauguucucgucaugugccauaccagagaguuagccuuccagauaagcaaagaguacgaacguuucaguaaauauaugcccaauauuaaaguaggggucuucuuugguggcuugccuauccagaaagaugaggaaacguuaaaaaauaauugcccgcauaucguuguggguacuccaggaagaauuuuagcauuggucagaucgaaaaaacuuaaucucaaacaucuaaagcauuuuauuuuggaugaaugugauaaaauguuggaguuauuagacaugagacgugauguucaagaaauauaucguaacacuccccacgaaaaacaagucaugauguucagugccaccuuaaguaaagaaauuagaccaguuugcaagaaauuu

SEQ ID NO: 3784 - RNA, 657 nt, Diabrotica virgifera
guugcugaauugaccaacaaauuggauucaauuagaggguuuuuacauucucgucuacguaccgcuacacucaggaacgacuuugaaggucaagcugugcuuauaaauugccuguugagaaauuauuugcauuauucguuguaugaucaagcugacaaacuagugaguaaaugcguauuuccugaaacugcaaguaacaaugaaugggccagauucuuauacuacuugggcagaauuaaggcggcaagauuagaauacaguguagcacauaaacaucuugugcaggccaugagaaaagcaccccagaaugcugccauugguuucagacagguuguucaaaagcuuacuguuguaguugaacuacugcuaggagauauaccagaacgacagauuuuuagacaaucuaguaugaggcacucccuugccccauacuuucaacuaacacaagcaguuagaaugggcaauuugcaaagauuuggugagguguuagagaacuucggcccacaauuuagacaagaucauacauuuacacuaauuuugagacugcgccacaauguuauuaaaacagcuauaagauccauaggauuaucauacuccagaauaucuccccaagacauagcuaagaaacuggggcuggauucagcugaagaugcagaa

SEQ ID NO: 3785 - RNA, 668 nt, Diabrotica virgifera
gaguacucaaacaucgacgaaugguacaagcgggguguugacacuucaaaaauaguuacuaaauaucguaaaggugcaugugaaaauuguggagcuaugacucauaaaaagaaagauuguauggaaagaccucgcaaaguuggagccaaauuuuccggggcaaauauugcaccagaugaauuugcccagaaaaacuuagcguugagcuuugauggaaaaagagaucgauggaguggauaugacccaucugagcacaaagcaguaauagaagaguuccagaaaguugaggaagcuaaaagacaacugaaggcugauaaguuaaaugcaaacgaaucuucugacgaugaagaaaaagaugaggacaaauauguagaugaaguugauaugccugguacuaaaguagacagcaaacagagaauuacuguaagaaauuugaggauaagagaagacacugcaaaauacuugaggaaucuugauuuagguucugcuuauuaugaucccaagacaagaucuaugagggaaaacccuaauccugaaaaagaugcuacguacaguggagagaauuucguucguuuuacaggcgauaccaccaaucaugcgaaggcucaguuauuugcuugggaagcguaugaaaaggguguggauguucaucuuuuagccgaaccaac

SEQ ID NO: 3786 - RNA, 499 nt, Diabrotica virgifera
ucuccguaagaagaggaaguucgaauuaggacguccagccgcaaauaccaaacuuggagcacguagaauucacuauguccguacacgaggagguaacuugaaguaccgugcauugaggauugaaaaaggaaauuucgcauggggcagcgaagguacugcucguaaaacacguauuauugaugucguuuacaaugccaguaauaacgaauugguacguaccaaaacauugguaaagaaugccaucguuguuauugacgcaaccccuuucagacaaugguacgaaagccacuauauuuuaccuuuaggacgcaagaagggggcaaaauugacagcggaagaugaagaaauguucaauaagaaacguagcaaaaaaguacagaaaaaauaugaaacuaggcaaaaaacagcuaaaguagaaccugcauuagaagaacaauucucaacuggaagguuauuagcuugcuuagcgucaaggccaggacaaugugguagagcugau

SEQ ID NO: 3787 - RNA, 735 nt, Diabrotica virgifera
ggauacugccgaacaaguauacauauccuccuuagcacuauuaaaaauguugaagcacggccgagcuggaguacccauggaaguaaugggucuuauguuaggagaauucguagaugacuauaccguucguguaaucgauguauuugcuaugccucagacugguaccggugucaguguagaagcuguugauccaguguuucaagcaaaaaugcuugacauguuaagacagacugguaggccagaaaugguuguggggugguaucauucccauccagguuucggauguugguugucuggaguggauaucaacacccagcaaaguuuugaggcucucucggaaagagcuguagcaguaguaguugauccaauccagucagugaaaggcaaagucguuauugaugccuuuagguuaauaaauccgaauaugaugguauugggccaagaaccucgccaaacuacauccaacuuaggacaucuacagaaaccaucaguccaggcuuugauucauggucuaaaucggcauuacuacuccaucaguauuaauuacagaaagaaugaauuggaacaaaaaaugcuacuaaaucuccauaaaaaauccuggauggauggucuaacuuuagcagauuacucugaaaauuguagugugaaugaaaagacuguagcugauauguuagaacuagccaagaauuacaacaaggcauuagaagaggaggagaaaaugacuccagaacagcu

SEQ ID NO: 3788 - RNA, 783 nt, Diabrotica virgifera
gcaagcucagagaaaugaacucaaugccaaaguucguauguugagagaagaacugauguuacuucaagagcaaggaagcuaugucggagaaguuguaaagcccauggauaagaaaaaaguccuugugaaaguucauccagaaggaaaauuuguaguugacauugacaaaaacauagacauaaaugauguuacuccaaauugucgaguagcccucagaaaugaaucuuacacauugcacaaaauacuuccaaacaagguugauccuuuaguuuccuugaugaugguggagaaagucccugauucaacuuaugaaaugguaggaggacuugacaagcaaauuaaagaaaucaaagaaguaauugaacuuccaguuaaacauccagaacuuuuugaugcucuugguauugcacaaccuaaggguguguuguuauauggaccaccaggcacuggaaaaacucuucuggcacgugcuguagcucaucacacagaguguacauuuauuagaguaucugguucagaauugguacagaaauucauaggagaaggaucccguaugguaagagaacucuucguaauggccagagaacaugcuccuucaauuauuuucauggaugaaauugauuccauuggaucuucccguauugaaucaggaucugguggugauucugaaguccaaagaaccauguuggaacuucuaaaucaauuggaugguuuugaagcuaccaaaaacaucaaaguaauuauggcuaccaacagaauugauauuuuggaucccgcuuuacu

SEQ ID NO: 3789 - RNA, 472 nt, Diabrotica virgifera
ccuucgaacuucaaagcuucagcuuuuuccaaagagggucaauucaggaguucaugucauucuuuugcaaaaccauaguggaaagaacaauaccagccucaaggcagaguguuaaagaaggagaauauuugugucauguauauguacgagcugauaacuuagcugguguuaucauaacugaucaugaauacccaucaaggguuucucacacacuaauaacaaaaauacuagacgaauuuggugccaaaauuccugcagcuaacuggcccagccuugaggagagagauguaccauuuccacaauuaaauaccuacuuagcgaaauaucaaaauccuagagaagcagaugcuauuacaaaaauucaagaagaucuugaugaaacgaagauuauuuugcauaauaccauacaagcaguuuuggaacgaggcgagaaacuagacgacuuagugagcaagucggaagguuuaagcau

SEQ ID NO: 3790 - RNA, 581 nt, Diabrotica virgifera
aggaucuaccgcuauuggaauaugcaccagugguggaguagugcuugcuguagaaaaacgcauuacuuccccauuaauggaaccuacuacgauugagaaaauuguagaaguugacaaacauauuggaugugcgguuucaggacuuauggcagauucaaggacuaugauagauagagcucguguggaaugucagaaucauugguuugucuacaaugaaaauauaaguguagaauccugugcacaagguguaucaaauuuggcuauucaguucggagauucugaugaagauggugcagccaugucuagaccuuuuggaguagcaauuuuguuugcugguauagaugaaaaaggaccucaguuguaccauauggauccaucaggaacauuuguucaguuugacgcaaaggcgauaggaucaggauccgagggugcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacuccaaaagauauguucc

SEQ ID NO: 3791 - RNA, 725 nt, Diabrotica virgifera
aaugacggagcuaccauuuuacgucuuuuagaaguugaacauccugccgccagaguauuaguagaauuggcucaguuacaggaugaagaaguaggagaugguacaacuucaguuguuaucauagcugcagaauuacuaaagaaugcugaugaacucgugaaacaaaagauacauccaacuucaauuauaaguggauacagauuagcaugcaaagaggcuuguagguacauucaggaucauuugacuauuccagucgaagaauugggaaaggagugcaucauaaauguugccaaaaccucgaugagcucaaaaauuauuggagcugaugcugaucuuuuuucacaaaucguugucgaugccgccaaugcuguuaaagugacagauucaagaggaaauagcauguaucccauaaaggcugucaaugucuugaaagcacaugguaaaagcgccagagagagcuuccuuguaccagguuaugcauuaaacugcaccguugccagccaagcgaugcccaaaaaaauuguuaacgccaaaaucgcauguuuagauuuuucauugcagaaggcuaaaaugaagauggguguucagguuuugauuacugauccaaaucaacuggaagcaauccgcacaagagagcucgacaucaccaaagaacgcauccagaaaauccucucuaccgguguuaauguuauucuugcgaguggugguaucgaugaucuuugccu

SEQ ID NO: 3792 - RNA, 606 nt, Diabrotica virgifera
uuuuacaauuuucccggcaaacagaccagcuauuccaacccuauaacacauacacagucucccguuacaacaucaacuucuguauuagcuauuacuuacgauaaaggaguauugauagccggagaucugguugcuucauacggaucuuuagcuagguacagaaauugcccgaggguuauuaaagucaaucagaauaucaucuugggagccggaggagacuaugcugauuuccaauacgucaagaguuucauugagcaaaaaauaauugaugaagaaugcauugaugauggacuaaaaaugaaaccaaaaucauuguacugcuggcuuacuagaguaauguaccaacgcaggaguaaauuagacccuuuuuggaauaaucugguuauaggaggaauccaggauggaguccccuuucuuggaaccguagauaaauugggaacugcauauacagacaaaguuauauguacagguuauggagcccacauagccuugccucuucugagagacucuuuagauaaaaauggagcucuuaacuuggccgaugccaaaacucugauucacaaaugcauggaaguauuguucuauagagaugccagaaguuuuccu

SEQ ID NO: 3793 - RNA, 790 nt, Diabrotica virgifera
aucccuuucggaagagacuagcaauaauuugaagaaaaacguguaugaaaacuauguucaauuuauugagacugccaaagaaauaucucauuuggaaagugaaauguaccaguugucccauuuacuaucagaacaaaaaucauuauuaagugcucugucaacaacaucuauuuuagaagacacucaacacuugaauauugaaagagagaauaagaguaaugacaaggacauagaagaggaaaauaagcaaaaacuugcagccauuuuagaaaaaguggaaggaugcaaggaauugcuagaaguaccgggaagaaaauuucuauaugaaggagauuuguuagaaauugauccaacagaaaauacgucuuugaaaacuguucauguguauuuauuuacagauggauuuaugauaacaaauagaaauuccaauagucgagguuugaugaaguacauuuaugaaauaauguacgauuuaaguagucuagcagugguuaacgucagagauuuaggaaauguuaagcaugcauuuaaauuguuaauuuuuccggacacgagaguuuuucaauguucuucuaauuccaacaagaaagagugguuggacaaguuugaccaagcaaagaagacuagauuagcccaagagcaacauaagagggagucaauuucggaaaaaucacccucacgaucagcuucgauagagucuccuaguuauaacccuuuugacgaaguugaagacgauguaggaaccguucagccagaaugguuuuuggacauuccagaggaacuugaugug

SEQ ID NO: 3794 - RNA, 667 nt, Diabrotica virgifera
agaucgagagacaggagaaacagaucuaaggaucgaaaauacaaaaauuauucuagagauaaagauaggagagaaagaagcaauucuagggauauaaaacgggauagaaguacugagaagaaguucaaaagugaaaaagauaauccagaguuugaagaugauccuaccccaggaaaaauauauaauggaaaaguaucaaauauuguaccuuuuggaugcuuuguccagcuggagggacuuaaaaggagaugggaaggcuugguucauauuucacagcuuagagcagaaggcagaguuacuaauguaucugaaguaacaucuagaggagcuagaguaaaggucaaaguauugacgguaacaggucagaaggugucauuaucuaugaaagaugucugucagauuacugguaaagaccuuaacccacauucccaugcuccgacugaaagagaagauagagauagaaauccugacaggccuguaaacagcaguacgucuguauugagacugccaguaaacauagaugaaggagaagaagacucccggaaacgaguaacaaggauuucaagucccgagagaugggaaauaaaacagaugauuucaucaggauguauugcuaaaagugaguugccugauuuugaugaagaaacuggauuguuacccaaggaug

SEQ ID NO: 3795 - RNA, 698 nt, Diabrotica virgifera
uucucuuuugguagcuggacaagaaagugagugucaauuguacaaacugaauccuaaacuagucgaggaaguggaaaauaucgguaauaauacucaucucaggcaacggaauacaaaaaacaaagaaguuacagaugacaacaaaaacgugacaaaagaguuauauuuugauguuaaugcaauagaaaauguucaaacugacuuuaaugggagugaaccauuaucgagggugguaaaaauuaaucaugaugguacauuauuagcuacaggugguacagauggagauguacgaauauggaaguuuccuaguaugcaaccucuauuuauucuuaaggcacauacaaaagaaauagacgauauagauuuuaguagguuugacaauuaugugauuaccauagccaaagaugguuuagcaguauugugggauuguaugacaggaaaagaaagaacaaaacuaacauggaagcagccaggaucaaaauauuuauauaaacgguguagauuuggcguaauagaaggacuagacaagaaaugugcacuauauacaauauccaauccaauaggaguagcuaaaaaacaaaaauccuaucuccagcaauggauaccugaggaaaacaucuuaagaagguguauagaauuugaugaaaguuuggcagcuuuagcuguucgugaugaugguagauuuguugcgguuggua

SEQ ID NO: 3796 - RNA, 664 nt, Diabrotica virgifera
ucgaaguacaacucugcaaagaauguauagaaugggcaaaggaagagagaagaacuuuucuacgucagucccuugaagccaggcugauugcucuuuauuuugacacuggaauguacagcgaagcgcuacaacuggaaucgaccuuacugaaagaguuaaaaaaguuggaugacaaaaauuuguugguggaaguacaacuacuugaaagcaaaacauaucaugcuuuaaguaauuuaccgaaggcuagagcugcacuaacuucagcacgaaccacagcuaacgcuaucuauugcccuccaaagaugcaggcagcuuuagauuuacaauccggaguauuacacgcugcagaugagaaggauuucaaaacagcuuauucuuauuuuuaugaagcuuuugaagguuuugauaguguugaauccccaaaagcccucacagcccuuaaauacaugcuuuugucaaaaaucaugauaaacaguccggaagacguccaacaaaucguuagugguaaauuggccuuuaaauacgcuggucaagauauagaggcuaugaaaucaguugcacaggcugcacacaaaagaucacuagcagauuuccaacaagcuguaaaacaguuuaaacaugaauuagaagaugauguuauuguuagagcacauuuaggaacguu

SEQ ID NO: 3797 - RNA, 793 nt, Diabrotica virgifera
uggcagaaaaauaugaggcuaagcuucaagaggcucuacaagaacucagagaucaauaugaaagucaaauggccaacaaccguggcgaaaucgaguugcuuuacgaacagaagauuaagaacuugcaaucagcuaaugacagacaugcugccucugccuccggugcucuugacgaauugagacaaguuagaaccagaaucgauacuuugaauucucgaauuagcgauuuagagaaccagaacgcuggcuuagcagcucgugcuagagauuuggagaaguuguuagagaaugagcgcaugcgccauguggaagaccucgcaauguuagaaagagaauugcauagacuccgagaagaaauggcuaaucaacuucaagaauaccaggaucuuauggacauuaagguuucucuugauuuagagauagcugcuuaucggaaacugcucgaaucugaagaagcucgucuuaauauuaccccaacagguagugaaguucaugaaguaacucacaguaggagccaacgcagcucgucgcaacgucgcacuccagucagauugggagccaaaagaaagcgaacacuacucgaagaaagccaagagucaagcaugaaugacuauacggugaacagcuccucaaaaggugacauugaagucgcugaugucgauccagaaggacacuauguuaaguugcacaauaaaaguaaucaagaagucgcacuuggaggauggcaagucauuagacguguuggugaggaggaaacuacauucaaauuucacaggucacuaaagcuugaagg

SEQ ID NO: 3798 - RNA, 764 nt, Diabrotica virgifera
aagaagaagcucuuaacgcaguuggauacgacgacaucggagguuguagaaaacagcucgcucaaaucaaagaaaugguagaguuaccacugagacauccuagucuuuucaaggcuauuggaguuaaaccaccaagagguaucuuacuuuacgguccaccggguacugguaagacacucauugcacgugcaguagcuaacgaaacuggagcguucuucuucuugauuaacgguccugagauuaugagcaaauuggccggugaauccgaaagcaaucuucguaaagcuuucgaggaagccgacaagaauuccccagcuauuauuuucauugaugaauuggaugccaucgcucccaagagagagaaaacacacggagagguggaacgccguauaguaucccaacuucuaacuuugauggacgguaugaagaagaguucccacguuaucguuauggccgcuacuaacagaccaaacucaaucgauccagcuuuacguagauucggaagauucgacagggaaaucgauaucggaauaccugaugcaacuggcagacuugaaguuuuacguauucacaccaagaacaugaaauuggccgaugaugucgacuuagaacagaucgcugcagaaacucauggucacguaggugccgauuuagcuucacuauguucggaagcagcccuucaacaaaucagagaaaaaauggaccucaucgaccucgaagacgaccaaauugacgcagaaguccuaaacucacuggcaguuacc

SEQ ID NO: 3799 - RNA, 650 nt, Diabrotica virgifera
aguucccagucuaugugaagaucuauuaucaucuguggaucagccuuuaaaaaucgcaaaagauaaagaaacuggaaaagauuaucuucuuugugacuauaauagagauggagauuccuacaggucaccaugguccaauacauacuacccgccccuagaagaugguucaaugccaucugaaaaguuaagaaaacuagaacuagacgccaaucuugcauuugaucaauacagggaaauguauuuugaaggagguguaucuucuguuuauuuuugggacuuagaccauggauuugcaggagucauucuaauuaaaaagacuggagaugguaguaaaaagauuaaaggguguugggauuccuuacaugucguagaaguacaagagaagaguucgggaagaaacucccauuauaaaaugacuucaacugcuauguuauggcuucaaacuaauaaacagggaucuggaacuaugaacuuggguggaagucugacucggcagaucgaacaagaugcagcuguaaacgauaucaacccucacauagccaacauuggaagaaugguagaagauauggaaaacaaaauucgcaauacauugaacgaaauuuacuucagcaaaacgaaggacaucgucaacagucugcgaucaguucaac

SEQ ID NO: 3800 - RNA, 654 nt, Diabrotica virgifera
ugccaaaucagaaacgaguacauccgguuccaguucggauucuucuagcgacacggaagauucggaggaagaaaggcgaaacaaacaacugaagcugcuagaaaaagaguugacggcaaugcaagaaaaaaugcguaaauugguagacgagagcucgaaaaagaaaaaagaaaagaaaaaggacaaagugaaaaagaaaccgacaucaggugggucucuggcgaacgccucacuaucaacucuaccgaacagcagcagcgcgggcuuggguaagccgggugccgguggucacggggcucuaaacaagucaaacaacaacaacucaauagcggcggacagcguugacgacagcaucgccaguguugugucgggggccgaucuaaagauggccgagucgcaccauccgcaaacuggaacaggcgcucaccauccgccggcaggcaaaucccugaacaugcaucacaacaugacggcuaacgcuggcgccaacgcuuccgcgcaggcuaaaacaccuaaaaguaaaggacuccgcggcaauaaacccgcugcagcuaccaacgcggcucccaacaagagggucaaagccaacaacaaagcuggugcggguaggaagaagaacgcagcacaaccaccaccuaugcaguucgauucuga

SEQ ID NO: 3801 - RNA, 704 nt, Diabrotica virgifera
augagcaaaggacaugucaucgaccaaaucccugaauugccauugguugucagugacaagguacaagaaaugagcaaaacuaaacaggcuguccaguucuugaggagaaucaaggcaugggcugacauucaaaagguuuacaagagucaacguuuccgugcugguaagggaaaaaugcguaauaggagacgcauccaacguaaaggaccauugguuguuuacuacaaagaucaaggucuucgucgugcuuuccguaacaucccaggcauugaccucauuagcguacagaaguuaaauuuguugaaacuugcuccugguggucauguaggucgcuuuguuauuuggacugaaucagcuuuccaacguuuagauaaauuguucggcacauggaaaacagcaucauuggaaaagaaggguuacaaucuaccccagccuaaaauggccaacacugaucuaucuagauuguugaaggcugaugaaaucaaagcuguauuacgugcuccucaaaagaagguuguacgucguguacgucgucucaauccauugaccaacgcuaaggccaugcuuaaguugaauccauaugcugcuguacucaaacgugaagccauuuugaagaaucaaaagagacaguuaaacagggaagaacuuuuggccaagaaacgugguauuaccgugagugccgacaacgucgugauuagauccag

SEQ ID NO: 3802 - RNA, 738 nt, Diabrotica virgifera
ggcguuccauaacauauccuaugccgaagccgaaaaauguaugguuaauauggaccagggugaaguuaucauuaggccuucgaguaagggugcggaucauuugaccauuacuuggaagguuacggauggaaucuaucaacacauugauauuaaggaacaagggaaaguuaacgcuuuuucuuuaggaaaaucauuauggauuggaaaugaagaauuugaagaucuugaugaaauaauagcuaggcacguuacaccaauggcggcgcaugcuagagauuuacuguauuuuagguauuacaaagauuuccaagguggucauaaagauaaggcugaggaauaucuaaaagaugaaaaaaagaaaaaugcuucuaaaauucauuauguaguuagugcugcuaagaauauaccugguaaauuucuucuuucguaccuuccacgcaacaaaguuagacacgaauauguaacaguuacuccagaaggcuuucgguuuagacaacaaauguuugauuccguuucuucguuauuuaaaugguucaaagaacauuuccgggagccuccaccaggcggugcaacaccagguagcacgccaaggauggcuucaagcagaacuggauauggaagugccacacccgcguauaguaugaauaaugaagcuauucaaagaguugcucaaaauuuaccaagucauguaguucaagcguuaucugcugccaccaaccaaacuccacauuaucccca

SEQ ID NO: 3803 - RNA, 786 nt, Diabrotica virgifera
gguggccauuucauuuuugaaggaauguggacaaaaacugacagaaguuucaaguagagguauuacugcuauauuugagauguuaagaaacauuuuacaugaaggccagcuagaaaaaagaauucaguacaugauugaaguuauguuucaaauaaggaaagacggauuuaaggaucaugcugcugucguagaagaauuagauuuaguagaagaggaagaucaauucacucaucuuauuauguuagaugauguuaaagaggcugaugcagaggauauauugaauguguucaaauuugaugagaguuaugaagaaaaugaagauaaauacaaaacccuuaguaaagaaaucuuaggcagugauggugagucugaaucagguuccgaagguucagaagaggaaucugauaaugaaaaugaggacgaagucaaggaccagggaacaauuauugacaauacugaaacgaauuuaauuucucuuagaagaaccauauauuugacuauucagucuaguuuagauuuugaagaaugugcacauaagcuacugaagauggaguugaaaccuggacaagaaauagaauugugucacauguuucuugacugcugcgcagaacaaagaaccuacgaaaaguuuuauggucuuuuggcucaaagauuuugucaaaucaacaaaguguauaucgagccuuuccaacaaauuuuuaaagauaccuauucuaccacucacagacuagaugcuaacagguuaagaaacgucagcaaauuuuuugcgcauuuacuuuuuacgga

SEQ ID NO: 3804 - RNA, 750 nt, Diabrotica virgifera
cacgaacuuacuuuccaagcaauggccuaugacuuacuacccauagaaaaugauguauauaaguacgaagcaucggcugguguuaugaaagaaguccuucuagacgaaaacgacgagcuuugggucgaucuacgccaccaacacaucgcgguggugucucagagcgucaccaagaaucugaagaaauucaccgacuccaaacgcaugacccagagcgacaagcagucgaugaaggaucucucaaccaugaucaaaaagaugccgcaauaucagaaagaauuguccaaguaugcuacgcaucuucaucucgcugaagacugcaugaaggccuaucagggguauauagacaaguuguguaaaguugagcaggauuuggcaaugggaacugaugccgaaggcgagaaaaucaaggaucacaugcgcaacaucguccccaucuugcuagaucccaaaaucaccaaugaauacgauaagaugcguauuauagcauuguacgccaugacgaaaaacggcaucacagaugaaaaucucuccaaauuggcuacccaugcccaaaucaaggacaaacagaccaucgccaaccuucaguuacuuggagucaacguuauuaaugauggaggaccaagaaaaaaacaauauacaguaccgcgcaaagaaagaauuacagaacaaacguaccaaaugucaagauggacaccuaucauuaaggauauaauggaggauugcauagacgacaaacuggaucagaaa

SEQ ID NO: 3805 - RNA, 658 nt, Diabrotica virgifera
uaacccagaacaagugauggcaaaauuuguacugaacauauuucaacucaaacucgucgaauacaucgaucaaagauugaauuccaaguuaggaaccuauggcuauuuacaaguauuauaugaguuauauuauaagacuaaucaguuaucuaaugauuugagcauauuuaacaugggaaaugacaagaacuuuuuaucgaaguuaacgacaaauauuuuuaacaaauauauuagugauuauaucacgauggaauuaaaaggucugaaagauagguguucugcaaauuuacaaaaauauuaugaauccaaaggucaucagaagaagcagauucagucaggagguuuccaagaccuucgaagagaccuucaagcuguuauaggaacucgagcgaauauuaacauugcucagaucgaaaauuaugguggagaaaccuuuuuaucugaagaauuagcuauuacgauauuacaagauacaaaacacgcuuuccagagaugccaguuguuauccaaacccacagacagagccucaaacgcaacucaaauuuuggaucgacugauaaacagcuuauuaguagagcaugucgacuaugcaguagaauugggcuuacaagcuguuccuguuguagaagggaccaaaacuccuccagcgcuauauuuu

SEQ ID NO: 3806 - RNA, 707 nt, Diabrotica virgifera
ucuuggucggaaacuaacagggaucguagagaaaggcuucgacaacuagcuuuagaaacuauagaucuacaaaaagaucccuauuuuaugaaaaaccacuugggcucauacgaguguaaacuuuguuugacguugcacaacaacgaaggaaguuacuuagcccauacucaggguaaaaaacaucaggcaaauuuagcuagaagagcagccaaagaggcuaaggaugcuccuacgcuuuugcaaccagagaaacccagaguagaaccuaagaaguuugugaagauuggucgaccugguuauagaguaacgaaacaaagagaugccgaaaguggacaacagagucuucuguuccagauugauuauccagaaauaagugauaugauucuaccccgucaccguuuuaugucagcuuaugaacaaaaaaucgaaccaccagaucguaaauggcaguaucuucuauuugcagcagaaccguacgaaacaauugccuucaaaguaccaagcagagaaguagagaaaaccgacagcaaauuuuggacucauuggaacaaggauacuaagcaauucuuccuacaauuugcauuuaaaaaugacaauaagagaacuguuaauacagugguccaaagacauacgauuguuggugcagcaccaccacccccaaugcuaccuguuccaccaccaccaagaccaccgauguucaauccuau

SEQ ID NO: 3807 - RNA, 278 nt, Diabrotica virgifera
aacaauuaccggcgaaguauacagagggaaacugauagaagccgaagauaauaugaauugccaaaugacucaaauuacuguaacuuacagagauggaagagucgcucaauuggaaaauguuuauauuagaggaucgaaaauuagauuccugguauugccagauauguugaaaaaugcuccuauguucaaaaaacaaacuaaagcgggaacggcaggccgaggaaaaucugcuauacugcgagcccaagcucgggggagagguagggggcaacaacaac

SEQ ID NO: 3808 - RNA, 746 nt, Diabrotica virgifera
ucaacaaguuggugcaaaucuuacagccacaucugauagagaaaccaucuccuauaccuuagaaggaacaagaagugccguugaaaaggcucuaccauauuuagcagaaguagcuacccaccaagaauuuagaccuugggaagugucagagcucuccaacagauuaauuuuggauauuuuaaccagaccuuuacaguuaagagccaucgauuugcuucacaaugcugccuaccguagcaaagguuuagguaacucacucuucauuccaaaaucccaaguagguaaaguuucaucagaaacguuacaacauuacguagccagcaacuuuguagcuggccgugcugcaguuguugguacagguguaagcgagaguuuguugaaucaauucgcugcuaguuugggaauugcaaauggcgaaggcagcaccaauccaucuccuuacaaggguggugaacucagaucaaacaaagguggaccacuugcuuuuguugcaguaggaggagaaggagcuccauugaagaacaccaaagaagcucuugcguuugcaguucuacagaaagcuguaugugcuggcccucagaucaaauauggcguacuugauaauggagucuacagcaaagcucuugguggcucaucagauguaucugcgugcgcuguuaaugugagcuauucagacagcgguuuguuugguauuuugcucgcugcaccugcuggaucuguaggcaaagcaguucaaucagcuguua

SEQ ID NO: 3809 - RNA, 292 nt, Diabrotica virgifera
agccuacaagaugaggagagcccacgcagguaacuauuaugaaccauuaccacaagcuuccaacgaaaucgaagaugaaaacgauagaaugacuaaugaucugcaagaaaagauuggcgucuuaaaaucguugacuauagacauuggaaaugaaguuaaauaccaggacagaaugcucagagauguggacgacgaucuagauaagacuggaggcuucuugggcaccaccaugucaagaguacugagauuaucgaaaggaucucauaauuaccucauccuguauuuauuugug

SEQ ID NO: 3810 - RNA, 796 nt, Diabrotica virgifera
guuccaaggcuguaguacaaguauucgaagguacaucagguaucgaugccaaacacacugucugugaguucacaggagauauucucagaacuccagucucugaggauauguugggaagaguauucaacggcucuggaaaaccuauugacaaaggucccccaauucuggcugaagacuaccuagauauucaaggacaacccaucaacccauggucccguaucuacccagaggaaaugauccaaacugguaucacugccaucgaugugaugaacucgauugcccguggucagaagauucccuuuuucucagcugcuggucugccacauaacgauauugcugcccaaauuuguaggcaagccggucuugucaaaaucccaggcaaaucaguuuuggaugaccacgaagacaacuuugccaucguguucgcugcuauggguguuaacauggagacugcuagauucuucaaacaagauuucgaagaaaaugguucuauggaaaacguauguuuguucuugaacuuggcuaacgauccaaccaucgaaagaaucaucaccccacgucuugcucuaacagccgcugaauucuuggcuuaccagugcgaaaaacacguguuagucauuuuaacugacaugucuucauacgcugaagcuuugcgugagguaucugccgccagagaggaaguacccggucgucgugguuuccccgguuacauguacaccgauuuggccaccaucuacgaacgugccggucgugucgaaggccguaacgguuccaucacucaaauccccaucuugac

SEQ ID NO: 3811 - RNA, 796 nt, Diabrotica virgifera
acuuacgauccagaagaggacgacgacgaugaugauggcgccaaguugguguauccaaaaucugaugagcaacgucagagauuggccacugcuguuaaaaacauauugcuguucagaucucuggauaaagaucaaaugaacgaugucuuggaugcaauguucgaaagaguggucaaaaaggaugaauugguaaucaaacaaggagaugacggcgauaauuuuuauguaauucaaaguggaacuuuccauguguuugucgcaccagauccaucgaaagaacccaaucauauucacacuuacgaaaauaguggcagcuucggagaguuggcguugcucuacaacaugccccgugcagcuacggucaaagcaaauagcgaagguucccuuugggcuauggauaggcagaccuucagaagaaucguucucaagucugcguucaaaaagaggaagauguacgaagcguugauagaaaguguuccgaugcuuaaaacucuucagccuuacgaacguaugaaucuugcugaugcauugguaccuagagucuucuacgauggagauaggauuaucaaacagggcgaugcagcggacgguauguacuucguagaacaaggugaaguggccauuaguguuuuagacgauagcgguaaagagguagagaucaaucguauuaguaaaggagguuacuuuggagagcuggcauugguuacacaucguccuagagcugcuucugcuuauugcgauggagaaguuagaugugcauuuuuggacguggaagcauuugaacguuuguuggguc

SEQ ID NO: 3812 - RNA, 782 nt, Diabrotica virgifera
uuaucacaccacagacaagguuuacuugcuauuuuuaaaagcggagguauuccagcacuuguaaaguugcucaguucuccuguagaaaguguucuugucuaugcuauaaccacccuucacaaccuuuuauuacaucaagauggaucaaagauggcuguuagacuugcaggugguuugcaaaagaugguugcacuacuccaaagaaaccaugucaaauuuuugucaauuguaacugauugcuuacaaauuuuggcuuaugguaaccaggagagcaaguugaucauuuuggcaagucaaggaccuauugaauuggucagaaucaugagaucuuacgauuaugagaaguuguuguggacuacuucuagaguucugaaaguucuuucaguuugugccaguaacaaaccugcuauaguugaagcaggaggaaugcaagcuuuggcaaugcacuugggaaauccaagcacaagauugguucaaaauugucuauggacauugcgaaaucuaucagaugcugcuacaaaaguugauggucuagaaagcuuauugcaaucuuugguacaaguauuagcaucuucugaugucaauguagugacaugugcugcugguauccuuuccaaucugacuuguaacaaucagcgcaauaaaguaacugugugccaagugggagggguugaugcacuugugcgcacuauagucagugcaggagauagagaagaaaucacggaaccagcuguuugugcacugcgucauuugacauccagacauguggaaucagaaauggc

SEQ ID NO: 3813 - RNA, 673 nt, Diabrotica virgifera
aaaaacgaaggcccuaucuugcaucagaauguaaaaauuuacaugcuugugaaaaauggaggaugcagaucauaagagaaauugccaagaaaguagcucaaauucaaaaugcuggccuuggagaauuuaggauaagagacuuaaaugaugaaauaaauaaacuacugagggagaagaggcauugggaggaucaaauaaaggaauugggcgggccugacuaucagagaguuggacccaggauguuagaucaugaaggcaaagaaguaccuggaaauaggggguauaaauacuuuggagcagcuaaggaauuaccagguguucgagaacuuuuugagcaggagccgccuccuccuccaaggaaaaguagagcagaacuaaugaaagacauugaugcggacuacuauggauacauggacgacgaugacggaauuuugauuccauuggaaguuaaagcugaaaaaacagccguucaaaauacaguagcugaguggguuaguaaaaaagaacaaaauuuggagaacgcagagaaccaaacagaagaagaaaguauauaugcaguucaggagucugacgaugaagaaaguaaggaaacuguacaacaguuaguagauggaucacagcaaagauuuguugcacauguaccuguaccaucucaacaagauaucgaacaggc

SEQ ID NO: 3814 - RNA, 511 nt, Diabrotica virgifera
acaugacuggugaauucgaaaagaaauauguagcaaccuuaggaguagaaguucacccuuuaguuuuccacacaaauagaggacaaauucguuuuaacguaugggacacagcaggccaagaaaaguuugguggucugcgugauggauacuacauccaaggacaaugugccauaauuauguuugauguuacaucuagagucacuuacaaaaauguuccaaacuggcacagagaucuuguuagaguuugugaaaauaucccaauuguauugugugguaacaaaguugacaucaaagauaggaaaguuaaggcaaagagcauugucuuccauaggaagaagaauuuacaauacuaugacaucucugcaaaauccaacuacaacuuugaaaaacccuucuugugguuggcuaggaaacucauuggagaucccaacuuagaauucguagcugcaccugccuugcuuccuccagaaguccagauggauccccaauggcagcaacaaaucgaaaagga

SEQ ID NO: 3815 - RNA, 774 nt, Diabrotica virgifera
aacgauccaaguuagugcuuccggaaccacaaauuucagaccaggaaaugcaccaaguggugaaguugggcaaagcgagugaagcagcuagggaaauaguuacagaaagcgguguugaaaccacugacacuuuguugaaugauuauacuuucaauccucaagcggcugcuacaccaaggacuccggcgccccagacugauaggauuuugcaagaagcucagaacaugauggcgcucacacacguagauacgccccucaaaggcggcauuaacacuccguuacacaauucagauuucagcgggguccugccccaagcucagaccgucagcaccccgaauaccgugcuugcuacgcccuucagauccaguaggagugacggagcuggcacuccuggcaguagcguuggauuuaugacgccuagaaguggcgcuuuggugccuguggggaagacgccgguaggaaugacgccuucgguuagggauaagcuuaguauuaauccagaggaagcaauggacguaggaagcacaccagcugagcacagaauguaccagaugucgaugaaagaucaauuaaaaaugggguugagcagucuaccacaaccgaaaaacgacuaugaaaucguggugcccgaaaaugaagaccaggaagaacccgagcaagcucagucacaaaugaucgaagaucaagcugauguagaugcacggaaacaagaagagcucaaggcgaaagccgccagggagcuggcgcuacguucucaagucauccaacgugauu

SEQ ID NO: 3816 - RNA, 330 nt, Diabrotica virgifera
aaaugguauguggcucauccagacaagcucaagaaaaaaauuacaagagaauuaaucacaacuauuuuagcuagaaaaccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauauuuuggaaguguuugugaguuagacauaaucuucaacuuugagaaagccuacuuuauauuggaugaguugauguuggggggugaaguucaggagacaagu

SEQ ID NO: 3817 - RNA, 730 nt, Diabrotica virgifera
gaugaagcuagcaagucagauuuagcaaagaaggcuggcaaauucacagaagaaguugguaaaacuacacauaaaauuagugaaacagcucaagaaauuaguaaaacuggagcguuucaaaguauaucucaagcuacuaaggcuguuaaacaagaaauagacaauacuaguauagaagguagaguauauguuaguccuaaaauacuacgcaagagaacagaaacaagugcaguuguccaucaaaaauauuaugaaccaaacacagaugcuacaggcguugaacuacacaaagauucuaaguuuuaugaaucuuggcaaaauuucaaagauaacaauccauauguacauaaaguuauggacuggaaauuaaaauacgaugaaagugaaaauccugucauccgugcuuccagagcucuaacagaaaaaguuggugauaucaugggugguuuauuucagaaaacugaacuaucugaaacacuuacagaaaucuguaagauagauccugcguucgauaccaaaagauuucugaaacaaugugagacagauauuauucccaauauucucgaagccaugacgagaggagaguuagaaguucuuaaagauuggugccaugaagguccauuuaaucuuuuugcuguuccuauaaaagaagccuauaaaaagggauacaagauugaaucaaaaauuuuagauaucgaucauguggauuuagucuuaggcaaagugaugg

SEQ ID NO: 3818 - RNA, 712 nt, Diabrotica virgifera
accuggcuuaaauacuguggaagaaggaccaaaacaguucacaaauaaugugagugguuuaaaacaaaaauuagaagaaaucaaacucaaguuaccauggauagaacgacuggacuguguaaaugcacaagccccuuuagcaccugaauuagcagcucaaauguugacccacgaggaaaaaagaaguaaugagcuuaaaaauaauaaaaagcucacacaguuuacuccaagugaagacccgguuuuaaacgacuuuaaaagagaaaugauguuccacagacaagcccaggcugccauucuagauucuauaccaaagcuaaaagauaugggaauacuaacuaaaaggccugacgauuacuuugcugaaauggcgaaaacggaugcccauaugcagaagauuagggaacaucuuaugaagaaacaggagcaacagaagagaagcgaacgagucaaacaacuuagacagcaacgaaaagaagguaaaauguuacaaguucagacaaaacuucaaagacaacaagaaaagaaagauaugcuugcucagguuaaaaaaguaagaaagggaauguccaaagaucuugacuuccuugacggaaaaaauaaaucugcugccaaaaaaauggcagaaaaacggaaaaugaaagacaaaaaguucgguuucgguggaaagaaaaagggaaugaaaagaaacacaagagauagugcugcagau

SEQ ID NO: 3819 - RNA, 795 nt, Diabrotica virgifera
ugcagacaagaaucuucgaaccagcgccaccugggagcagaaaaguugugauagcuacaaauauagcagaaacgucuuugacgauagaugguaucuacuacguaguugauccaggcuuugugaaacaaaaagucuauaacuccaaaacuggaauggauucauugguaguuacaccgauuucacaggcucaagcaaaacaacgagcaggucgugcugguagaacgggaccugguaaauguuacagacuauacacagagagggcauacagggaugaaaugcuuccgacgccaguaccugaaauucaacguaccaaccuugcaacaacaguccugcagcuuaaaacuauggguaucaacgaccugcuucauuucgauuucauggacgcuccgccgguggagucguuaauuauggcuuuggaacaguuacauuccuugucagcucuugaugaugaaggguuauugacacgauuaggaagaaggauggcagaauuucccuuggaaccaaaucuuucaaagauguugauaaugucaguugcccuacaaugcucagacgaaauucuuacaauagucagcauguuaucaguucaaaauguauuuuaccggccaaaggauaaacaagcauuggcagaccagaaaaaagcaaaauucaaucaacccgaaggugaccacuugacgcuuuuggcgguauauaauaguuggaaaaacaauaaauuuucuaacgcuugguguuacgagaacuuuguacaaaucaggacauuaaagagggcucaagaugugaggaaacaacugcuaggaa

SEQ ID NO: 3820 - RNA, 685 nt, Diabrotica virgifera
agaucguuccauugacaacaaggccauguacgauacuuucucagcuuuugguaacauucuuaguuguaagguagcccaagaugaaaacagcucuaguaaagguuauggguuuguccauuuugaaaccgaagaagcugcaaauaagucuauugaaaagguaaaugguauguuguugaacggaaaaaaaguauauguaggucgcuuuauuccacacaaagaaagagaaaaggaacugggagaaaaagccaagcuguucacaaauguuuauguuaaaaauuuuggugaagauuuugcugaggaacaguuaaagguuauguuugaaaaguaugguaaaauuaccagcuacaagauaaugaguaaagaagaugguaaaucaaaaggauuugguuuuguagccuuugaaaguucagaggcagcagaagcggcaguugaagcuuuaaauggaaaagaguugguugaaggaaaaccuuuguauguuggaagagcccaaaagagagcugagcgucaacaagaacuaaaacgucgcuuugaagccuuaaaaauggaaagacuuaaucgcuaucaggguguaaaucucuauguuaaaaaucuagaugauacaauagaugaugaacgucuccguaaagaguuuacuccuuuuggaaccauaacaucugccaaagugauguuggaagaagguagaagc

SEQ ID NO: 3821 - RNA, 778 nt, Diabrotica virgifera
uccuacuggucaaccucuaguugaacucaguacaaacacuauuaauaaacuucuuaccgcucuaaacgaauguaccgaauggggccaaguguucauccucgauucacuuucaaauuacaccccucgugaugagcgcgaggcccaaaguauuugugaacguauuacuccgagauuggcgcaugcuaaugcugcugugguuuugucugcuguuaaaguuuugaucaaaaugauggagauucuagcuggagauacugauuucugcaauacuuuaagcaagaaacuagcuccuccauugguaacguugcuuaguucugaaccagaagugcaguacguggcauuaaggaauaucaacuuaauuguucagaagaagcccgacauacuuaaacaugagaugaaaguauuuuucgucaaauacaacgauccaaucuacguuaaauuggaaaaguuggacauaaugauccgucuagcaucucaagucaacauugcucaaguccucagugaauuaaaggaguaugcuacugaaguugauguagauuucgucaggaaggcaguuagagcuauugguagaugugccaucaaaguugaaccuucggcagaaagauguguggcuacacuuuuggaccuuauucaaacaaaagucaacuacguuguucaagaagcuauuguuguuaucaaggauauauuuagaaaauaucccaauaaguaugaaaguauuaucaguacacuuugcgaaaauuuggauacucuugaugagcccgaagcuagagccaguauggua

SEQ ID NO: 3822 - RNA, 354 nt, Diabrotica virgifera
gaaguuggagcuaccucuucuuuggcuccuaaaauugguccucuagguuugucucccaaaaaaguuggugacgauauugccaaagguacugcugauuggaaaggucuuaaaaucacaguucaauugaaaauccaaaaucgucaagcuaccauuucuguagucccaucugcuuccucccugaucauuagggcucuuaaagaaccaccacgcgauaggaagaagcaaaagaacauuaaacacacugguaacauuacuuucgaugaaaucaucgcuauugccagacagaugaggcccaggucgauggccaaacaguuauccggaacuguaaaagagguuuuaggaacagcccaauca

SEQ ID NO: 3823 - RNA, 754 nt, Diabrotica virgifera
gaguagacccaaaccucuuguagaauuugcaaauaaacccauucuccuucaucaaauagaagcacuuguagaugcuggaguuacugaaguuauauuagcaguaucauaucgugcuaagcaaauggaagaagaguugacaguggaagccaaaaaacugggaauuaauauaauauuuucccaugaaacagaaccuuuagguacagcgggaccaauugcauuagccagggaucaucuuucuaaaagcacuaaaccauucuuuguguuaaauuccgauauuauuugcgacuucccauuuaaagcauuggcugaauuccauaaaaaccacggaaaggaagguacaauagugguuacuaaaguggaagaaccgucaaaauaugguguaguaguauaugauaaagacaacagcauccaaaguuuuguagaaaaaccucaagaauucauuucuaauaaaauuaaugcugguuuguacauucuaaauccaagcgucauuaauaggauagaauuaaaaccaacuucuauugagaaagaaguauuuccuuacauggcugcugauaaacaguuguaugcauuugaauuggaagguuuuuggauggauguuggucaaccaaaagauuuucugacaggaauguguuuauaucucaaacauuuaaggcagacaaaugaagacaaacuuuauaaaggaccaggugucguuggcaauguauuaguagauccuacugcuaaaauuggaaacaauugucaaaucgggccuaau

SEQ ID NO: 3824 - RNA, 683 nt, Diabrotica virgifera
accucuuaaaagaaggugccagcggggcauucgcccaguauaacaaagaucaacugacccccguuaaaauagaaaacgccgaucauuuagugcuuauuacggaauacaacgauuuagggaauaauagauucuucgaccccagaaguaagcagaguuuuaccuaugaucaccugagaaaagaagccuuagacuaccaagucuauacccccgauagugcuucugagccuuggcgggcagccuuagacuccgaguucauucaguacacuaggaaccauuacaaagauggaguauguagugugguaggccgcaaccagagcgggguuguuaacuuaacagcuuguaucgaagaccaccaguucucuccgaagaacuacuggaaugggagauggagaucucagugguccauuagucuaacugaugauuccacugcugaggugagagggguacucaaaguacagguccauuauuaugaagaggguaauguacaauuaguaaguacuaaagaaauaaaagaaacuguuccuguuucaucugaggcacaaacugccaaagaaaucauccaaguaauagaagccgcugaggaucucuaucagacggcaauuucagaaaacuaccagaacaugucagauacaaccuucaaggcccuacgaagacuucuuccugucaccaggacaaaaauggau

SEQ ID NO: 3825 - RNA, 780 nt, Diabrotica virgifera
aacaaccaagcacuucauugugugaaaacuggaucucccacuuuagaaggcuccgaacaacaauguugcuaugauaaaaacggcuuuuugaugcucucuuacgaucagcaaugggguucuaguccgagacguugccacaacuuggguaaaaugccuuacaaugaagcgacaaaagugccuacucucucacaaugguuuaaugacaugguacccaaauauuuguguugucuuuggcaagacgagcaagcugugggaugugaaacacugagauuugaacggagaccuacacaggauuguguagcuuaccaagcaccagguguagcaggagucuacggugauccacacuuuguuacuuucgacgauguagaauauacguuuaauggaaagggagaauucgcauuggugaaaucaguuacgcaaacggacaaucuggaaauccaaggaagauuugagcaaauggacccuaacacuuauggugagguuagagcuacucagcugacuucuguaguagcuaaagguaauaacacaauagcaauugaagucagaaggagaccucuggauucuagauggagauauagguuggauguuauagcagauaauagaagacuuuauuuugauagacccucacuaaaauuccagcacuuccaagguguuacuauuuacacuccaagcuacauccuuaaucaaucagaagucaucauuauguuugacaauggagcuggaauggagguugucgacaaucaaggauucaugagugcaagaguauuuuugccuuggucg

SEQ ID NO: 3826 - RNA, 515 nt, Diabrotica virgifera
gcggcuuuaguuccuuuuuauuucacuuuucacuccauuuuccuucuugauauuuugauauuuugucgguauacacguuucgugucucaagacuuaaaaaugcguuacguggcugcuuacuuauuggccguuuugggcggcaaagccucucccaaugcugcagaucuugaaaaaaucuugggaucuguagguguugaagcugaaggagaaagaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaagaaaagaaagaggc

SEQ ID NO: 3827 - RNA, 688 nt, Diabrotica virgifera
aagggaaaggauaguugcagaguguaaugcuguaagacaagcuuugcaagacuuguugacugaauauaugacaaauaugggcaauaaagauaaaagugagagccuaauacgagcaaucgacaauauggguagaaagacuaaggauuuaagaagacaacugagaaaagcuguuguagaucauguaucugacaguuucuuggaaaccaacguaccucuucucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggugucaaaaugguuagauaugcugcugcucagaucgacaaucuguguccugaaguaauaaaugcagcuagaauuuuagccgcuagaccucgcaguaaaguugcucaagaaaauauggacgcauucaagcaaucaugggagaaucaagugagacuucugacugaagcagucgaugacauuacuacuaucgacgacuuuuuggcuguuucugaaaaccauauucuggaagauguuaauaaauguguacuugccuugcaagaaggugauucugacacauuggaucgcacugccagugguauaagaggaagauccaauagggugugcaauguaguaacagcu

SEQ ID NO: 3828 - RNA, 753 nt, Diabrotica virgifera
aacuacaaaggccacuacagccccaacaacccucuccuuugguuuugcuacuccuacgacuguaccguuuggaucaucaacuacaauuacaccugcaacaacuccucaauuuggauuaucgcuuccaaaggcuagugccccggccacuacuaccuuuucacuucuaggaucugccccagccacuacugcagcagcaccuacagguauaucauuugguacugccacuacuacagcaacaacuucagcuacagguuuaucauuuggaacuccaauuggaacugcuacaacuacagcaacaacuucagcuucagguuuaucuuucggucuuacaacagcgucuucuacaaguucugcugcaccuacacuuuugucaucaacaaccacuucgacaacgucaucagugucugcaucuggugcuuugaguaguacaacaucagcaccgacuuuugccaccucaucguugucuucaacaggcaccuuaacauucucucaacucgaagauucgaucaacaaauggaccauggaucuagaagaacaaggaaaauucuucaucaaccaggcuaagcaauuaaaugcaugggauacuuuacuuauaucuaauggagagaaaauuuuaacccuuaacaguagcaucgagaaaguuaagcaacaacagcaacaguuagaccaagaauuagacuucgugcuggcacagcaaaaggaauuggaagagcugauuguaccgauagaaaaagaauuguuggggauaccugu

SEQ ID NO: 3829 - RNA, 437 nt, Diabrotica virgifera
cuuaggacuggauaacgcaggcaaaacuacccuucuacauaugcucaaggaugacagacuggcccagcaucuucccacguuacaucccacaucagaggagcuuuccauugguaacaugagguuuacgacguucgauuuggggggccacgagcaggcuaggagaguguggagggacuacuuuccagcagucgaugccauaguguuccuuguugaugccaacgacagcucaagauuuguagaaagccaggaacagcuaaaugcccuccucucagacgaaacucuaucaaacuguccaauacuuaucuuagguaauaaaauugaucucccaggugcugcuucggaagaugaauuacgaacuagauucggcuuguuuggccaaaccacaggcaaaggcaaaguagccagaaaugaucuacccgguaggccucuagaacuau

SEQ ID NO: 3830 - RNA, 423 nt, Diabrotica virgifera
ugccgacaaaaaucaaacaauaacaaauauccuuacacaaguucagacauucguuaccacagcucucacuuguagagaaacaauaacguccauguugcaguuuuauggaacuuuaaacgacuaucucgacccagcugguggagcagaugaacucgagguugaggcaaaaagacauuauauauugcaguuacacccugagaucaaagacacccuacagacacauacucgaauuuugcagacuuuacuccccuuuguggaaucagaaaauauuucuaaagugguugaaaugacagcucaauuggaagaggcaucuguuagucaucucaguuuguauggagaguggagagauacaauguacaaaauggugguagcucuacaagauuuuacugauauaaugaguucgauuaagguauuguucucuca

SEQ ID NO: 3831 - RNA, 750 nt, Diabrotica virgifera
aguggcaacuuuauauggcaaaguuguguuagucaaucucauugaccaaaagggagcugaagguaacauggagaaauccuuuaagaacgccaugaguucauugucguauccuucagcacgauacgaaccuuucgacuuccauucugaauguagcaaaaugaggugggaccgucugaaaauccucauagaccgucuagcucuggaccaagaugaaaugggcuucuuucucuuauugcgggaugguuccuuaagcucguuacaagacggagucuucaggacgaacugcauagauuguuuggacagaaccaaugugguccaaaguaugcuagcgcacagaaauuuagaaauaguuuuaaggaaguugaauauuuuacaccaaaaccagaacuuggaguuccaguauuccuucgagguuuuguuuaagaauguuugggcagacaacgcugauauuauaagcacacaauacucgggaaccggagcuuuaaaaacggauuuuacuagaacagguaaaaggacuaaggcuggaguuuuucgagacggagucaauucgcuuaccagauacuacaaaaauaauuuaacugacggguaucgccaggaugccauagauuuguucuuagguuacggcaaaccgauaucuccacuaagaguagacaaaucguggcgauauauuacuuacccuucgguacuuuuagucgcuguauccauguuuguagcuucugcuguguuuccuucggaauacucaaccgaauc

SEQ ID NO: 3832 - RNA, 721 nt, Diabrotica virgifera
agauuccagccucagacuauggacaaaguugaagcuaaggucgguuauaguauuaagaaaucccuuaacaaugaaacguuguacauggacagagauucucagauuaaggcuauugaaaagaccuuugaagacucuaagaaugucaucgagaagcauuacagcaaaccaaaugucguagcuguggauauuuugccuguguauccagauuucagccuuuggaaguacccuugugcccaaguuauuuuugauuccgauccagcuccuguuggcaagcaaguaccagcucagauugaagagaugucucaggcuaugaucagaggugugauggacgaaaguggagaacaauuuguugccuacuuuuugcccacagaagacacucuucagaaacgaagggaugauuuugucaaccagauaccauaucaagaugaugaggaauaugaguauaagauggcaagagaguacaacuggaauguaaagagcaaggcaagcaaaggguaugaagaaaacuacuucuuuguggcaagaccagauggaauuuauuacaaugaacuggagaccagaguaaggcugaguaagagaagggucaaagcuggugcuccaccuaguaacacaaggcuuauugucaaacacagacccauggaugcuaaugaguucagaaugcagagguaccgagagaaacagcuggaaccaccaggugaagaugaugaggaaauggagguug

SEQ ID NO: 3833 - RNA, 759 nt, Diabrotica virgifera
aaagcuaagaacgcugagaagaucaagcuuuuggaugaagccauagaagaugccgagaaaaauuuaggugaaauggaaguucgagaagccuacuuaagaaaagcagaauacuacagccgaauuggugauaaagacaacgcaguuaguacuuucagacaaacauaugauaaaacuguaucacuuggucaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguguaucaaggugcauauuguaugucaguacgagacuucaaaucagcugcuaacuuguuuuuggacacaguaagcacuuuuacaucauacgaacuaauggacuauaaagcauuugucagguauacuguauacaccucuauuauuaguuugccaaggaaccaauuaagagauaaaguggucaaagguuccgaaauauuggaaguacugcauucagaaccauuuguaaaagauuaccuuuuuucuuuauauaauugucaguaugcugaauuuuucacaaaucuugcagaaguugaaacaguucucagaaaagauuauuucuugaauccucacuaucguuucuauguaagagagaugaagauacuugcuuauacacaauuauuggagucauauaggucucuuacuuuacaauacauggcagaagccuuuggaguuacu

SEQ ID NO: 3834 - RNA, 681 nt, Diabrotica virgifera
cagcagaggaauaaaggguucuccuguccucucugccauaaagccuaccgagcgcaugcucauagggagaugguucaaugcucuaauuguaaaaaauuuguacaugggacaugcgacgcugaagcagauguagcuacuuaccaucaaaagaaagaucuuaacccugaauaugaauauguauguuuacauugcaaaaacaguacugcuagacaaauaacugcaaaaagagcaaguauugaagacucaucggauguaccagcuucccaugaaucucuuuacgaugacaccucagaauucgaccugccuucuccggaugaauuugcucguaguauggguaugggcaaaggaaaaccguucgccagcaaaauugcuaaaaagcgcaugaccuuucccguuggugguaggccaaaagguacaggcaaaguaccucccgguaagauggguuucaugaaacgaucucgacuaucggauuuuaacaggaaaaggggccauaaaucaaaaaugugcgguauuuucggcguaccugguguuggccuucaacgaccgacugccgauggaaaaagcgacgaagagcccgguguggagaauagauugguuuuauguucugccaaagauaaguauacguugacgcaagauaucugugucauguguggagcgcuuggaauggaccaagaaggaugu

SEQ ID NO: 3835 - RNA, 670 nt, Diabrotica virgifera
ugucaaggagguuuugucaagauaugaugaugauuggauuguggaugaugauggcgguggcuauguggaagaugguagagauauauuugaugaugaucucgacauggagucaauugcucaagccucagcuaaaagcaaaggcacuaaacgaaaaacaaaaaauguaucugaaaaugcugggaaaggaaaaauucaacaaauguuauccaguuuaccuucaaagaaaaaaguggaaacgaaaauugaugaugaugagaugcugucagaaauucuuggagagauugauuccucgccuuccacuaguggacaaaagccaaagauuaacgaguauucagcuuuagcuaaaaaguuggcugcuaaggauuacaugaaaaauuucucccaaccuucuaaaaaacgugucauugagaggaaaucauuaccaaaugaggaagcuggggaggugacacaugggucuguguuaaaagaaguacagucuaaugugggaaaauccacaaagaagccccaaagaaaugucacagaacaaacuguuaucaacccuuucaaaaaagugaaagaaacuccugcagucaaacagccacaaacugaagcagcccaagaaguaauagaagaaacuccuuuagaaaccuuugaugacaccuugacagaagacuucgaugaugaucccaug

SEQ ID NO: 3836 - RNA, 746 nt, Diabrotica virgifera
ccauacuucagaaccaccaaugccuagagaaaguaaaucgaagaaaaauuugcaaugggugccaucuuugccaaauuccagucauuuagaugcaguuccucaagcuacuccuauuaauaggaacagaguagcaucaaaaaaggugaggacauucccauuauguuuugaugacacagauccacaaguaaacauugaaaauucuugucagcaagaaauacuuguuccuauuagacuugauauggaaauugaaggacaaaaacucagagauacuuuuacauggaauaaaaaugagaguuugauuucucccgaacaauuugcggaaguccuuugugaugaucucgauuuaaacccauugacguuugugccugccauagcucaagcaaucagacagcagcuggaagcuuuuccaaacgaaccgccaaguauacuggaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauucguaacagccauagcauacucuauccguggucaacucucguggcaucagaggacuuacgcuuucagugaagcuccgcuuccgacaguugaaguuccguucagaacucccagcgagucagaucaaugggcgccguuuuuggaaacuuuaacagaugccg

SEQ ID NO: 3837 - RNA, 666 nt, Diabrotica virgifera
aucaguucccaaaguggaucuacagcuagugguuuugcagaucaugacuauccaacuaucaguggaguaucacaaguuaucaacaauaugacacaaguuaaauguguuaauagcauuccuuuaccaacggaaauuguugaccacuuuucacggguucaaugccauugcaugaugggucucuuuugugaaaucaauagagcuuggcuuacuguggauagugauauuuauguauggacuuacgaacaaaauacugaucuggcauacuuugauggaauaagugagaccauuguuuguguuggucuuguaaagccaaagaugggagucuuccaugcuuuuauaaaguaucuucugaucuuggcaacuucuguugauauugugguuuuggguguaacuuuuacugagaagccaggugauaccacagaggaaauucaguugauaccagacccaguuuuuaguuuaccaacugauggugccacuguuacuaucaucaguaguacuaaugacggaagaauuuuuuauggcacaaaggagggaaagcucuuugaaauauacuaucaggcugaaagugguugguuugggcaaagauguaaaaagguaaacuugucuacaaguacccuaucuuuucuaguuccuucauuuuuaaaugcugcucuuagcgaagaagau

SEQ ID NO: 3838 - RNA, 663 nt, Diabrotica virgifera
agaagccauacguucaguuuguacuccggagauuguuguucucacacaggcuaguuauguaguucuauggcuguguggauuaacuacuauuguuaacuuaccuuucagugcucgcgaaucuucgauaaauagauuggcgccacucaaauuagcuccuguuuugaauuugaggccucuuacuacauguacgucguuauuggagcuuuucauauccucuaccgguggccaggaagccagaaaaucuuuugccagaguaaauugcagcgaugaggcuuuggcccauuggcauaucucacuucuaccuuauuugaaucacgugagacauauaauuuggcccauaacuggagguacaguucuugccgagugguuguuaagcaguggacaacauuuaugguugcaacaauacguucguuuacuuagcaacuggugugaauggaauaguuguacaagaaacuucuugcuagcuuccgccuuuuugucaacuggagaauauaacaaagcagaagauuuguuugaaacggcugcuaaagggguuuuaacagauggcuuuuuacaagaacguuguuuaaaagggaauuugccuaguccaacuggagcguauauucacuauuauuuaaagguuauucaacuauuugaucuucacaaggccaaagauuccguuau

SEQ ID NO: 3839 - RNA, 720 nt, Diabrotica virgifera
gagaagcuacaaaugguugcaaaaaauccaucaaaaccucauuuuaaccauuaucuuuuugaaacauuuucauuagccauaagaaucguauguaaggcaaaucccacugcuguuacagcauuugaagauauauuguuucccauuuuccaaggaauucuacagcaggauauucaagaauuuauuccuuauguauuucaaauucuuucucuauugauggagaguacaccucaagguaauaaucuggagcccuacaugcagcuuuuaccauucuuauuggcuccugugcuaugggauagaccugcuaauauuaguccacuaguaagauuauuaugcgcuuucgcucuacaagcagccccacaaauuguagcgcaggauaaagugagcggauuccuaggaguauuccagaaauugauugcuucaaaaacucaugaucaugaggguuucuuuuugauucaaaguaugauucagcauuuaccaauggaagcccuagcaccuuaucacaaacggauauuuucccuuuuguuucuaagacucucuuccaguaagaccacaaaauauguaauuaaucucauaguuuucuuuucgcuguacguugugaaauauucagcaaaugaacugaucucgacuguugacgauauucaagcagaaauguuugguaaggugcuugaaaaacuauauauugcugaaauacaaaaaguuucuguagccgucgauagaaaa

SEQ ID NO: 3840 - RNA, 505 nt, Diabrotica virgifera
cuugaacccauuucaguucgaaauaacuuuugaauguauagaagaacuuagagaagauuuggaauggaaaaugauauauguaggcucagcugaaagugaagacuaugaucaaacuuuagacucaguuuuuguaggaccuauaccugaaggcaaacauauguucgucuuucaagcggauccuccaaaugucucacguauuccagaaaaugaugcucuugguguuacaguuguacuauuaacguguucuuauagaagucaggaguucauucguguaggauauuuuauuaauaaugaauauacugauccagaacuuaaagaaaauuuaccuaguccuccacaauuugauaagguaacccgaaauauucuagcauccgaaccaagaguuacccgcuuuaaaaucaacugggaagaaaccaaccccacagaaaauaacacaaacucugaccaaaguggagcaucagcacccacgacaucagaagcuggacccucugcuccugucgaagua

SEQ ID NO: 3841 - RNA, 698 nt, Diabrotica virgifera
cucuucaucaaccugaggaggaucaacuuaucuuaccaaaugcccuucaacagcaacagcagcagcaacaacagcagauugcgaccagcaauucccaaguaccuccuuuggcaccaaugggcggauugacaccuacacuuggacuuggcaugggccaugccaugucuguaccacaaaccaaauauguaacugguuucgcauugcccaugaguucuaugaaugcacaaacuccccaacacacaaugagcccuauggugaauuuaggggguucaauaacuacaggagcuggagugacuccaacgauggcaccuucaacuccuucaccuaugacgccaaugacuccucauucugcugacccuggcaucauuccacaguuacaaaauauaguguccacaguaaauuuaaguugcagauuagacuuaaagaaaaucgcucuccacgccagaaacgccgaguacaacccaaaacguuucgcagccgucaucaugaggauacgugaaccacguacuacagcccuaaucuucucuucgggaaaaauggugugcacgggagccaaaagugaagaagacucgagguuagcagcaagaaaguacgccaggauaauccaaaaacucggauucccagcgaaguuccuggauuucaaaauucagaauauggugggcaguugugacguuaaauucccuauaagacucgaaggg

SEQ ID NO: 3842 - RNA, 340 nt, Diabrotica virgifera
augaacuucacauuugcagcuggaaaucagguuuacuauacugcaacuucaguuaaacaaguagaugugccaucuuucucugguagcuuugguauccuccccgcccauguacccacacuggcugugcuaaaaccuggaguagucacuguuuacgaagauggugguaauguuaagaaaaucuuuguuuccagugguacugucaccaucaaugaugauucaucaguucagauucuugcugaagaagcccacccaguagaaaacauugaugucaaugcagcaagagacauccuuaccaaagcccagagccaguuaucaucugcaaguacagaugaggcgaaag

SEQ ID NO: 3843 - RNA, 685 nt, Diabrotica virgifera
caaggaaggagaaugggaaaaguuagugauggacacauucagaaaauaugaaaagucgagcagggcaaaacacgaggaagaacuaaaagaaaagcgagaacaagaagcucgaaaaaaagcagcugcugccaaaaaggcagaagcagaaacugucaagccugcucaaaucaccgaauugacugaugaagaagcugaaaggcuucaggcugagauuaaugcuaagaaaaacacuucugauaaagcugaaaguucuucaaaugguccagaagcugcaaccacagcuaaaaaaguaggagaagacgaggaugaaucugaaaaaggcaagauacugcccaacucgggaaauggaugugaucuagagaaguacaaguggacgcaaaccuuaggagauauugaguuaaaaauuccccucaaaguaaacuucaggguaaaacagaaagaucucguaguaaauaugacgaagaaacacuugacgugugguaucaaaggucaaccaccuaucauagacgacgauuuuccacacgagaucaaauuggaagagucuucuugggugaucgaagauggaaaagaccuguuauuuacuuuugaaaagauaaauaaaaugaauugguggagccaaauagucaaauccgauccagaaaucagcacaaagaagaucaaucccgaaccauccaaacuuagcgau

SEQ ID NO: 3844 - RNA, 350 nt, Diabrotica virgifera
gauaaaaagcauagcgaccgagaaagguggauauguauuuacccugcuuacaucaacaacaaaaaaacauuggcacagggcagaaaaauagccaaagaaagaugcguugaaaaucccacucaccaggaaauucgugauguucuggucgcggcugguuugaaagugggugucgaaaacaaauuguacagcagagagagaaguaaagaaauguuauaucgugguagaauaaggauacaguuaaagaacgacgauggaaguuuguguaaugacaguuucccuaccagagacagcauuauguaccauuuaggagacaugauucccaaacugaaaagcaggcaaaauaaaagcuc

SEQ ID NO: 3845 - RNA, 772 nt, Diabrotica virgifera
aucuucgacuaguggaaggagaaaaugaucucgauauuacacgagaaaccuaugaaagagcuauugcuaauauuccuccaacaaaaaacaaacaguuuuggagaagauauauuuauuuauggauuaauuaugcgauauuugaagaacuugaggcuaaagauuaugaaagaacucgucagguuuauaaggcuuguuuagaaauacuaccucacaagauauuuacuuuuuccaaaauaugguugcuguuugcacaauuugaaauucgucagaagaacuuaacugcagcaagaaaaauccuuggaaugucaauugguauguguccucgagauaagcuuuuuagaggauacauugaucuagagauucaacuaagagaauuugacagaugcagaaaauuguacgaaaaauuucuugaguucgguccggacaauugcauaaccuggaugaaguuugccgaacuggaaacacuauugggggauauagaaagagcuagagguauauucgaauuagccauuaaccaagccagacuugacaugccagaauuauuguggaaagcuuacaucgacuuugaaauaucacaagaugaaccagauaacgcaaggcagaucuacgaaagacuucuggaaaggaccucccacguuaagguuuggcuaucauaugcuaaauucgaacucaacaauccaacagaagacgaauuaaauguucguuuagcuagaagaaucuuugaaagggcuaaugaaaaucugaagagcuuuccagagaaagaagcaagagu

SEQ ID NO: 3846 - RNA, 779 nt, Diabrotica virgifera
gccaagccagaaagaaaaauccaauucagggagaaaguacuauggacugcaaucacucuuuucaucuuuuuaguauguugucagauuccauuauucgguauaaugaguucagauucugcagauccuuucuacuggauucguguuauucuugcaucaaacagagguacccuuauggaacuugguauuuccccaauuguaacuucaggucugauuaugcagcuguuggccggugccaaaauuaucgagguuggugacacuccaaaagacagagccuuauucaauggugcccaaaaauuguuugguaugguuauuacugucggucaagccaucguguauguaaugacaggcauguauggugauccggcugaaauuggagcuggagugugccuucucaucaucauccaacuguucgucgccggucuuauuguuuugcuucuugaugaacuucuccagaaaggauaugguuuagguucugguauuucccucuucauugccacaaacauuugugaaacuauuauuuggaaagccuucucaccagcaacaguaaacacuggaagaggaacagaauuugaaggagcugucauugccuuauuccacuuguugaccaccagacaagacaaaaucagaggauuacgugaagcuuucuacaggcaaaaucuucccaauuugaugaacuuguuggcgacaguacucguuuuugcuauaguaauauacuuccaaggauucagaguagaucuacccaucaagagugcaagauaccguggacaauauuccagcua

SEQ ID NO: 3847 - RNA, 335 nt, Diabrotica virgifera
acauuucaaggguacuagagccgaacaggacggauuauuaagacuaucaaccacauuauacguuggaaaucuaucuuuuuauacaacugaagaacagaucuaugagcucuuuucaaaauguggagacauaagaagaguuguaauggguuuggauaaauauaagaagacacccuguggguuuuguuuuguagaauacuauaacagagcugaugcagaaaacuguuuaagguauauaaaugguacucguuuagaugauaggauuguaagaacggauugggaugcaggauuuauagaagguagacaauaugguagaggaaaaacaggaggacagguac

SEQ ID NO: 3848 - RNA, 665 nt, Diabrotica virgifera
cguggaagaaaagcacuuuugggaagcuuagggcuuauugcuggugguacuggugccuugcuguuugcuuuggaccaaucaguuaaagcaucugaucuugaauugcauccuccaaagaauguuuggagucauucuggaacuuucaauuccuuggaucaugcuaguguaagaagagguuaugaaguauacaaacaagugugugcugccugccacucaaugcgcuucauugcuuaccguaacuuaauuggaguuucccacacugaagcagaagccaaagcugaagcugaagaacaaaugauugaagauggucccgaugacacggguaacuuuuucaaaagaccaggaaaguuaucugacuacuuccccaguccauaccccaaugaagaagcagcucgugcugccaacaaugguuccuacccuccagauuugagcuauauuguaucugccagacauggaggcgaagauuacauauuugcccuuuugacggguuacugcgacgcgccagcgggcgugguccucagagacggacaauacuucaaccccuauuuccccgguggugccauuucgauggcacaagcccuauauaaugaaaccauagaauacagugacggaacaccagcaacugccagucaacucgccaaagacgucgcuguguuccuaaaaug

SEQ ID NO: 3849 - RNA, 779 nt, Diabrotica virgifera
agagaaacauacucucgggacauauugaaaaggcucauguaagugauuuucaauucgaaaaccagagaagaacguuuacgagcuaugguuacgcauuagacccaucgauaaguaaugauggagauggacaucuaaaaguugucgguucaacugaagaggguaaaaacguagaaaguguuaagacuguauuugaaacuucaaagauaagacccuuggauaagaggaaaaggaaaagaaaugauaauccgggugauauagaaggauuuuugggaccauggggugguuuuguugaugaacaaaaaguuucuagaccaacggaggaagaacaggcugaguuagaugaaauaacuucuaaaaagaauaagaaagguaaaccaacagaggacaaaccaauugaggaaaagucuguauugcauaucaaagauccaguggacuaucaaggaaggucuuuuuugcaugcuccacaagauguugggguuaaucucaaaucugauacaccuccagagaaauguuuuuuacccaagucccauauucauacauggacuggucacuccaaagguguugcagccaucaggugguuucccagaacggcacauuuguuccugucugcuaguauggauuguaggauuaagaucugggaaguuuauaaugagagaagaugcauuagaacuuacuaugggcauagacaagcugugagagacaucaacuuuaacaauucuggaaagcuuuuucucucagcuggauaugacagguauauuaaacuuugggacacagaaacu

SEQ ID NO: 3850 - RNA, 664 nt, Diabrotica virgifera
ccacuuuuugaaaagaggccuagaaauuuuggaauuggucaggauauucaaccuccccgugauuuaucucgauuuguaaaauggccaaaauacauccguauucaaagacaaaaggcuguacuucaaaagagauugaaaguuccaccaccaauuaaccaauucucucaaaccauugacaaacaaacagccacccaauuauuuaaagucuuggaaaaauacaggcccgagacagcccuucaaaagaaaaauagguuaaaggcuaaggcugaagcuaagguugccaagaaagaggaggcaccugcuaaaaaaccaaacacauugaaggcugguaccaauacaguuacuaagcugaucgaacagaaaaaagcccaauugguuguuauugcacacgauguugacccaauugaguugguucuguuccuaccagcccucugcagaaaaaugggugucccauacugcauaguuaaagguaaagcaagacuuggacuucuaguaaggcgcaagacuuguucaucuguagcucuuacacaaguugacucuggagacagguccaacuucaacaaacuuuuggaaguaaucaaaacuaacuucaacgaccguguugaugaaaucaggaggcacugggguggugguuugcuuggauccaaaucugcugcucguauug

SEQ ID NO: 3851 - RNA, 662 nt, Diabrotica virgifera
gauccagaaagugguggaauuagugccugccuauaccacgauccccauauuuuacauacacuuagugcuguucaaauucucugcaucuacaauaaauuagaggcaauaaacguagaggguguuguuaaauauaucgcaagccuucaguuacccgaugguaguuuuacaggagauaaauggggugaaguugauacuagguucucauuuugugcaguuaugacauuaucguugcuuaauaaaauggaugcaauugauguaaauaaagccguggacuuuguuuuacaauguaaaaacuuugauggggguuucggaucuaggccacuuucugaaagucaugcaggguuaauguauugcuguguuggcuuuuuaucuaucacaaauagguuagaugccauugauagagacacccuugcuuggugguuaugugaaagacaacuaccaucuggagguuuaaaugguagaccagaaaaauuaccugauguauguuacucaugguggguguuaucaucauuaaccauguugggcaggcuucauuggauugaugcgaaugcuuuaaaaaacuuuauuuuggcuugucaagacacagagacuggaggauuugcagauaggcccggugauaucgcagauccuuuucauaccauauuugguuuagcagcauuguc

SEQ ID NO: 3852 - RNA, 732 nt, Diabrotica virgifera
ggaaccuuauauggcuccugcucuauucccuaucacucuagaagccaugaagucggaaaacgaugcuguuucucuacaggguaucgaauucuggucuaacguuagugaugaagagguugauuuggccaucgaagauaccgaagccacugaagcaggucgaccaccuacaagauguucacggcacuacgccaaaggugcccuacaauauauaguaccgauucugcugcaaaaauuaacgaaacaggaagaacuggacgacgaagacgauuggaauccuugcaaagcagccggcguuugcuuaaugcuucucgccacguguugcgaagacgaaaucguuccacacguucugcccuucaucaaagaaaauauuaagucugauaauuggcgauuccgagaugcuucuuugauggcuuucggaucuauuuuaggugguuuggagaguacuacuuugagaccgcuuguugaacaggcgaugccgaccuugauagaucugauguacgacaauagcguuaucguaagagacacagccgccuggaacuucggcagaauuugcgaaaucauuccggaggcggccaucaacgaaaccuuccucaaaccgcuauuagaaagcuugaucacaggccucaaggccgaaccucguguugccgccaaugucugcugggcguucucuggauugguggaggcagcuuacgaaaaugccgacguuaaugaagaaaccgguacuccagauac

SEQ ID NO: 3853 - RNA, 751 nt, Diabrotica virgifera
auuugacuugguuugugcagcguauaaagccucuaaaggacuuagacauugaucuacaagaacaaguugagcagguucugcuaaacugggauaauggaaguguaccgggauggccaaaagaaacagggucugcacuaacaaauguuggagcccacuuggaccucucugcauuuucaaguugggaagaauuggcaucguuagguuuagacagacugaaaucugccuuaauggcguuaggauugaaauguggagguacuuuggaagaaagagcucaaagauuauucucaacaaaaggaaaagguuccuuggauccuucacuuaugacgaaaaauaacaaaggcaaagccaacaaagaaaaggaguuauugagacaaagagaacuugcaacuuuagaagcccaaguguacagauuagcagagugggucucaccgcagagagcugcgacaaaagaaaaugugcaaagaaaacaagcucguacugacggagaaagagacgacagcgaaaaugaagaaagcgaagaugauaguccugaugaaggugacgaugauguuccguauaauccaaagaaucuuccuuugggaugggauggaaaaccuauaccguacuggcuguauaaacuacaugguuuaaacaucagcuauaauugugagauauguggaaauuacguuuauaaaggcccaaaagcauuccaaagacauuuugcagaauggagacacgcccacggaaugagaugccuugguauuccuaacac

SEQ ID NO: 3854 - RNA, 504 nt, Diabrotica virgifera
uuggaacuuucaaagcguucgacaagcacaugaauaugauauuaggcgacugugaagaguuucggaaaauuaaaucaaaacuguccaaaguugaacgugaggaaaaacgaguauuaggauuuguuuuacugagaggagaaagcauaguuucuuuaacaauagaaggcccucccccaccagaagaagguuuacccagaguaccaaucccuggagcagccccaggaccaggaauugguagagcuggagguagaggaaugccaccaggcauggcagguguaccuguaggccuucaaggaccuguaagaggagugggaggaccaucccaacaggucaugacaccaggagguagaggccaaguaucugcaccuccacagaugaaucaaggaccaccaaggaugggaggaccaccaccaggcaugaugggaccaccucccgguaugaugggcauggcuccccaaaugggaaugggacguggaggaccaccgccaaugggaaugagaggac

SEQ ID NO: 3855 - RNA, 743 nt, Diabrotica virgifera
aagucacaaggggcuuuuaacaauuuaauucgggaaaugaaggaacaugauauucaaaaauauuucaauuaucuuagaaugcauccuugcacauuucaaaaauuauuuagucuaguuggaccagcauuagcaaaaacauauuguguucgugaaccaauuucgccagaagaaagacuugcuauuacuuuaagauaccuugcuaguggagacaguaugauguccauuucauaugcauuuaggguugcucacaauacaguuuccaaaauuauaaaggaagcaugcgaugcaauuugggauuguuuaaaccaagaccagcugcuaacaccaagugaagaagcuugguuaaauaucgcugaagguuuuggagaaagauggcaacugccucauuguguuggagcaauugaugggaagcauguaguaaugcaggcaccuucaaaaucaggcucuacauucuucaauuauaagggcagccacaguauaguuuuguuagcccucugugaugcaaguuaucgcuucacauugguggauauuggagcugaaggaagacacagcgauggggguauauucaaaaauuccaauaugggaaaauuaauuaauacaaauaauauaaauuuuccucaaccuucauugcugggucaaggagauacuccuuucaauuuuuauauuguaggugaugaagcuuuuccucuaacuacuucaauaaugcguccauauccaggucacuuucuuccucgagauaagcg

SEQ ID NO: 3856 - RNA, 781 nt, Diabrotica virgifera
uacaugcaguuugcccuaaugcauagaucuccuucuaucuccgaagauaaggccgccgaaauaaucaaccauuuaucucagaaagauaacgagacaaaacagaaaaugcagaugauggaaccguuugacaauaaaucaauaauagcucaaagacucucguucacuaaucgagaaaugaagaaagaauaugaaccaauggacaccaacgauuacuauuccuacuugcauaauaacgcagagaauaaaccgaaucgguuuuaugacggugcuuacagaccgaugccgguuagcagaaucuacaagaacaucagauauaagguuuggucgccuggauguuuacaaccgaaucagaaacauaagauaccuacggauaaagaaaucauggaguuguuguauagaaugcaaauaacagucacgccgccaguuaugccggaugauacaagaaagugcauguuuugucaggguguuugugauggaguagcugauggcacggcaagauuacuuaacuuugaaguugauaaauggguucacuuaaauugcggucuuuggucugacggcguauacgaaacggugaauggggcguuaaugaauuuggagaaugcuuuacaaacaagccuaacgacgcccugcguacauugcaauauguuaggugcuacuauaagaugcuucaaaacgagauguuccaguguguaccaucugaauugugcaguaaaagacaauuguguauuuuucaagaacaaaacugucuauugcauagcgcaugucccuaagaacgaaaagg

SEQ ID NO: 3857 - RNA, 707 nt, Diabrotica undecimpunctata
ugaaagucauuccaguggaggugaggaagcuccaacgaaagaugugcaagaaccaaagccugggccuucucaggaaccugaugauaaggaaaaugaugaagaugaacccgcagaugaggaagcugcuaauucguggcugaaugaguguuuugaugccuaugaagcugguggauauagucccaaguuucuuacuccagaugaaauagagccaggaacuauuguuguuauagaagaagaugaucugaaaagauuggaauuugcaagaauucaggugguugguaaaggaaaaaccguggaaaauguuauaacuaaggaagaauugauguuacaaaaagaagcucguaagggcauggaugcagaugaggcacaguucucuguagagcaagcuuuggacagucaagucuaucuguggucugauaaauaccguccuaggaaacccagguauuuuaauaggguacacacaggauuugaauggaacaaauacaaucaaacacauuaugauauggauaaucccccuccaaaaaucgugcagggauauaaguuuaacauauucuauccagauuuaaucgacaaaaguaguacuccagaguauuaucugacuccuugcccagaaaauaaagaauucgccauauugagauuucaugcugggccuccauacgaagauauugccuucaagauugucaauagagagugggaguauucguaca

SEQ ID NO: 3858 - RNA, 728 nt, Diabrotica undecimpunctata
uaugaagcaaccgaggaaaaauuaaaagauauauuuggcgaaguuggacaaguacuaucuuuuaagcuuguguuugaucgugaaacuggaaagcccaaaggauaugguuucugugaauacagagaucaagaaaccgccuugagugcaaugagaaauuugaaugguuaugaaauagggggaagaaauuuaagaguggacaaugcuuguacugaaaaaucuagaauggaaaugcaaaaucuucuuaaccaaccuauaguagaaaaucccuauggagaggcaguucaagcugaaaaggcuccugaggcuauaaguaaggcaguugcaucuuuaccuccugaacaaauguuugaauuaaugaagcaaaugaagacaaccauucagaauaauccaacagaagcaagacagaugcuuuugcagaauccacagcuugccuaugcucuuuuacaagcucaaguuguaaugaaaauuauugacgcagcuacugcaguuaguuuacuucauccuguaaaccaagugccagcaacacugaugccuggagacaaaaauguuccuguucaaguaccaauuaguaaucaguacagggagccuccagcaccuguccaaccaccaagacaggaauuucagccuguuccugcuccuguuauacauccaucccagaaucaaguauuugcaggucaagauauagaucuaagauccauuggugcugugccagaucugagauuaaggcc

SEQ ID NO: 3859 - RNA, 775 nt, Diabrotica undecimpunctata
cgagagcagcuaaaagaucuuacaaaacaauaugauaaaucagaaaaugaucuuaaagcuuugcagaguaugggccaaauaguuggagaaguacucaaacaacucacugaagaaaaauuuauagucaaagcuaccaaugguccccguuaugugguaggaugucgucgucaacuagacaaagcaaaguuaaaagcaggaacuagaguagcauuggacaugacuacauuaacuauuaugcgauauuugccuagagaaguggacccauugguguauaauaugagucaugaagauccuggagauguuacuuauuccgcuauuggugguuuaucugaacagauuagagaacuucgagagguuauugaauugccuuuguugaauccagaauuguuuaugagaguuggaauuaccccaccuaaagguuguuuauuauaugguccuccagguacuggaaaaacucuacuagcuagagcuguagcaucucaguuggaugcaaauuuccucaaaguagucuccagugcuauuguugauaaauauauuggagaaucugcaagacugaucagggaaauguuuaacuaugcuaaagaccaucaaccuugcauuauuuucauggaugaaauugaugcuauuggugguagaagauuuucugaagguacuucagcugauagagaaauccaaaggacucuuauggaacugcuuaaccagauggaugguuuugauucauuaggacagguaaaaaugauuauggcaaccaacagacccgauacucuagauccug

SEQ ID NO: 3860 - RNA, 666 nt, Diabrotica undecimpunctata
ggcuauuucucaugcagguacuugucuaggcauuuuagcaaaugauggaauuuuguuggcugcugaaaggcguaacacuaacaaauuauuagaugagguuuuuauuucagaaaaaauauacaaacuaaaugaugauaugguuuguaguguagcuggaauaacaucugaugcuaauguuuuaacaaaugaauugagacuuauaggucaaagauauuuauaucaguauggugaaucuauuccuugcgaacaauuaguuuccuggcuuugugaugucaagcaggcauacacucaguauggagguaaacguccauuugguguuucaauauuauauaugggaugggauaagcauuauggguaccagcuguaucagucagaucccaguggcaacuauucugguuggaaagcuacuugcauaggcaacaacagcucagcagcaauuucaaguuuaaaacaagaauauaaagaaggucaaaugacuuugaaggaugcaaagacguuagcagugaagguucuggcaaaaacacuggauauggcaaaacuaacuucugaaaaaguggaaauggcuacucuuacccgcaaaaaugauaaaacuaugaucaaaauuuuaagcggcaaggaaguggaggaacugauuucagaguaugaaaaaagugaagcugcuguaga

SEQ ID NO: 3861 - RNA, 680 nt, Diabrotica undecimpunctata
cgaagaagacaaacagcuucaggaugaacuaaauuuauguguugagaaacuccaggauaaugaugaaaagagauacuugccugcucugcaagcuuuaucaaaucauauucaagccucaacuacuucgaugacuucuguaccuaagccguuaaaauuuaugaggccccauuaugacaccaugaagacaguacaugaaaaaauaacugauccugacacuaaaaaagugugugcagauauuauaucuguuuuagcuaugacaaugggagaagguagagaauguuuaaaauaccggcuucuuucuaauuuggauaaaauuggugaauggggacaugaauacguuaggcauuuggcaggagagauugcaggagaaugggccgagacugauuuuauaguaaacacugaaauuagagagaaacugauuuuacuuacaaaacaaauugugccauacaacauggcacacaacgcagaagcagaagcaugugauuugcuuauggaaauugaaaggcuugaucuacuagaacaguauguggaugaaaacauuuaccacaggguguguuuauaucuuaccaguuguguaccauauguggcagaucccgagaauacuacucuacuacagacugcucuuuuacuguuuagaaaguucgaucaauauccacaggcgcugagauuagcuaugcagu

SEQ ID NO: 3862 - RNA, 664 nt, Diabrotica undecimpunctata
ggagguccuuacgugaauacagcauggucaucuaguucgauagaggauggacguccaccaagccaagagguacuagucaaagagugcgugaauuguggugcuaguguuacaccccuuuggcguagagacgguaccgggcauuaucuauguaacgcgugcggguuauaccacaaaauuaaugggguucacagaccuccgauuaggccuucgaaaaaaccacaggcgacaggaaacagaagaaaugguguaucaugugcaaauugcaaaacaaauaacacaacucuuuggcgaagaaauaaucaaggggaaccuguuugcaacgcuugcggacuuuacuuuaaauuacacgggguuaaccgaccgaugaguaugaaaaaggauggcauccaaacacguaagagaagaccaaaaaacucugguggaaauccagguccaucuggccaaguccggaucggcaacaucuaccaauaucaacaugcuccagaacuugaaauacaacaggacaccuaccaguugccuauaaacguauauccuucacccacucaaggaccuuacagacaauacgcagcugagaaucuucgaggcuuaaaugcucagccauugcaaccaauuauugccacagaugacgaacagacaagcgucauaacuucuaccucacagcaag

SEQ ID NO: 3863 - RNA, 794 nt, Diabrotica undecimpunctata
ccauuugcagauguggauucugccuuuacuuuagccuaugcgauaauaaugcucaacguugaccaacauaacgaaaaugcaaaaaaacaaacgacccccaugucggcuaaugcuuucaagaaaaauuugaagggcguuaacggagguaacgauuuugacgaagaaauguuagaugauauauauacaacaauaaaaaacgaagaaauaguuaugccagccgaacaagccggguuaguuagggaaaauuauuucuggaagauccugcugaggaagggacagacaaaagauggcauguacauacaugauaauagugguacuuacgauucugagcuuuuccagauuguguauggaccuauaguagcagcucugucuucuguuuacgagaaggcugaaaacgaaaguguacauaagaaagucaugcaaggauucgaaagaugcgccuuuaucgcugcaaaucucaauaugucgacaaauuuggauaugcucauucucgguauuuguaaauuuacuguguuuuacaaccaacagaaacagaacaacauugugguucaauuuggaaugaacagcaaggcgcaguuggcccuuaggacgguauuuuuccuaauucaucaacacggaaacaccaugagggauggauggaaacacuuauuugaucucuuguuagcacucuauagcaacggacuguugucaaaaacguuuguagagguagaagacuuuauugaaccaaguggcaaauuaauucuagucuacaaggaagcaccaucugcggcgaagcaggauaccgguuuacugag

SEQ ID NO: 3864 - RNA, 496 nt, Diabrotica undecimpunctata
gcagauaggcgauuugguauucaagcccaaacaguagcuacaaauuuccgaaaaaucuuugaaaugggaccacauuuauauguaggucuuccaggauuagcaacagauacucaaacaguuauggaaaaacuccguuuccgaaaaaacuuguaugaacuuaaggaaaaucgaaaaauaucuccaaaaguauuugcgucuaugauaucaaauauguuguaugaaaaaagauuugggccauuuuuuguggaaccuguaguagcuggacuucuaccugauacuuaugaaccuuuuaucuguaauauggauuuaauugguuguauaaaccaaccuucagacuuuguuguugguggaacagccucagcacaguuguaugguaugugugaagcacuuugggaaccuaaccuaggaccugaagaucuuuuugaaacaaucucucaagcacucauuaaugccuuugacagagaugccauuucugguuggggagcuacaguauaca

SEQ ID NO: 3865 - RNA, 773 nt, Diabrotica undecimpunctata
caaaacaucugugcuagcuguaaugaucauaugccaaggcacgucccgauacucuuacagcuucuucaccaagcggauuccuuugccaucaccaacacagcuaccuugggucuucuaagaggaguggccucgauaauaggucgaaugccgcacgaggaguugacgaaguccuuacgggaauuauguucuaugcagcucaauccgauaugucaaaucauagaacaggauguucauccagugaagggggccaacacagauccgguaauguggcucgauagacuuagugcagugcuuagauauguuaauguacauauucccgaagguguggaaaacccuuguaaaccgguaauucucgaaguguggccgguauugucucgcacguucgauaaauaccaaagugacauuaggauaauggagagauguugucgcgcugugcguuucaugcuucggugcguugcgcaagaagugcgagaacucuuagaaagucuaguuggacaaauagugaggaucuauacguuauaccaacauucguguuuucuguaugucgguaguauacuuguggacgaauacgcuauagauccgauaugcgugccaggacuacuggauaugcuacaagcguuucuagaaccuaccuuucacguguugcaggaggagaacggguugaagaaucaucccgauacgguagaugacuuuuuuagguugugcgcaagauuuaugcagagggcaccuuuagcauuuuuaaaauguucuuccuugguccacaucuuacagug

SEQ ID NO: 3866 - RNA, 744 nt, Diabrotica undecimpunctata
caauccuccaccaccaaauauaccauccaguggcgguacaaugauucaaagaccuacuggugcucccuauucaccaaugagagguggaauuauuccgccacagcagggaaauaaaaggccugcagauaauaggacccaacugcaacagaaaaguaaugaauacagccauaguacaaguaagaagaagaaaaagcuggcagauaaaauccugccacagaaagucagagauuugguuccagaaagucaagcuuacauggaucuauuagcauuugaaagaaaauuggacucuacuauaaugagaaaaagauuggacauccaagaagcucuuaagcguccuaugaagcaaaaaaggaaguugagaauauuuauuuccaauaccuucuauccugccaaggaaccucagccugaaggacccgauggaccaugucaggaaggcacuguugcuucuugggaauuaagaguagaaggucgucucuuagaagauccaaagaacgauccaaauaaaguuaaacgcaaguuuucuucuuucuuuaaaucccugguuaucgaauuggauaaagagcuguauggaccagacaaucauuuaguugaauggcauagaacacuaaccacccaagaaacagaugguuuccagguaaaacgcccuggugacaagaaugugagauguacuauuuuguugcuucuugauuaucaaccucugcaguuuaagcuugauccuagacuagcuagacuuuugggaguuca

SEQ ID NO: 3867 - RNA, 313 nt, Diabrotica undecimpunctata
agaacccacauuagaugaguuagaacaaaaaaugagagaagcugaaacagaaucacaugaggguaaaaggaaaaaugaaucauuguggccaauuuucaaaauccaucaucagaaauccagauauauauuugaucuuuuuuauagaagaaaagcaauuagcagggaacuauaugacuauugucuugaggaaaacauugcagauaaaaauuuaauagcgaaguggaagaagcaaggauaugagagucuuuguugccuacgauguauucaaacaagagacacuaacuuuggaacaaacuguauuugucguguaccu

SEQ ID NO: 3868 - RNA, 702 nt, Diabrotica undecimpunctata
ggaggaugaauucagaaccaucagacaaauaguacaaaaauaucaguauguugcuauggacacagaauuuccugguguaguugcaaggccuauuggagaauuuagaaguucugcagauuaccaauaccaaaugcugaggugcaauguagauuuauugaggauaauacagcuuggacugacguuucuugaugauaacggaaaaacuccagguggugccuauacuacauggcaguucaacuucaaauuuaaccuucaagaagacauguaugcacaggauaguauagaccuccugcaaaauucuggaauucaguuuaagaaacaugaggaugaagguauugaaccucucgaauuugcggaauugcuuaugucaucugguauuguccugguggaaaauauaaaauggcuauccuuccauucugguuacgauuuuggcuaccugauaaaacuguuaacggacaacaauuuaccucaagacgaaacagaauucuucgauuuguuaaaauuauauuuuccuaccauauaugauguaaaguaccuuaugaaaucgugcaaaaaucuuaaaggaggauuacaagaaguggcagaacagcuagaacuugaaaggauuggaccacaacaucaagcagguucggauucucuucugacaggaauggcauuuuucaagaugaaagagauguucuucgaagacaccauagacgacuc

SEQ ID NO: 3869 - RNA, 733 nt, Diabrotica undecimpunctata
ucugguacugguaaaacagccaccuuuucuauuucgauuuuacaagcuuuagauuuaacaaugcgagaaacacaaguuuuauguuugucuccuacuagagaauuggcuguacagauucaaaaaguuauucuagcuuuaggugauuuuaugaauguucaaugucaugcuuguauuggagguacaaaucuuggagaagauaucaggaaacuggauuauggacagcaugugguuaguggaacaccugggagaguuuaugauaugaucagaagaagagcucuaagaacaagaucuguaaaaauguugguuuuggaugaggcugaugaaauguuaaauaaaggauucaaagaacaaauuuaugauguauauagauuccuucccccaucaacacaaguuguacucauuucagcuacacugccucacgaaauuuuggaaauuacuuccaaauuuaugacagauccuauuaggauuuugguaaaacgugaugaauugacauuggaagguauaaaacaguucuuuguggcaguugaaagagaagaauggaaauuugacacccucugugaccucuaugauacauuaaccauuacucaggcugucauuuucuguaacacaaagaggaagguggacuggcugacagagaaaaugagggaaaacaauuuuacaguuaguucaaugcauggagauaugccacaaaaggaacgugacaauauuaugaaagaguuuagaucgggacaga

SEQ ID NO: 3870 - RNA, 768 nt, Diabrotica undecimpunctata
gguagggaacaagcuuguaauuuaucagauaucaaaguuauuaagcaacugggaggaacaguagaagauacugaauuaguggaaggaauuacuuucccacaaagaucugcaaaugugucuggaccaaaaaggauugagaaagcuaaaauugguuuuauccaguucuguauuucaccuccaaaaacagauauggaucacaaugucauugugucugauuaugcugcuauggauagaguauuaaaagaagagagagcauauauuuuaaauaucgucaagcagauaaagaaagcuggauguaauguacuuuugguucaaaaaucaauuuugagagaugcaguuucggaucuugccuuacacuuuuuggauaaaaucaagugcaugguuauuaaggauauugaaagagaagauguugaauuuguauguaaaucuuuaggcugccguccuauugcaucuuuagaucauuuuguugcugaaaacuugguuaccgcugauuuaguugaagagguuggaguggcaggaaauagaauggucaaaauuacaggugcacaaaaugcaggcaggacaguaacucuacugguuagaggauccaacaaauugguucuugaagaggccgauagaucucuucaugaugcucuauguguaauucguugccuuguucgcaagaaggcacuuauugccgguggaggagcacccgagauugagguggcucuuaaacuagcugccauggccaacaaacuggacggcauugaugcuauuuguacaagggca

SEQ ID NO: 3871 - RNA, 788 nt, Diabrotica undecimpunctata
  misc_feature (184)..(184): n is a, c, g, or u
aacacagcaaugccuuaguagauguucugccaccagaggcagauucuucaauaagcaugcuccaggcugaugaaaaaccagauguucaauacagugauauuggaggcauggauaugcaaaaacaagaaauaagggaagcuguagaguuaccuuugacucacuuugaauuguauaaacaaauugncagugauauuggaggcauggauaugcagaaacaagaaauaagggaagcuguagaguuaccuuugacucacuuugaauuguauaaacaaauugguauugauccccccagagguguguugauguauggaccuccuggaugugggaagacuauguuggccaaggcuguugcucaucauacuacagcugcuuuuauucguguagucggaucagaauucguacagaaauaucuuggugaagguccucgaauggugagagauguguuccguuuggcaaaagaaaauucuccagcaaucaucuuuauugaugaaauugaugcaauugcaaccaaacgauuugaugcgcagacaggugcugaucgugaaguccagagaauuuuauuggaauuacuuaaccagauggaugguuuugaucagacaacgaauguuaagguaaucauggcaacuaacagagcugauacauuagauccugcacuuuugagaccuggccgucuggacagaaaaaucgaauuuccuuuaccagauagaagacaaaaacguuugauuuucagcacuaucacaucuaaaaugaauuugucagaggaggucgacuuggaggacuauguagcu

SEQ ID NO: 3872 - RNA, 343 nt, Diabrotica undecimpunctata
gacuugggaauggaugaagaagaagaggaagugguuccuuuaccaaauguaaacucugcuauacucaggaaagucauucaaugggcgacuuaccacaaagacgauccuccaccaccugaagaugacgauaauaaagaaaaaagaacagaugauauuuccucuugggaugcagacuucuugaaaguggaccaaggaacccuuuucgaguugauuuuggcugcuaacuaucuggauaucaagggacucuuggaugucacauguaaaacuguugcuaauaugauuaaagguaaagcuccugaagaaaucagaaagacuuucaacaucaagaaugacuuuacagcgu

SEQ ID NO: 3873 - RNA, 696 nt, Diabrotica undecimpunctata
gauugcaagcaauuaaccgaaaaucaaguuaaaacacuaugugauaaggcuaaagaaauauugucaaaagaaucaaauguacaagaagugaaaugcccaguaacaguauguggagauguccauggacaauuccacgaucugauggaacuguuuaggauaggagguaggagcccagauacuaauuaccuguucaugggagauuauguagaucguggauacuauucuguugagacugucaccuuacugguagcacugaaagucagguacaaagagagaauuacaauuuugagaggcaaccacgaaucaagacaaaucacacaaguuuacggauuuuacgaugaaugucuaaggaaauacgguaacgcaaauguuuggaaauucuucaccgaucuguucgauuauuugcccuuaacagcacucgucgauagucaaauuuucugccugcacgguggauugaguccuagcauugauaccuuggaucacauuagggcacuagaucguuuacaagagguaccucaugaagguccaaugugcgaucuucuauggucugacccggacgaccgcggaggcuggggcaucucuccccguggagccggcuacaccuucggacaggacauuucagaaacguucaaccauaccaacggucugucuuuaguaucuagagcgcaucagcucgucauggaggguuacaauugg

SEQ ID NO: 3874 - RNA, 643 nt, Diabrotica undecimpunctata
uugcaauucaagcagacaauaauggaaugcaaauuuuuguaaaaacacucaccggcaaaaccaucacccuugauguugaaccgucaaauaccaucgaguaugccaaagcuaaaauucaagacaaagaagguauuccaccgaaucaacaaagauuaaucuuugcuggaaagcaguuggaagacgaucguacuuucucagacuacaauauucaaaaagaaucuacccuacauuugguacuucgucuuaggggagguaugcaaauuuuuguuaaaucuuuaacuggaaagauuguuacccuagaaguagaaccuucagauacuauucaaaaugucaaagcuaaacuugaugauaaaauagguguaccaccagaacaacaaagauuaaucuuugguggaaaucaguuggaagauggucguacucucucagacuacaauauucaaaaagauucuacauucaauuugguacuucgucuuagaggagguaugcaaauuuuuguuaaaucuuuaacuggaaagauuacuacccuacaaguagcaccuucagauacuauucaaaguaucaaagcaaaacuugaugauaaaauagguguaccaccaagucaacaaagaauaaucuuugcuggaaaugaguuagaagauggccg

SEQ ID NO: 3875 - RNA, 685 nt, Diabrotica undecimpunctata
ggauuugaaaugcaacccaagguauacaaagauuguaaaauagcccuguuaaacauugaauuggaacuuaaagcugaaagagauaaugcagaaguaagaguagauaauguaaaagaauaucagaaaauuguugaugcagaguggacaauucuuuacaauaaacuucaaaaaauuuaugagucuggagcuaauguuguuuuguccaaauuacccauaggagauguugcuacucaauacuuugcugacagggauauguucugugcuggucguguucaagaagaugauaugaaacguacgcugaaagcauguggaggugcuguaaugaccacuguuaaugacaucaacgauucuguacucgguaaaugugagcuguuugaagaaaaacaaauaggaggagacagauuuaacuucuuuaaaggcugucccaaugccaaaacauguacuuuaauuuuacguggaggagcagaacaauuuuuagaagaaaccgaaagaucacuacaugaugccaucaugauuguuagaaggacuauuaaaaaugaugcaguuguagcuggugguggugccauagagauggaauuaucaaaaauuuuacgggaucauucucguacaauugccggcaaagaacagcuucugauuggugcaauagcuaaggcauuagagaucauccccagacaauuaugcgaua

SEQ ID NO: 3876 - RNA, 747 nt, Diabrotica undecimpunctata
  misc_feature (84)..(84): n is a, c, g, or u
ugggucucacuagaacguauacaauucguuggugcuuguaauccuccaacugaucccggcaggaagccucuaucccaccgauunguggaacagaaagguuuuuacagagccucggaucaauccugggucucacuagaacguauacaauucguuggugcuuguaauccuccaacugaucccggcaggaagccucuaucccaccguuuccugcggcacguacccguuauuuauguagauuacccaggagagacaucuuugaaacagaucuacgguacuuucaccagagcuaugcuaagguuggcgccuggucugaaagguuaugccgaaccauugacuaaugcuaugguugaauuuuauuuggcaucucaagauagauuuacucaagauaugcaaccucauuauguauauucuccaagagaaaugacgagauggguaagaggaauuugugaagcuauaaggccucuugauaaucuucauguugagggguugguaaggcuuugggcccacgaagcucuccggcuauuccaagacagauuagucgaagacaccgaaagacguuggaccaacgaaaacauugaugcuguagccuuaaaacacuucccaucagcuaacugugagaaagcuuuggaaagacccauucuuuacagcaauugguuaucuaaggauuauguaccuguuggaagagaacaacuaagagaauauguaaaggccagacuaaaaguuuucuacgaagaagagcuugauguu

SEQ ID NO: 3877 - RNA, 696 nt, Diabrotica undecimpunctata
aaaguuguuuuggccacaaauauagcugaaacgucuuuaacaauagacaauauuauauacguaauagauccugguuuugcuaaacaaaaucauuucaauucgagaacagggauggagaguuugaugguaguaccaauaucuaaagcuucugcaaaccagagagcuggcagagcaggcagaguagcagcuggaaaauguuuuagauuauacacugcuuggucuuauaaacaugagcuagaagacaauacuguaccugagauccagcgaauaaauuuaggaaacgcuguacucauguugaaggcacuaggaauaaaugacuugguacauuuugauuuuuuggauccuccuccucaugagacuuuaguguuagcauuagaacaauuauacgcuuugggagcuuuaaaucaucacggagaauugaccaaauugggcagaaggauggcugaguuaccuguagauccaaugauggcgaaaaugauuuuagcuucggaaaaauauaaaugcucugaagaaauagugaccauaggagccauguuaucuguaaacggagccauauuuuacagaccaaaggauaaaauaauucacgcugauacugcucgaaaaaauuucaaucacuuagcaggagaucauuuaagucuucuuaauguuuauaaucaauggagggauucugauuacucccuacaaugguguuacgaa

SEQ ID NO: 3878 - RNA, 693 nt, Diabrotica undecimpunctata
uggagaauuuucgaagagcaauugguuugagaauuagggaaaccaaagaaguuuaugagggggaagucagugaauugacaccaguagaaacagagaacccugcuggagguuacggaaaaacuguaagucauguuaucauugggcuaagaacugcaaaggguaguaaacagcucaaacuggaucccaguauauaugaagcacuccaaaaagagaaaguugaaguuggagacgucauuuauauugaagccacaaguggugcaguuaaaagacaaggaagaucugaugccuaugccaccgaauuugauuuagaagcugaagaauauguaccauuaccaaaaggagauguacauaaaaagaaggaaguuauucaggacguuacauuacaugaucuagaugccgcuaaugcuaaaccucaagguggacaagacguucugucaaugaugggccaacuucuaaaaccaaagaaaacagaaaucacagauaaacuuagaaaggaaaucaauaaaauaguagauaaauauauugaucaagguauugcagaauuaguuccugguguacuauuuaucgaugaaguacacauguuggauauagaaacauucacuuaucuacacagagcuuuagaaagugccauagcucccauuguuauuuuugcaacgaauagaggucguugucuaauuagaggaacggacgaug

SEQ ID NO: 3879 - RNA, 691 nt, Diabrotica undecimpunctata
gaagggcuagggaugaaaaacuaaugacuaauauucuucaaacucuucguaacaaugguaacguacuuauagcaguagacacggcaggcaggguucuggaguuggcucacauguuggaucagcuauggcguaacaaagaaucuggccuguuagcauacuccuuagcguuguuaaacaaugucaguuauaacguuauagaauuugccaaaucccagauagaauggaugagugauaaauuaaugagaaguuuugaaggcgccagaaauaaucccuuucaauuuaagcacuugcaguggugucacaguuuagcagaauuaaguaaaguuccuaguccaaagguuguucuugcaaguucacccgauuuggaaaguggauucuccagagaauuguucuugcagugguguucuaauuccaacaacaguauuauauuaacaacaagaacauccccugguacuuuagcuagagacuuaauugauaacggagcagaaagaaauauagauuuaacgguagaaaggcgaguaaaacucgaagguguagaacuugaagaauaugaaaaacgacaacgagcgcgaggucacaauguagaaaaggaagaugcagauucggacucugauucugacauagaaaugucuguuaucaccaaagguagacacgacauaguuauuaaacaagagggaaaaauaaaugccgg

SEQ ID NO: 3880 - RNA, 659 nt, Diabrotica undecimpunctata
uuguagucgucgaaacuguugacuaccaacccuucgaaauuggaaauuuuccagcuccaacuaccccugaagaagucggagcccguaucuuaauucaagagagaauagaagaaggugaagauaucgaaaugcaacuagagagugaugaggaagaaucaccaguuacggaaucugguuuaaguaguaugcaggacaagaccaaucggaagacacgcgacgacaccagaauucaagacauggaagaagaaaguuccgaugaagagaaaggagaagacgacgaggaauuaguuuuaccuccgccaccaccgucuauucaaccaccguuacccccuauucccgauaaaguugucgugaaaaaauaugaucccaaacaagcugucaauguuagccgaccaacaaucggagaugauuaucucgugucacccaucacuggagagaaaauaccugcgaacaaagugcaagaacauaugcguauuggucuguuggauccgcguuggguagagcagcgcgacaaacaaauaacggacaaaaugaaccaagaaacaguauaugcugcugguagugccaucgaugcuucauugaaacugcucgccgagcgacguacugauauuuuugguguuggagaugaagaaacagcuauugguaagaagauuggcgaa

SEQ ID NO: 3881 - RNA, 687 nt, Diabrotica undecimpunctata
guguucuucuugguuguuggcgugcuaaaggaguuuuagauguuucuaacaguuuugcaguucccuuugaugaagaugacaaagauaaaucuguuugguucuuggaccaugauuauuuagaaaauauguauggaauguuuaaaaaaguuaaugcuagggaacgaguaguggguugguaccacacuggccccaaacugcaucaaaaugauauugccauuaaugaguuaaucagaagauauuguccaaauucaguucuaguuauuauagaugcuaaaccaaaagauuuagguuuaccgacugaggcuuaucaagcuguagaagaaguacaugaugaugguucaccuacuucuaaaacauuugagcauguuccuagugaaauuggagcugaagaggcagaagaaguugguguugaacacuuauugagagauauuaaagauacaacuguuggcacuuugucucagagaauaacaaaucagcuuuuaggauuaaaaggucuccauucacaguuacgugauauuagggacuauuuaguacaaguuugugcuaaccaacuuccaauuaaucaccaaaucaucuaucaauuacaagauauauuuaaucuuuuaccagauauaaaucaggaugcauuuaauacaucguuuuauguuaaaaauaaugaucaaauguuaguuguuuaucuggcagcuu

SEQ ID NO: 3882 - RNA, 677 nt, Diabrotica undecimpunctata
caaaucgcggaugugauaaggacaugccuugguccucaagcuauguuaaaaaugcuuauggauccaaugggagguauugugaugacuaaugauggcaaugcuauuuuacgugaaauuacaguacaacauccagcugcuaaaaguaugauugaaauugcaagaacacaagaugaagaaguuggagaugguacuaccucaguaauugucuuagcaggagaaauguuaguggcagcugaacaguuuuuggaacaacacauucacccaacaaucauaauucgccaguacagacaagcacuugaagauaugauccaguuauuggaagguccauugaguauaccagucgauagaaaugauaaaaaugcucuugcacaaguuguuaaaggcugcauugguacaaaauucauaaguaaauggucagauuuagcaguaaauauugcuuuagaugcaguaaacacaguauuauuagaagaaaauggcagaacugaaguugauaucaagagguaugccaaaguugagaagauuccuggaggaucuauugaagagucuaaaauuuuaaaagguguuaugcuuaauaaagauguaacacaucccaaaaugaaaagauauauacagaauccgagaauaauacuuuuggauugcgcauuagaauauaaaaaaggggaaucucagacaaaugu

SEQ ID NO: 3883 - RNA, 552 nt, Diabrotica undecimpunctata
aauccuuaugccgacaauggagggaguguaguagcaauagcaggugaagacuuuguaauaauuggugcagauacacguuugagugcuggauuuuccauuuacacuagagaacaaaacaaacuauucccgcuaucaggcacuacaguuuuaggcugugcaggauguuggugugauacucuaacauuaaccagaauccuuaaaucucgcaugcagauguaccaacaagagcauaacaaaacaaugucuacaacugcaugugcccaaauguugucaaccaugcucuacuacaagagauucuuuccuuauuauauaucaaacauucuuguugguuuagauaaugaaggaaagggcuguguuuacagcuaugauccaaucggacauugugaaaaagcuacuuauagagcaggugguucggcuggagcucugcuccaaccccuuuuggacaaucagauuggacaaaagaacaugcuuaaaacaucuggagaaccucuuagucaggagaaagcuuuggcuacacugaaagauguauuuauuucugcugcugaaagagau

SEQ ID NO: 3884 - RNA, 665 nt, Diabrotica undecimpunctata
gcuacucaguggcuauguuuccuggcaaugaacgagaagacguugaaagggguggaaaaauuaucaugcccccaucagcuuuggaacaauugacuagguuaaauaucaacuauccuauguuguuuaagcuugugaauaaaaagacucaucgcacaacacauuguggaguuuuagaauuuguugcugaugaaggaaaaguuuauuugccacuuuggaugaugaacaacuuaguacucacugaaggagauuugguucagauggaaaguguuucccuuccaguuggcacauuuucaaaauuccaaccucucaauccagacuucuuggacauuacuaauccuaaggcagucuuagaaaaugguuuaagaucuuuugcuugccuuacaacaggagaugucauugcaguaaaguacaaucaaaaggcuuaugaguuguguguucuagaaaccaaaccuggagaugcaauuagcaucauugaaugugauaugaauguggaauuugcugcuccuguuggauacaaagaacccgaacaagucaaaaaggaagaagaagaaauggccauagauccugcagauuuaaugccagaaccuucuggauuuguagcauuuagaggugcaggaaaucgacuugauggcaaaaagcguaaagauacuuccggagcugauagu

SEQ ID NO: 3885 - RNA, 698 nt, Diabrotica undecimpunctata
aggaaagguugguggaaaauuggaagacacaacauuaguuaaagguguaguuauugacaaaacaaugucccauccacaaaugcccaaagaacuaaaagauguaaaauuggcuauucucaccuguccauuugaaccaccaaaaccaaagaccaaacauaaguuggauguaagcaguguggaagauuauaaggaacuaagacaguaugaacaugauaaguucaaggaaauaguuggauuaguaaagaaagcuggagcuacauuagcaauuugccaauggggcuucgaugaugaagccaaucauuuauuguuacaacaagaguuaccagcuguaagauggguuggagguccagaaauugaacuuauagccauagcuacuggcgguaggauaguaccccguuuugaagagcuuacuccagaaaaacuugguuaugcugguuugguacgggaaauugcauuuggcaccacuaaagauagaauguugguuauugaagaauguucaaauucacgggcaguuacaauucuuguuagaggagguaaccaaauguuaguagcugaagccaagagaagucuccaugaugcauuauguguugucaggaguuuaguucaggaaccaagaguaguguauggugguggagcagcagaaauugccugcaguuuggcagucgcggcucaagcagaucaacuagcuuccuuggaac

SEQ ID NO: 3886 - RNA, 194 nt, Diabrotica undecimpunctata
ucaaaaggagaaaagaaacguuuugaaguaaaaaaguggaaugcuguagcuuugugggccugggacauuguaguggauaacugugccauuugccgaaaucauauuauggaucuauguauugaaugccaggcgaaccaggcgucagccaccagugaagaaugcacuguagcuugggguguuuguaaucaugcguu

SEQ ID NO: 3887 - RNA, 792 nt, Diabrotica undecimpunctata
gguuggagaaaagcaguagauauugccagaaaagcucuucuagacacugccaaagacaacagcucugauuuagaaaaguucagagaagaucugaugaacauugccagaacuacacucagcucaaagauucugucacaacauaaagaacauuuugccaaacuggcaguagaugcuguguuaagauugaaagguucaggugauuuacagucuauccagcuaauuaagaaaacuggugguaccuuggaagaauccuuuuuggaugaagguuucuuauuggacaaaaaaccugguguacaucaaccaaagagaguagaaaaugcaaaaauccugauagccaacacuccuauggacacagauaaaaucaaaguauuugguucucacauuaagguagauucaauggcuaaaauugcagagcuggaaucugcagaaaaggaaaaaaugaaagauaaagucaacaaaauucuuaaacauaaugcuaauguauuuauuaauagacaguugauuuacaauuauccugaacaacuauuugcugaugcaggaguuauggcuauugaacaugcagauuuugauggaauugaaaggcuagcacuugucacaggaggagagauugucucaacauuugaccauccagaauugguaaaacuaggaacuuguaagcuuauugaacaaaucaugauuggagaagauauccugcuccguuucagugguguugcucuuggagaagcuugcacaauugucaucagaggugcuacacaacagaucauugaugaagcugaccgauccauucaugau

SEQ ID NO: 3888 - RNA, 651 nt, Diabrotica undecimpunctata
  misc_feature (356)..(356): n is a, c, g, or u
gcaucagguagaauaugccauggaagcaguuaaccuagguucagccacaguuggacuaaaaaguaaaacucaugcuguacuuauugcguugaagagggcuucuucagaacugucugccuaccaaaagaaaauuaucaauauagacgaucacauugguauuaccaucucuggacuuacagcagaugcuagaauucuuaguagauauaugcgaaacgaaugcuugaauuauaaguacucuuuggauacuuauaugccguuaaauaggcucauuaguauuuuaggcaacaaaaugcaaacauguacccaaagauaugaccgcaggccauucggugugggucuucuaguagcugguuaunugcgaaacgaaugcuugaauuauaaguacucuuuggauacuuauaugccguuaaauaggcuuauuaguauuuuaggcaacaaaaugcaaacauguacccaaagauaugaccgcaggccauucggugugggucuucuaguagcugguuaugaugaaucugguucccauaucuaccaaacgugcccuucugcuaauuucuacgauugcaaagcuauguccauuggagcucgaucccagagugccaggacuuacuuagaaaaacaucucgaugaacugccauccagugcuuuagaaga

SEQ ID NO: 3889 - RNA, 789 nt, Diabrotica undecimpunctata
ggacuuugccaaauucuacgaaacaaauggucaaauagaagaugcucgccucaucuuugaaaaagcaucccaaguuucuuacgucaaaguagaugauuuggcaacaguguggugugaaugggccgaaauggaaauaaggaacgagaauuaugaugaagcuuuaagacucaugcauaaagcaacuguuaugccuagucgaaaaguagcauaucaugaugacacugaaacaguccaaagucgucuuuauaagucucucaaaguuuggucuauguaugcagauuuagaagaaaguuucgguacauuuaagucuuguaaagccauuuacgacaaaauuauagauuugaagauugcaacuccgcaaauuauuauaaauuaugggauauuucuagaagaaaauaauuacuuugaagaggcauucagagcauaugaaaaaggaauaucucuauuuaaauggcccaauguauacgacauauggaacaccuauuugacgaaauuccuaacucguuauggaggaucaaaacuagaacgcgccagagauuuguucgaacaaugcuuggauggauguccacaacaguuugccaaacaucucuaucugcuuuaugcaaaauuagaagaggaacacgggauggcuagacaugccauggcuguauaugaaaggucaaccaaagcuguuccagagcaagaaauguucgauguuuuuaauaucuacaucaaacgagccgccgaaauuuaugggauucccaaaacgaggcagaucuacgaaaaggcuaucgaguuacuuccagagga

SEQ ID NO: 3890 - RNA, 658 nt, Diabrotica undecimpunctata
cuauugugggagcucuuuguacaagcagggccuuuagucaauguacauaugcccaaagaucgaguaacgacaaugcaccagggcuauggguuuguagaauuuaugggagaggaggaugcagauuaugcuauuaaaauuaugaacaugauaaaauuguaugggaagccuauaagaguaaacaaagcuucagcucaucagaaaaauuuggauguaggggcuaauauuuuuauuggaaauuuagacccagaaguagacgaaaaguuacucuacgauacuuuuucggcguuuggaguaauauuacaaacaccuaagauuaugagagauccugauacugguaacuccaaaggguucgcuuucaucaauuuugcaaguuuugaagcaucagaugccucuaucgaagccaugaauggccaauauuugugcaauagacccauaucagugucauaugcauucaagaaagacuccaaaggagagagacaugguucugcagcugaacgucuccuugcugcucagaauccauuaucacaggcugauaggccucaucaacuguuugcugaugcaccuccaauagguuugaugcccaugucaauggccccaccuccuccaccagucauaaugacaggaaugaugcccccgccaccuccaacacuuucaaacu

SEQ ID NO: 3891 - RNA, 636 nt, Diabrotica undecimpunctata
gcacccaaacuucguuauuuagauuucucagaaagacaugguuacauuaaggguguuguaaaagauaucauacaugacccuggccguggugcuccauuggcaguaguacauuucagagaucccuacaaguuccaaaccaggaaggaauuauuuauugcuccugaaggaauguauacuggacaauuuuuguacuguggaaaaaaagcuaaccuccaaauuggaaauguauugccuguaggaacuaugccugaagguaccauuguaugcaauuuagaagaaaaaacuggugaccguggucgguuagcucgugcaucuggaaacuaugcuacuguaauugcccauaaucaugauacaaagaaaaccagaguuaaguugcccucuggagccaagaaaguuauuccaucaaacaauagggcuaugguugguauuguugcuggagguggucguauugacaaaccaaucuugaaagcaggucgugcuuaccacaaauacaaaguuaaacguaacugcuggccuaagguacgugguguugcuaugaacccuguugaacauccucacggaggugguaaccaucaacacauugguaaagcauccacaguuaaaagaggaacaucugcuggucguaaaguuggucuu

SEQ ID NO: 3892 - RNA, 290 nt, Diabrotica undecimpunctata
aaacaguuagcaaccaaagcugcucguaagagugcgccugccacuggaggaguuaaaaaaccucaucguuacaggccagguaccguagcucuucgugaaauuagacguuaccagaaaaguacugaauuacuuaucagaaaacuaccuuuccaacgucuuguucgugaaaucgcacaagauuuuaaaaccgauuuacguuuucagaguucggcaguuauggcuuuacaggaagcgagugaagcauauuugguagguuuguuugaagauaccaauuuaugcgcuauucacgc

SEQ ID NO: 3893 - RNA, 678 nt, Diabrotica undecimpunctata
caagaugauaugacuggcgauggcacuacaucuacaguuuuagucauaggugaacuauuaaaacaagccgauauuuucauagcugaaggucuucauccuagauuguuaacagaaggcuuugauaaggcuagggcaaaagcauuggaacuacuggacaagaugaagauuccaauugaugcaaacaaagaaacuuugacagauauuugcaggacaaguuuaagaacaaagcuacaucaaaaacuugcugauguuuugacagacguuuguguggaugcuguucuagcuauaaagaaagaugauaaaccuguugaucuucauaugguugaauuaauggaaaugcaacacaaaacagaaacugauacucaguuaauuaaggguuugguccuggaccauggcucacgucauccagauaugccuaaaagucucaacaauugcuacauuuuaacauguaaugucagcauggaauaugaaaaaagugaagucaauucaggauucuucuacaaaacugcagaagagagggagaaauuagugacugcugagcgugaauucauugaacagagaguuaagaaagucauugaauugaaaagaucacucuguaauggaacugauaagacuuuugucguuauuaaccaaaaagguauugaccccaugagucuggauaugcuugccaaagaagga

SEQ ID NO: 3894 - RNA, 651 nt, Diabrotica undecimpunctata
aacguccaacaaccaaaaucugucacagcugcaaaggucauuaaaaagaugaaucccgauaucaauguuguugcacaugagaaucguguuggaccugaaacugaaaaugucuacaaugaugauuucuuugaaaaguuagauggaguugcuaaugcacucgauaauguagaugcuaggauuuauauggacagaagauguguuuacuaccgcaagccucuucuagagucuggaacucuaggaacuaagggaaacacucaagugguggcgccuuuucucucugaaucauauaguucuucucaagaucccccagagaaaagcauuccaaucuguaccuuaaagaauuucccuaaugcuauugagcauacucuacaaugggcgagagauauguuugaaggauuauuuaaacaaaaugcugaaaaugcuucguuguauauaaccgaccccgauuuucuugauagaacuguuaaacuaccugguguacaaccuuuggagguacuggaaucuguaaaggcugccuuaguugaugagagaccuaaagauuuaaaugauugcauugcaugggcacguaaucauuggcaagaacaguauuccaaccaaaucaggcaguuguuguucaacuucccaccugaucaauuaaccaguacaggccag

SEQ ID NO: 3895 - RNA, 612 nt, Diabrotica undecimpunctata
ugaaugugauaaaauguuggaguuauuagauaugagacgugauguucaggaaauauaucguaacacuccccaugaaaaacaagucaugauguucagugccaccuuaaguaaagaaauuagaccaguuugcaagaaauuuaugcaagaucccauggaaguauauguugacgaugaagcuaaauuaacauugcauggucuacaacaacauuauguaaaacuaaaagaaaaugaaaagaauaaaaaguuauuugaguuacuagauguuuuggaauucaaccagguuguuauuuucguaaaauccguacaaagguguguggcgcuggcacaacuacugacugaacaaaacuuuccagcaauaggaauccacagaggaauggaucaaaaagaaagacugucccgguaugaacaauucaaggauuuccaaaagagaauucuaguagccacuaacuuauuuggacgugguauggauaucgaaagagugaacauugucuucaacuaugauaugcccgaggauuccgacacuuaccugcacagaguggcgcgagcuggucguuucgguaccaaaggucuagccauuaccuucguaucagaagagggggaugccaaaauauu

SEQ ID NO: 3896 - RNA, 671 nt, Diabrotica undecimpunctata
ucuaucauucaaggguugccgaauuaaccgauaaauuggauucaauuagaggcuuuuuacauucucgucuacguacugcuacacucaggaaugauuuugaaggucaagcugugcuuauaaauugccuguugagaaauuauuugcauuauucuuuguaugaucaagccgauaaacuagugaguaaguguguauuuccugaaacugcaaguaacaaugaaugggcaagauucuuguauuacuuaggcagaauuaaggcugcacgauuagaauacaguguagcacauaaacaucucgugcaggccaugagaaaagcaccccagaaugcugcuauugguuucagacagacuguucaaaagcuaacaguuguaguugaacuauuguuaggagauauaccagaaagacagguguuuagacaaucuaguaugaggcacucccuugcuccauacuuucaauuaacacaagcaguuagaaugggaaauuugcaaagauuuggugagguguuagagaacuuuggcccacaauuuagacaagaucauacauuuacacuaauuuugagacugcaccacaauguucuuaaaacagcuauaagaucuauaggauuaucauacuccagaauaucuccccaagacauagcuaagaaacuggggcuggauucagcugaagaugcagaa

SEQ ID NO: 3897 - RNA, 796 nt, Diabrotica undecimpunctata
gaucaaugagggaaaacccuaauccugaaaaagaugcuacguacaguggagagaauuucguucguuuuacuggugauacgaccaaucaugcuaaggcucaguuauuugcuugggaagcguaugaaaaggguguggauguucaucuuuuagcugaaccaacaaaauuagaacuacucaaaaaagaauaugagaaaaagaaagaagagguuaaaucgacaauucaaagcaguguguuagauaaguacggaggacaggaacauuuagaggcaccaccuaagagcuuguuguuggcucaaucagaaguuuauguggaauauucaagaucugguaaagucauuacuggggcggaaaaagaagucauuagauccaaauaugaagaagauguguacauaaauaaccacacaucaguguggggaucguauuggagaggaggacaauggggguacaaauguugucacuccuucauaaagaauuccuauugccuaggcgaggcaggaaaaacgguuaacgcuccuguaacgcaagauauuccaacggaucaagacguuggugaagcaagcaguacaaaggaagccgggauaucagauggugaaagcgaagauaguaguuccaguaauucaucagaaggugagaaacugaaaaagaaacagagaagauuaaagaaaaaggaaaagaaggcaaagaaaaaggagaagaaagcuaaagaaaaguugaagaaaaaacaggaaaaagaaauggccccagaaguagaugagcaaauaauguuggacgauaggaaaaggccguacaacaguau

SEQ ID NO: 3898 - RNA, 499 nt, Diabrotica undecimpunctata
ucuccguaagaagaggaaguucgaauuaggacgcccagccgcaaauaccaagcuuggagcucguagaauucacuauguccguacacgaggcgguaacuugaaauaucgugcauugaggauugaaaaaggaaauuucgcauggggcagcgaagguacugcucguaaaacacguauuauugaugucguuuacaaugccaguaauaacgaauugguacguaccaaaacauugguaaaaaaugccaucguuguuauugaugcaaccccuuucagacaaugguaugaaaaccacuacauuuuaccuuuagggcgcaagaagggggcaaaauugacaacagaagaugaagaaauuuucaauaagaaacguaguaaaaaaguacagaaaaaauaugaaacuaggcaaaaaacagcuaaaguagaaccugcucuagaagaacaauuccaaacuggaagauuauuagcuugcuuagcaucaaggccaggacaaugugguagagcugau

SEQ ID NO: 3899 - RNA, 740 nt, Diabrotica undecimpunctata
ggauacugccgaacaaguauacauauccuccuuagcccuauuaaaaauguuaaagcacgggcgugcuggaguacccauggaaguaaugggucuuauguuaggagaauucguggacgacuauaccguucgaguaauugauguauuugcuaugccucagacugguaccgguguuaguguagaagcuguugauccaguuuuucaagcaaaaaugcuugacaugcuaagacagacugguagaccagaaaugguugugggaugguaccauucacauccagguuuuggauguugguugucaggaguugauaucaacacccaacaaaguuuugaggcucucucagaaagagcuguagcaguaguaguugauccaauacagucagugaaaggcaaaguuguuauugaugcauuuagguuaauaaauccuaauaugaugguauugggucaagagccucgccaaacuaccucuaacuugggacaucuacagaagccaucagugcaggcuuugauucauggucuaaaucggcauuacuacuccaucaguauuaauuacagaaaaaaugaauuggaacaaaaaaugcuacuaaaucuccauaaaaaauccuggauggauggucuaacuuuagcagauuacucagaaaauuguagugucaaugaaaagacuguugcugauauguuagaacuagccaagaauuacaacaaggcauuagaagaggaggaaaaaaugacuccagaacaacuugcua

SEQ ID NO: 3900 - RNA, 650 nt, Diabrotica undecimpunctata
ccuugaugaugguggagaaagucccugauucaacuuaugaaaugguaggaggacuugacaagcaaauuaaagaaaucaaagaaguaauugaacuuccaguuaaacauccagaacuguuugaugcacuugguauugcacaaccuaaggguguguuguuauauggacccccagguacuggaaaaacucuucuggcacgugcuguagcucaucauacagaauguacauuuauuagaguaucugguucagaauugguacagaaauucauaggagaaggaucccguaugguaagagaacuauucguaauggccagagaacaugccccuucaauuauuuucauggaugaaauugauuccauuggaucuucccguauugaaucaggaucugguggugauucugaaguccaaagaaccauguuggaacuucuaaaucaauuggauggcuuugaagcuaccaaaaacauuaaaguaauuauggcuaccaacagaauagauauuuuggauccugcuuuacucagaccaggaagaauugacagaaaaauugaauuccccccaccgaaugaggaagcgagauuggacaucuuaaagauucacuccaggaaaaugaaccuuacaagaggaauaaaucuuagaaaaauagcugaguugaugcca

SEQ ID NO: 3901 - RNA, 477 nt, Diabrotica undecimpunctata
aucugguuucgagcuucaaagcuucagcuuuuuccaaagagggucaauucaggaguuuaugucauucuuuugcaaaaccauaguggaaagaacaauaccagcuucaagacagaguguuaaagaaggagaauauuugugucauguauauguaagagcugacaacuuagcugguguuaugauaacugaucaugaguacccaucaaggguuucucacacacuaauaacaaaaguacuagacgaauuugcugccagaauucccgcagcuaacuggcccaaccuugaggagagagauguagcauuuccacaauuaaauaccuacuuagcaaaauaucaaaauccuagagaagcagaugcuaugacuaaaauucaagaagaucuugaugaaacgaaaauuauuuugcauaauaccauacaagcaguuuuggaacgaggcgagaaacuagaugacuuggugagcaagucggaagguuuaagcau

SEQ ID NO: 3902 - RNA, 615 nt, Diabrotica undecimpunctata
cgaaggaagauuguuucaaguagaauaugccauagaagcuauuaaguuaggaucuacugcuauuggaauauguaccagugguggaguagugcuugcuguagaaaaacguauuacuucccccuuaauggaaccuacuacgauugagaaaauuguagaaguugacaaacauauuggaugugccguuucaggacuuauggcagauucaaggacuaugauagauagagcucguguggaaugucagaaucauugguuugucuacaaugaaaauauaaguguagaauccugugcacagggaguaucaaauuuggcuauucaguuuggagauucugaugaagauggugcagccaugucuagaccuuucggaguagcaauuuuguuugcugguauagaugaaaaaggaccucaauuguaccacauggacccgucaggaacauucguucaguuugaugcgaaggcaauaggaucaggauccgagggggcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacucc

SEQ ID NO: 3903 - RNA, 734 nt, Diabrotica undecimpunctata
auaaaggccgucaaugucuugaaagcucaugguaaaagcgccagagagaguuuucucguacccgguuaugcauugaacugcaccgucgccagccaagcuaugcccaaaaaaauuguuaacgcuaaaaucgcauguuuagauuuuucauugcagaaggcuaaaaugaagauggguguucagguuuuaauuacugauccaaaucaacuggaagcaauccguacaagagagcucgacaucaccaaagaacgcauccaaaaaauccucucuacugguguuaauguuauucuugugaguggugguaucgaugaucuuugccugaaauacuucguggaaaauggagcgauggguguaagaagaguaaagaaagcagacuuaaaacgcauugccaaagcaaccggugccacuuuccuaaccucucuaaguaacauggaaggagaugagaguuucgauucuagcaugguaggagaggcagcggaaguuguucaagacagaauuucugaugaugaauugauaaucauuaaaggaccaaaagcacguacugcagccucaauaaucuugcgaggacccaacgauuucuauugugaugaaauggaaagaucuguucaugacgcccuguguguuguaaaacguguacucgaaucaaaaagcgucguaguggguggaggcagugucgaagcagcgcuuucgauauauuuggaaaacuuugccaccacacuaagcuccagggaacaauu

SEQ ID NO: 3904 - RNA, 668 nt, Diabrotica undecimpunctata
ucagcaaauucaacaaugacuuacaguuuacacuuacuguuuaaguuuucgguuuugacuuuguggcauaauggccccguacccggaaacuuuuauaacuuucccggcucgcacaccagcuauucaaacccuauaacacauacacagucucccguuacaacaucaacuucuguauuagcuauuacuuacgauaaaggaguacugauggccggagaucugguugcuucauauggaucuuuagcuagguacagaaauuguccaaggguuauuaaagucaaucagaauaucauauugggagccggcggagacuaugcugauuuucaauacgugaagaguuuuauugagcaaaaaauaauugaugaagaaugcauugaugauggacuaaaaaugaaaccaaaaucauuguacuguuggcuuaccagaguaauguaccaacggaggaguaaauuggacccauuuuggaauaauuugguuauaggaggaauccaggauggagucccauuucuaggaacuguagauaaauuaggaacugcauauacagacaaaguuaucuguacagguuauggagcgcacauagccuugccccuucugagagacuccuuagauaaaaauggggcucuuaacuuagcugaugccaagacucugauacacaaaugcauggaaguguu

SEQ ID NO: 3905 - RNA, 653 nt, Diabrotica undecimpunctata
uuuagaagacacucagcaccugagcauugaaagggagaauaagaguaaugacaaggauguagaagaggaaaauaagcagaaacuugcagccauuuuagaaaaaguggaaggaugcaaggaauuguuagaaguaccaggaagaaaauuuuuauaugaaggagauuuguuagaaauugauccaacagaaaauacaucuuugaaaacuguucacguguauuuauuuacagauggauuuaugauaacaaauagaaauuccaauagucgagguuugaugaaguacauuuaugaaauaauguacgauuuaaguagucuggcagugguuaacgugagagauuuaggaaauguuaaacacgcguuuaaauuguuaauuuucccggacacgagaguuuuucaauguucuucuaauuccaacaagaaagaaugguuggacaaauuugaccaagcaaagaagacuagacuagcucaagagcaacaaaagagagaaucuauuucggaaaaaucacccucacgaucagcuucaauagagucuccgaguuauaauccauuugacgaaauugaagacgauguaggaauggugcacccagaaugguuuuuggacauuccagaggaacuugauguguguguagcucaaagacacuucgaagaagcucuuu

SEQ ID NO: 3906 - RNA, 755 nt, Diabrotica undecimpunctata
uggauuguuacccaaggaugaagauggagaggccgauauugaaauugaauugguugaagaugaagcuccauuuuugcaaggucacgguagagccuuacaugaucuuaguccuguaagaauagucaaaaauccagacgggucauuagcccaagcugccaugaugcaauccgcuuuggcuaaagaaagacgggaacagaaaaugauucagcgggaacaggaggucgauucccagccuuccgguaagaauaagaguuggauagauccucuuccagaggacgaaucaagaaugaugggcagaggaauaggcuuacaaguucaagauuuaccagaauggaaaaaacauguaauagguggcaaaaaaucaucauucgguaaaaagaccaacuuaacaauaauagagcaacgucaauccuuaccaauauauaagcucaaagaggaauuacgaaaagccguaaccgacaaucaaauucuuauaguuauuggugaaacugguucaggaaaaacaacacaaauaacacaguacuuagcugaagcuggauuuacaucgagaggaaagauugguuguacucaaccaagaagaguggcagccaugucuguagcuaaaagaguugcugaagaauucggaugucguuugggacaagagguugguuacaccauucguuucgaagauuguacuagucccgaaacuaugauaaaauacaugacagaugguauguuauuaagggaaugucucauggaucuggaccucaaacaau

SEQ ID NO: 3907 - RNA, 719 nt, Diabrotica undecimpunctata
uagcuggacaagaaagugacugucaauuguacaaacugaauccuaaacuagucgaggaaguagaaaauaucggcaauaauacucaucucaggcaaagaaauacaaaaaacaaagaaguuacagaugacaacaaaaaugugacaaaagaguuauauuuugauguuaaggcuauagaaaauguucaaacugacuuuaauggcagugaaccauuaucgaggguaguaaaaauuaaucaugaugguacauuauuagcuacaggugguacagauggagauguacgaauauggaaguuuccuaguaugcaaccuuuauuuauucuuaaggcacauacaaaagaaauagaugauauagauuuuaguagguaugacaauuaugugauuaccauagccaaagaugguuuagcaguauugugggauuguaugacaggaaaagaaagaacgaaacuaacauggaaacagccugaaggaucaaaauauuuauauaaacguuguagauuuggugugauagaaggacuagacaagaaaugugcacuauacacaauaucaaauccaauaggaguagcuaaaaaacaaaaauccuaucuccagcaguggguaccugaagaaaacauguuaagaagguguauagaauuugaugagagucuggcugcuuuagcuguucgugaugaugguagauuuguugcuguugguacaauguuuaguggaucaguguccauucuu

SEQ ID NO: 3908 - RNA, 671 nt, Diabrotica undecimpunctata
aacuuauaaaggccaccaggccuuuuuugaguuuaauaagcaaagcaaaagcugcuaaauugguaaggucucucguugauuauuuucuggauuuagaagcuggcauugguauugaaguacaacucugcaaagaauguauagaaugggcaaaggaagagagaagaacuuuucuacgucagucccuugaagcuaggcugauugcccuuuauuuugacacuggaauguacagcgaagcguuacaacuggaaucaaccuuacugaaagaguuaaaaaaguuggaugauaaaaauuuguuaguggaaguacaacuacuugaaagcaaaacauaucaugcuuuaaguaauuuaccgaaggcuagagcugcacuaacuucagcacgaaccacagcuaaugcuaucuauugcccuccaaagaugcaggcagcuuuagauuuacaaucaggaguauuacaugcugcagaugagaaggauuucaaaacagcuuauucuuacuuuuaugaagcuuuugaagguuuugauaguguugaauccccaaaagcccucacagcgcuuaaauacaugcuuuugucaaaaauuaugaucaacaguccagaagauguccaacaaauuguuagugguaaauuggccuuuaaauaugcuggucaagauauagaggcuaugaaaucaguugca

SEQ ID NO: 3909 - RNA, 718 nt, Diabrotica undecimpunctata
gaccguuuggcuggauauauagaucgaguaagauauuuagaaggugaaaauaacagauuaacgagggaaauacaaaccacucaggaaacgguaacaagggaaguuucaaacauaaaaucuauguacgaccaugaauuaucagaugcuagaaaacuauuagacgaaacccaccgugaaaaagcacguuuagaaauagauguuaaacgucuuuuagaagagaaugacgaacucaagucugaguuagcgaaaaagaauaaagauuuggcucuagcugaaaauucugccagaauauacgagacaagauguaaugaauuacagcuuaaagcaaaucaagcagcuucugaugcuaagaaagcaaucgcagaugcuaaagaacuugaaaaagaacgugauaagcuacguaaacuucuugauaaccaucguaaacagcuagaagaagaaucauuggcgaggguggaaguugaaaaugccaaccaaagccuucgagaagagcuaucauuuaaggaucagauccaucaacaacaguugaccgaaacucguacucgucgucaaguagaaauuagcgaaauugauggucgucuggcagaaaaauacgaggcuaaacuucaagaggcucuacaagaucucagagaucaauaugaaggucaaauggccaacaaccguggcgaaaucgaauugcuauaugaacagaagauuaaaaacuugcaaucggcuaaug

SEQ ID NO: 3910 - RNA, 651 nt, Diabrotica undecimpunctata
gagagccguugaauucaaagucgucgaaaccgauccugcuccguacuguauaguggcuccagauacagucauucauugugauggagauccaaucaagcgcgaagaggaagaagaagcucuuaacgcuguuggauacgacgacaucggagguuguagaaaacagcucgcucaaaucaaagaaaugguagaguuaccacugagacaucccagucucuucaaggcuauuggaguuaaaccaccuagaggcaucuuacuguacgguccaccggguacugguaagacccucauugcacgugcaguagccaacgaaacaggagcuuucuucuucuugauuaacgguccugaaauuaugagcaaauuggccggugaauccgaaagcaaucuucguaaagccuucgaggaagccgacaagaauuccccagcuauuauuuucauugaugaauuggaugccaucgcucccaaaagagagaaaacacauggagagguugaacgucguauaguaucucaacuuuuaacuuugauggacgguaugaagaagaguucccacguuaucguuauggccgcuacuaacagaccaaacucaaucgauccagcuuuacguagauucggaagauucgacagggaaaucgauauaggaauacccgaugcaac

SEQ ID NO: 3911 - RNA, 650 nt, Diabrotica undecimpunctata
aguucccagucuaugugaagaucuacuaucaucuguggaucagccauuaaaaauugcaaaagauaaagaaacuggaaaagauuaucuucuuugugauuauaauagagauggcgauuccuacaggucaccaugguccaauacauacuacccaccccuagaagaugguucaaugccaucugagaaguuaagaaaacuagaacuagaugccaaucuugcauuugaucaauacagggaaauguauuuugaaggagguguauccucuguuuauuuuugggauuuagaccauggauuugcaggagucauucuaauuaaaaagacuggagaugguaguaaaaagauuaaaggauguugggauuccuuacauguaguagaaguacaagagaagaguucgggaagaaacucccauuauaaaaugacuucaacugcuauguuauggcuucaaacuaauaaacagggaucuggaacuaugaacuuggguggaagucuaacucggcagaucgaacaagaugcagcuguaaaugauaucaauccccacauagccaacauuggaagaaugguagaagauauggaaaacaaaauucgcaauacauugaacgaaauuuacuucagcaaaacaaaggacaucgucaacagucugcgaucaguucaac

SEQ ID NO: 3912 - RNA, 672 nt, Diabrotica undecimpunctata
uaaagccaacaacaaagcuggcgcggguaggaagaaaaacgccgcacagccaccaccgaugcaguucgauucugaggacgaagauaaugccaaaccgaugucuuacgacgaaaaacggcaauugucuuuggauauuaauaaauuaccaggugacaaauuggguagaguuguacauauaauccaauccagggaaccgucguugagggauuccaauccugacgaaaucgagaucgauuucgaaacgcugaaacccucaaccuuaagagaauuagagaguuacguugcgucgugucuucgcaaaaagccacauaaaaaaguagcuggcaaaucuaaggacgaacaaauagcggaaaaaaagcaagaguuagaaaaaagacuaauagauguaaacgauaaaaucggcaacuccaagaaggcccccaaaaaagaugaagccaacaagguagauccaacgggcgcgggaggucccucaggccgcuuauccucuagcuccagcaguucggacuccgacagcaguaguagcagucuguccucuaguucuagcgacuccagugacagugaagcaggugggacggcgaaccgacaggccaaaaagaaagcgaauaaaaaaucaccuaauccuucucuaggaaguuccaccaccaccaccacuacgacuauaaaaguaccgcc

SEQ ID NO: 3913 - RNA, 704 nt, Diabrotica undecimpunctata
augagcaaaggacaugucauugaccaaaucccugaauugccauugguugucagugacaagguacaagaaaugagcaaaacuaaacaggccguucaguucuugagaagaaucaaagcaugggcugacauucaaaagguuuacaagagucaacguuuccgugcugguaagggaaaaaugcguaauaggagacgcauccaacguaaaggaccauugguuguuuacuacaaagaucaaggucuccgucgugcuuuccguaacaucccaggcauugaccucauuagcguacagaaguuaaacuuguugaaacuugcuccugguggucauguaggucgcuucauuauuuggaccgaauccgcuuuccaacgguuagauaaauuguuuggcacauggaaaacaccaucauuagaaaagaaggguuacaaucuaccccaaccuaaaauggcaaauacugaucuaucuagauuguugaaggcugaugaaaucaaagcuguauuacgugcuccucaaaagaagguuguacgucguguacgucgucucaauccauugaccaacgccaaggcuaugcuuaaauugaauccauaugcugcuguacucaaacgugaagccauuuugaagaaucaaaagagacaguuaaacagagaagaacuuuuggccaagaaacgugguauuaccuugagugccgacaacgucgugauuagauccag

SEQ ID NO: 3914 - RNA, 738 nt, Diabrotica undecimpunctata
ggcguuccauaacauauccuacgccgaagccgaaaaaugcaugguuaauauggaucagggugaaguuaucauuaggccuucgaguaagggugcggaucauuugaccauuacuuggaaagugacugauggaaucuaucaacauauugauauuaaggaacaaggaaaaguuaacgcuuuuucuuuaggaaaaucauuauggauuggaaaugaagaauuugaagaucuugaugaaauaauagcuagacacguuacaccaauggcagcgcaugcuagagauuuacuguauuuuagauauuacaaagauuucgcggguggucauaaagauaaggcugaagaauaucuuaaagaugaaaaaaagaaaaaugcuucuaaaauucauuauguaauuagugcugcuaagaauauaccugguaaauuucuucuuucguaucuuccacgaaacaaaguuagacacgaauauguaacaguuacuccggaaggcuuccgguuuagacaacaaauguuugauuccguugguucguuguuuaaaugguucaaagaacauuuccgggagccuccgccagguggcgcaacgccggguaguacgccaaggcuggccucaagccgaacuggauauggaacugccacaccugcguuuaguaugaauaaugaagcuauucaaagaguugcucaaaauuugccaagucauguaguucaagcguuaucugcugccaccaaucaaacuccacauuaucccca

SEQ ID NO: 3915 - RNA, 779 nt, Diabrotica undecimpunctata
uuaaggaucaugcugcuguuguagaagaauuagauuuaguagaagaagaagaucaauucacucaucuuauuauguuagaugauguuaaagaggcuaaugcagaggauauauugaauguguucaaauuugaugauaauuaugaagaaaaugaagauaaauacaaaacccuuaguaaagaaauauuaggcagugauggugaaucugaaucagguucugaagguucagaagaggaaucugaagaugaaaaugaggaugaagucaaggaucaggggacaauaauugacaauacugaaacuaauuuaauuucucuuagaagaacaauauauuugacuauucagucuaguuuagauuuugaagaaugugcacauaagcuacugaagauggaguugaaaccuggacaagaaauagaauugugucacauguuucuugacuguugugcagaacaaagaaccuacgaaaaauuuuauggcuuguuggcucaaagauuuugucaaaucaacaaaguguacaucgagccuuuccaacaaauuuuuaaagauacuuauucuacaacucacagacuagaugccaauagguugagaaauguuagcaaauuuuuugcacauuuacuuuuuacugaugccauuggaugggaaguacuggaaaucaugaaauuaaaugaagaagauaccaauaguucuaguaggauuuucauaaaaaucuuguuucaagaauuggcugaauauaugggacuaggaaaauuaaaugcaagauuaaaggaugagacccuacaggcuuau

SEQ ID NO: 3916 - RNA, 791 nt, Diabrotica undecimpunctata
uugaaccuccaagacagauguacagaggggcacauguguuuuuuacagaaguaugcccggaagaacuguucaaugagcugugcaagucuugugcggccagaaaaauuaagacucucaaggaaaucaacauugcguucuugccguacgagucucagguguucucauuggauucaccagacacguuccaauguagcuacgaucccucguuuuccgccgccagaaacgccaauauggaaagaauggcggaacaaauugcgacucucugugcaacucuaggagaauauccucacgucagauauagaaccgauugggaaaggaauguugagcuggcucaacuaauucagcaaaaauuggacgccuauaaagccgaugaaccuaccaugggagagggaccggaaaaggcgagaucgcaguugcuaauucucgaucgagguuucgacuguguaucuccucuucuucacgaacucaccuuccaagcaauggccuaugacuuauugccaauagaaaaugauguguauaaguacgaagcaucagcuggcguucugaaggaaguccuucuggaugaaaacgacgaacuuugggucgaucuacgccaccaacauaucgcaguggugucucaaagcgucacgaagaaucugaagaaauucacagacucaaaacgcaugacccagagcgacaagcagucgaugaaggauuuguccaccaugaucaaaaagaugccgcaauaucagaaggaauugucuaaguaugcgacgcaucuucaucucgcugaggacuguaugaaggccuau

SEQ ID NO: 3917 - RNA, 797 nt, Diabrotica undecimpunctata
aaagauaggugcucugcaaauuuacaaaaauacuaugaauccaaaggucaucagaagaagcagauucagucaggggguuuucaagaucuucgaagagaucuucaagcuguuauaggaacucgagcaaacauuaauauugcacagaucgaaaauuaugguggggaaacuuuuuuaucugaagaauuagcuauuacgauauuacaagauacaaaacacgcuuuucaaagaugucaguuguuauccaaacccacagaaagggccucaaacgcaacucaaauuuuggaucgauugauaaacagcuuauuaguagagcaugucgacuaugcaguagaauugggcuuacaagcugugccuguuguagaaggaaccaaaacucccccagcgcuauauuuuuuuagugucguccaccacaguaauaauauuauacaucuuguugagaaacaguucauggauuuauugguuccauuaguugaaaacaccccaaggaauaacgauuguguacaaaagaaaaaguuuguacuggaagauauagaacggaagauuaacacaggacuagauaggugucucaaugccauuucgagcugggucaaacuguaucuccaaacagaacagaaaaaaucugacuucaaaccugaaucugacgacuucgacacaguagcgucacccgcuuguaaaaacgucaucaauuacguuaauaguauuguaaaagaaauuaaagcgaaccuggaugguaauaaugucacagccauauugcaagaacuuggcauaagauuacaccgagugguguaugaucacau

SEQ ID NO: 3918 - RNA, 702 nt, Diabrotica undecimpunctata
uuggucagaaacuaacagggaucgcagagaaagacuucgacaacuugcuuuagaaacuauagauuuacaaaaggaucccuauuuuaugaaaaaccauuugggaucauacgaauguaaacucuguuugacauugcacaacaacgaaggaaguuacuuggcccacacucaggguaaaaaacaucaggcuaauuuagcuaggagagcagccaaagaggcuaaagaugcaccuacacuuuugcaaccagagaaacccagaguagaaccuaagaaguuugugaagauuggucgaccugguuauaggguaacgaagcaaagggaugcugaaaguggacaacagagucuuuuguuccagauugauuauccagaaauaagugauaugauucuaccucgucaccguuuuaugucagcuuaugaacaaaaaaucgaacccccagaucguaaauggcaguaucuccuauuugcagcagaaccuuaugaaacaauugccuucaaaguaccaagcagagaaguagagaaaaccgacagcaaauuuuggacucauuggaacaaggauacuaagcaauuuuuccuacaauuugcauuuaaaaaugacaauaagagaacuguuaauacagugguccaaagacauacaauuguuggugcagcaccaccaccuccaaugcugccaguuccaccaccaccaagaccaccaauguucaaucc

SEQ ID NO: 3919 - RNA, 288 nt, Diabrotica undecimpunctata
aacaauuaccggcgaaguauauagaggaaaacugauagaagcugaagauaauaugaauugccaaaugacucaaauuacuguaacuuacagagauggaagaguagcucaauuggaaaauguuuauauuagaggaucaaaaauuagauuucuaguauuaccagauauguugaaaaaugcuccuauguucaaaaaacaaacuaaagcgggaacggcaggucgaggaaaaucugcuauacugcgagcccaagcucgggggagaggcagggggcaaacacaaccaguacgagg

SEQ ID NO: 3920 - RNA, 746 nt, Diabrotica undecimpunctata
ucaacaaguuggugcaaaucuuacagccacaucugauagagaaaccauauccuauaccuuggaaggaacaagaagugcuguugaaaaggcucuaccauaucuagcagaaguagcuaccaaccaagaauuuagaccuugggaacuuucagaacuguccaacagauuaauuuuggauauuuuaaccagaccuuuacaauuaagagccauugauuugcuucacaaugcugccuaccguagcaaaggguuagguaacucacucuucauuccaaagucucaagugggaaaaguuucaucugaaacauuacaacauuauguagcuaacaacuuuguagcuggccgugcugcaguuguugguacagguauaagugagaguuuguuaaaucaauuugcugcuaguuuggaaauuccaaauggugaaggcagcaccaauccauccccuuacaaagguggugaacucagaucaaacaaagguggaccacuugcuuuuguugcaguuggaggagaaggagcuccuuugaaaaacaccaaagaagcucuugcauuugcaguucuacagaaagcuguaugugcuggcccucagaucaaauaugguguacuugauaauggagucuacagcaaagcucuugguggaucaucggauguaucugccugcgcuguuaaugugagcuauucagacagugguuuguuugguauuuugcuugcugcaccugcuggaucuguaggcaaagcaguucaaucagcuguua

SEQ ID NO: 3921 - RNA, 183 nt, Diabrotica undecimpunctata
ugaucugcaagaaaagauugguguccuaaaaucguugacuauagacauuggaaacgaaguuaaauaccaggacagacuucucagagaugucgaugacgauauagauaagacaggagguuucuugggcacaacuaugucaagaguacugagauuauccaaaggaucccauaauuaccucauccu

SEQ ID NO: 3922 - RNA, 788 nt, Diabrotica undecimpunctata
guggucagaagauucccauuuucucagcugcuggucugccacauaacgauauugcugcccaaauuuguaggcaagccggucuugucaaaauuccaggcaaaucaguuuuggaugaucaugaagacaacuuugccauuguuuucgcugcuauggguguuaacauggaaacugcuagauucuuuaaacaagauuucgaagaaaacgguucuauggaaaauguaugucuguucuugaacuuggcuaaugauccaaccauugaaagaaucaucaccccgcgucuugcucuaacagcugccgaauucuuggcuuaccagugugaaaaacacguguuggucauuuuaacugacaugucuucauaugcugaagcuuugcgugagguaucugccgccagagaagaaguacccggucgucgugguuucccagguuacauguacaccgauuuggccaccaucuacgaacgugccggucgugucgaaggccguaacgguuccaucacucaaauccccaucuugacuaugccuaacgacgauauuacucacccuauuccugacuugacagguuauauuaccgaaggacagaucuacgucgaucgucaauugcacaacaggcaaaucuauccaccaauuaacguacugccaucucucucacguuugaugaagucugccaucggcgaagguaugaccagaaaggaccacucugacguuucuaaccaauuguaugcuugcuaugcuauugguaaggacguccaagccaugaaagcuguaguaggugaagaagcucuaacacca

SEQ ID NO: 3923 - RNA, 599 nt, Diabrotica undecimpunctata
ggaacaaccuggagauguuauuaguuacgccgccgaauacuuuacgagguugagggaaaccaggguaacauccagaguguaugaugaagcugcugccucgcaggaggaacuuguaucaccugacgaaucuguaauguccaaagaugaagaaccuucaauccgguuugcugguaggcguaaaucaguauucgcagaaacuuacgauccagaagaagacgacgacgaugaugauggcgccaaauugguguauccgaaaucugaugagcaacgucagagauuggccacugcuguuaaaaacauauugcuguucagaucucuagauaaagaucaaaugaaugaugucuuggaugccauguucgaaagaguagucaaaaaggaugaauugguaaucaagcaaggagaugacggcgauaauuuuuauguaauucaaaguggaacuuuccauguguuugucgcaccagauccaucgaaagaacccaaucacauucacacuuacgaaaauaguggcagcuucggagaguuggcguugcucuacaacaugccccgugcagcuacggucaaagcgaauagcgaagguucccuuugggcuauggauaggc

SEQ ID NO: 3924 - RNA, 674 nt, Diabrotica undecimpunctata
accacucuucacaaccuuuuauuacaucaagauggaucuaagauggcuguuagacuugcaggugguuugcaaaagaugguugcacuacuccaaagaaaccauguaaaauuuuugucaauuguuacugauugcuugcaaauuuuggcuuaugguaaccaagagagcaaguuaaucauuuuggcaagucaaggaccuauugaauuggucagaaucaugagaucuuacgauuaugagaaguuguuguggacuacuucuagaguucugaaaguucuuucaguuugugccaguaacaaaccggcuauaguugaagcaggaggaaugcaagcuuuggcaaugcacuugggaaauccaaguacaagauugguucaaaauugucucuggacauugagaaaucuaucagaugcugcuacgaaaguugauggucuagaaagcuuauugcaaucuuugguacaaguauuagcaucuucugaugucaauguagugacaugugcugcugguauucuuuccaaucugacuuguaacaaucagcgcaauaaaguaacuguuugucaagugggagggguugaugcacuuguacgcacuauagucagugcaggagauagagaagaaaucacagaaccagcuguuugugcacugcgucauuugacauccagacauguggaaucagaaauggc

SEQ ID NO: 3925 - RNA, 650 nt, Diabrotica undecimpunctata
uaagcauaaaaagcgaaggccuuaucuugcaucagaauguaaaaauuuacaugcuugugaaaaauggagaaugcagauaauaagagaaauugcgaaaaaaguagcucaaauucaaaaugcuggccuuggagaauuuaggauaagggacuuaaaugaugaaauaaauaaacuacugagggagaagcgacauugggaggaccaaauaaaggaauuggguggacccgacuaucagagaguuggaccgaggauguuggaucaugaaggaaaagaaguaccuggaaauagaggguauaaauacuuuggggcggcuaaggaauuaccagguguucgagaacuuuuugagcaggagccgccuccuccuccaaggaaaaguagagcagaacuaaugaaagacaucgaugcggacuacuauggauacauggacgacgaugacggaauuuugauuccacuggaaguuaaagcugaaaagauagccguucaaaauacaguagcugaguggguuaguaaaaaagaacaaaauuuggagaacgcagaagaccaaacagaagaaaauauauaugcaguugaagagucugaagaugaagauaguaaggaaacuguacaacaguuaguagauggaucacagcaaagauucguagcacauguaccug

SEQ ID NO: 3926 - RNA, 507 nt, Diabrotica undecimpunctata
accgguaaaacuaccuuuguaaaaagacauaugacuggugaauucgaaaagaaauauguagccaccuuagggguagaaguucacccuuuaguuuuucacacaaauagaggacaaauucguuuuaauguaugggacacagcaggccaagaaaaguuugguggucugcgugauggauacuacauccaaggacaaugugccauaauuauguuugauguuacuucuagagucacuuacaaaaauguuccaaacuggcacagagaucuuguuagaguuugugaaaauaucccaauuguauuguguggaaacaaaguugacaucaaagauaggaaaguuaaggcaaagagcauugucuuccauagaaagaagaauuuacaauacuaugacaucucugcaaaauccaauuacaauuucgaaaaacccuucuugugguuggcuaggaaacucauuggagauccaaacuuagaauuuguagcugcaccugccuugcuuccuccagaaguccaaaug

SEQ ID NO: 3927 - RNA, 744 nt, Diabrotica undecimpunctata
auagcuucgcuacuucacagaaagucugcaaaacaguguaaagcccguugguucgaaugguuagaucccaguauuaaaaaaacugaauggucuagagaggaagaugaaaaacuauuacauuuggcuaaacuuaugccuacucaguggagaacaauugcucccauuauuggaagaaccgcagcacaguguuuggaaagauaugaauauuuauuggaucaagcacaaaagaaagaagaaggugaggaugcaguggaugaucccagaaagcugaaaccuggagagauugacccaaauccagagacaaaaccugcaagaccagaucccaaagauauggaugaagaugaauuagagauguuaucugaagcuagagcuagauuagccaauacucaaggcaaaaaggccaagaggaaggcucgugagaagcaauuggaagaggcgagacguuuagcagcucuccagaaacgcagagaacugagagcugccggaauagaaguuacuucucgcagaaagaaaaaacgaggaguagacuacaacgccgaaauaccauucgaaaagagaccagcaauuggauuuuaugauacaucuaaugaaguauuagauccuauggcucccgauuuuucaaaaaugaggcaacagcacuuggauggggagcuaagaagugaacaagaggagagagagcguaaaaaagauaaacagaaauuaaagcagcgcaaggaaaacgacauuccucaagcgauguuacaa

SEQ ID NO: 3928 - RNA, 329 nt, Diabrotica undecimpunctata
aaaugguauguggcucauccagacaagcucaagaaaaaaauuacaagagaauuaaucacaacuauuuuagcuagaaagccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauacuuuggaaguguuugugaguuggauauaaucuucaacuuugagaaagccuacuuuauauuggaugaacugaugcuggggggugaaguucaggaaacaag

SEQ ID NO: 3929 - RNA, 682 nt, Diabrotica undecimpunctata
gaaauuccuuuauuggccggcucuuugaaaauuuuaaagaugagcuggccaaaaacaaagaaaugaaagaaucucugaaaaaauuucgagaggaagcucaaaaauuagaacaaagugaugcauuaaaagcagcuaggcagaaauuugaaaguguagaaaaagaagcuaguaaaaguagugaaguuuuuaaagaaaguuuagguucuguuaaggaaaaacuuaaaggaguuauagaugaagcuaguaagucagauuuagcaaagaaggcuggcaaauucacagaagaaguugguaaaacuacacauaaaauaagcgaaacagcucaagaaauuaguaaaacuggagcauuucaaaguauaucucaagcuacuaaggcuguuaaacaagaaauagacaauacuaguauagaagguagaguauauguuaguccuaaaauacuacggaagagaacagaaacaagugcaguuguccaucaaaaauauuaugaaccaaacacagaugcuacagguguugaacuacacaaagauucaaaguuuuaugagucuuggcaaaauuucaaagauaacaauccauauguacauaaaguuauggacuggaaauuaaaauaugaugaaagugaaaauccugucauccgugcuuccagagcacucacagaaaaaguuggugauaucaugggugguuu

SEQ ID NO: 3930 - RNA, 712 nt, Diabrotica undecimpunctata
accuggcuuaaauacuguggaagaaggaccaaaacacuucacaaauaaugugagugguuuaaaacaaaaauuagaggaaauacaacucaaguuaccauggauagaacgacucgacugcguaaaugcucaagccccuuuagcaccugaauuagcagcucaaauguugacacaugagcaaaaaagaaguaaugagcuuagaaauaauaaaaagcucacgcaguuuacuccaaaugaagacccgguuuuaaacgacuuuaaaagggaaaugauguuccauagacaagcucaggcugcuauucuagauucuauaccaaagcuaaaagauaugggaguacuaacuaaaagacccgaugauuacuuugcugaaauggcgaaaacagaugcccauaugcagaagauuagggaacaucuuaugacgaagcaggagcaacagaagagaagugagcgagucaaacaacuuagacaacagaggaaagaagguaaaauguuacaaguucagacaaaacuucaaagacaacaagaaaagaaagauaugcuugcccagguuaaaaaaguaaggaagggaauguccaaagaucuugacuuccuugacggaaaaaauaaaucuucugccagaaaaauggcagaaaaacggaaaaugaaagauaaaaaguucgguuuugguggcaagaaaaagggaaugaaaaggaacacaagagauagugcugcagau

SEQ ID NO: 3931 - RNA, 667 nt, Diabrotica undecimpunctata
agaucgagagacaggagaaacagaucuaaggauagaaaauacaaaaacuauucuagagauaaagauagaagagaaagaagcaauucacgaggcauaaaacgggaaagaaguacugaaaagaaguucaaaagugaaaaagauaauccugaauuugaagaggauccuaccccaggaaagauauauaauggaaaaguaucaaauauuguaccuuuuggaugcuuuguccagcuggagggacuuaaaagaaggugggaaggcuugguucauauuucacagcuuagagcagaaggcagaguuacuaauguaucugaaguaacaucuagaggagcuagaguaaaggucaaaguauugacaguaacaggccagaagguaucauuaucuaugaaagaugucugucaaauuacugguaaagaccuuaacccacauucccaugcuccaacugaaagagaagauagggauagaaauccugacaggccuguaaacagcaguacaucuguguuaagacuuccaguaaacauagaugaaggagaagaagacucccggaaaagaguaacaagaauuucaagucccgagagaugggaaauaaaacagaugauuucaucaggauguauugcuaagagugaguugccugacuuugaugaagaaacuggauuguuacccaaggaug

SEQ ID NO: 3932 - RNA, 662 nt, Diabrotica undecimpunctata
gauccuuggguuaugcguauguaaauuuucagcaaccugcugaugcugagcgugcauuggauacaaugaacuuugacuugauuaaaggacgucccaucagaauaauguggucucaacgagauccaucauugagaaaaucugguguugggaauguuuuuauuaagaauuuggaucguucuauugacaacaaggcuauguaugauacuuucucagcuuuugguaacauucuuaguuguaagguagcucaagaugaaaacggcuccaguaaaggauauggguuuguacauuuugaaacugaagaagcugcaaauaaaucuauugaaaagguaaaugguauguuguuaaauggaaaaaaaguauauguuggccgcuuuauuccacgcaaagaaagagaaaaggaacugggagaaaaggccaaacuuuucacaaauguauauguuaaaaauuuuggugaagauuuaucugaggaagaguugcggaauauguuugaaaaauaugguaaaauuaccagcuacaagauaaugaguaaggaugaugguaaaucuaaaggguuuggcuuuguugcauuugaaaauccagaggcggccgaaacagcaguagaagcauugaauggaaaagaguugauggaaggaaaaccuuuguauguaggaagagcccaaaag

SEQ ID NO: 3933 - RNA, 699 nt, Diabrotica undecimpunctata
guaggcaaagauguuucagcuuuguuuccagauguaguaaacugcaugcagacugauaauuuagagcucaaaaagcuaguuuauuuauauuuaaugaacuaugcuaaaucucaaccugacauggcuauuauggcaguaaauacuuuuguaaaggacugugaagaucccaauccacuuauuagagcgcuugcuguuagaacaauggguuguauuagaguagauaaaaucacugaauaucuuugugagccacuaaggaaauguuuaaaagaugaagauccuuauguaagaaaaacagcagcuguuuguguugccaaauuguaugacauuucaucugguuugguagaggaucaaggcuuuuuagaacagcuaaaagaauuguugagugauuccaacccuaugguaguugcuaaugccguugcagcuuuauccgagauaaaugagagcaguccuacuggucaaccucuaguugaacucaguacaaacacuauuaacaaacuucuuaccgcccuaaacgaauguaccgaauggggccaaguauucauccuugauucccuuucaaauuauaccccucgugaugaacgcgaggcacaaaguauuugugagcguauuacuccgagacuggcucaugcaaaugcugcugugguuuugucugcuguuaaaguuuugauuaaaaugauggagauucuggcuggagauacu

SEQ ID NO: 3934 - RNA, 351 nt, Diabrotica undecimpunctata
gaagugggagcuacuucuucuuuggcuccuaaaaucgguccucuagguuugucucccaaaaaaguuggugacgauauugccaaagguacugcugauuggaaaggucuaaaaaucacaguucaauugaaaauccaaaaucgucaagcuacuauuucuguaguuccaucugccucuucccugauuauuagggcucuuaaagaaccaccacgagacaggaagaagcaaaagaacauuaaacacagugguaacauuacuuuugaugaaaucauugcuauugccaggcaaaugaggcccagaucaauggccaaacaguuaucuggaacuguaaaagaaguuuuaggaacagcccaa

SEQ ID NO: 3935 - RNA, 775 nt, Diabrotica undecimpunctata
uggaagaggaauugacaguggaagccacaaaauuggguguuaguauaauauuuucccaugaaacagaaccuuuagguacagcaggaccaauugcauuagccagggaacaucuuucuaaaagcacuaaaccauucuuuguccuuaauucagauauuauuugcgauuucccauuuaaagcauuggcagaauuccauaaaaaccauggaaaagaagguacaauagugguuacuaaaguggaagaaccaucaaaauaugguguaguaguauaugacaaagacaacagcauccaaaguuuuguagaaaaaccucaagaauuuauuucuaauaaaauuaaugcugguuuauacauuuuaaauccaagugucauuaauaggauagaauuaaaaccaacuucuauugagaaagaaguauuuccuuacauggcggcugauaaacaguuguaugcauuugaauuggaagguuuuuggauggauguuggucaaccaaaagauuuucuuacuggaauguguuuauaucugaaacauuuaaggcaaacaaaugaagaaaaacuuuauaaaggaccaggugcuguuggcaaugucuuaguagauccuacugcuaaaauugggaacaauugucaaauugggccuaauguuacaauaggaccagguguuguuauagaagaugggguauguauaaaacgaucuacaauacuuaaagaugcuacgauuagcucaaauucuugguuagaaagcuguauuguuggauggaaguguuguguuggaagauggguaag

SEQ ID NO: 3936 - RNA, 680 nt, Diabrotica undecimpunctata
uuuuaaaagaaggcgcuagcggagcauucgcucaguauaauaaagaucaacugacccccguuaaaauagaaaacgccgaucauuuagugcuuauuacggaauacaacgauuuagggaauaauagauucuucgaccccagaaguaagcagaguuuuaccuaugaucacuuaagaaaagaagcauuagacuaucaagucuauacccccgauagcacuucugagccuuggagggcugccuuagacucagaguucauucaguacacuaggaaccauuauaaagauggaguauguagugugguaggccgcaaccagagcggaguuauuaacuuaacagcuuguauugaagaccaccaguucucuccuaagaacuacuggaauggaagauggagaucucagugguccauuagucuaacugaugauuccacugcugagguucgaggcguacucaaaguacagguccauuauuaugaagaggguaauguacaauuagugaguacuaaagaaauaaaagaaacuguuccuguuucaucugaggcacaaacugcuaaagaaaucauccaaguaauagaagccgccgaggaucucuaucaaacggcaauuucagaaaacuaucagaauaugucagauacaaccuucaaggcccuacgaagacuucuuccugucaccaggacaaaaauggau

SEQ ID NO: 3937 - RNA, 754 nt, Diabrotica undecimpunctata
cugugggaugugaaacacuaagauuugaacguagaccaacacaagauuguguagcuuaccaagcaccaggcgucgcaggagucuauggugauccacacuuuguuacuuucgacgauguagaauauacguucaauggaaaaggggaauucgcauuggugaaaucaguuacacaaacggacaaucuggaaauccaaggaagauucgagcaaauggacccuaacgcuuauggugagguuagagcuacucagcugacaucuguaguagcuaaagguaauaacacaauagcaguugaagucagaaggcgaccacuagauucuagauggagauauagguuggauguuauagcagauaauagaagacuguauuucgauagacccucacuaaaauuccagcacuuccaaggaguuacuauuuauacuccaaccuacauccuuaaucaaucagaagucaucauuauguuugacaauggagcuggaauggagguugucgauaaucaaggauacaugagugcaagaguauuuuugccuuggucguuuauaaauaaaaccauaggccuuuuuggaaauuggaguuucaacaaagaagacgacuuuacacuuccagaugguuccagagcagcaauaguaucuaacauaaaugacauggaaaggguuuacacugauuuugguuccaaauggauguuagaugauguguuagauccucaaaaggguagagcguuauuccauagggaauuuggaagaacuucagccacuua

SEQ ID NO: 3938 - RNA, 189 nt, Diabrotica undecimpunctata
cuuucuuuuccucagcagcuggagcagcagcaggggcaccuccggcagcaggugcagcaccaccaccaacuggcauggagcucaauuucucacggccuugugcaaugaguucuucaacugacuugccacugagcucgcugaugacuuucuuuacuuuuucuccuucagcuucaacaccuacagacccua

SEQ ID NO: 3939 - RNA, 766 nt, Diabrotica undecimpunctata
uccacaacuucgugaugauuuagcagcugcuagagcuguacuuaagaaacauuccacuauguuauuaacugcaucuaagguuuauguacgucauccagaauuagcagcugccaaagcaaauagagauuauguuuuaaaacaagucugugaagcugugaauacuauuaaugauguagcucagggaagaacuccucaaccugcuucuggaccauaugauggaccuggagaguuggcugcugcuuuggaugauuuugaugaccacaugguaauggagccucuagcauacaaugaaguucauaccagaccuucauuggaagaacgucuagaaagcauuauaaguggugcagcccuuauggcagauuccaguuguacuagggaugaaagaagggaaaggauaguugcagaguguaaugcuguaagacaagcucugcaagacuuguugacugaauauaugacaaauaugggcaauaaagauaaaagugagagccuaguaagagcaaucgacaauauggguagaaagacuaaggauuuaagaagacagcugagaaaagcuguuguagaucauguaucugacaguuucuuggaaaccaauguaccucuccucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggcgucaaaaugguuagauaugcugcugcucag

SEQ ID NO: 3940 - RNA, 654 nt, Diabrotica undecimpunctata
uacuuugccaucgaauccaauaguaucuucaacuacuggaauucaaagcacauuugguucaggagauaauaaagaccaaaguaaaccuucauuguuugcaacucccucaagucagccuguuucauuuggguuaacuacaaaagccaauacagccccaacaacccucuccuuugguuuugcuacuccuacgacuuuaccguuuggaucaucaacuacaauuacaccugcaacaacuccucaauuuggauuaucgcuuccaaaagcuagugcuccagccacuacuaguuuuucacuucuaggaucugcuccagccacuacugcagcagcaccuacagguauaucauuugguacugccacuacugcagcaacaacuucaguuacagguuuaucauuuggaacuccaauugggacugcuacaacugcagcaacaacuucagcuucagguuuaucuuucggucuuacaaccgcuucuucuacaaguucugccgcaccuacacuuuugucuucaacgacaacuucgacaacaucaucagugucugcaucuggugcuuugaguaguacaacaucagcaccgacuuuugccaccucaucguugccgucaacaggcaccuuaacauucucucaacucgaagauucgaucaacaaauggaccau

SEQ ID NO: 3941 - RNA, 433 nt, Diabrotica undecimpunctata
aggacuggauaaugcagguaaaacuacccuucuacauaugcucaaggaugacagacuggcacagcaucuucccacguuacaucccacaucagaagagcuuuccauugguaacaugagguuuacgacguucgauuuagggggccacgagcaagcuaggagaguuuggagggacuauuuuccagcagucgaugccauaguguuccuuguugaugccaacgacagcucaagauuuguagaaagccaggaacagcuaaaugcccuccucucagaugaaacucuuuccaacuguccaauacuuaucuuagguaauaaaauugaucucccaggugcugcuucagaggaugaacuacgaacuagauuuggcuuguuuggccaaacaacaggcaaaggcaaaguagcuagaaaugaucuaccugguaggccucuagaacua

SEQ ID NO: 3942 - RNA, 442 nt, Diabrotica undecimpunctata
aucccacuacuauugccaacaaaaaucaaacaauaacaaacauucuuacacaaguucagaccuuuguuaccacagcucucacuuguagagaaacaauaacguccauguugcaguuuuauggaacuuuaaaugaauaucuugacccagcugguggugcagaugaacucgagguagaagcaaaaagacauuauauauugcaguugcacccagagaucaaagacacccuacagacccauacucgaauuuugcagaguuuacuuccauauguagaaucagaaaacauuuccaaagugguugaaaugacugcucaauuggaagaagcaucuguuagucaccucaauuuguauggagaguggagagauacaauguacaaaauggucguugcucuucaagauuucacugauauaaugaguucaauuaaaguauuguucucccaacuaga

SEQ ID NO: 3943 - RNA, 651 nt, Diabrotica undecimpunctata
auugucguauccuucagcucgauacgaaccguucgauuuccauucugaauguagcaaaaugagaugggaucgucucaaaauccuaauagaccgucuagcccuggaccaagacgaaaugggcuucuuucucuuauuacgggaugguuccuuaagcucguuacaagacggagucuucagaacgaacugcauagauuguuuggacagaacuaacgugguccaaaguaugcuagcgcacagaaauuuagagguaguuuuaagaaaauugaauauuuuacaccaaaaccagaacuuggaguuccaguauuccuucgagguuuuguuuaagaauguaugggcagauaacgccgauauuauaaguacccaguacucgggaaccggggcuuuaaaaacagauuuuacuagaacagguaaaaggacuaaggcuggaguuuuucgagauggaguuaauucgcuuacuagauacuauaaaaauaauuuaacagacggguaucgccaggaugccauagauuuguucuuaggcuauggcaaaccgauaucuccacuaagaguagacaaaucguggcgauauauuacguacccuucgguacuuuuggucgcuguauccauguuuguagcuucugcuguauuuccuucggaauacucaaccgaauc

SEQ ID NO: 3944 - RNA, 702 nt, Diabrotica undecimpunctata
ccgcaagacucaaaaagaucucgccaucaugccaagucaguguccugguugcgaagaacugaauacauuucaacagaacagaccagauuccagccucagacuauggacaaaguugaagcuaagguugguuauaguauuaaaaagucccuuaacaaugaaacuuuguacauggacagagacucucagauuaaggcuauugaaaagaccuuugaggauucuaagaaugucauugagaagcauuacagcaaaccuaaugugguagcuguggauauuuugccuguuuauccagauuucagccuuuggaaguacccuugugcccaaguuauuuuugauucugauccagcuccuguuggcaagcaaguaccagcucagauugaagagaugucucaagcuaugaucagaggugugauggacgaaaguggagaacaauuuguagccuacuuuuugcccacagaagacacucuccaaaaacgaagagaugauuuugucaaccagauaccauaucaagaugaugaggaauaugaauauaagauggcaagagaguacaacuggaauguaaagagcaaggcaagcaaaggguaugaagaaaauuauuucuuuguggcacgaccagauggaauuuacuacaaugaacuggagaccagaguaaggcugaguaagagaagggucaaagcuggugcuccaccuaguaacacaaggcuu

SEQ ID NO: 3945 - RNA, 675 nt, Diabrotica undecimpunctata
gaaagaugauauggccccaugguaugaacucauuuguaaagaugcugguuggaaacuugauacuaaucuacuaagugcauuaaaagcuaagaacgcugagaagaucaagcuuuuagaugaagccauagaagaugcugagaaaaauuuaggugaaauggaaguucgagaagccuacuuaagaaaagcagaauacuacagccgaauuggugauaaagacaacgcaguuaguacuuucagacaaacauaugauaaaacuguaucacuuggccaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguuuaucaaggugcauauuguaugucugucagagacuucaaaucagcugcuaacuuguuuuuggacacaguaagcacuuuuacaucguaugaacuaauggacuauaaagcauuugucagauauacuguauacaccucuauuauuaguuugccaaggaaccaauuaagagauaaagugguaaaagguucagaaauauuggaaguauugcauucggaaccauuuguaaaagauuacuuguuuucuuuauauaacugucaguaugccgaauu

SEQ ID NO: 3946 - RNA, 727 nt, Diabrotica undecimpunctata
cgcagcaacaacagaauauuauacacgaacaacguguucaggccaucgcgagaguccagcgacaaauauccguggauccagcucaacaguuuuugucggaacaacaaagucccuugcaaccaaguacgccucaggagcuuaguccgucugcuacaccaacaccaagcccaagacaguucauaggaaugaaauccccgaccuuuccucuuccuucaccaguggcucagacagcaauuagaccuccuacacccucucauucuccacaugauguaagucaggcaagcaccccugacgguaaugaucacuuuauucaaucaccuucuacuccuaaaccuaauuuuccuacuagauuaccuacagaucaauuuauccaccaaccugcaacuccuaggccccaguuuggaauacaacggccgccuuuacagaacuuugguaauacgaugaggacagaucagcaggauauuaauaucaaccggcaguuacgagaucuucuccagcgacaacaggugaaaaaauuggaugaacuguuaccagguaaaguucaacaacaaagaguguggccuccaauugaacaacaagaaaaugaggccucggcaacuacugguacuucggcaguuguggcuacaacagcagauaccacuuucaggcaaccauuaccgcccagcauugugcgaccuagaguggcucucucuuuagcuggucgagcagguccugguacuauuagggu

SEQ ID NO: 3947 - RNA, 779 nt, Diabrotica undecimpunctata
ucagacguugccuuuugauauccacgaugcccucaguaaguacaaagcaacaaaaguacaaaaaauggacuccgaaaaaggauuguugaacuuuuuuguaaaccaauucucuucuauugaucccgauuugauaauaggccaugacuuacagggcuaccaaauuaauauuuuagccgaaagacuuucaaaacucaauacaaauauuuucaauaaauugggucgcuugaaaagaucggaaaagaaaaauuuggaaaaaagucuuuuugcuggaagauuaguaugcgauauaaaaauaucagcuaaggaauuaauaaaaucacguucauacgauuuggacgccuuaugccaaguuguucugaaacuuaacgaaaaucaaagaaucgaauuagaacccgaugauguaccaaagauguuuaaaaccacuucagauauucugaaauugguaucguuuaccaugcaggacacuauguauauauuaaaaaucauguauaauuugaauguuauuccauuggcguugcagauaaccaauauagcugguaaugucaugucuaagacuuugaugggugguagauccgaacgaaaugaguuuuuguuguugcacgcuuuuuccgagaaaggcuauauaccuccagauaaggaguauaagaagaaaggagauggaaagcagaguucaaaaaagaaaccuacguaugcaggagguuugguuuuggaucccaaagucggauuuuacgacaaucuuauucuccuaauggacuucaauucucuauaccccagcauca

SEQ ID NO: 3948 - RNA, 746 nt, Diabrotica undecimpunctata
ccauacuucagaaccaccaaugccuagagaaaguaaaucaaagaaaaauuugcaaugggucccaucuuugccaaauuccagucauuuagaugcaguuccucaagcuacuccuauuaacaggaacagaguagcagcaaaaaaggugaggacguucccauuauguuuugaugacacagauccacaagugaacaucgaaaauucuugucagcaagaaguucuuguuccuauuagacuugauauggaaauugaaggacaaaaacuaagagauacuuuuacauggaauaaaaaugagaguuugauuucuccagaacaauuugcagaaguucuuugugaugaucuugauuuaaacccauugacauuugugccugccauagcucaggcaaucaggcagcaguuggaagcauuuccaucagaaccgccaaguauaauugaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauuuguaacagccauagcauacucuauccguggucaacucucguggcaucagaggacuuacgcuuucagugaagcuccgcuuccuacaguugaaguuccguucagaacucccagcgagucagaucaaugggcgccauuuuuggaaacuuuaacagaugccg

SEQ ID NO: 3949 - RNA, 778 nt, Diabrotica undecimpunctata
cuagagcuguacaugugucccauuauagcgacagaaauuugguacugauuucgacuguuaaugauaaagaugugcuuuggugcaugaguucagauauguuucccuuuggucagacuuugauggaggcuuauaguguuguaaaucuagauggaccagcauuagcuauaucagaggugcggcauccaacuccuuuaccguuaccaucaaaccaagaagcgccaccucugguugucagacaacacgcggaaccaccuaagaaauauguggucuuaacaucucacaguguucagauuuuuauuaaacugaggccaguugauauucucaaucagauacuuagagauagucaaggcuuagacacugaagcgcuuaagacguuuuuuacgauucaaaaagaggaccaagcuugcgcaacuuguuugauucuggcuucuuuagaaagugaugagaacguugaaguugcagaauaugccacaagggcuuucuuuuuguaugguggagaaccuaaacuggcgcaagccaauauauaugccggacccaguguauuugcuccucaaauaauaucaacaccugcuccacaccaauaccagucucagcaguaccaaaccgcucaacacuuccaaucuaauaugucacaaacacugccaacuguuccaaauacuaccggauaugaauucaccgguccguuuauuuuuucggcgaaacauaauaguuuauauuuguauuuaaguagaauauugcgaccaguuuggaacuugagaacgguugauaagcuuucugu

SEQ ID NO: 3950 - RNA, 656 nt, Diabrotica undecimpunctata
uugugcuuccuacaaaucgagcaauuggucaccuauuauuuuagaaacauuaccugaugccaaucaagcaccugcuaaugauggagauagugauccuagacaaguguauuugcaacacauuuuccaucccggcagauuuccuuugcacauaauaagcaaagcucuuucuauuuacaagaggucuacuauuuuaucugaugcccaaauaucagccucagcuuuaaaacaaagaauuugucuagcuguggauaaugaaauacaaaauacguuaaacggaucuaaugugaaugaugaugaauauuuagaaugugcagacugguguuggcaaaaauucuauucuugcuguguacaguaccauaucgcuagcuuaaaaccucuuggucuaauguuauuaccuucugucucuggagcaguauuuuugaaaaaaucgacguuuucauuccuuagaccuuuggauccucuggaacacaugacucucugcuaugaagauguuuacagagaccaauucaucaauuuuuccauguuagcugaagaucuagacacgacagaugacguaaugaacuuguuuaaagucaucguauauuuagaacaacaaaugagugaaucauucgcccaggcauucgagaaagaaauuuuuaaucuacgugcaccugaug

SEQ ID NO: 3951 - RNA, 708 nt, Diabrotica undecimpunctata
ggaagcuuuuacuacaacgcuucuaacaaaucuuuuuggaauacuagaaaaaccuguuucagaagaaaaugaguauguuaugaaagcacugaugagaacauuuucuacauuacaagaaagaguccuaccauucuugaacgucgcauugccaaaauuaacagaaaagcuacaauugguugcaaaaaauccaucaaaaccucauuuuaaccauuaucuuuuugaaacauuuucauuggccauaagaaucguauguaaggcaaaucccacugcuguuacagcauuugaagauauauuguuucccauuuuucaaggaauucuacagcaggauauucaagaauuuauuccuuauguauuucaaauucuuucucuuuugauggagaguacaccucaagguaauaaucuggaacccuacaugcagcuuuuaccauucuuguuggcuccugugcuaugggauagaccugcuaauauuaguccacuaguaagauuauuaugcgcuuucgcucuacaagcagcuccacaaauuguaucgcaggauaaagugagcggauuucuaggaguauuccagaaauugauugcuucaaaaacucaugaucaugaggguuucuuuuugauucaaaguaugauucaacauuuaccaauggaagcccuagcgccuuaucacaaacggauauuuucccuuuuguuucuaagacucuccuccaguaagac

SEQ ID NO: 3952 - RNA, 461 nt, Diabrotica undecimpunctata
cuugaacccauuucaguucgaaauaacuuucgaguguauagaagaacuuagagaagauuuggaauggaaaaugauauauguagguucagcugagagugaagacuaugaucaaacuuuagauucaguuuuuguaggaccuauacccgaaggcaaacacauguucguguuucaagcggauccuccaaaugucucacguauuccagaaaaugaugcucuugguguuacaguuguacuuuuaacauguucuuauagaagucaggaguucauucguguaggguauuuuauuaauaaugaauauacugauccagaacuuaaagaaaauuuaccuaguccuccacaauuugauaagguaacccgaaauauucuagcaucugaaccuagaguaacccgauucaaaauaaauugggaagaaacuaaccccacagaaaauaacacaaacucagaccaaaauggagcaucag

SEQ ID NO: 3953 - RNA, 668 nt, Diabrotica undecimpunctata
cuuaccaaaugcccuucaacagcaacagcagcagcaacaacagcagauugcaacuaguaguucccaaguaccuccuuuggcaccaaugggaggcuuaacaccuacucuuggacuuggcaugggucaugccaugucuguaccacaaaccaaauauguaacugguuuugcauugcccaugaguucaaugaaugcacaaacuccucaacacacaaugagcccuauggucaauuuaggggguucuauaacaacaggagcaggaguaacuccaacaauggcuccaucaacuccaucgccaaugacuccaaugacaccucauucugcagauccaggaaucauuccacaauuacaaaauauaguguccacaguaaaucuaaguuguagauuagacuuaaagaaaauugcccuacaugccagaaaugcugaguacaacccaaaacguuuugcagcuguaaucaugaggauacgugaaccacguaccacagcucuaaucuucucuuccggaaaaauggugugcacuggagccaaaagugaagaagacucaagguuagcggcccgaaaguaugccaggauaauccaaaaacucggauucccugcgaaguuuuuagauuucaaaauucagaauauggucggcaguugugacguuaaauucccuauaagacuugaagggc

SEQ ID NO: 3954 - RNA, 335 nt, Diabrotica undecimpunctata
gaccuaugcagaccaaaugaauuucacuuuugccgcuggaaaucagguuuacuauacugcaacuucaguuaaacaggucgauguaccaucuuucucugguagcuuugguauccuuccugcccacguacccacacuggcuguguuaaaaccuggaguugucacuguuuaugaagaugaugguaaaguuaagaaaaucuuuguuuccagugguacugucaccauaaaugaugauucaucaguacagauucuugcagaagaagcccacccaguagaaaacauugaugucaaugcagcaagagauauccuuaccaaagcccagagccaguuaucaucug

SEQ ID NO: 3955 - RNA, 658 nt, Diabrotica undecimpunctata
auaucauccucagggaccaacacagcuucuggauacguuuguaaauuuuuugaguagaaaaaccgacuuuuucauuggcgccaaggaaggagaaugggaaaaguuggugauggacacuuucaaaaaauacgaaaaguuaagcaggucaaagcacgaggaggaacuaaaagaaaagcgugaacaagaagcucgaaaaaaagcagcugcugccaaaaaggcagaagcugaaguuguuaagccugcucaaaucacugaauugacugaugaagaagcugaaaggauucaggcugagauaaaugcuaaguuaaacacuucuguuaacgcugaaaguucuucaaaugguucagaagcugcagcugcgacuaaaaaaguagaagaagaugaggaugaaucugagaaaggcaagauacugccuaacacaggaaauggaugugaucuagagaaguacaaguggacacaaaccuuaggagauauugaguuaaaaauuccccucaaaguaaacuucaggguaaagcagaaggaucucguaguaaauaugacgaagaagcacuugacgugugguaucaaaggccagccgccuaucauagacgacgauuuuccacaugaaaucaaauuagaagagucgucuugggugaucgaggacggaaaggaccuauua

SEQ ID NO: 3956 - RNA, 350 nt, Diabrotica undecimpunctata
auaaaaagcauagcgaucgcgaaagguggauauguauuuauccugcuuacauuaacaacaaaaaaacauuggcacaagggagaaaaauagccaaagaaagaugcguggaaaauccuacccaucaggaaauucgugauguucugguggcggcugguuugaaaguggguguugaaaacaaauuguacaguagggagagaaguaaagaaauguuauaucgugguagaauaagaauacaguuaaaaaaugacgaugguaguuuguguaaugacgguuucccuaccagagaaagcauuauguaucauuuaggagacaugauucccaaacugaaaagcaggcaaaauaaaagcuca

SEQ ID NO: 3957 - RNA, 746 nt, Diabrotica undecimpunctata
auaugguugcucuuugcucaauuugaaauucgucagaagaacuuaacuacagcaagaaaaauucuuggaaugucaauugguaugugcccucgagauaaacuuuuuagaggauacauugauuuagagauucaauuaagagaguuugacagaugcagaaaauuauacgaaaaauuucuugaguuuggaccagaaaauugcaucaccuggaugaaguuugccgaauuggaaacacuuuugggagauauugauagagcuagagguauauuugaauuggcgauuaaucaagcaaggcucgacaugccagaauuauuguggaaagcuuacauugacuuugaaauaucacaagaugaaccggacaaugcacggcagauauaugaaagacucuuggaaagaaccucccacguuaagguuuggcuaucguaugcuaaauuugaacuuaacaauccaacagaagaugaauuaaaugugcgcuuagcuagaagaaucuuugaaagggccaaugaaaaucuaaagagcucuccggagaaagaagcaagagugcuccuauuggaaaauuggagggaguuugaaaauaaucauggggacgaaucgagcaaagaaaaaguuaaugccaaaguaccaagaagaaucaaaaagaggcagaaaguuguugaugaggacgguguggaacaaggaugggaagaaguauuugauuacauauuccccgaagacgaggcuaguagacccaacuugaaacuucuugcagc

SEQ ID NO: 3958 - RNA, 654 nt, Diabrotica undecimpunctata
ucaucauccaacuguucguugccggucucauuguuuugcuucucgaugaacuucuucagaaaggauaugguuuagguucugguauuucccucuucauugcaacaaacauuugugaaacuauuauuuggaaagcguucucaccagcgacaguaaacacuggaagaggaacagaauuugaaggagcugucauugccuuguuccacuuauugaccacaagacaagacaaaaucagaggauuacgugaagcuuucuacaggcaaaaucuucccaauuugaugaaccuuuuggcgacaguacucguuuuugcuauaguaauauacuuccaaggauucagaguagaucuacccaucaagagugcaagauaccguggacaauacuccagcuauccaaucaaauuguucuacacuucgaacaucccuauuauucugcaaucugcccuuguaucuaauuuguaugucaucucacagauguuggcuguuaaauuccaagggaacuucuuaauuaaucuauuaggaguuugggcugacguuggaggcgguggcccagcuaggucuuaccccauuggaggauuauguuacuacuuaucuccaccugaaaguguaagucacauucuggaggauccaauccaugcaaugcucuacaucgucuucaugu

SEQ ID NO: 3959 - RNA, 333 nt, Diabrotica undecimpunctata
cgaccacauuauacguuggaaauuuaucuuuuuauacaacugaagaacaaaucuaugagcucuuuucaaaauguggggauauaagaagaguuguaauggguuuagauaaauauaagaagacacccuguggguuuuguuuuguagaguacuauaauagagcugaugcagaaaacuguuuaagguauauaaacgguacucguuuggaugauaggauaguaagaacagauugggaugcuggauuuauagaagguagacaauaugguagaggaaaaacaggaggacagguacgugacgaauauaggacugauuaugacucuggaagaggaggguaug

SEQ ID NO: 3960 - RNA, 551 nt, Diabrotica undecimpunctata
aaacuuauccucuguuggccaguuaaguucguauuccacaacaaaagaauggacucguggaagaaaagcacuuuugggaagcuuagggcuuauugcuggugguacuggagccuugcuguuugcuuuggaccaaucaguuaaagcaucugaucuagaauugcauccuccaaagaauguuuggagucauucuggaacuuucaauuccuuggaucaugcuaguguaagaagagguuacgaaguauacaaacaaguaugugcugccugccacucaaugcgcuucauugcuuaccguaauuuaguuggaguuacccacacugaagaggaagccaaagcugaagcugaagaacaaaugauugaagauggcccugaugacacggguaacuucuucaaaagaccaggaaaguuaucugacuacuuccccaguccauaucccaaugaagaagcagcccgugcugccaauaaugguucauauccuccagauuugaguuauauuguaucugccagacauggaggugaagauuacauauuugcccuuuuaacgggcuauugcg

SEQ ID NO: 3961 - RNA, 681 nt, Diabrotica undecimpunctata
acaccuccugaaaaguguuuuuuacccaagucucauauucauacauggacugggcacuccaaagguguugcagccaucagaugguuucccagaacagcacauuuguuccugucugcuaguauggauuguaggauuaagauuugggaaguuuauaaugagagaagauguauuagaacuuacuaugggcauagacaagcugugagagauauuaacuuuaauaauucuggaaagcuuuuccuuucagcuggauaugacagguauauuaaacuuugggacacagaaacuggacaaguuguuucaagauucacuagucgaaaaauuccauacuguguuaaauuuaacccagauaaaaauaagcagcauuuauuuguugcugguacauccgacaagaaaauuaucuguugggauacuaggucuggugacaucguucaggaauaugauaggcauuugggagcugucaacagcauuacuuucguagacgaaaaccgaagguuuguuacuaccucagaugauaagucguuaaggguaugggaaugggauauaccugucgacaugaaauacauugcagauccuacaaugcacagcaugccagccgucacaccagcaccuaauggaaagugguuggcgugucaaaguauggacaauaagauugugauuuucuccgccaugaaucguuuuaaa

SEQ ID NO: 3962 - RNA, 664 nt, Diabrotica undecimpunctata
ccacuuuuugaaaagaggccuagaaauuuuggaauuggccaggauauucagccuccccgugauuuaucucgauuuguaaaauggccaaaauacauucguauucagagacaaaaagcuguacugcaaaagagauugaagguuccaccaccaauuaaccaauuuucucaaacuauugacaaacaaacagccacccaauuauuuaaagucuuggaaaaauacaggccugagacagcccuucaaaagaaaaauagguuaaaggcuaaggcugaagcuaagguugccaaaaaagaagaggcaccugcuaagaaaccaaacacauugaaggcuggugccaauacaguuacuaaguugauugaacagaaaaaagcccaauugguuguuauugcacaugauguugacccaauugaguugguucuguuucuaccagcccuuugcaggaaaaugggugucccauacugcauaguuaaagguaaagcaagacuuggacuucuuguaaggcgcaagacuuguucagcuguagcucuuacacaaguugacucuggagacagguccaacuuuaacaaacuuuuggaaguaauuaaaacuaacuucaacgaccguguugaugaaaucaggaggcacugggguggugguuugcuuggauccaaaucugcugcucguauug

SEQ ID NO: 3963 - RNA, 713 nt, Diabrotica undecimpunctata
gauccagaaagugguggaauuagugccugcuuaaaccaugauccccauauuuuacauacacuuagugcuguucaaauucucugcaucuacaauaaauuagaggcaauaaauguagaggguguuguuaaauauauugcaagccuucaguuaccugaugguaguuuuacaggagauaaguggggugaaguugacacuagguucucauuuugugcaguugcaacauuaucauugcuuaauaaaauggaugcaauugauguaaauaaagccauagacuuuguuauacaauguaaaaacuuugauggugguuucggaucuaggccacuuucagaaagucaugcaggguuaauguauugcuguguuggcuuuuuaucuauuacaaauagguuagaugccauugauagagauacccuugcuuggugguugugugaaagacaauuaccaucaggugguuuaaauggcaggccagaaaaauuaccugauguauguuacucaugguggguauuaucaucauuaaccauguuaggcaggcuccauuggauugaugccaaugcucugaaacacuuuauuuuggcuugucaagauacagagacaggaggauuugcagauaggccuggugauauugcugauccuuuucauacuauauuuggguuagcagccuugucccuuuugggacaugauucuguaaagaagauuaauccuacuuacugcaugcc

SEQ ID NO: 3964 - RNA, 696 nt, Diabrotica undecimpunctata
ggaaaaucacauaagcagccacaacgauaggucgcaguucaacgaucuccagagucuuuugugcgccacccuucaguccguacucagaaaaguuacuccggaagacgcgccgcacaucucagacgccauaaugaccgccauguugaccauguucaauuccaauucguguaagaguggagguguucaagaagaugcuauuauggccgucucgacgcugguggaaguccugggagaaaacuucauaaaauacauggacgcguucaaaccguuccucuaccucggauugaagaaccaccaagaauaccaagugugcguuacagcaguaggcuuaacuggcgauauuuucagagcccucaaacuaaaagcgcuaccguacugugaugaaauaaugaccuuauuacuagaagaucuccgcgaucagucgguucaucguagcguaaagccagaaauuuugggcguauucggagacaucggucuuagcaucggcuccgaauucaagaaguaccucgacgugguucuguccacuuuggcucaggcuucgcaggcccaagucgaucgcaacgacuucgauauggucgacuaucucaacgagcuaagagaaggaguuuuagaagcuuauacgggcaucuuacaaggucucaaaggcgacggucccacuccacauccugacguuuugauacuugaaccccacauucc

SEQ ID NO: 3965 - RNA, 682 nt, Diabrotica undecimpunctata
augucaguggaauuugacgaauuugccaaagccagggaaaauccuaacgaagauauggcuaacuuuguagaauuuacugaugaggaggguuaugggaaguauuuggauuuacaugaauguuaugaaaaguauauaaacuuaaaaggcauagaaaagguagauuacauuaccuacuuggguauguuugaccaacuauaugauauuccaaaagaaagaaaaagcggugaauauaaaaaauauuuguuaugccuaauugaauauuugacuugguuuguacagcguauaaagccucuaaaggauuuagacauugaucuacaagaacaaguggagcagguucuggcaauuugggauacuggaagugucccaggguggccaaaagaaacaggaucugcacuaaccaauguuggggcccacuuggaucucucagcauuuucaaguugggaagaauuggcaucguuagguuuagacagacugaaaucugccuugauggcguuaggauuaaaauguggagguacuuuggaagaaagagcucaaagauuauucucaacaaaaggaaaagguuuuuuggauccuucacuuaugacaaaaaauaauaaaggcaaagccaacaaagaaaaggaauuauugaggcaaagagaacuugcaacauuagaagcccaaguguacagauuagcagaguggg

SEQ ID NO: 3966 - RNA, 495 nt, Diabrotica undecimpunctata
cugcaagacucucguacuuucauaggaacuuucaaagccuucgacaagcacaugaauaugauauuaggagacugugaagaguuucgaaaaauuaaaucaaaaauguccaaaguugaacgugaggaaaaacgaguauuaggauuuguuuuacugagaggagaaagcauaguuucuuugacaauagaagguccucccccuccagaagaagguuugcccagaguaccaauuccuggcgcagccccaggaccaggaauugguagagcuggagguagaggaaugccaccaggcauggcagguguacccguaggcuugcaaggaccuguaagaggagugggaggaccaucccaacagguuaugacaccaggagguagaggccaaguaucagcuccuccacaaaugaaucaaggaccaccaaggaugggaggaccaccgccagguaugaugggaccuccuccuggaaugaugggcauggccccccaaaugggaaugggacgu

SEQ ID NO: 3967 - RNA, 761 nt, Diabrotica undecimpunctata
uuuggcaaguggauguucuaugggugaauuacauuauucuuauaagauuggaaggucuacuguggcaggaauaauucaugaaguauguaaaguguuauggagagaacuaaaaacuguaguaauggaaauacccacagcagauaaauggagagaaauugcuaacggguuugagaaacacgcuaaguuuccuaacugcauuggcgcaaucgaugggaaacauauacgguuauuccaaccggcacagucugcuucacuauauuauaauuauaaacacuuuuucucacuacuacuacuagcauugugugaugcaaauuauuguuuuacauggguugauauuggugcauaugggaaaaauagcgacucgggaguauuucaagaaucuacauuguacagaaugcuuauggagaagacacugaacauuccugaaccaacggcaauaacagguggguccauugugcccuauguaauagugggugaugaagcuuuugcucugauggaaaauuuaaugaaaccauuugguggaaaauuacucacguacgaaaaaaaaauuuuuaauuaucguuuaacucuugcaagacgguauaucgaauguacauuugguaucaugugcaacaaauggcgaauauuacaucgaccguuagauguaaauauuaauuucgcugaagauauugugaaagcuauuugcguacuccacaauuauguuaggcaaagagaugguucuacguuugaagagacgcuuuauacagcaccgcuaacuaauc

SEQ ID NO: 3968 - RNA, 669 nt, Diabrotica undecimpunctata
auagacugucgccgauaguaccuaugaucaaaccaguaccaauuagauugaaaccaguuggaggauugcuuguuaaagaaacucccagugauaacaaagaaaacaucaauacagauagucuuaacguaaugacaaagaucaaaucugaaaacaaaccgucgauaccgacgaaagauucaggacauguuaccgugacauuaacauuaacuucaucugcugcugaagacauaauggguguacuaagggacuuggcaaacauucuacaaauuccagcuccuacgaguuaucaaauaguggaaaggacaacaaccccucccagucagaaacucgggcucuaccggaccaagggcaaggaugguaaagagggagcgccaauagacauucaaaguauucuuaauggggcuaccaaguucuguaaacacugugauguaauuauuuuaagcaauuugauaaggagaaagguuuccgaccuuccuuucuuggccaaagacucagaacuuuuaagcgacggagaggaacuauucuucugcagcucgacuugcuacaugcaguuugcccuaaugcauagaucaccuucuauuuccgaagauaaggccgccgaaauaaucaaccauuuaucucagaaggauaacgagaguaaacaaaaaaugcagaugauggaaccauuug

SEQ ID NO: 3969 - RNA, 692 nt, Diabrotica barberi
uacaucagucaguagcuggagauguuacuuccguauuuaaagguaaaaccgcuguccaguuagcagcuuuagagaagcaaauagagggaaaaauuagcggcaaagcugaugguauugauauagguuacugggaaucccuguuaucacaacuuaaggcacacauggcuagagcaagacuacgagauagacaucaagaaagcuugagaagaaaacuucaaguuuugaaagccgaacaagccaucauuguaacagcuccaagcgaaagucauuccaguggaggcgaggaagcuccaacgaaagauguacaagaaccaaagccuggaccuucucaggaaccugaugauaagcaaaaugaugaggaggaaccugcagaugaggaagcagcuaauucauggcuaaaugaguguuuugaugccuaugaagcugguggauauagucccaaguuucuuacuccagaugaaauagagccgggaacaauuguugugauagaagaagaugauuugaaaagauuggaauuugcaagaauucagguuguugguaaagguaaaacuguggaaaauguuauaacgaaggaagaguugaugcuacaaaaagaggcucguaaaggcauggauggagacgaggcacaguucucuguagagcaagcuuuggacagccaagucuaucuuuggucugacaaauaccguccuagg

SEQ ID NO: 3970 - RNA, 737 nt, Diabrotica barberi
caaggcagaugcuuuuacagaauccgcagcuugccuaugcucuuuuacaagcucaaguuguaaugaaaauuauugacgcagcuacugcaguuaguuuacuucauccugugaaccaaguaccagcgacacuuaugccuggagacaagaauguuccuguccaaguaccaguuaauaaucaguacagggagcccccagcaccuguucaaccgccuguccauccaagacaagacuuccaaccuguuccuccuccuguuaugcauccaucucaaaaucaaguauuuccaagucaagauauagaucugagauccauugguggugugccagaucuaagaaaccuaagacccaugggugaccaggauaugagacaaaugccaucugcuauucaaaaucccuuaccaccuacuaucggagaaagcuuuauucgagauccuagagcagcacaggcguuugcaggagauccaaggcaagcacgcauggacccacgucaaaaacccauggugccuccuccucaaggccaaaugcccauaccaccuccaaucgcaagaccaccuguaaugccgccucagccucaaguuccugugacgagagcagcaccucuaccucaaccgucuccagcuccuacuccugcaacggccaguccaaauguugcaaaugccggggcuucggaucaagaaaaggccgcacucauuaugcaaguauugcagcugucagaugaacagaucucuaugcuuccaccu

SEQ ID NO: 3971 - RNA, 659 nt, Diabrotica barberi
cgagagcagcuaaaagaucuuacaaaacaauaugauaaaucagaaaaugaucuuaaggcuuuacagagcaugggccaaauaguuggagaaguacucaaacaacucacugaagaaaaauuuauaguuaaagcuaccaacgguccccguuaugugguaggaugucgucgucaacuggacaaggcaaaguuaaaagcaggaacuagaguagcauuggauaugacuacauuaacuauuaugagguauuugccuagagaaguggacccauugguguauaauaugagucacgaagaucccggagauguuacuuauucugcuauuggugguuuaucugaacagauuagagaacuucgagagguuauugaacugccuuuguugaauccagaauuguuuaugagaguuggaaucacuccaccuaaagguuguuuguuguaugguccuccagguacuggcaaaacucuacuagcuagagcuguggcgucucaguuagaugcaaacuuccucaaagucguuuccagugcuaucguugauaaauauauuggagaaucugcaagacugaucagagaaauguuuaacuaugcuaaagaccaucaaccuuguauuauuuucauggaugaaauugaugcuauuggugguagaagauuuucugaggguacuucagc

SEQ ID NO: 3972 - RNA, 630 nt, Diabrotica barberi
ggcuauuucucaugcagguacuugccugggcauuuuagcaaaugauggcauuuuguuggcugcugagaggcguaacacuaacaaauuauuagaugagguuuuuauuucagaaaaaauauacaaacucaaugaugauaugguuuguaguguggcuggaauuacaucagaugcuaauguuuuaacaaaugaauugagacuuauaggucaaagauauuuauuucaguaugccgaaucuauuccuugcgaacaguuaguuuccuggcuuugugaugucaagcaggcauacacucaguauggagguaaacguccauuugguguuucaauauuauauaugggaugggauaagcauuauggauaccagcuauaucagucagaucccaguggcaacuauucugguuggaaagcuaccugcauaggcaacaacaguucagcagcaauuucaaguuugaaacaagaauauaaagaaggucaaaugacuuugaaggaugcaaagacguuagcaguaaagguucuggcaaaaacauuggauauggcaaaacuaacuucagaaaaaguggaaauggcuacacuuacccgcaaaaaugauaaaaccaugaucaaaauuuuaagcggcaaggaaguagaagaacu

SEQ ID NO: 3973 - RNA, 769 nt, Diabrotica barberi
uguguacccuauguagcagauccugagaauacuacucuacugcagacugcucuuuuacuguuuagaaaguuugaucaguauccccaggcacugagauuagcaaugcaguuaaaugacuuuggauuaauugaagaaauuuuugucaacugcccugauucggacguacaaaaacaacuggcuuuuauguuaggacgacaacagauauauguugaaauuccugagcauacgccugaauacgaagaucuaaucgagauaauggcaaacugucaucuuaauaaccacuucuugaaccuagcccgcgaguuggacauuauggauccuaagaccccagaagauguuuacaaaucccauuuagaaaauagccgucccccauucgguggaaaccaaguugauuccgccagacaaaaucuagccgccagcuuuguuaacgguuuuguuaaugcagcuuuuggucaagauaagcucuuaauggaggaugggaauaaauggcuuuacaaaaacaaagaacauggaaugcuuagugcuacugcuucuuugggacuaauucuuuuaugggauguagacgguggucuuacuccuaucgauaaauacuuguacucuucugaggaccauaucaagucuggcgcuuuauuagcuuguggcauuguaaacugcgguguaagaaaugaaugugaucccgcacucgcacuuuugagugauuauguucuucacaacacaaauauaaugagaauaggggcuauuguaggucuagguuuagcguauguugguu

SEQ ID NO: 3974 - RNA, 688 nt, Diabrotica barberi
cucgaacaagcagcauuuaggggucaauggggcgcaaggcguucagucgcccaauaagccacggaauaaaucuagaacuagcgccgaggguagagagugcgucaacugcggggcgacaaguacuccacuguggagaagggacggcacuggucauuaucuaugcaaugcauguggacuuuauuacaagaugaauggacaaaacaggccacucaucaaacccaaaagaagacugaguuuacaaagugcggcgaggcgagcaggaacgaguugcgcgaacuguaaaaccacaacuacgacccucuggaggcgcaaucagaacggggagccugucuguaacgccugcggacucuacuauaaacuacacaacguuaacaggccauugacgaugaaaaaggaaggcauucaaacucgcaacagaaaacuuucuucaaagaguaaaaagaaaaaaucgggugcaucgugucugucuuugggcggcaugaugggugacaugaugaagccuuuagauagcaaaggugccuucgguggaggcuucggcgcagguauggguggcggacauccgcaucuuaacgcugcucuucauccucaccacgcuaugacacauuggcaucaguaucagcauacccaaggguucguuucagguccaccuccacccgccccaccauccgcagcuucguaucaccaucau

SEQ ID NO: 3975 - RNA, 674 nt, Diabrotica barberi
uucauaccaacacugacuggacuauuauuuucacgcuuuuggaaugugugggagcaggggcucaaccaccuaagccuguuagcucagccgaagauacagaacugaaaaguaaaucugacggugaaacuuccgauaaccacgaggaagagggcacccuuucagauucagaaggaaggaagaguccgaaagauaauacccagaggucacaaaguccugugaguguuguaacuucgccuguuggaacuccaaauacagguggauggauuuugguaggaaacgaaggugaaauucaacccgucaugggccgcaccgucccuccaacccaauacggccuagcguuagagaagaaccuuggaagccaugaccccagaaguaugaugaagugcugcgaaagucuugcguuucuaguaagagaugucgcccauauuacaccuuacaauuuugacguuuguguucauuguauaaggacuuuuguagaagcuagcuuacaugguucuaauuucaaaagguugagagauucuaggucuagaaagaaaacuuuagauaggacuagaacuagaaaaaguccaacaaguagucccgaugaggaagauagugacgacgaaaacauuccaagugguuaucagcaaauaucaauacaguuauuagauuuaaugcauacuuuacauacgcga

SEQ ID NO: 3976 - RNA, 638 nt, Diabrotica barberi
gcaguuuaguacaaaaaccugaaguaaauucuauaaucuauaacgaaaagugcuuaaauuuuaguggcaaaauguccauucuagcuuacaaugguggugcuaugguggcgaugaagggagaaaacuguguagcaauugcagcagauaggcgguuugguauucaagcccaaacaguagcuacaaauuuccaaaaaaucuuugaaaugggaccacauuuauaugugggucuuccaggauuagccacagauacccaaacaguuauggaaaaacuccguuuccgaaaaaacuuguacgaacuuaaggaaaaucgaaaaauaucuccaaaaguauuugccucuaugauaucaaacauguuguaugaaaaaagauuugggccauuuuuuguggaaccuguaguagcuggacuucuaccuaauacuuaugaacccuuuaucuguaauauggauuuaauugguuguauaaaccaaccuucagacuuuguuguugguggaacagccucagcacaguuguaugguaugugugaagcacuuugggagccuaacuuaggaccugaggaucuuuuugaaaccaucucucaagcucucaucaaugccuuugacagagaugccauuucugguuggggagcuacaguguacauc

SEQ ID NO: 3977 - RNA, 731 nt, Diabrotica barberi
ggauccaguaauguggcuagauagacuuagugcggugcuuagauauguuaauguacauauuccggaagguguggaaaacccuuguaaaccgguaauucucgaaguguggccgguauugucucgcacguucgauaaauuccaaagugacauuaggauaauggagagauguugucgugccgugcguuucaugcugcggugcgucgcgcaagaagugcgugaacucuuagaaagccuaguuggacaaauagugaggaucuauacguuauaccaacauucguguuuucucuaugucgguaguauacucguggacgaauacgcaauagauccgauaugcgugccaggacugcuggauaugcugcaagcguuucuggaaccuaccuuucacguguugcaggaggagaacgggcugaagaaucauccugauacaguggaugacuuuuuuagguugugugcaagauuuaugcagagggcgccuuuagcauuuuuaaaauguucuuccuugguccacaucuuacagugugcccuuuuggcuucuucccuggaccaccgagaagcgaauaugucugugaugaaauucuuuuacgauuugauaaaccagggccagagcgggagggcugaucccgaauucaaucaacgacagauguuaguuaaaagcauccucgacgaguauggccaacaacuagucucgaaucuaauccauucuugugucuucuaccuccauuccuacaugc

SEQ ID NO: 3978 - RNA, 744 nt, Diabrotica barberi
caauccuccaccaccaaauauaccaucuaguggcgguacgaugauucaaagaccugcuggugcucccuauucaccaaugagagguggaauuauuccgccacagcaaggaaauaaaaggccugcagacaauaggacucaaaugcaacagaaaaguaaugaauacagccauaguacaaguaagaagaagaaaaagcuggcggauaaaauccugccacagaaagucagagauuugguuccagaaagucaagcuuacauggaucugcuagcauuugaaagaaagcuggacucuacuauuaugagaaaaagauuggacauccaagaagcucuuaagcguccgaugaagcaaaaaaggaaguugagaauauuuauuuccaauaccuucuauccugccaaggaaccucagccugaaggacccgauggaccaugucaggaaggcacuguugcgucuugggaauuaagaguagaaggucgucuuuuagaagauccaaagaacgauccaaauaaaguuaaacgcaaguuuucuucuuucuuuaaaucccugguuaucgaauuggauaaagagcuguauggaccggacaaucauuuaguugaauggcacagaacccuaaccacucaagaaacagaugguuuccagguaaaacgcccuggugacaagaaugugagauguacuauuuuguugcuucuugauuaucaaccucugcaguuuaagcuugauccuagacuagcuagacuuuugggaguuca

SEQ ID NO: 3979 - RNA, 285 nt, Diabrotica barberi
gaacccacauuagacgaguuagaacaaaaaaugagagaaguugaaacacaaucucaugaggguaaaaggaaaaaugaaucauuguggccaauuuucaaaauccaucaucaaaaauccagauauauauuugaucuuuuuuauagaagaaaagcaaucagcagggaacuauaugacuauugucuuggugaaaacauugcagauaaaaauuuaauagcgaaguggaagaagcaaggauacgagagucuuuguugcuuaagauguauucaaacgagagacaccaacuuu

SEQ ID NO: 3980 - RNA, 650 nt, Diabrotica barberi
ugcuauggacacagaauucccugguguaguugcgaggccuauuggagaauuuagaaguucugcagauuaccaauaccaaaugcugaggugcaauguagauuuauugaggauaauacagcuugggcucacauuucuugaugauaauggaaaaacuccagggggugccuauacuacauggcaguucaacuucaaauucaaccuucaggaagacauguaugcacaggauaguauagaccuccugcaaaauucuggaauucaguuuaagaaacaugaggaugaagguauugaaccucuugaauuugcggaacugcugaugucaucugguauuguccugguggaaaauauaaaauggcuguccuuccauucugguuaugauuuuggcuaucugauaaaacuguuaacggacaacaacuuaccucaagacgaaacagaauucuucgauuuguuaaaauuauauuuuccuaccauauaugauguaaaguaccuuaugaaaucgugcaaaaaucuuaaaggaggauuacaagaaguggcagaacagcuagaacuugaaaggauuggaccacaacaucaagcagguucagauucucuucugacaggaauggcauuuuucaagaugaaagagauguucuucgaagacacaauagacgacu

SEQ ID NO: 3981 - RNA, 786 nt, Diabrotica barberi
ucugguacugguaaaacagcuaccuuuuccauuucgauuuuacaagccuuagauuugacaaugcgagaaacgcaaguuuuaugcuugucuccuacuagagaauuggcuguacagauucaaaaaguuauucuagcuuuaggugacuucaugaauguucaaugucaugcuuguauuggaggcacaaaucuuggagaagauauuagaaaacuugauuauggacagcaugucguuaguggaacaccuggaagaguuuaugauaugaucagaagaagagcucuaagaacaagaucuguaaaaauguugguuuuggaugaggcugaugaaauguuaaauaaaggauucaaagaacaaauuuaugaugucuacagauuccuucccccaucaacacaaguuguacucauuucagcuacacugccucaugaaauuuuggaaauuacuuccaaauuuaugacagauccuauuaggauuuugguaaaacgugaugaauugacauuggaagguauaaaacaguucuuuguggcugucgaaagggaagaauggaaauucgauacccucugugaccucuaugacacauuaaccauuacacaggcuguuauuuucugcaacacaaagaggaagguagacuggcugacagagaaaaugagggaaaacaauuuuacaguuaguucaaugcacggagauaugccacaaaaggaacgugacaauauuaugaaagaguuuagaucaggacagaguaggguccuaaucaccacugauguuugggcuagagguaucgacguacaacaa

SEQ ID NO: 3982 - RNA, 684 nt, Diabrotica barberi
agaaagcuggaugcaauguacuuuugguucaaaaaucaauuuugagggaugcaguuucagaucuugccuuacacuuuuuggauaaaaucaaguguaugguuauuaaggauauugaaagagaagaugucgaauuuguauguaaaucuuuaggaugccgcccuauugcaucuuuggaucauuuuguugcugaaaacuugguuacugcugauuuaguugaagagguuggauuggcaggaaauagaauggucaaaauuacaggugcacaaaaugcaggcaggacaguaacucugcugguuagaggauccaacaaauuaguucuugaagaggcugauagaucucuucaugaugcucuauguguaauucguugucuuguucgcaagaaggcacuuauugccggaggaggagcaccagagguugagguggcucuuaaacuagcggcuauggccaacaaacuggaaggcauugaugccauuugcacacgggcauaugcgaaugccuuagagauuauaccauuuaccuugucugagaaugcaggauuaaaucccauacagaccgucacugaacuaagaaacagacacgccaaaggagagacgucugcuggaauaaacguucguaaaggagcuauuacagauauucucgaagaaaauguuguucaaccacuuuuaguuagcacuucagcauuga

SEQ ID NO: 3983 - RNA, 748 nt, Diabrotica barberi
caaaacacugguaucguuggcucaacuacagguucaaauuauuauguuagaaucuuaucaacaaucgacagagaacucuuaaaaccuucugcuaguguugcucuucauaaacacagcaaugccuuaguagauguucuaccuccagaggcagauucuucaauaagcaugcuccaggcugaugaaaaaccagauguucaauacagugacauuggagguauggauaugcagaaacaagaaaucagggaagcaguagaguuaccuuugacucacuucgaauuguauaaacagauugguauugauccccccagagguguguugauguauggaccuccuggaugcgggaagacuauguuggccaaggcuguugcucaucauacuacagcugccuuuauucguguagucggaucagaauucguacagaaauaucuuggugaagguccgcgaauggugagagacguguuccgucuagcaaaagaaaauucuccagcaaucaucuuuauugacgaaauugaugcaaucgcuaccaaacguuuugaugcccagacgggugcugaucgugaaguccagagaauuuuauuggaacugcuuaaccagauggaugguuuugaucagacaacaaauguuaagguuaucauggcaacuaacagagcugauacauuagauccugcacuucugagaccuggucgucuggacagaaaaaucgaauuuccuuuaccagauagaagacaaaagcguuugauuuucagca

SEQ ID NO: 3984 - RNA, 282 nt, Diabrotica barberi
aaaugcuccgucacuaucaaaacuauguuagaagacuuaggaauggacgaggaagaagaagaagugguuccuuuaccaaacguaaauuccgccauacucaggaaagucauccaaugggcgacuuaccacaaagaugauccaccaccgccagaggaugacgauaacaaagaaaaaagaacagaugauauuuccucaugggacgcagacuuccugaaagucgaccaaggaacucucuucgaguugauuuuggcugcuaacuaucuggauaucaaggggcucuua

SEQ ID NO: 3985 - RNA, 753 nt, Diabrotica barberi
gaaugcaagcaauuaacggaaaaucaaguuaaaacacuaugugauaaggcuaaagaaauauugucaaaagaaucaaauguacaagaagugaaaugcccaguaacaguauguggagauguccauggacaguuccacgaucugauggaacuguuuaggauaggagguaggaguccagauacuaauuaccuguucaugggagauuauguagaucguggauacuauucuguugagacugucaccuuacugguagcacugaaagucagguacaaagagagaauuacaauuuugagaggcaaccacgaaucaagacaaaucacacaaguuuacggauuuuacgaugaaugucuaaggaaguacggaaacgcgaauguauggaaauucuucaccgaucuguucgauuauuugccccuaacagcgcucgucgauagucaaauuuucugucugcacgguggauugaguccuagcaucgacaccuuggaucacauuagggcgcuagaucguuuacaagagguaccucaugaaggcccuaugugcgaccuucucuggucagacccugacgaccgcgggggcuggggcaucuccccccguggagccggcuacaccuucggacaggacauuucagaaacguucaaccauaccaacggucugucuuuaguaucuagggcacaucaacucgucauggaagguuacaauuggugucacgaaagaaauguagugaccauuuucagcgcccccaauuauugcuaccgaugc

SEQ ID NO: 3986 - RNA, 693 nt, Diabrotica barberi
accaucagauaccaucgagaaugucaaagcuaaaauucaagacaaagaagguauuccaccagaucaacagagauuaaucuucgcuggaaagcaauuggaagauggccgcacccucucagacuacaacauucaaaaagaaucuacccuccauuuggugcuucgucuuagaggagggaugcaaauuuuuguuaaaaccuuaacuggaaagaccaucacccuugaaguagaaccuucagauaccauugaaaacgucaaagccaaaauucaagacaaagaagguauuccaccagaucaacagagauuaaucuuugcuggaaagcaguuagaagauggccguacucucucagacuacaauauucaaaaagagucuacccuccauuugguacuucgucuuagaggagguaugcagauuuuuguuaaaacacucacugguaagaccaucacccucgagguugaaccaucagauaccaucgagaaugucaaagcuaaaauucaagacaaagaagguauuccaccagaucaacagagauuaaucuucgcuggaaagcaauuggaagauggccgcacccucucagacuacaacauucaaaaagaaucuacccuccacuuggugcuucgucuuagaggagguaugcaaaucuuuguaaaaacacucacugguaagaccaucacccuugagguugaaccaucaga

SEQ ID NO: 3987 - RNA, 731 nt, Diabrotica barberi
cuauaucaaacgauggggcaacuauuuugaaauuauuggacaucguucacccugcugcgaaaacuuugguagauauugcuaagucacaagaugcagaggucggggacgguacgacaaguguaguauuacuagcaggagaguuuuuaaagcaaauaaagccuuacguugaugaggguguucacccaagaauaauaaucaaagcagucagaagaucguuccaaauuugccucgagaaaauaagugaaaucucuguuaaaaucaauaaaucaaaugcugacgaauuuagaucucuauuggaaaagugugcugcaacagcgaugagcucgaaauuaauuaaucaacaaagaucuuucuuuucuaaaaugguuguagaugcuguucuauuacuggacgauuuacuaccucucaauaugauugguaucaaaaagguacaagguggagcccuagaagagucacuuuugguagccggaguagccuuuaagaaaacuuuuucuuaugcuggguuugaaaugcaacccaagguauacaaagauuguaaaauagcucugcugaacauugaauuggaacuuaaagcugagagggauaacgcagaaguaagaguagauaauguaaaagaauaucagaaaauuguugaugcggaguggacgaucuuguacaauaaacuucaaaaaauuuaugagucuggagcuaauguuguuuuguccaaauuacccauuggagauguugcuacu

SEQ ID NO: 3988 - RNA, 747 nt, Diabrotica barberi
uuuuuacagagccucagaccaauccuggguugcacuagaacguauccaauuugucggugccuguaauccuccaacugaucccggcagaaagccucuaucccaccgauucuugcgacacguacccguuauuuauguagacuacccuggagagacaucuuugaaacagaucuacgguacuuucaccagggcuaugcuaagauuggcgccuggucugaaagguuaugccgaaccauugacuaaugcuaugguugaauuuuauuuggcaucucaagauagauuuacucaagauaugcaaccacauuauguuuauucuccaagagaaaugaccagauggguaagaggaauuugugaagcaauaagaccucuugauaaucuugcuguggaggguuugguaaggcuuugggcucaugaagcucuccgucucuuccaagacagauuagucgaagacaccgaaagacgguggacuaacgaaaacauugaugcuguagcuuuaaaacacuucccgucagcuaacugcgagaaagcuuuggaaagacccauucuuuacagcaauugguuaucuaaggauuauguaccuguuggaagggaacaacuaagagaauauguaaaggccagacugaaaguguucuacgaggaagaacuugauguuccuuuggugcuguucgaugagguguuggaucauguuuuaaggauugaccgaauauucagacaaccucaaggucacuuacuacugaucggaguuucugg

SEQ ID NO: 3989 - RNA, 695 nt, Diabrotica barberi
ggagauccagcggauaaauuuaggaaacgccguacugauguugaaggcgcuaggaauaaaugauuugguacauuuugauuuuuuggauccgccuccucaugagacuuugguguuagcauuagaacaauuauacgcuuugggggcuuuaaaucaucacggagaauuaaccaaauugggcagaagaauggccgaguuaccgguggaucccaugauggcgaagaugauauuagcuucggaaaaauacaaaugcucugaagaaauagucaccauaggagccauguuaucaguaaauggugccaucuuuuaccgaccaaaggauaaaauaauucacgcugauacugcucgaaaaaauuucagucacuuagcaggagaucaucuaagucuucuaaauguuuauaaucaauggagggauucugauuacucccuacagugguguuacgaaaauuucauacaauacagaucgaugaagcgagcccgagacgucagggaacagcugguuaacuugaugacaagaguagaaauagaaaucguuuccaacguuucugaaaccguggacauccgcaaggcuaucaccuccgguuauuucuaccacauugcuagauuuuccaaaggaggaaguuacaagacggugaagcacaaccaaagugucaccauccacccuaacagugcacuuuucgaaucauuaccuagguggg

SEQ ID NO: 3990 - RNA, 703 nt, Diabrotica barberi
gguaaaacagcaauugcacuugcaauagcccaagaguugggaaauaaaguaccuuuuugcccaaugguaggaucugaagucuacaguucugaaauaaaaaagacugaaguucuuauggagaacuuucgaagagcaauugguuugaggauuagggaaaccaaagaaguuuaugagggggaagucagugaauugacaccgguagaaacagagaacccugcuggagguuacggaaaaacuguaagucauguuaucauuggucuaagaacugcaaaggggaguaaacagcucaaacuggaucccaguauauaugaagcacuccaaaaagagaaaguugaaguaggagacgucauuuauauugaagccacaaguggugcaguuaaaagacaaggaagaucugaugcuuaugccaccgaauuugauuuagaagcugaagaauaugugccauuaccaaaaggagauguacauaaaaagaaagaaguuauucaggacguuacauuacaugaucuagaugccgcuaaugcuaaaccucaagguggacaagacguuuugucaaugaugggccaacuucuaaaaccaaagaaaacagaaaucacagauaaacuuagaaaagaaaucaacaaaauaguagauaaauauauugaucaagguauugcagaauugguuccugguguacuauuuauugaugaagugcacauguuggaua

SEQ ID NO: 3991 - RNA, 742 nt, Diabrotica barberi
uuaaaugguugugagcucgauagacugcaaaaaccuuccuuacuuauuacugaugcguuuaaugcuacuuaucaacaagccagaagaagggcuagagaugaaaaacuaaugaccaauauucuucaaacucuucggaacaaugguaacguacuuauagcaguagacacggcaggcaggguucuggaguuggcucacauguuggaucagcuauggcguaacaaagaaucuggccuauuggccuacucuuuagcguuuuuaaacaacgucaguuauaacguuauagaauuugccaaaucccagauagaauggaugagugauaaguuaaugagaaguuuugaaggcgccagaaauaaucccuuucaauuuaaacacuugcaguggugucacaguuuagcagaauuaaguaaaguuccuaguccaaagguuguucuggcaaguucacccgauuuggaaaguggguucuccagagaguuguuccugcagugguguucuaauuccaauaacaguauuauauuaacaacaagaacauccccugguacuuuagcuagagacuuaauugacaacggagcagaaagaaauauagauuuaacgguagaaaggcgaguaaaacucgaaggcguagaacuugaagaauaugaaaaacgacaacgagcgcggggucaaaauguagaaaaggaagaugcagauucggacucugauucugacauagaaaugucuguuaucaccaaagguagacaugaca

SEQ ID NO: 3992 - RNA, 738 nt, Diabrotica barberi
aacagcccuuuauacccaaggaaacaccuucagaauuugaauuuauagcugaucccccaucaauuucagcucuagauuuggauauuguuaagcuuacagcucaguucguagcuagaaaugguagagcuuuucugacacaauugaugaauagagaacagagaaaucugcaguuugauuuuuugagaccucagcacucuuuauuucaauacuucaccaaauuacuggagcaauauacaaagguucuuauucccccaaaaaguaugcaugaaagccugcgaaacgaggcuaauaguccgaagaauguuuuagagcaagucaaauaucgugcagaaugguuaaaguaucaagagcaacaaaaagccaaggaggaggagcuuuuagaacgagaaaggguugcguaugcacaaauugacuggcaugaguuuguagucgucgaaacuguugacuaccaacccuucgaaauuggaaauuuuccggcuccaacuaccccugaagaagucggagcccguauuuuaauucaagagaggauagaagaaggggaagauaucgaaaugcaauuagagagugaugaggaagaaccaccaguuacggaagcugguuuaaguagcaugcaggacaaaaccaaucggaagacacgcgacgauaccagaauucaagauauggaagaagaaagcuccgaugaagaaaaagaagaggaagaggaauuagcuuuaccuccaccaccaccaucuauucaac

SEQ ID NO: 3993 - RNA, 793 nt, Diabrotica barberi
uuaaucgcaugggcaaaaucggcaaucaaaagcguguuguugguguucuucuuggcugcuggcgugcuaaaggagucuuagauguuucuaacaguuuugcaguuccuuuugacgaagaugacaaggauaagucugugugguucuuggaccaugauuacuuagaaaacauguauggaauguucaaaaaaguuaaugccagggaacgaguaguagguugguaccacaccggccccaaacugcaucaaaaugauauugccauuaaugaguuaaucagaagguauuguccaaauuccguucuaguuaucauagacgcuaaaccaaaagauuuagguuuaccaacugaagcuuaucaagcuguagaagaaguacacgaugaugguucaccuacgucuaaaacauuugagcauguuccuagugaaaucggagcugaggaggcugaagaaguugguguugaacacuuauugagagauauuaaagacacaacuguugguacuuugucccagagaauaacgaaucagcuucuaggguuaaaaggucuccauucacaguuacgugauauuagggacuauuuggugcaagucugugguaaccagcuuccaauuaaucaccaaaucaucuaccaauuacaagacauauuuaaccuuuugcccgauauaaaucaggaugcauuuaauacaucguuuuacgugaaaaauaacgaucaaauguuagucguuuaucuagcagcuuuaguuagaucuauugucgcucuacacaaucuuauuaacaacaaacuaacaaauagagacgcgga

SEQ ID NO: 3994 - RNA, 758 nt, Diabrotica barberi
gaacaacacauucauccgacaaucauaauucgccaguacagacaagcacucgaagauaugauccaguuauuggaagguccauuaaguauaccagucgauagaaacgauaaaaaugcucuugcccaagucguaaaaggcugcaucggcacaaaauucauaaguaaauggucagauuuggcaguaaauauugcuuuagaugcaguaaauacaguauuauuagaagaaaauggcagaacugaaguugauauuaagagguaugccaaagucgagaagauuccuggaggauccauugaagaaucuaaaauuuuaagagguguuaugcuuaauaaagauguaacccaucccaaaaugaaaagauauauacagaauccgagaauaauucuuuuggauugugcauuagaauauaaaaaaggggaaucucagacaaacguagaaauuucagcagaaacagacuucaccaaacuauuagaacuggaagaggagcaugucaagcgucaaugugaugagauuauugcacucaaaccugacgucgucuucacagaaaaaggagugucagauuuggcccaacacuuuuuacugaaagcugguauuaccgcuaucaggcguguucgaaaaucugauaauaacagaauugccagagccuguggagccacgauuguuaaccgaacagaagaauuacaagaaagcgauguugguuuaggagcuggacucuucgaaaucaagaaauuuggugaugaguauuucugcuuuguggucga

SEQ ID NO: 3995 - RNA, 566 nt, Diabrotica barberi
augcaacgucaaauuaaccccuaugcagauaauggagggaguguaguagcaaucgcaggugaagacuuuguaauaauuggugcagauacacguuugaguacuggauuuuccaucuauaccagagaacaaaacaaacuuuucccacuaucaggcacuacaguuuuggguugcgcaggauguuggugugacacucuaacauuaaccagaauccuuaaaucucgcaugcagauguaccaacaagagcauaacaaaacaaugucuacaacugcaugugcccagauguugucuaccaugcucuacuacaagagauucuuuccuuauuauauaucaaacauucuaguagguuuagauaaugaaggaaagggcuguguuuacagcuaugauccuauuggacauugugaaaaagcuacguauagagcaggugguucagcuggagcucuucuucagccucuguuggacaaucaaauuggacagaagaacaugcuuaaaacaucuggagaaccucuuagucaggagaaagcuuugucuacccuuaaagauguauuuauuucugcugcugaaagaga

SEQ ID NO: 3996 - RNA, 658 nt, Diabrotica barberi
gagaagacguugaaagagguggaaaaauuauuaugcccccaucagccuuggaacaauugacuagguuaaauaucaacuaucccauguuguuuaaacuugugaauaaaaagacacaucgcacaacgcauuguggaguuuuagaauuuguugcugaugaaggaaaaguuuauuugccacuuuggaugaugaacaacuugguacugacugaaggagauuugguucaaauggaaaguguuucccuuccaguuggcaccuuuucaaaauuccaaccucucaauccagacuucuuggacauuacuaauccuaaagcagucuuagaaaaugguuugagaucuuuugccugccuuacaacaggagaugucauugcaguaaaguacaaucaaaaggcuuaugaguuguguguucuagaaaccaaacccggagaugccauuaguaucauugaaugugacaugaauguggaauuugcugcuccuguuggauacaaagaacccgaacaagucaaaaaggaagaagaagaaauggcuauagauccugcagauuuaaugccagaaccuucuggauuuguagcauucagaggugcaggaaaucgacuugauggcaaaaagcguaaagauacuucaggagcugauaguucagugggcaaaccaacuuaugucag

SEQ ID NO: 3997 - RNA, 692 nt, Diabrotica barberi
gguugguggaaaauuggaagacacaacauuaguuaaagguguaguuauugacaaaacaaugucccauccacaaaugcccaaagaacuaaaagauguaaaauuggcuauucucaccugcccauucgaaccaccaaaaccaaagaccaaacauaaguuggaugucagcaguguggaagauuauaaggaacuaagacaguaugaacaagaaaaguucaaagaaauaguugguuugguaaagaaagcuggagcuacauuagcaauuugucaauggggcuucgaugaugaagccaaucacuuauuguuacaacaagaguuaccagcuguaagauggguuggagguccagaaauugaacuuauagcaauagcuacuggggguaggauaguaccccguuuugaagagcuuacuccugaaaaacuuggucaugcugguuugguacgagaaauugcauuuggcaccacuaaggauagaauguugguuauugaagaauguucaaauucacgggcaguuacgauucuugucagaggagguaaucaaauguuaguagcugaagccaagagaagucuccaugaugcauuauguguugucaggaguuuaguucaggaaccaaggguaguguauggugguggagcagcagaaauugccugcaguuuggcagucgcggcucaagcagaucaacuagcuuccuuggaac

SEQ ID NO: 3998 - RNA, 198 nt, Diabrotica barberi; identical to SEQ ID NO: 3774

SEQ ID NO: 3999 - RNA, 774 nt, Diabrotica barberi
gauagccaacacuccuauggacacagauaaaaucaaaguauuugguucucacauuaagguagauucaauggcuaaaauugcagagcuggaaucugcagaaaaggaaaaaaugaaagauaaagugaacaaaauucuuaaacauaaugcuaauguauuuauuaauagacaguugauuuacaauuauccugaacaauuguuugcugaugcaggaguuauggcuauugaacaugcagauuuugauggaauugaaaggcuagcacuugucacaggaggagagauugucucaacauuugaccauccagaauuaguaaaacuuggaacuuguaagcuuauugaacaaaucaugauuggagaagauauccugcuccguuucagugguguugcucuuggggaagcuugcacaauugucaucagaggugcuacacaacagaucauugaugaagcugaccguucccuucaugaugcuuuguguguauuagcagccacagucaaagagagucgaauuguguauggaggagguugcagugaaacucuaauguccacagcgguaucaagagcugcugcuaacacuccaggaaaagaagcuguagcaauggaagcuuuugccagagcuuuguugcaguugcccacaauuauugcagacaaugcagguuacgacucugcccaauuggucagugagcuuaaggcagcacauaacaguggccagagcaccaugggacuuaacauggaaaagggugaauugggggauaugaaaaccuugggaaucacagaauc

SEQ ID NO: 4000 - RNA, 728 nt, Diabrotica barberi
gcaucagguagaauaugccauggaagcaguuaaccuagguucagccacagugggacugaaaaguaaaacucaugcuguacuuaucgcguugaagagggcuucuucagaacugucugccuaccagaagaaaauuaucaacauagacgaucacauugguaucaccaucucgggacuuacagcugaugcuaggauucuuaguagauauaugcgaaacgaaugcuugaauuauaaguacucuuuggauacuuauaugccauugaauaggcuuaucaguauuuuagguaacaaaaugcagacauguacccaaagauaugaccguagaccauucgguguaggucuucuaguagcugguuaugacgaaucugguucucauaucuaccaaacgugcccuucugcuaauuuuuaugauugcaaagcuauguccauuggagcccgaucccagagugccaggacauacuuagaaaaacaucuggaugaauugccauccaguucuuuggaagaacuuaucaaacauggauugagggcucuuagagauacucuaccuccagagguugaccuuacaaccaaaaaugucuccauaggcuacacuggaaaaggcgugaccuucaaaauccuugaagaagaagaaacugcccccuacuugucccuuauugagggugaagaacgcagaggaggaggagcugcagcugccgcaauugaggaucuuccugcagauccauugagagaug

SEQ ID NO: 4001 - RNA, 791 nt, Diabrotica barberi
ucaaaguagacgauuuggcaacaguguggugugaaugggccgaaauggaaauaaggaacgagaauuaugaugaagcuuuaagacucaugcauaaagcaacuuuuaugccuagucgaaaaguagcauaucaugaugacacugaaacaguucaaagucgacuguauaagucucucaaaguuuggucuauguacgcagauuuagaagaaaguuucggcaccuuuaaaucuuguaaagcuauuuacgacaaaauaauagauuugaaaauugcaacaccucaaauuauuauaaacuaugggauauuucuagaagaaaauaauuauuuugaagaggcauucagagcguaugaaaaaggaauaucucuauuuaaauggcccaauguauacgacauauggaacaccuauuugacgaaauuccuaacucguuaugggggaucaaaacuagaacgugccagagaucuguucgaacaaugcuuggauggauguccacaacaguuugccaaacaucuuuaccugcucuacgcgaaacuagaagaagaacauggaauggcuagacacgcuauggcuguauaugaaagaucaaccaaagcuguuccagagcaagaaauguucgacguuuuuaauauauauaucaaacgagccgccgaaaucuaugggauucccaaaacgagacagaucuacgaaaaggcuaucgagguacuuccagaggauaaaacuagagaaaugugucuuagauuuucugauguggaaacaaaacuaggugaaauugauagagcccgagcuauauaugcucac

SEQ ID NO: 4002 - RNA, 662 nt, Diabrotica barberi
cuauugugggagcucuuuguacaagcagggccuuuagucaauguacauaugccaaaagaucgaguaacaaccaugcaccagggcuauggguuuguagaauuuaugggagaggaggaugcagauuaugcuauuaaaauuaugaacaugauaaaauuguaugggaagccuauaagagucaacaaagcuucggcucaucagaaaaauuuagauguaggagcuaacauuuuuauuggaaauuuagacccagaaguagacgaaaaguuacucuaugauacuuuuucggcauuuggaguaauauuacaaacaccuaagauuaugagagauccugauacugguaacuccaaaggguucgcuuucaucaauuuugcaagcuucgaagcaucagaugccuccaucgaagccaugaauggccaauauuugugcaauagacccauaucaguaucuuaugcuuucaagaaagacucaaaaggagagagacauggaucugcagcugagcgucuucuugcugcucagaauccauuaucacaggcugauaggccucaucaacuguuugcugaugcaccuccaauagguuugaugcccauguccauggccccaccuccuccaccagucauaaugacaggaaugaugcccccaccgccuccaacacuaucaaacuugcc

SEQ ID NO: 4003 - RNA, 637 nt, Diabrotica barberi
agcacccaaacuacguuauuuagauuucucagaaagacaugguuacauuaaggguguuguaaaagauaucauacaugacccuggccguggugcuccauuggcaguaguacauuucagagaucccuacaaguuccaaacuaggaaggaauuguuuauugcccccgaaggaauguacacuggacaauuuuuguacuguggaaagaaagcuaaccuccaaauuggaaauguauugccuguaggaacuaugccugaagguaccauuguaugcaacuuagaagaaaaaacuggugaccguggucggcuagcucgugcaucuggaaacuaugcuaccguaauugcccauaaucacgauacaaagaaaaccagaguuaaguugccuucuggagccaagaaaguuauuccaucaaacaacagggccaugguugguaucguugcuggagguggucguauugacaaaccaaucuugaaagcaggucgugcuuaucacaaauacaaaguuaaacguaacugcuggccuaagguacgugguguugcuaugaacccuguugaacauccucacggaggugguaaccaucaacacauugguaaagcauccacaguuaagagaggaacaucugcuggucguaaaguuggucuu

SEQ ID NO: 4004 - RNA, 292 nt, Diabrotica barberi
caguuagcaacuaaagcugcucgcaagagugcaccugcuacuggaggaguuaaaaaaccucaucguuauaggccagguaccguagcgcuucgugaaauuagacguuaccagaaaaguacugagcugcuuaucagaaaacuaccuuuccaacgucuuguccgugaaauagcucaagauuuuaagacagauuuacguuuucagaguucggcaguuauggcuuuacaggaagcgagugaagcauauuugguagguuuauucgaagauaccaaccuaugcgcuauucaugcuaaga

SEQ ID NO: 4005 - RNA, 680 nt, Diabrotica barberi
uacauagcagaaggucuccacccuagauuguuaacagauggcuuugauaaggcuaggacaaaagcguuggaaguacuggagaaaaugaagauuccaguugaggcuaacaaagaaacuuugacagauauuugcaggacgaguuuaagaacaaaguugcaucaaaaacuggcugauguuuugacagacguuuguguggaugcuguucuagcuauaaagaaagaugacaaaccuguugaucuucauaugguugaauuaauggaaaugcagcacaaaacagaaacagauacucaguuaauuaaggguuuaguccuggaccauggcucccgucauccagauaugccuaaaagucucaacaacugcuacauuuuaacauguaaugucagcauggaauaugaaaaaagugaagucaauucaggauucuucuacaaaacugcagaagagagagaaaaauuagugacugcagagcgugaauucauugagcagagaguuaagaaagucauugaacugaaaagaucacucuguaauggaacugauaagacuuuuguuauuauuaaccaaaaagguauugaccccaugagccuggauaugcuugccaaagaaggaauaauagcucucagaagagcuaagagacguaacauggagcgucuaucauuggcuugugguggaguagcuaugaacag

SEQ ID NO: 4006 - RNA, 798 nt, Diabrotica barberi
agagaacaaaucgcagaagugguuaugcaagucaauguuccagaauucaucccuaaaucuggcguaaagauagcaguuacggauucucaaauggcuaugaaugguaauaauguggauuuggaucgcguuucccaaauuaaagaagaacuacccucaguagcagaacuagguggacuacgucuuacuccuuuagaauuugaaaaggacgaugacaccaauuuccacauggacuuuauaguugcugcuucaaaucuucgugcagcuaauuacaaaauaccucccgcugauagacauaaaucaaaacuuauugcugguaagauuauucccgccauagcaacaacaaccucaguagucgcuggaaugguuugcuuggaacuuuacaaacucaccagaaguuacacaucccuaacuccauucaaaaauaauuuuauuaaccucgcucugccuuucuucaguugcucagaaccaaucgcagcccaacaaauggaauacugugguaacaaauggacacuaugggaccgcuucgauguucagggagaaaugacgcuuagugaauuuuuggaauacuucaaggaaaaacacggucuugaaauuacuaaccucgcucugccuuucuucaguugcucagaaccaaucgcagcccaacaaauggaauacugugguaacaaauggacacuaugggaccgcuucgacguucagggagaaaugacgcuuagugaauuuuuggaauacuucaaggaaaaacacggucuugaaauuacgauguugucccagggcguuugcaugcuguauucguuc

SEQ ID NO: 4007 - RNA, 653 nt, Diabrotica barberi
cucaagcuguuauuggcauggauauucugugccaagcuaaauccgguauggggaaaacugcuguuuuuguauuagcuacacuccaaguaauagauccuacagaaaauguuguauauguucucgucaugugccauaccagagaguuagccuuccagauaagcaaagaguaugaacguuucaguaaauauaugcccaauauuaaaguaggggucuucuuugguggcuugccuauccagaaagaugaggagacguugaaaaauaauuguccgcauauuguuguggguacuccaggaagaauuuuagcauuggucagaucgaaaaaacuuaaucucaaacaucuaaagcauuuuauuuuggaugaaugugauaaaauguuggaguuauuagacaugagacgugauguucaagaaauauaucguaacacuccccacgaaaaacaagucaugauguucagugccacccuaaguaaagaaauuagaccaguuugcaagaaauuuaugcaagaucccauggaaguauauguugaugacgaagcuaaauuaacauugcauggucuacagcaacauuauguaaaacuaaaagaaaacgaaaagaauaaaaaguuauuugaauuacuagauguuuuggaguucaaccagguugucauuuucgua

SEQ ID NO: 4008 - RNA, 656 nt, Diabrotica barberi
ccaacacuagaaggaagcuuaauggacugguguugagaagucucauuacucaaauauauccuguagcugaacgugaugcccucauuaguuucgucgaggaagcuucuggagaacucgacgccacccagucaagagcaaggucagcuguuaagucacccguucccgagguagauacauauauaaaucuuuuaauacuaguacguuuaaucgacaccaauaaguuaguugaagcagagcgauguucccaagcucucaugaauaaaauaacuaaccaaaacagacguacuauagaucauauugcugccaaguguuauuucuaucacuccaggguugcugaauuaaccaacaaauuggauucaauuagaggcuuuuuacauucucgucuacguaccgcuacacucagaaaugacuucgaaggccaagcugugcuuauaaacugucuguugagaaauuauuugcauuauucauuguaugaucaagccgacaaacuagugaguaaauguguauuuccugaaacugcaaguaacaaugaaugggcaagguucuuauacuacuugggcagaauuaaggcggcaagauuagaauacaguguagcgcauaaacaucuugugcaggccuugagaaaagcaccccagaaugcugcuauugguuucaga

SEQ ID NO: 4009 - RNA, 778 nt, Diabrotica barberi
gaguacucaaacaucgacgaaugguacaaacgggguguugacacuucaaaaauaguuacuaaauaucguaaaggugcgugugaaaauuguggagcuaugacucauaaaaagaaagauuguauggaaagaccucgcaaaguuggagccaaauuuuccggagcaaauauugcaccagaugaauuugcccagaaaaacuuagcguugagcuuugauggaaaaagagaucgauggaguggguaugacccaucugagcauaaagcaguaauagaagaguuccagaaaguugaggaagcuaaaagacaacugaaggcugacaaguuaaaugcaaacgaaucuucugacgaugaagaaaaagaugaggacaaauauguagaugaaguugauaugccugguacuaaaguagacagcaaacagagaauuacuguaagaaauuugaggauaagagaagacaccgccaaauauuugagaaaucuugauuuagguucugcuuauuaugaucccaagacaagaucuaugagggaaaacccuaauccugaaaaagaugcuacguacaguggagagaauuucguucguuuuacuggugauaccaccaaucaugcuaaggcucaguuauuugcuugggaagcauaugaaaaggguguggauguucaucucuuagcugaaccaacaaaacuagaacugcucaaaaaagaauaugagaaaaagaaagaagagguuaaaucaacaauucaaagcagcguucuagauaaauauggugggcaggaacauuuagaagcac

SEQ ID NO: 4010 - RNA, 590 nt, Diabrotica barberi
gccuccuguggauuuuaguuuauucguucagaauggguauuaguagagaccauuggcauaaacgaagguccacaggaggcaagaggaagccucuccguaagaagaggaaguucgaauuaggacguccagccgcaaauaccaagcuuggagcacguagaauucacuauguccguacacgaggagguaacuugaaguaccgcgcauugaggauugaaaaaggaaauuucgcauggggcagcgaagguacugcucgucaaacacguauuauugaugucguuuacaaugccaguaauaacgaauugguacguaccaaaacauugguaaagaaugccaucguuguuauugacgcaaccccuuucagacaaugguaugaaagccacuauauuuuaccuuuaggacgcaagaagggggcaaaauugacagcagacgacgaagaaauuuucaauaagaaacguagcaaaaaaguacagaaaaaauaugaaacuaggcaaaaaacagcuaaaguagaaccugcguuagaagaacaauucucaacuggaagguuauuagcuugcuuagcgucaaggccaggacaaugugguagagcugau

SEQ ID NO: 4011 - RNA, 735 nt, Diabrotica barberi
ggauacugccgaacaaguauacauauccuccuuagcacuauuaaaaauguugaagcacggccgagcuggaguacccauggaaguaaugggucuuauguuaggagaauucguagaugacuauaccguucguguaaucgauguauuugcuaugccccagacugguaccggugucaguguagaagcuguugauccaguuuuucaagcaaaaaugcuugacauguuaagacagacugguaggccagaaaugguuguggggugguaucauucccauccagguuucggauguugguugucuggaguggauaucaauacccaacaaaguuuugaggcucucucggaaagagcuguagcaguaguaguugauccaauacagucagugaaaggcaaagucguuauugaugccuuuagguuaauaaauccgaauaugaugguauugggccaagaaccucgacaaacuacauccaacuuaggacaucuacagaaaccaucaguccaggcuuugauucauggucuaaaucggcauuacuacucuaucaguauuaauuacagaaaaaacgaauuggaacaaaaaaugcuacuaaaucuccauaaaaaauccuggauggauggucuaacuuuagcagauuacucugaaaauuguagugugaaugaaaagacuguugcugauauguuagaacuagccaagaauuacaacaaggcauuagaagaggaggagaaaaugacuccagaacagcu

SEQ ID NO: 4012 - RNA, 783 nt, Diabrotica barberi
gcaagcucagagaaaugaacucaaugccaaaguucguauguugagagaagaauugauguuacuucaagagcaaggaaguuauguuggagaaguuguaaagcccauggauaagaaaaaaguccuugugaaaguucauccagaaggaaaauuuguaguugacauugacaaaaacauagacauaaaugauguuacuccaaauugucgaguagcccucagaaaugaaucuuacacauugcacaaaauucuuccaaauaagguugauccuuuaguuuccuugaugaugguggagaaagucccugauucaacuuaugaaaugguaggaggacuugacaagcaaauuaaagaaaucaaagaaguaauugaacuuccaguuaaacauccagaacuguuugaugcccuugguauugcacaaccuaaggguguguuguuauauggaccaccagguacuggaaaaacucuucuggcacgugcuguagcucaccauacagaguguacauuuauuagaguaucugguucagaauugguacagaaauucauaggagaaggaucccguaugguaagagaacucuucguaauggccagagaacaugcuccuucaauuauuuucauggaugaaauugauuccauuggaucuucccguauugagucaggaucugguggugauucugaaguccaaagaaccauguuggaacuucucaaucaauuggaugguuuugaagcuaccaaaaacaucaaaguaauuauggcuaccaacagaauugauauuuuggaucccgcuuuacu

SEQ ID NO: 4013 - RNA, 488 nt, Diabrotica barberi
accugguugaaaucagcuuuugaacuucaaagcuucaguuuuuuccaaagagggucaauacaggaguucaugucauucuuuugcaaaaccauaguggaaagaacaauaccagccucaaggcagaguguuaaagaaggagaauauuugugucauguauauguaagagcugauaacuuagcuggcguuaucauaacugaccaugaauacccaucaaggguaucucacacucuaauaacaaaaauacuagaugaauucggugccaaaauuccugcagcuaacuggcccaaccuugaagagagagauguagcauuuccacaauuaaauaccuacuuagcgaaauaucaaaauccuagagaagcagaugcuauuacuaaaauucaagaagaucuugaugaaacgaagauuauuuugcauaauaccauacaagcaguuuuggaacgaggcgagaaacuagacgacuuggugagcaagucggaagguuuaagcau

SEQ ID NO: 4014 - RNA, 463 nt, Diabrotica barberi
cauauuggaugugccguuucaggacuuauggcagauucaaggacuaugauagauagagcucguguggaaugucagaaucauugguuugucuacaaugaaaauauaaguguagaauccugugcacaagguguaucaaauuuggcuauucaguucggagauucugaugaagauggugcagccaugucuagaccuuuuggaguagcaauuuuguuugcugguauagaugaaaaaggaccucaguuguaccauauggauccaucaggaacauuuguucaguuugacgcaaaggcgauaggaucaggauccgagggugcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacuccaaaagauauguucc

SEQ ID NO: 4015 - RNA, 652 nt, Diabrotica barberi
auguuauucuugcgaguggugguaucgaugaucuuugcuugaaauacuucguugaaaauggagcgauggguguaagaagaguaaagaaagcugacuuaaaacgcauugccaaagcaacuggugccacuuuccuaacuucucuuaguaacauggagggagaugaaaguuuugauucuagcaugguaggagaggcagcggaaguuguucaagaaagaauuucugaugaugaauugauaauuauuaaaggaccaaaagcacguacagcagccucuaucaucuugcgaggacccaacgauuucuauugugaugaaauggaaagaucuguucacgacgcguuguccguuguaaaacgcguacucgaaucgaaaagcgucguagucgguggcggcaguguugaagcagcacuuucgauauauuuggaaaacuucgccaccacgcuaagcuccagagaacaauuggcuaucgccgaauucgccaggagcuuacugguuauuccuaaaacguuggcaguuaaugcagcgcaggacgcuacagauuuaguagcuaaguugagggcauaccauaauuccagucaaacgaaaaaggaucaugcgcauuugaaauauguaggauuagaucucauggaagguaccguucgagauaaccgaaaagc

SEQ ID NO: 4016 - RNA, 756 nt, Diabrotica barberi
ucccguuacaacaucaacuucuguauuagcuauuacuuacgauaaaggaguauugauagccggagaucugguugcuucauacggaucuuuagcuagguacagaaauugcccgaggguuauuaaagucaaucagaauaucaucuugggagccggaggagacuaugcugauuuccaauacgucaagaguuucauugagcaaaaaauaauugaugaagaaugcauugacgauggacuaaaaaugaaaccaaaaucauuguacugcuggcuuacaagaguaauguaccaacgcaggaguaaauuagaccccuuuuggaauaauuugguuauaggaggaauccaggauggagucccguuccuuggaacuguagauaaauugggaacugcauauacagacaaaguuaucuguacagguuauggagcccacauagccuugccucuucugagagacucguuagauaaaaauggagcucuuaacuuggcugaugccaaaacucugauucacaaaugcauggaaguguuguucuacagagaugccagaaguuuucccaaauaucagcuugguguuauugauaaggaugauggcgucacgauccagggaaccauagauaaauugggaacugcauauacagacaaaguuaucuguacagguuauggagcccacauagccuugccucuucugagagacucuuuagauaaaaauggagcucuuaacuuggcugaugccaaaacucugauucacaaaugcauggaaguguu

SEQ ID NO: 4017 - RNA, 725 nt, Diabrotica barberi
aagagugguuggacaaguuugaccaagcaaagaagacuagauuagcccaagagcaacauaagagggagucaauuucggaaaaaucacccucucgaucagcuucgauagagucuccuaguuauaacccuuuugacgaaguugaagacgauguaggaauggugcacccagaaugguuuuuggacauuccagaggaacuugauguguguguagcucaaagacacuucgaagaggcucuuucauuguugcaaaaagcuaaggaauauauuagccaaaugacggcugguaaugagaaacacgaucauguguuccucgauauucaaagaaagguugaacaacgacaaaauagucuuaccgaaguuuuaaugaaagaacuggaaguuaauccugauaaaucuuugcaagguggauugagggcugcuagaagagcaguaagguuauuaaaucaauuaggaagagaaaaccaaucauguaacuuauuccugaaauuguguagcaguauguugaggacacaguguaagcguguaaaaagagaaggauccaccacaacauacauacgaaauuuggcgaguguaguuuucacuaacaugugucauaugucggaugaguuucuaagggccuuucccgacucaccaacuugugcuucagcuuauguuguuugggccagcaacgaauugcuucuuuuuacuggacauuuuauaaaacaaguauuuaugccccagacuucg

SEQ ID NO: 4018 - RNA, 744 nt, Diabrotica barberi
gugguucuaggagcaaaagaaauaaagaaagaaguaggucuaggaauaggagaagcagaucaagggauagaagaaguagaucgagagacaggagaaacagaucuaaggaucgaaaauacaaaaauuauucuagagauaaagauaggagagaaagaagcaauucgagggauauaaaacgggauagaaguacugagaagaaguucaaaagugaaaaagauaauccagaguucgaagaugauccuaacccaggaaaaauauauaauggaaaaguaucaaauauuguaccuuuuggaugcuuuguccagcuggagggacuuaaaaggagaugggaaggcuugguucauauuucacagcuuagagcagaaggcagaguuacuaauguaucugaaguaacaucuagaggagcuagaguaaaggugaaaguauugacaguaacaggucagaaggugucauuaucuaugaaagaugucugucagauuacugguaaagaccuuaacccacauucccacgcuccgacugaaagagaagauagagauagaaauccugacaggccuguaaacagcaguacaucuguauugagacugccaguaaauauagaugaaggagaagaagacucucggaaacgaguaacaaggauuucaagucccgagagaugggaaauaaaacagaugauuucaucaggauguauugcuaagagugaguugcccgauuuugaugaagaaacuggauuguuacccaaggaug

SEQ ID NO: 4019 - RNA, 701 nt, Diabrotica barberi
uucucuuuugguagcuggacaagaaagugagugucaauuguacaaacugaauccuaaacuagucgaggaaguggaaaauaucgguaauaauacucaucucaggcaacggaauacaaaaaacaaagaaguuacagaugacaacaagaaugugacaaaagaguuauauuuugauguuaacgcaauagaaaauguucaaacugacuuuaaugggagugaaccguuaucaaggguaguaaaaauuaaucacgacgguacauuauuagcuacagguggcacugauggagauguacgaauauggaaguucccuaguaugcaaccuuuauuuauucuuaaggcacacacaaaagaaauagaugauauagauuuuaguagguaugacaauuaugugauuaccauagccaaagaugguuuagcaguauugugggauuguaugacaggaaaagaaagaacaaaacugacauggaaacagccugaaggaucaaaauauuuauauaaacguuguagauuugguguaauagaaggacuagacaagaaaugugcacuauacacaauauccaauccaauaggaguagcuaaaaaacaaaaauccuaccuccagcaguggauacccgaggaaaacauguuaagaagguguauagaauuugaugagaguuuggcugcuuuagcuguucgugaugaugguagauuuguugcgguuggua

SEQ ID NO: 4020 - RNA, 664 nt, Diabrotica barberi
ucgaaguacaacucugcaaagaauguauagaaugggcaaaggaagagagaagaacuuuucuacgucagucccuugaagccaggcugauugcucuuuauuuugacacuggaauguacagcgaagcgcuacaacuggaaucgaccuuacugaaagaguuaaaaaaguuggaugacaaaaacuuguugguggaaguacaacuacuugaaagcaaaacauaucaugcuuuaaguaauuuaccgaaggcuagagcugcacuaacuucagcacgaaccacagcuaacgcuaucuauugcccuccaaagaugcaggcagcuuuagauuuacaauccggaguauuacacgcugcagaugagaaggauuucaaaacagcuuauucuuauuuuuacgaagcuuuugaagguuuugauaguguugaauccccaaaagcccucacagcccuuaaguacaugcuuuugucaaaaaucaugauaaacagucccgaagacguccaacaaaucguuagugguaaauuagccuuuaaauaugcuggucaagauauagaggcuaugaaaucaguugcacaggcugcacacaaaagaucacuagcagauuuccaacaagcaguaaaacaguuuaaacacgaauuagaagaugauguuauuguuagagcacauuuaggaacguu

SEQ ID NO: 4021 - RNA, 793 nt, Diabrotica barberi
uggcagaaaaauaugaggcuaagcuucaagaggcucuacaagaacucagagaucaauaugaaagucaaauggccaacaaccguggcgaaaucgaguugcuuuacgaacagaagauuaagaacuugcaauccgcuaaugacagacauucugccucugcuuccggugcucuugacgaauugagacaaguuagaaccagaaucgauacuuugaauucucgaauuagcgauuuagagaaccaaaacgcuggcuuagcagcucgugcuagagauuuggagaaguuguuagagaacgagcgcaugcgccauguggaagaccucgcaauguuagaaagagaauuacauagacuccgagaagaaauggcuaaccaacuucaagaauaccaggaucuuauggacauuaagguuucucuugauuuggagauagcugcuuaucggaaacugcucgaaucugaagaagcucgucugaauauuaccccaacggguagugaaguucaugaaguaacucacaguaggagccaacgcagcucgucgcaacgucgcacuccagucagauugggagccaaaagaaagcgaacacuacucgaagaaagccaagagucgagcaugaaugacuauucggugaacagcuccucaaaaggugacauugaagucgcagaugucgauccagaaggacacuauguuaaguugcacaacaaaaguaaucaagaagucgcucuuggaggauggcaagucauuagacgugucggugaggaggaaaccacauucaaauuucacaggucacuaaagcuugaagg

SEQ ID NO: 4022 - RNA, 702 nt, Diabrotica barberi
agauucggaagauucgacagggaaaucgauaucggaauaccugaugcaacuggcagacuugaaguuuuacguauucacaccaagaacaugaaauuagccgaugaugucgacuuggaacagaucgcugcagaaacucauggucacguaggugccgauuuagcuucacuguguuccgaagcagcccuucaacaaaucagagaaaaaauggaccucaucgaccucgaagacgaccaaauugacgcagaaguccuaaacucacuggcaguuaccauggagaacuuccguuacgccaugacgaagagcagcccaagugcuuuacgugagaccauaguagaaguaccaaaugucacuugggacgauaucgguggcuuggcuaaugucaagaaagaguugcaagaauuggugcaauauccugucgaacauccagauaaguuccuuaaguucgguaugcaaccguccagaggaguguuguucuaugggccgccugguugcgguaaaacguuauuagcuaaggcuauugcgaaugaaugccaagccaacuuuaucucaguuaaaggaccagaguugcuuacuaugugguuuggugaaucagaagcaaacgucagagauaucuucgacaaggcuagaucugcggcaccuuguguucuauucuucgacgaauuagauucaauugccaaaucgcgugguggaaauguaggugau

SEQ ID NO: 4023 - RNA, 651 nt, Diabrotica barberi
guucccagucuaugugaagaucuacuaucaucuguggaucagccuuuaaaaauugcaaaagauaaagaaacuggaaaagauuaucuucuuugugacuauaauagagauggagauuccuacaggucaccaugguccaauacauacuacccgccccuagaagaugguucaaugccaucugaaaaauuaagaaaacuagaacuagacgccaaucuugcauuugaucaauacagggaaauguauuuugaaggagguguaucuucuguuuauuuuugggacuuagaccauggauuugcaggagucauucuaauuaaaaagacuggagaugguaguaaaaagauuaaaggauguugggauuccuuacauguaguagaagugcaagagaagaguucaggaagaaacucccauuauaaaaugacuucaacugcuauguuauggcuucaaacuaauaaacagggaucuggaacuaugaacuuggguggaagucuaacucggcagaucgaacaagaugcagcuguaaacgauaucaacccucacauagccaacauuggaagaaugguagaagauauggaaaacaaaauucgcaauacauugaacgaaauuuacuucagcaaaacgaaggacaucgucaacagucuacgaucaguucaacca

SEQ ID NO: 4024 - RNA, 721 nt, Diabrotica barberi
caugacuaccacgacaucauaaagaaacccauggauuuuagcacuguaaaaaauaaaauggaaaaccgagaguaucgcacuccucaagacuuugccgccgacguuagacugauuuuuaguaauuguuacaaguacaacccuucugaccacgaugugguugcuauggcgaggaaguugcaggauguguuugaagugaaauaugcaaagauucccgacgaaccugucaauaggguaggagccccugccguuaauaauauaccugccaaaucagaaacgaguacauccgguuccagcucugauucuucuagcgacacggaagauucggaggaagaaaggcgaaacaagcaacugaagcugcuagaaaaagaguugacggcgaugcaagaaaagaugcguaaauugguagacgagagcucgaaaaagaaaaaagaaaagaaaaaggacaaagugaaaaagaaaccggcaucaggugggucuauggcgaacgccucacuaucaacucuaccgaacagcagcagcgcgggcuuggguaagccgggugccgguggucacggggcucuaaacaagucaaacaacaacaacucaauagcggcggacagcguugacgacagcaucgccaguguugugucgggggccgaucuaaagauggccgagucgcaccauccgcaaacuggaaccggcgcucaccauccgccggcaggcaaaucccugaacaugcauc

SEQ ID NO: 4025 - RNA, 704 nt, Diabrotica barberi
augagcaaaggacaugucaucgaccaaaucccugaauuaccauugguugucagugacaagguacaagaaaugagcaaaacuaaacaggcuguccaguucuugaggagaaucaaggcaugggcugacauucaaaagguuuacaagagucaacguuuccgugcugguaagggaaaaaugcguaauaggaggcgcauccaacguaaaggaccauugguuguuuacuacaaagaucaaggucuucgucgugcuuuccguaacaucccaggcaucgaccucauuagcguacagaaguuaaacuuguugaaacuugcuccugguggucauguaggucgcuuuguuauuuggaccgaaucagcuuuccaacgguuagauaaauuguucggcacauggaaaacagcaucauuggaaaagaaggguuacaaucuaccccaaccuaagauggccaacacugaucuaucuagauuguugaaggcugaugaaaucaaagcuguauuacgugcuccucaaaagaagguuguacgucguguacgucgucucaauccauugaccaacgcuaaggccaugcuuaaauugaauccauaugcugcuguacucaaacgugaagccauuuugaagaaucaaaagagacaguuaaacagggaagaacuuuuggccaagaaacgugguauuaccuugagugccgacaacgucgugauuagauccag

SEQ ID NO: 4026 - RNA, 746 nt, Diabrotica barberi
gaaggaaauucaagcgacugcggcguuuugaagaugaggaaagugaaggagaagaagaacaugauccugaacaagauagggaacaaauugcuauggauauauuuucagaugaugacgaugaaagacgaucagaacggagucacagaccugccgucgaacaagagacuuaugguguaggcgaggaagaagaggaaggggaguacucggaugccgaugauuuuauaguugacgaugacgguagaccgauagcugaaaagaagaagaagaaaaaaccaauauuuacugaugccgcucuccaagaggcucaagaaaccuucggugucgauuuugauuaugaugaauuuaguaaauacgaugaagaugauuacgaagaugaagaggaggaggaugacgaauacgaggaagaugauguagagaaaaggaaacggccuaaaaagacuucaaagaaaaaaccgacgaagaaauccauuuuugaaguguaugaaccuagugaacuuaaaagagguuucuuuaccgaucucgauaaugaaauccguaacaccgauauucccgaaagaaugcaacuucgugauguuccaaucaccgcuguuccggaugacucaacugaacuugaugaugaagcagaauggauuuacaggcaagcguuuuguaacagaacuguuuccaauguggauucucauuuaucaucagaggcaagagagaaauugaagaagacucaucaugccaucggaaagaucagaaaagca

SEQ ID NO: 4027 - RNA, 759 nt, Diabrotica barberi
aguggcacaugaaauuuuggcuuuggagauacuuacguuguugguggagacuccuacagacgauucuguggaaguggccauuucauuuuugaaggaauguggacaaaaacugacagaaguuucaaguagagguauuacugcuauauuugagauguuaagaaacauuuuacaugaaggccagcuagaaaaaagaauucaguacaugauugaaguuauguuccaaauaaggaaagacggauuuaaggaucaugcugcuguuguagaagaauuagauuuaguagaagaagaagaucaauucacucaucuuauuauguuagaugauguuaaagaggcugaugcagaggauauauugaauguguucaaauuugaugagaguuaugaagaaaaugaagauaaauacaaaacccuuaguaaagaaaucuuaggcagugauggugagucugaaucagguucugaagguucagaagaggaaucugaugaugaaaaugaggaggaagucaaggaccagggaacaauuauugacaauacugaaacgaauuuaauuucucuuagaagaaccauauauuugacuauucagucuaguuuagauuuugaagaaugugcacauaagcuacugaagauggaguugaaaccuggacaagaaauagaauugugucacauguuucuugacugcugcgcagaacaaagaaccuacgaaaaguuuuauggucuuuuggcucaaagauuuugucaaaucaacaaaguguacaucgagccuuu

SEQ ID NO: 4028 - RNA, 743 nt, Diabrotica barberi
uagcauucauuccgacugagucacagguguucucguuggauucaccagacacguuccaauguagcuacgaucccucauuuuccgcugcuagaaacgccaacauggaaagaauggcagaacaaauugcgacacucugugcgacucuaggggaauacccucacgucagauauagaacugauugggaaagaaauguugagcuggcucaacuaauucagcagaaauuggacgccuauaaagccgacgaaccuaccaugggagaggggccggaaaaggcgagaucacaauuaauuauccucgaccgagguuucgacuguguaucuccccuucuucacgaacuuacuuuccaagcaauggccuaugacuuacuacccauagaaaaugauguauauaaguacgaagcaucggcugguguuaugaaggaaguccuucuggacgaaaacgacgagcuuugggucgaucuacgccaccaacacaucgcgguggucucucagagcgucaccaagaaucugaagaaauucaccgacuccaaacgcaugacccagagcgacaaacagucgaugaaggaucucuccaccaugaucaaaaagaugccgcaauaucagaaggaauuguccaaguaugcuacgcaucuucaucucgcugaagacugcaugaaggccuaucagggguauauagacaaguuguguaaaguugagcaggauuuggcaaugggaacugaugccgaaggcgagaaaaucaaggau

SEQ ID NO: 4029 - RNA, 721 nt, Diabrotica barberi
agucaaaugggaugucugucgaguaaggacguauuugcuaacuuuuuaacucuuuguaaauacaaucaugaaauaauugucaagguuuuuaauaauccggaacaagugauggcaaaauuuguacugaacauauuucaacucaaacucgucgaauacaucgaucagagauuaaacucuaaguuaggaaccuauggcuauuuacaaguauuauaugaauuauauuacaagacuaaucaguuaucuaaugauuugagcauauuuaacaugggaaaugacaagaacuuuuuaucgaaguuaacgacaaauauuuuuaacaaauauauuagugacuauaucacgauggaauuaaaaggucugaaagauagguguucugcaaauuuacaaaaauauuaugaauccaaaggucaucaaaagaagcagauucagucaggagguuuccaagaucuucgaagagaccuucaagcuguuauaggaacucgagcaaauauuaacauugcccagaucgaaaauuaugguggagaaacuuuuuuaucugaagaauuagcuauuacgauauugcaagacacaaagcacgcuuuucaaagaugccaguuguuauccaaacccacagacagagcaucaaacgcaacucaaauuuuggauagacugauaaacagcuuauuaguagaacaugucgacuaugcaguagaauugggcuugcaagcuguuccuguuguagaag

SEQ ID NO: 4030 - RNA, 707 nt, Diabrotica barberi
ucuuggucggaaacuaacagggaucguagagaaaggcuccgacaacuagcuuuagaaacuauagaucuacaaaaagaucccuauuuuaugaaaaaccacuugggcucauacgaguguaaacuuuguuugacguugcacaacaacgaaggaaguuacuuagcccauacucaagguaaaaaacaucaggcuaauuuagcuaggagagcagccaaagaggcuaaggaugcuccuacgcuuuugcaaccagagaaacccagaguagaaccuaagaaguuugugaagauugguaggccugguuauagaguaacgaagcaaagagaugccgaaaguggacaacagagucuucuguuccagauugauuauccagaaauaagugauaugauucugccccgucaccguuuuaugucagcuuaugaacaaaaaaucgaaccaccagaucguaaauggcaguaucuucuauuugcagcagaaccguaugaaacaauugccuucaaaguaccaagccgagaaguagagaaaaccgacagcaaauuuuggacucauuggaacaaggauacuaagcaauucuuccuacaauuugcauuuaaaaaugacaauaagagaacuguuaacacagugguccaaagacauacaauuguuggugcagcaccaccacccccaaugcuaccuguuccaccaccaccaagaccaccgauguucaauccuau

SEQ ID NO: 4031 - RNA, 278 nt, Diabrotica barberi
aacaauuaccggcgaaguauacagagggaaacugauagaagccgaagauaauaugaauugccaaaugacucaaauuacuguaacuuacagagauggaagggucgcucaauuggaaaauguuuauauuagaggaucgaaaauuagauuucugguauugccagauauguugaaaaaugcuccuauguucaaaaaacaaacuaaagcgggaacggcaggccgaggaaaaucugcuauacugcgagcccaagcucgggggagagguagggggcaacaacaac

SEQ ID NO: 4032 - RNA, 746 nt, Diabrotica barberi
ucaacaaguuggugcaaaucuuacagccacaucugauagagaaaccauuuccuauaccuuagaaggaacgagaagugcuguugaaaaggcucuaccauauuuagcagaaguagcuacccaccaagaauuuagaccuugggaagugucagaacuaucuaacagauuaauuuuggauauuuuaaccagaccuuuacaguuaagagccaucgauuugcuucacaaugcugccuaccguagcaaagguuuagguaacucacucuucauuccaaaaucccaaguagguaaaguuucaucagaaacguuacaacauuacguagccagcaacuuuguagcuggccgugcugcaguuguugguacagguguaagcgagaguuuguugaaucaauucgcugcuaguuugggaauuggaaauggcgaaggcagcaccaauccaucuccuuacaaggguggugaacucagaucaaacaaaggugguccacuugcuuuuguugcaguagggggagaaggagcuccauugaagaacaccaaagaagcucuugcguuugcaguucuacagaaagcuguaugugccggcccucagaucaaauauggcguacuugaucauggagucuacagcaaagcucuugguggcucaucagauguaucugcgugcgcuguuaaugugagcuauucagacagcgguuuguuugguauuuugcucgcugcaccugcuggaucuguaggcaaagcaguucaaucagcuguua

SEQ ID NO: 4033 - RNA, 194 nt, Diabrotica barberi
aucugcaagaaaagauuggcgucuuaaaaucguugacuauagacauuggaaacgaaguuaaauaccaggacagaaugcucagagauguggacgacgaucuagauaagacuggaggcuucuugggcaccaccaugucaagaguacugagauuaucuaaaggaucucauaauuaccucauccuguauuuauuugug

SEQ ID NO: 4034 - RNA, 704 nt, Diabrotica barberi
ggcucuggaaaaccuauugacaaaggucccccaauucuggcugaagacuaccuagauauccaaggacaacccaucaacccauggucccguaucuaccccgaagaaaugauccaaacugguaucacugccaucgaugugaugaacuccauugcccguggucagaagauucccauuuucucagcugcuggucugccacauaacgauauugcugcccaaauuuguaggcaagccggucuugucaaaaucccaggcaaaucaguuuuggaugaccacgaagacaacuuugccaucguguuugcugcuauggguguuaacauggaaacugcuagauucuucaaacaagauuucgaagaaaaugguucuauggaaaacguaugucuguucuugaacuuggcuaacgauccaaccaucgaaagaaucauuaccccacgucuugcucuaacagccgcugaauucuuggcuuaccagugcgaaaaacauguguuggucauuuuaacugacaugucuucauacgcugaagcuuugcgugagguaucugcugccagagaagaaguacccggucgucgugguuucccagguuacauguacaccgauuuggccaccaucuacgagcgugccggucgugucgaaggccguaacgguuccaucacacaaauccccaucuugacuaugccuaacgacgauauuacucacccuauucccga

SEQ ID NO: 4035 - RNA, 204 nt, Diabrotica barberi
uuuacuggaacaaccuggagauguuauuaguuacgccgccgaauauuuuacgcgcuugagggaaacccgggugacauccagaguguaugaugaagcugcugccucgcaggaggaauugguaucaccugacgaauccguaauguccaaagaugaagaaccuucaauccgguuugcugguaggcguaaaucaguguucgcagaaac

SEQ ID NO: 4036 - RNA, 782 nt, Diabrotica barberi
uuaucacaccacagacaagguuuacuugcuauuuuuaaaagcggagguauuccagcacuuguaaaguugcucaguucuccuguagaaaguguucuugucuaugcuauaaccacucuucacaaccuguuauuacaucaagauggaucuaagauggcuguuagacuugcaggugguuugcaaaagaugguugcacuacuccaaagaaaucaugucaaauuuuugucaauuguaacugauugcuuacaaauuuuggcuuaugguaaccaggagagcaaguuaauaauuuuggcaagucaaggacccauugaauugguccgaaucaugagaucuuacgauuaugagaaguuguuguggacuacuucuagaguucugaaaguucuuucaguuugugccaguaacaaaccugcuauaguugaagcaggaggaaugcaagcuuuggcaaugcacuugggaaauccaagcacaagauugguucaaaauugucuuuggacauugagaaaucuuucagaugcugcuacaaaaguugauggucuagaaagcuuauugcaaucuuugguacaaguauuagcaucuucugaugucaauguagugacaugugcugcugguauucuuuccaaucugacuuguaacaaucagcgcaauaaaguaacugugugccaagugggagggguugaugcacuugugcgcacuauagucagugcaggagauagagaagaaaucacggaaccagcuguuugugcacugcgucauuugacauccagacauguggaaucagaaauggc

SEQ ID NO: 4037 - RNA, 655 nt, Diabrotica barberi
uaagcacaaaaagcgaagaccuuaccuugcaucagaauguaaaaauuuacaugcuugugaaaaauggagaaugcagauaauaagagaaauugccaagaaaguagcucaaauucaaaaugcuggacuuggagaauuuaggauaagagacuuaaaugaugaaauaaauaaacuacugagggagaaacggcauugggaggaucaaauaaaggaauuaggugggccugacuaucagagaguugguccacggauguuggaucaugaagggaaagaaguaccuggaaauaggggguauaaauacuuuggggcggcuaaggaauuaccagguguucgagaacuuuuugagcaggagccgccuccuccuccaaggaaaaguagagcagaacuaaugaaagacauugaugcggacuacuauggauacauggacgacgaugacggaauuuugauuccauuggaaguuaaagcugaaaaaacagccguucaaaaugcaguagcugaguggguuaguaaaaaagaacaaaauuuggagaacgcagagaaccaaacagaagaagaaaguauauaugcaguucaggagucugacgaugaagaaaguaaagaaacuguacaacaguuaguggauggaucacagcaaagauuuguugcacauguaccugua

SEQ ID NO: 4038 - RNA, 511 nt, Diabrotica barberi
acaugacuggugaauucgaaaagaaauauguagccaccuuaggaguagaaguucacccuuuaguuuuccacacaaauagaggacaaauucguuuuaauguaugggacacagcaggccaagaaaaguuugguggucugcgugauggauacuacauccaaggacaaugugccauaauuauguucgacguuacaucuagagucacuuacaaaaauguuccaaacuggcacagagaucuuguuagaguuugugaaaauaucccaauuguauugugugguaacaaaguugacaucaaagauaggaaaguuaaggcaaagagcauugucuuccacaggaagaagaauuuacaauacuaugacaucucugcaaaauccaacuacaacuucgaaaaacccuucuugugguuggcuaggaaacucauuggagaucccaacuuagaauucguagcugcaccugccuugcuuccuccagaaguccagauggauccccaauggcagcaacaaaucgaaaagga

SEQ ID NO: 4039 - RNA, 795 nt, Diabrotica barberi
aucuaccgagaccucaagaagugaacaugaccguccuucgaccaucccacgagagcuauuccuuauccgaucugcagcgagccgaagagcucaucaaacgcgagauggugacuauguuacauuucgauaaccuuaagaauccgguuccgacgcagaguaagagguccaauaugucgcaggcucaucaauuggccuuuuuggagcagcauccguaugagucguucaggaaagaagauuuagaggcggccaaggggauauugaagagggaaauggaggugguuaggaaugguaugaaucacggggaguugccuaucgaagucuacacucaggugugggaagaaugcuuaagccaaguucuguuccucccgaaccaaacgagauacacucgagccaacuuagcuaguaaaaaagacagacuggaaucggcggaaaaaaggcucgaacagaacagaucucacauggcgaaagaagccaaacgagcugccaaaauggagaaaaaauugaagauuuuaacaggcggguaccaguccagagcgcagguguugaucaaacaauuacaagauuguuaugagaaccuagauucgacuaauuuagaauugaauacguucaaguuucugcaagaacaagaaaaaucugcucuaccaagaagaauacagucucucacugaagacgucagucgacaaacagaacgagaacgaggcuugcaaaagaaauacggcgaucuucaagcagaaauaaaauacuuacaagaaucauaccugagucagcuucaaaaagaacagagaaaggaagcug

SEQ ID NO: 4040 - RNA, 330 nt, Diabrotica barberi
aaaugguauguggcucauccagacaaacucaagaaaaaaauuacaagagaauuaaucacaaccauuuuagcuagaaaaccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauauuuuggaaguguuugugaguuagauauaaucuucaacuuugagaaagccuacuuuauauuggaugagcugaugcuagggggugaaguucaggagacaagu

SEQ ID NO: 4041 - RNA, 779 nt, Diabrotica barberi
uucgagaggaagcucaaaaauuagaacaaagugaugcacuaaaagcagcuagacagaaauuugaaaguguagaaaaagaagcuaguaaagguagcgaaguuuuuaaagaaaguuuagguucuguuaaggaaaggcuuaaaggaguuauagaugaagcuaguaagucagauuuagcaaagaaggcuggcaaauucacagaagaaguugguaaaacuacacauaaaauuagugaaacagcucaagaaauuaguaaaacuggagcguuucaaaguauaucucaagcuacuaaggcuguuaaacaagaaauagacaauacuaguauagaagguagaguauauguuaguccuaaaauacuacggaagagaacagaaacaagugcaguuguccaucaaaaauauuaugaaccaaacacagaugcuacagguguugaacuacacaaagauucuaaguuuuaugaaucuuggcaaaauuucaaagauaacaauccauauguacauaaaguuauggacuggaaauuaaaauacgaugaaagugaaaauccugucauccgugcuuccagagcucuaacagaaaaaguuggugauaucaugggugguuuauuucagaaaacggaacuaucugaaacacuuacagaaaucuguaagauagauccugcguuugauaccaaaagauuucugaaacaaugugagacagauauuauucccaauauucuugaagccaugacgagaggagaguuagaaguucuuaaagauuggugucaugaaggcccauucaaucuu

SEQ ID NO: 4042 - RNA, 712 nt, Diabrotica barberi
accuggcuuaaauacuguggaagaaggaccaaaacaguucacaaauaaugugagugguuuaaaacaaaaauuagaagaaauaaaacugaaguuaccauggauagaacgacuggacuguguaaaugcacaagccccuuuagcaccugaauuagcagcucaaauguugacccacgaggaaaaaagaaguaaugagcuuaaaaauaauaaaaagcucacacaguuuacuccaagugaagacccgguuuuaaacgacuuuaaaagagaaaugauguuccacagacaagcccaggcugccauucuagauucuauaccaaagcuaaaagauaugggaauacuaacuaaaaggccugacgauuacuuugcagaaauggcgaaaacggaugcccauaugcagaagauuagggaacaucuuaugacgaaacaggagcaacagaagagaagugaacgagucaaacaacuuagacagcaacgaaaagaagguaaaauguuacaaguucagacaaaacuucaaagacaacaagaaaagaaagauaugcuugcucagguuaaaaaaguaagaaagggaauguccaaagaucuugacuuccuugacggaaaaaauaaaucugcugccaaaaaaauggcagaaaaacggaaaaugaaagacaaaaaguucgguuucgguggcaagaaaaagggaaugaaaaggaacacaagagauagugcugcagau

SEQ ID NO: 4043 - RNA, 658 nt, Diabrotica barberi
gcuccaguaaaggauauggguuuguacauuuugaaacugaagaagcugcaaauaaaucuauugaaaagguaaaugguauguuguuaaauggaaaaaaaguauauguuggccgcuuuauuccacgcaaagaaagagaaaaggaacugggagaaaaggccaaacuuuucacaaauguauauguuaaaaauuuuggugaagauuuaucugaggaagaguugcggaauauguuugaaaaauaugguaaaauuaccagcuacaagauaaugaguaaagaugaugguaaaucuaaaggcuuuggcuuuguugcauuugaaaauccagaggcagcugaaacagcaguagaagcauugaauggaaaagaguugauggaaggaaaaccuuuguauguaggaagagcccaaaagaaagcugagcgccagcaagaacuaaaacgucgauuugaagcccuuaaaauggaaagacuuaaucguuaucaggguguaaaucucuauguuaaaaacuuggaugauacuauagacgacgaacgucuccguaaagaauucucuccguucggaaccauaacuucugccaaaguaaugauggaagaagguagaagcaaggguuuugguuucgucugcuuuuccuccccggaagaagcuacaaaagcaguaacggagau

SEQ ID NO: 4044 - RNA, 669 nt, Diabrotica barberi
ggaucugcugaagacacuaguagcgcuccagaaccaaccguuauuccuaaucaagagagucuuaucggugacuugcuaucaauggaucuuaaugcuccagcuccugcggcugcacaagcagcuguaccagccaguaauguagaucucuuagguggaggauuggauucuuuguuggauauugguaccacucccgcaccucccacuucuacgggacuucuuggugacauuuuuggaauaccaacugcuccaaccauguauacaccacccaaaacuauaugguuaccggcugaaaaagguaaaggauuggaaauacauggagcguuuucaagaagagcugggcagaugucaauggauuugacauucaccaauaaagccaugcaggcgaugucugccuucgcuauucaguucaacaaaaacagcuucgguauaguucccggcucaccacucaccgugccugcgcuucagcccggacagagcuuggaauacaauuuagcguuggccacuacuggaccaguacaacguauggauccacucacuacucuccaaguggcaaucaaaaacaacgucgauaucuucuauuacgccugccaaauucccauucagauucuguucaccgaagacggcacuuuggauaagaggguguuccuuacuacuuggagagacauuccg

SEQ ID NO: 4045 - RNA, 354 nt, Diabrotica barberi
gaaguuggagcuaccucuucuuuggcuccuaaaauugguccucuagguuugucucccaaaaaaguuggugacgauauugccaaagguacugcugauuggaaaggucuuaaaaucacaguacaauugaaaauccaaaaucgucaagcuaccauuucuguagucccaucugccuccucccugaucauuagggcucuuaaagaaccaccacgcgauaggaagaagcaaaagaacauuaaacacacugguaacauuacuuucgaugaaauaauugcuauugccagacagaugaggcccaggucgauggccaaacaguuauccggaacuguaaaagagguuuuaggaacagcccaauca

SEQ ID NO: 4046 - RNA, 692 nt, Diabrotica barberi
cacuuguagaugcuggaguuacugaaguuauauuagcaguaucauaucgugcuaagcaaauggaagaagaguugacaguggaagccaaaaaauugggaauuaauauaauauuuucccaugaaacagaaccuuuagguacagcgggaccaauugcauuagccagggaucaucuuucuaaaagcacuaaaccauucuuuguguuaaauuccgauauuauuugcgacuucccauuuaaagccuuggccgaauuccauaaaaaccacggaaaggaagguacaauagugguuacuaaaguggaagaaccgucaaaauaugguguaguaguuuaugauaaagacaacagcauccaaaguuuuguagaaaaaccucaagaauucauuucuaauaaaauuaaugcugguuuguacauucuaaauccaagugucauuaacaggauagaauuaaaaccaacuucuauugagaaagaaguauuuccuuacauggcugcugauaaacaguuguaugcauuugaauuggaagguuuuuggauggauguuggucaaccaaaagauuuucugacaggaauguguuuauaucucaaacauuuaaggcagacaaaugaagacaaacuuuauaaaggaccaggugucguuggcaauguauuaguagauccuacugcuaaaauuggaaacaauugucaaaucgggccuaau

SEQ ID NO: 4047 - RNA, 685 nt, Diabrotica barberi
accucuuaaaagaaggugccagcggggcauucgcccaguauaacaaagaucaacugacccccguuaaaauagaaaacgccgaucauuuagugcuuauuacggaauacaacgauuuagggaauaauagauucuucgaccccaggaguaagcagaguuuuaccuacgaucaccugagaaaagaagccuuagacuaccaagucuauacccccgauagcgcuucugagccuuggcgggcagccuuagacucagaguucauucaguacacuaggaaccauuacaaagauggaguauguagugugguaggccgcaaccagagcgggguuguuaacuuaacggcauguaucgaagaccaucaguucucuccgaagaacuacuggaaugggagagaagaccaccaguucucuccgaagaacuacuggaaugggagauggagaucgcagugguccauuagucuaacugaugauuccacugcugaggugagagguguacucaaaguacagguccauuauuaugaagaggguaauguacaauuaguaaguacuaaagaaauaaaagaaacuguuccuguuucaucugaggcacaaacugcuaaagaaaucauccaaguaauagaagccgcugaggaucucuaucagacggcaauuucagaaaacuaccagaacaugucagauacaaccuucaaggc

SEQ ID NO: 4048 - RNA, 699 nt, Diabrotica barberi
gguaucuggaauucagcgauccaccuccaaauuaugacuauccauuaguauuuccaauuaaagaauggcccaaaaagaaugauccugccuuuauugguauuuucuucagcagaugcagaaucgguaaucugcgugauggagacauugaccaaagaacacccggggucuauuuuagaauggaaagagauuuaagaacgaggcaagacagaauggguguagaaauuagagaaagacuuaagugggacaucagaacaggagucauuggaucagaaacauucgauccuaagcacgccguuauugucacuuggaaaaacguuucuuucacuggaggauucgcuaaugcuaaauacaagacaaacaccuuccaaaugguucuugcaacugacgaagucuucacuuacgcgauguucaacuaccucaacuuggacuggaccucccacacugaagcggguggugauucccaaaacggagaagguggugucagugccuauguugguuuuaacgcuggaaacgguaccagaagcuacgaauacaauccuuacagucaagcuuccgucauucgagaucucacugcaguuggauuuggaaaugguuuuaagggaagacauauuuuccguauagacgaagacauuuugcuuggaucaugcaacaaagauauagauggugccaaccuuccccugaaauucgcuccugaaagug

SEQ ID NO: 4049 - RNA, 338 nt, Diabrotica barberi
auaaguaagcagccacguaacgcauuuuuaagucgguauacacguuucgugucucaagacuuaaaaaugcguuacguggcugcuuacuuauuggccguuuugggcggcaaagccucucccaaugcugcagaucuugaaaaaaucuugggaucuguagguguugaagcugaaggagaaagaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaagaaaagaaagaggc

SEQ ID NO: 4050 - RNA, 688 nt, Diabrotica barberi
aagggaaaggauaguugcagaguguaaugcuguaagacaagcuuugcaagacuuguugacugaauauaugacaaauaugggcaauaaagauaaaagugagagccuaguacgagcaaucgacaauauggguagaaagacuaaggauuuaagaagacaacugaggaaagcuguuguagaucauguaucugacaguuucuuggaaaccaacguaccucuucucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggugucaaaaugguuagauaugcugcugcucaaaucgacaaucuguguccugaaguaauaaaugcagcuagaauuuuagccgcuagaccucgcaguaaaguugcucaagaaaauauggacgcauucaagcaaucaugggagaaucaagugagacuucugacugaagcagucgaugacauuacuacuaucgacgacuuuuuggcuguuucugaaaaccauauucuggaagauguuaauaaauguguacuugccuugcaagaaggugauucugacacauuggaucgcacugccagugguauaagaggaagaucuaauagggugugcaauguaguaacagcu

SEQ ID NO: 4051 - RNA, 726 nt, Diabrotica barberi
aacuacaaaggccacuacagccccaacaacccucuccuuugguuuugcuacuccuacgacuguaccguuuggaucaucaacuacaauuacaccugcaacaacuccucaauuuggauuaucgcuuccaaaggcuagugcuccggccacuacuacuuuuucacuucuaggaucugccccagccacuacugcagcagcaccuacagguauaucauuugguacugccacuacuacagcaacaacuucagcuacagguuuaucauuuggaacuccaauuggaacugcuacaacuacagcaacaacuucagcuucagguuuaucuuucggucuuacaacagcgucuucuacaaguucugcugcaccuacacuuuugucaucaacaaccacuucgacaacgucaucagugucugcaucuggugcuuugaguaguacaacaucagcaccgacuuuugccaccucaucguugucuucaacaggcgccuuaacauucucucaacucgaagauucgaucaacaaauggaccauggaucuagaagaacaaggaaaauucuucaucaaccaggcuaagcaauuaaaugcaugggauacuuuacuuauauccaauggagagaaaauuuuaacccuuaacaguagcaucgagaaagucaagcaacaacagcaacaguuagaccaagaauuagacuucgugcuggcacagcaaaaggaauuggaagagcugauuguaccgau

SEQ ID NO: 4052 - RNA, 436 nt, Diabrotica barberi
cuuaggacuggauaacgcaggcaaaacuacccuucuacauaugcucaaggaugacagacuggcccaacaucuucccacguuacaucccacaucagaggagcuuuccauugguaacaugagguuuacgacguucgauuuggggggccacgagcaggcuaggagaguguggagggacuacuuuccagcaguggaugccauaguguuccuuguugaugccaacgacagcucaagauuuguagaaagccaggaacagcuaaaugcccuccucucagacgaaacucuaucaaacuguccaauacuuaucuuagguaauaaaauugaucucccaggugcugcuucggaagaugaauuacgaacuagauucggcuuguuuggccaaaccacaggcaaaggcaaaguagccagaaacgaucuaccugguaggccucuagaacua

SEQ ID NO: 4053 - RNA, 423 nt, Diabrotica barberi
agguguuuccuucaggagaucccaguaccauugccgacaaaaaucaaacaauaacaaauauccuuacacaaguucagacauucguuaccacagcucucacuuguagagaaacaauaacuuccauguugcaguuuuauggaacuuuaaacgacuaucucgacccagcugguggagcagaugaacuggagguugaggcaaaaagacauuauauauugcaguuacacccugagaucaaagacacccuacagacacauacucgaauuuugcagacuuuacuucccuucguugaaucggaaaacauuucuaaagugguugaaaugacagcucaauuggaagaggcaucuguuagucaucucaguuuguauggagaguggagagauacaauguacaaaauggugguagcucuacaagauuucacugaua

SEQ ID NO: 4054 - RNA, 750 nt, Diabrotica barberi
aguggcaacuuuauauggcaaaguuguguuagucaaucucauugaccaaaagggagcugaagguaacauggagaaauccuuuaagaacgccaugaauucauugucguauccuucagcacgauacgaaccuuucgacuuccauucugaauguagcaaaaugaggugggaccgucugaaaauccucauagaccgucuagcucuggaccaagaugaaaugggcuucuuucucuuauugcgggaugguuccuuaagcucguuacaagauggcgucuucaggacgaacugcauagauuguuuggacagaaccaaugugguccaaaguaugcuagcgcacagaaauuuagaaauaguuuuaagaaaguugaauauuuuacaccaaaaccagaacuuggaguuccaguauuccuucgagguuuuguuuaagaauguuugggcagacaacgcggauauuauaaguacacaauacucgggaaccggggcuuuaaaaacggauuuuacuagaacagguaaaaggacuaaggcuggaguuuuucgagacggagucaauucgcuuacuagauacuacaaaaauaauuuaacugacggguaucgccaggaugccauagauuuguucuuaggguaugguaaaccgauaucuccacuaagaguagacaaaucguggcgauauauuacuuacccuucagugcuuuuagucgcuguauccauguuuguagcuucugcuguauuuccuucggaauacucaaccgaauc

SEQ ID NO: 4055 - RNA, 721 nt, Diabrotica barberi
agauuccagccucagacuauggacaaaguugaagcuaaggucgguuauaguauuaagaaaucucuuaacaaugaaacauuguacauggacagagauucucagauuaaggcuauugaaaagaccuuugaagacuccaagaaugucaucgagaagcauuacagcaaaccaaaugucguagcuguggauauuuugccuguguauccagauuucagccuuuggaaguacccuugugcccaaguuauuuuugauuccgauccagcuccuguuggcaagcaaguaccagcucagauugaagagaugucgcaggcuaugaucagaggugugauggacgaaaguggagaacaauuuguugccuacuuuuugcccacagaagauacucuucagaaacgaagggaugauuuugucaaccagauaccauaucaagaugaugaggaauaugaguauaagauggcaagagaguacaacuggaauguaaagagcaaggcaagcaaaggguaugaagaaaacuacuucuuuguggcaagaccagauggaauuuauuacaaugaacuggagaccagaguaaggcugaguaagagaagggucaaagcuggugcuccaccuaguaacacaaggcuuauugucaaacacagacccauggaugcuaaugaguucagaaugcagagguaccgagagaaacagcuggaaccaccaggugaagaugaugaggaaauggagguug

SEQ ID NO: 4056 - RNA, 707 nt, Diabrotica barberi
cuacagccgaauuggugauaaagacaacgcaguuaguacuuucagacaaacauaugauaaaacuguaucacuuggucaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguguaucaaggugcauauuguaugucaguacgagacuucaaaucagcugcuaacuuguuuuuggacacaguaagcacuuuuacaucauacgaacuaauggacuauaaagcauuugucagguauacuguauacaccucuauuauuaguuugccaaggaaccaauuacgagauaaagugguaaaagguuccgaaauauuggaaguacugcauucagaaccauuuguaaaagauuacuuguuuucuuuauauaauugucaguaugcugaauuuuucacaaaucuugcagaaguugaaacaguucucagaaaagauuauuucuugaauccucacuaucguuucuauguaagagagaugaagauacuugcuuauacacaauuauuggagucauauaggucucuuacuuuacaauacauggcagaagccuuugggguuacuguugaauacauugauaaagaacuguccacauuuauagcagcaggaagauugcauugua

SEQ ID NO: 4057 - RNA, 727 nt, Diabrotica barberi
cgcagcaacaacagaauauuauacacgagcaacguguucaggccaucgcaagaguccaacgaucaauaucgguggauccagcucaacaguuucugucggaccaacaaagucccuugcaaccaaguacgccucaggagcuuagcccgucugcuacaccaacaccaagcccaagacaguucauaggaaugaaauccccgaccuucccucuuccuucaccagugccucagacagcaaucagaccuccuacacccucccauucuccacaugauguaagucaggcaagcaccucugacgguaaugaucacuuuauucagucaccuucuacuccuaaaccuaguuuuccuaauagauuaccuacagaucaauuuauccaucaaccugcaacuccuaggccccaguuuggaauacaacggccaacuuuacagaacuuugguaauacgaugaggacagaccagcaagauauuaauaucaaccgacaguugagagaucuucuacagcgacaacaagucaaaaaguuggaugaaauguuaccagguaaaguucaacaacaaagaguguggccuccaauugaacaacaagaaaaugaggccucagcaacuacugguacuucggcaguuguggcuacaacagcagauaccacuuucagacaaccguuaccgcccaguauuguacgaccuagaguggcucucucuuuagcuggucgagcaggaccugguacuauuagggu

SEQ ID NO: 4058 - RNA, 220 nt, Diabrotica barberi
ugcaucaacaggaaaacuuguggccaugaaauugugauggcgucuugcuugacgcauaaaaaauaugccguagauaugcagccuccagaucccccguuucagcaacauuucugugucauugcuucucccggugaccagacguugcccuucgacauccacgaugcucucaguaaguacaaagcaaccaaaguacaaaaaauggacucagaaaaaggauugc

SEQ ID NO: 4059 - RNA, 746 nt, Diabrotica barberi
ccauacuucagaaccaccaaugccuagggaaaguaaaucgaagaaaaauuugcaaugggugccaucuuugccaaauuccagucauuuagaugcaguuccucaagccacuccuauuaauaggaacagaguagcaucaaaaaaggugaggacauucccauuauguuuugaugacacagauccacaaguaaacauugaaaauucuugucagcaagaaauacuuguuccuauuagacuugauauggaaauugaaggacaaaaacugagagauacuuuuacauggaauaaaaaugagaguuugauuucuccagaacaauuugcggaaguccuuugugaugaucucgauuuaaacccauugacguuugugccugccauagcucaagcaaucagacagcagcuggaagcuuuuccaaacgaaccgccaaguauacuggaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauucguaacagccauagcauacucuauccguggucaacucucguggcaucagaggacuuacgcuuucagugaagcuccgcuuccgacaguugaaguuccguucagaacucccagcgagucagaucaaugggcgccguuuuuggaaacuuuaacagaugccg

SEQ ID NO: 4060 - RNA, 666 nt, Diabrotica barberi
aucaguucccaaaguggaucuacagcuagugguuuugcagaucaugacuauccaacuaucaguggaguaucacaaguuaucaacaauaugacacaaguuaaauguguuaauagcauuccuuuaccaacggaaauuguugaccacuuuucacggguucaaugccauugcaugaugggccucuuuugugaaaucaauagagcuuggcuuacuguggauagugauauuuauguauggacuuacgaacaaaauacugaucuggcauacuuugauggaauaagugagaccauuguuuguguuggucuuguaaagccaaagaugggagucuuccaugcuuuuauaaaguaucuucugaucuuggcaacuucuguugauauugugguuuuggguguaacuuuuacugagaagccaggugauaccacagaggaaauucaguugauaccagacccaguuuuuaguuuaccaacugauggugccacuguuacuaucaucaguaguacuaaugacggaagaauuuuuuauggcacaaaggagggaaagcucuuugaaauauacuaccaggcugaaagugguugguuugggcaaagauguaaaaagguaaacuugucuacaaguacccuaucuuuucuaguuccuucauuuuuaaaugcugcucuuagcgaagaagau

SEQ ID NO: 4061 - RNA, 799 nt, Diabrotica barberi
aaggccaaagauuccguuauaagcauugcaaauacugcucugagcauuguagacccagaagauccuuuagcggcuacuuuauauuccaucaaguucaaacaccacuuggcauuaaaacacuacgaacucgccuucgauucauugaaugcgaauccagaugcggaacggaaaaaagacaaucugagagauuugguuaaaacacuguuggaugaaaagaaauuggauacuuuauugaacuucacguacgguagcauggaugaguucuuuacaaauauacuguugagcagagcuagagcaaacgaugcaguuaacaacauuuucuacgacuucuuguauucuuaucaaauuaaaagaggaccucugucacacagacuagcugcaucaguaauguacgagcaggcuuucagauuaaaucauauuaacagcguugaagcacuggaaaaacaaguaaaauguuacuuggcagccaaaaacguucuacaucugugucaaccagaacacgcuuggguagugagaccagcugauccagaugaagaagaugacguaauaacuauucagccuuuggcaggaucaaacgaagaaaugaaaguauuuagauugagaaaacaacuugaagugguaaauauugaaacuguugagaaagaacuuauuuucgcaagugcaaaguuaaaauuggcaagauuuagcucgagccuaucaccgguuaauauaacaacuccuguggaauuaguaacauuauuaaauacugcugguuuauucaaaacugccuuagacauuugcacgacguuugaauugucau

SEQ ID NO: 4062 - RNA, 711 nt, Diabrotica barberi
ggcuaccauaaauuuggcacaaacccauagcaacgacgugaaugcauuaaaaguuauauacaguucauugguguuaauuuguaaaguauuuuauuccuuaaauuuucaagaucuuccagaauuuuuugaagauaacauucagauuuggaugucaaauuuccauacguuauuaacggcagaugucaaaugucuucaaaauacugauagcgaagaggcugguauuauggaacaauugagaucccaaguaugcgacaauauagcucuguaugcacaaaaauaugaugaggaauuucagcaguucuugccacaauuuguuacugacguuuggagucuuuuaguaucaacuggucuugaaccuaaauaugaucuguuaguuucaaaugcucuccaguuccugucaucgguugcagaaagaguucaguauagacauuuauuugaagauaacaauguuuugagcagcaucugcgaaaaagucauuauacccaauauggaauuuagaguuucagaugaggaguuauuugaagauaauccugaagaauauacacguagagacauugaagguucugauauugauacuaggcgaagagcugcuugugaucucguaaauacucucagccagaacuuugaacaaagaauuauagacauauuuggucaauauuuacaagugaugcuuggaaaauauguggaaaauaccaagcaguauuggagaag

SEQ ID NO: 4063 - RNA, 505 nt, Diabrotica barberi
cuugaacccauuucaguucgaaauaacuuuugaguguauagaagaacuuagagaagauuuggaauggaaaaugauauauguaggcucagcugaaagugaagacuaugaucaaacuuuagacucaguuuuuguaggaccuauaccugaaggcaaacacauguucgucuuucaagcggauccuccaaaugucucacguauuccagaaaaugaugcucucgguguuacaguuguacuauuaacguguucuuauagaagucaggaguucauucguguaggauauuuuauuaauaaugaauauacugauccggaacuuaaagaaaaucuaccuaguccuccacaauuugauaagguaacccgaaauauucuagcauccgaaccaagaguuacccgcuucaaaaucaacugggaagaaaccaaccccacagaaaauaucacaaauucagaccaaaguggagcaucagcacccacgacaucagaagcuggacccucugcuccugucgaagua

SEQ ID NO: 4064 - RNA, 681 nt, Diabrotica barberi
ugucuguaccacaaaccaaauauguaacugguuucgcauugcccaugaguucuaugaaugcacaaacuccccaacacacaaugagcccuauggugaacuuaggggguucaauaacuacaggagcuggagugacuccaacgauggcaccuucaacuccuucaccuaugacgccaaugacuccucauucugcugauccuggcaucauuccacaguuacaaaauauaguguccacaguaaaucuaaguugcagauuagacuuaaagaaaaucgcucuccacgccagaaacgccgaguacaacccaaaacguuucgcagccgucaucaugaggauacgugaaccacguacuacagcccuaaucuucucuucgggaaaaauggugugcacgggagccaaaagugaagaagacucgagguuagcagcccgaaaguacgccaggauaauccaaaaacucggauucccagcgaaguuccuggauuucaaaauucagaauauggucggaaguugugacgucaaauucccuauuagacucgaagggcuugugcuaacccauagcucuuucagcaguuacgaaccagaguuguucccuggacucauuuaccguaugguaaaaccuagaaucguacuuuugaucuucgugucuggcaaagugguguugacgggugcgaaaguaagacaggaaa

SEQ ID NO: 4065 - RNA, 251 nt, Diabrotica barberi
uaugccgaccaaaugaacuucacauuugcagcuggaaaucagguuuacuauacugcaaccucaguuaaacagguagauguaccaucuuucucugguagcuuugguauccuucccgcccauguacccacacuggcugugcuaaaaccuggaguagucacuguuuacgaagauagugguaauguuaagaaaaucuuuguuuccagugguacugucaccauuaacgaugauucaucaguucagauucuugcuga

SEQ ID NO: 4066 - RNA, 693 nt, Diabrotica barberi
caaggaaggagaaugggaaaaguuagugauggacacauucagaaaauaugaaaagucgagcagggcaaaacacgaggaggaacuuaaagaaaagcgagaacaagaagcucgaaaaaaagcagcugcugccaaaaaggcagaagcagaaacugucaaaccugcucaaaucaccgaauugacugaugaagaagcugaaaggcuucaggcugagauuaaugcuaagaaaaacacuucugauaaggcugaaaguucuucaaaugguucagaagcugcaacuacagcuaaaaaaguaggagaagacgaggaugaaucugaaaaaggcaagauacugcccaacucgggaaauggaugugaucuagagaaguacaaguggacgcaaaccuuaggagauauugaguuaaaaauuccccucaaaguaaacuucaggguaaaacagaaagaucucguaguaaauaugacgaagaaacauuugacgugugguaucaaaggucaaccaccuaucauagacgacgauuuuccacacgaaaucaaauuagaagagucuucuugggugaucgaagauggaaaggaccuauuauuuacuuuugaaaagauaaauaaaaugaauugguggagccaaauagucaaauccgauccagaaaucagcacaaagaagaucaauccugaaccauccaaacuuagugaucucgacgg

SEQ ID NO: 4067 - RNA, 332 nt, Diabrotica barberi
cgcgaaagguggauauguauuuaccccgcuuacaucaacaacaaaaaaacauuggcacagggcagaaaaauagccaaagaaagaugcguugaaaaucccacucaccaggaaauucgugauguuuuggucgcggcuggcuugaaagugggugucgaaaacaaauuguacagcagagagagaaguaaggaaauguuauaucgugguagaauaaggauacaguuaaagaaugacgaugguaguuuguguaaugacaguuucccuaccagagacagcauuauguaccauuuaggagacaugauucccaaacugaaaagcaggcaaaauaaaagcuc

SEQ ID NO: 4068 - RNA, 650 nt, Diabrotica barberi
gauaugggagagagcacuugauguugaccauaggaauauuaccauuugguugaaauauaccgaaauggaaaugagaaguagacagguuaaccaugcuaggaaucuaugggacagagccacaguuagaaguagacagguuaaucaugcuagaaaucuaugggacagagccacaguucuuuugccacgaguuaaucaguuuugguacaaauauacuuauauggaagaaauguuagaaaauguaccaggugccagagcaguuuuugaacgauggauggacuggcaaccugacgaacaagccuggcaaaccuauauuaacuuugaacuccgcuauaaagagauugauagagccagacaaauauaugaaagauuugucauaacacaucccgaaguuaaacacuggauaaaauacgcccguuuugaggaaaaccaugguuucauacacucaucuagacagauauacgagagagcaguacaauucuauggugacgaucauuuagaugagaaaucuaggcagauauacgagagagcaguacaauucuauggugacgaucauuuagacgagaaacucuacauugcguuugccaaguuugaagaaaaccaaaaggagcaugauagggcgagaguuauauacaaguaugcucucgaucaca

SEQ ID NO: 4069 - RNA, 721 nt, Diabrotica barberi
aucguguacguaaugacaggcauguauggugaucccgcugaaauuggagcuggagugugccuucucaucaucauccaacuguucgucgccggucucaucguauugcuucucgaugaacuucuccagaaaggauaugguuuagguucugguauuucccucuucauugcaacaaacauuugugaaacuauuauuuggaaagccuucucaccagcaacaguaaacacuggaagaggaacagaauuugaaggagcugucauugccuuauuccacuuauugaccaccagacaagacaaaaucagaggauuacgugaagcuuucuacaggcaaaaucuucccaauuugaugaaccucuuggccacaguacucguuuuugcuauaguaauauacuuccaaggauucagaguagaucuacccaucaagagugcaagauaccguggacaauauuccagcuauccaaucaaauuguucuacacuucgaacaucccuauuauucuacaaucugcucuuguaucuaacuuguacgucaucucacagauguuggcuguuaaauuccaagggaacuucuuaauuaaucuauugggaguuugggcugacguuggaggcgguggcccagcgaggucuuaccccauugguggauuauguuacuacuuaucuccaccugaaaguguaagucacauucuagaagauccaauccacgcaaugcucuacaucgucuucaugu

SEQ ID NO: 4070 - RNA, 335 nt, Diabrotica barberi; identical to SEQ ID NO: 3847

SEQ ID NO: 4071 - RNA, 665 nt, Diabrotica barberi
cguggaagaaaagcacuuuugggaagcuuagggcuuauugcuggugguacuggugccuugcuguuugcuuuggaucaaucaguuaaagcaucugaucuugaauugcauccuccaaagaauguuuggagucauucuggaacuuucaauuccuuggaucaugcuaguguaagaagagguuaugaaguauacaaacaaguaugugcugccugccacucaaugcgcuucauugcuuaccguaacuuaauuggaguuucccacacugaagcagaagccaaagcugaagcugaagaacaaaugauugaagauggucccgaugacacggguaacuuuuucaaaagaccaggaaaguuaucugacuauuuccccaguccauaccccaaugaagaagcagcucgugcugccaacaaugguuccuacccuccagauuugagcuauauuguaucugccagacauggaggcgaagauuacauauuugcccuuuugacggguuacugcgacgcgccagcgggcgugguccucagagacggacaauacuucaaccccuauuuccccgguggugccauuucgauggcacaagcccuauauaacgaaaccauagaauacagugacggaacaccagcaacugccagucaacucgccaaagacgucgcuguguuccuaaaaug

SEQ ID NO: 4072 - RNA, 779 nt, Diabrotica barberi
agagaaacauacucucgggacauauugaaacggcucauguaagugauuuucaauuugaaaaccagagaagaacuuuuacaagcuaugguuaugcguuagacccaucgauaaguaaugauggagauggacaucuaaaaguuguugguucaacugaagaagguaaagacguagaaaguguuaagacuguauuugaaacuucaaagauaagacccuuggauaagaggaaaaggaagagaaaugauaauccgggugauauagaaggauuuuugggaccauggggugguuuuguugaugaacaaaaaguaucuagaccaacggaggaagaacaggcugaguuagaugaaauaacuucuaaaaagaauaagaaagguaaaccaacagaggacaaaccaauugaggaaaagucuguauugcauaucaaagauccaguggacuaucaaggaaggucuuuuuugcaugcuccacaagauguugggguuaaucucaaaucugauacaccuccagagaaauguuuuuuacccaagucccauauucauacauggacuggucacuccaaagguguugcagccaucaggugguuucccagaacggcacauuuguuccugucugcuaguauggauuguaggauuaagauuugggaaguuuauaaugagagaagaugcauuagaacuuacuaugggcauagacaagcugugagagacauuaacuuuaacaauucuggaaagcuuuuucucucagcuggauaugacagguauauuaaacuuugggacacagaaacu

SEQ ID NO: 4073 - RNA, 664 nt, Diabrotica barberi
ccacuuuuugaaaagaggccuagaaauuuuggaauuggccaggauauucagccuccccgugauuuaucucgauuuguaaaauggccaaaauacauccguauucaaagacaaaaggcuguacuucaaaagagauugaagguuccaccaccaauuaaucaauucucucaaaccauugacaaacaaacagccacccaauuauuuaaagucuuggaaaaauacaggccugagacagcucuucagaagaaaaauagguuaaaggcuaaggcugaagcuaagguugccaagaaagaggaggcgccugcuaaaaaaccaaacacauugaaggcugguaccaauacaguuacuaagcugaucgaacagaaaaaagcccaauugguuguuauugcacacgauguugacccaauugaguugguucuguuccuaccagcccucugcagaaaaaugggugucccauacugcauaguuaaagguaaagcaagacuuggacuucuaguaaggcgcaagacuuguucauccguagcucuuacacaaguugacucuggagacagguccaacuucaacaaacuuuuggaaguaaucaaaacuaacuucaacgaccguguugaugaaaucaggaggcacugggguggugguuugcuuggauccaaaucugcugcucguauug

SEQ ID NO: 4074 - RNA, 680 nt, Diabrotica barberi
auccagaaagugguggaaucagugccugccuauaccacgauccccauauuuuacauacacuuagugcuguucaaauucucugcaucuacaauaaauuagaggcaauaaacguagaggguguuguuaaauauaucgcaagccuucaguuaccugaugguagcuuuacaggagauaaauggggugaaguugauacuagguucucauuuugugcaguuaugacauuaucguugcuuaauaaaauggaugcaauugauguaaauaaagccguggacuuuguuuuacaauguaaaaacuuugauggggguuucggaucuaggccacuuucugaaagucaugcgggguuaauguauugcuguguuggcuuuuuaucuaucacaaauagguuagaugccauugauagagacacccuugcuuggugguugugugaaagacaacuaccaucuggagguuuaaaugguagaccagaaaaauuaccugauguauguuacucaugguggguguuaucaucauuaaccauguugggcaggcuucauuggauugaugcgaaugcuuugaaaaacuuuauuuuggcuugucaagacacagagacuggaggauuugcagauaggcccggugauaucgcagauccuuuucauacuauauuuggguuagcagccuugucccuuuugggacaugauucu

SEQ ID NO: 4075 - RNA, 693 nt, Diabrotica barberi
gaaaccgguacuccagauacuuacgucuugucacaauacuucgaguucauaauacaaagacugcuugaaacaacggaucgacccgauggcgcccaacacaauuuacgaccugcagccuacgaagcccucauggaaauggugaaaaacucacccaaagauugcuaugucaccgugcaaaagacuacaauggucauuuuggacagauuacaucaggucuuacagauggaaacucacauaagcagccacaacgauagaucgcaguucaacgaucuccagagucuuuugugcgccacucuucaguccguacucagaaaaguuaccccagaagacgcgccaagaucgcaguucaacgaucuccagagucuuuugugugccacucuucaguccguacucagaaaaguuaccccagaagacgcgccacacaucucagacgccauaaugaccgccauguugaccauguucaauucgaauucauguaagaguggaggcguucaagaagaugcuauuauggcugucucgacgcuggucgaaguuuugggagaaaacuucauaaaauacauggacgccuucaaaccguuccucuaccucggauugaagaaccaucaagaauaccaagugugcguuacagcagugggcuugaccggcgacaucuucagagcucucaaacugaaagcgcuaccauacugugaugaa

SEQ ID NO: 4076 - RNA, 784 nt, Diabrotica barberi
uagaaggcauccaaacgaaaucaguguucccaugucaguggaauuugaugaguuugccaaagccagggaaaauccuaacgaggauauggcuaacuuuguagaauuuacagaugaggagggcuacgggaaguauuuggauuuacaugaauguuaugaaaaguauauaaacuuaaaaggcauagaaaagguugauuacauuaccuauuuggguauguuugaccaacuguacgauauuccgaaggagagaaaaagcggugaauauaaaaaauauuuguuaugccuaauugaauauuugacuugguuugugcagcguauaaagccucuaaaggacuuagacauugaucuacaagaacaaguugagcagguucugauaaacugggauaauggaaguguaccgggauggccaaaagaaacagggucugcacuaacaaauguuggagcccacuuggaccucucugcauuuucaaguugggaagaauuggcaucguuagguuuagacagacugaaaucugccuuaauggcguuaggauugaaauguggggguacuuuagaagaaagagcucaaagauuauucucaacaaaaggaaaagguuccuuggauccuucacuuaugacgaaaaauaacaaaggcaaagccaacaaagaaaaggaguuauugagacaaagagaacuugcaacuuuagaagcccaaguguacagacuagcagagugggucucaccgcagagagcugcaacaaaagaaaaugugcaaaggaaacaagcucguacugacggagaaagagac

SEQ ID NO: 4077 - RNA, 504 nt, Diabrotica barberi
uuggaacuuucaaagcguucgacaagcacaugaauaugauauuaggcgacugugaagaguuucggaaaauuaaaucaaaauuguccaaaguugaacgugaggaaaaacgaguauuaggauuuguuuuacugagaggagaaagcauaguuucuuuaacaauagaaggcccucccccaccagaagaagguuuacccagaguaccaaucccuggagcagccccaggaccaggaauugguagagcuggagguagaggaaugccacccggcauggcagguguaccuguaggucuucaaggaccuguaagaggagugggaggaccaucccaacaggucaugacaccaggagguagaggccaaguaucugcaccuccacagaugaaucaaggaccaccaaggaugggaggaccaccaccagguaugaugggaccuccacccgguaugaugggcauggcuccccaaaugggaaugggacguggaggaccaccgccaaugggaaugagaggac

SEQ ID NO: 4078 - RNA, 760 nt, Diabrotica barberi
acagcuuucgguuaggauuuucaaccguugcaacuaucguggaugaaacaucugaagcuauauggaaccgguuacaaccgauuuauaugccagagccaacagaagaaauaugggaaaaaucaauccuaggcuucaaaaauguauggcaguuccccaauuguuuaggaagcauagauggcaaacacgugaccaucagauguccccagaagaguggaucaaauuacuuuuccuauuuaaaaaaauuuuccauaguucuuauggcaauuguugacccagaauauaaauuuauuuguauagauguaggugguuaugguaaaaauagugacggugguauuuuugagacaucggcuaugggcagaaaauuugcaaaugaaacuaugaauauaccacccaacagaccauuagcuaaugaaaaugaagagauuccauguguauuaauuggcgaugaagcuuuuacacuaagcccuuacuuaaugaggccguuuccuuauagacaggcacgaaaugacaacagaaaagagagauuuaauuaucaucuaugcagagcccgacgcguaguggaaaaugccuuuggaauauuggcacauaaauggcgucuauuuuuuagaccacuagaaguuaaaguucaaacagcuacaaaacuugugaaggcagcaugcguauugcacaauuugcugcgcacaaaaaacacugacgagcaaucuuugcauuuacaagaaaacugcaauauuccuuuaccaguaguugauaaucuggcggu

SEQ ID NO: 4079 - RNA, 792 nt, Diabrotica barberi
cuccaacuaaaccggaagaaaaaauggcaaaccaagacaguaugauguuacaaaagaugaaaaaggagccucacuuaagcaaaguuucuauccuuaaaagaaaaguuggagcuggaaguggcaaaaucggcucucuuguuaguacagauuacaaugauauggacgauagcucauccacgccuccuauaacuccuccauuagcuacuacaagucgaggaggcauaccaaaaacauugcccaaaaagauuuuggagaaucaaagcagcaaggauuccguuauugucaugcacagcccagaggacaaacaacuugauaugauggauuuugacgaugacaccaauacuguuuuaucagcggaagucucucuaaguucugcagcucaaaaugacgaagauauguuggaaauggagacacuaucacaacaagauuuagcugaaggauuaucuagucccuuggaacccgaucaaauagcagaugaauauuuacuauuuccugggaauaugguaguugacaugucugcaggggaacauuuuuccgaaaaagaggaggaagaagaaaccguagaugaagaauuuaacgaugaaaacaugcauaucaugauucguaguccuacaaccagugacuaugaauacauuaugcaaaguaaggguaagaaauauaacguagguguccacgaugaaaacgaugaaaugccagaaucuccagaucaggaagacuuggcuguaccgucaccugaaguuucagacuuguugacaaauuacgaugaaaaugaugucuuaaugggcgaucaaa

SEQ ID NO: 4080 - RNA, 680 nt, Phyllotreta armoraciae
agcugaacagaagaagaaggaaaaggagcuucucaaagcuacggaaacagccgaggagaagagauugagaagauugaugaagaaagaggcgaaggaaagaaggcgaaaagaaaaaaugggcugggacaacgaauacuuacauuacacgaacagcgacaauccauucggagacggaaauuuacugaccacauucguuuggaacaaaaaacuguccaaagaaggcaucaaagacgucggccaugaagaaauugaagcgauaaacagauuaaaacaagaagagaauaaaagggaacuggaaaaagucaagaagcgaagauuagagagagaauuagagaggcaaagaagagaggaagaaacgcaaaugaugcaaagaacuaaagaagcagcccaauucgaggaaugggaaaggcaagaagauaaauuccaccuggaacaagcucgauugagaucucacauaagaauacaagacggacgagcuaagccgauugaucuacuagcaaaguacauaagcgcugaagaagaagucgaugcuguugaaaugcacgaaccguauacuuaccucaaugguuugcaaaucaaagaccuagaagacuuagucgaagacaucaaagucuacaaagaacuagaaagggggaaaaaccuagauuacuggaacgauauaacagucauagucgaagacg

SEQ ID NO: 4081 - RNA, 668 nt, Phyllotreta armoraciae
aaucaaguaccugcgacuuugcugccgggcgauaaaaauguggccgugcaaguaccgauuagcaaucaguaucgggaaccuccgguuccagugcaagccccucgacaggaguaccagccgguaccggcgccugcaguacaucccaaucaugugcaacagcccguuuuuacaggucaagauguugauuugcgaucgauggguaacgugacugauccgagaaucaggccgaugaucgucgaucaggauaugagacaaaugccaaaugucauccagaauccucuaccgccuacuauaagcgaaagucucgccaaagcgggagauucgaaacuugauaauuuuucgagggauccucgaagugucaccggugguuucccaucagauccaaggcaagcuaggauggacccgcgacaaaaaaauauaauaccgccgacgagccagcaaguaccuucaucggugaaucccaaaauaauggcgaaucaagccggcccugccgccaucagaccggcccaaaacgucaccgugcaagcucaaucugcggguguugugcccgcugcaucggcugcagcugcaccggccaaugugaugaguccaggaauaggaggagcuggggcuacagaucaagaaaaagccgcccugauuaugcaaguccuccaauuauccgaugagca

SEQ ID NO: 4082 - RNA, 652 nt, Phyllotreta armoraciae
ugucacuuauuccgccauaggugggcuuuccgagcagauaagggaguuacgagaagucauugaauugccucuuaugaaucccgaauuguucaugcgagugggaauuacaccaccaaaagguugucuguuguaugggccuccuggaacugguaaaacccuguuagcuagagccguagcuucucaacuggacgcaaacuuuuuaaaagucguaucgagugcuaucguagacaaauacaucggugaaucugcuaggcuuauuagggaaauguuuaacuaugccaaagaccaucagccgugcaucaucuucauggaugaaaucgacgcuaucgguggucguagguuuucagaagguacaucggcagauagagaaauccaaaggacucuuauggaguugcugaaucaaauggacggauucgauucguuaggacaaguaaaaaugauuauggcgacaaauaggccugauacuuuggauccugcucugcuccguccuggucguuuggacaggaaaaucgagauuccucugccgaacgaacaagcucgucuugaaauuuugaagauucacgcacuuccuauugcuaaacacggggaaauugauuaugaagcuauuguuaaauugucagacaccuucaauggggccgauuuaagaaaugug

SEQ ID NO: 4083 - RNA, 675 nt, Phyllotreta armoraciae
aucaaguggaguaugccauggaggccauaucccaugcuggaacaugucuaggcauccuggcaaacgacggaauccuucuugccgcagaaagacguaacaccaacaagcugcuggacgaaguuuuuauuucugagaaaauauacaaacuuaacgaugauaugguuugcaguguggcaggaauuaccucggaugcuaauguucuaacuaaugaauugcguuugauugggcaacgguacuuguaucaguauggugaaucaauucccugcgaacaauuaguuucgugguugugcgauguuaaacaagcuuauacucaauacggaggaaaaaggccuuuugguguaucgaucuuguacaugggcugggauaagcauuaugguuaucaauuguaccaguccgauccgaguggaaauuauuccgguuggaaagcaacuugcauaggaaauaacaguucugcugccauuucgaguuugaaacaggaauacaaagaaggcaauaugacuuugaaagaugcaaaaaguuuggcuguaaaaguucuggcaaaaacguuagauauggcuaaauugacgucggaaaaaguggaaauggcuacgcugacacgaagaaaugauaaaaccaucauaaauauauuaaauaacaaagaaguggaagaacuuauuuccgaguacgaaaaauccg

SEQ ID NO: 4084 - RNA, 664 nt, Phyllotreta armoraciae
acuaccacgauuaugcagacguuaauggaaaaaucagaaacugaacugaaagauacauacgcuagauuuuugcccuuaggucuuggcuuguguauguugggcaaacaggagggugucgauuccauaauugccgcgcuggaaguuauaccggagccuuuuaaaucaauggcaacuacgauggucgacauuugcgcuuacgcuggcaccggcaacguacuuaaaguucaacauuuacuucacauuugcucugagcauuacgauggugacagcucagacaagaguucuaaagauaaggacaaaaaagaugcuucagagaaggagaaagaucuuucaucgagacaagcaguggccguacucggcauagcuuugaucaguaugggugaagacaucgguagugaaauggccuuccgaaccuuugggcauuuguugcgcuacugcgagccaguaaucagaagagcaguaccauuagcucuaggacucauuucaguaucaaauccuaaauugagcauacucgauacuuugaguaaauucucgcacgacagugaugcugaaguagcccauaaugccauauuugcuaugggcuuaguuggagcggguacgaauaaugcaagauuggccgcgaugcucaggcaauuggcgcaguaucacgcuaaagauccaaaca

SEQ ID NO: 4085 - RNA, 748 nt, Phyllotreta armoraciae
gcgugauccgaagaaauuuuaucacuccggccggcacaauaguugaaaccaacgaagagcaaccgccggaaccaacgauagaagaagucgucaaaacgacaucgucgaauccaagucccgccgaacagaaaacggaacccgcagaaauagucaccuacgcugcggagguccugccgcaggagcagagagagcaauucgcugacgccaaaucuuacgccguggaaaugccugccgaaaauuuucaaaaucagagcuauacgcaggacauuaguuacgugaauauagaaggaacuguugugccaguuacaauaucggaaauagaacauccuggggacuacgccaaucuacaaaccgcucaauacaauaacggcuauacggacgguacacaauauuuaaccaaucaucaauaccaaaauuuguauauagauagaaguacaguugauaauucuccuucugcuacaguuuuauaccguggcgaugauccaaauuugggagcuuccagauuccaaggaaacuacgacauauccaguucucaaucgcaagugaaccuucuucccgcuuccggagaagccuacuauccaucaacgucuaacuggacgccaaccagcagcgggucuuaccaacaacaauacccgucgggaaacguccuucaagcugauucgacucaagcuuucgcagguccuuacauaaacgcuaccuggucgucgaauucgauggaggacggacggcaaucuagucaagagaccgg

SEQ ID NO: 4086 - RNA, 720 nt, Phyllotreta armoraciae
ccuuggauaauuugcugcaguuguggagggugcccggguuccacgccgagcucuauguaaacuaugauugcgacauguacugugcuaauuuguacgaggagcucaccgagcugcuggccgaacgguccauuucuaccguugugggaguuuaucaugcgcauuugcugucgcucgacgggcuuuugauuauaaucgaugggauagggaagagauucgaugaagcgaaagaucgaucagauaccgaugagauuagcaguuauacaggagagaauacgaggauuaaagguuguguuaaaguucccgauaagaagguuuuggcugcgaagaaggcgaucaaaaaaugguugccgcaagguacggaguauuucaaucagaagccgaagaaagguauacaguuccugcaagagcacggcguuuuaaagcaggaacucgacguggaggagauugcuagauucuugcgggagaauccugcguugaacaaagcuaugaucggagaguauauuagcaaucgggggaauuugaagauacuagaggcuuucgugagcacauucgauuucaccggaauacgaaucgacgaagcgcuuagagcguuucuggagacauuucgauuaccaggugaagcucccacaauuucgcugauccuggaacauuucgccgagcacuggcacaaaagcaacggagaacccuucgcugacguagauucugcuuuuaccuuagcgu

SEQ ID NO: 4087 - RNA, 470 nt, Phyllotreta armoraciae
caaacaguagccacgaauuucgagaaagucuucgaaaugggcccgcaccuguucguaggccuccccggccucgccaccgacacgcaaacggucauggagaagcucagguuccgcaagaaccuguacgaauugaaagagaaccggcggaucucgcccaagguguucgcagccaugauaucgaacaugcuguacgagaagagguucgggccguuuuucguugaaccggucguggccggucuagcgcccgauaccuuugagccuuacauaugcaauauggauuugaucgguugccuuaacgagcccagcgauuucgucgugggcgguacggccucugcgcaauuguacggaaugugcgaguccuugugggagcccaaucucgcgcccgaugaucuauucgaaacuauaucgcaggcuuugauaaacgcuuucgauagggacgccauauccgguuggggagcuaccguuuauau

SEQ ID NO: 4088 - RNA, 740 nt, Phyllotreta armoraciae
ugcaaaccgguaauaauggagauauggccgauauuaucucgcgcauucgacacauaccacagcgacguccggauaauggaaagguguugucgcucggugcguuucauguugcguugcguagcucgacaacuccaagauuugcugccuucuuuggucggccaaaucgugcacauuuaccgucucuacggacauucuuguuguuuguacgucggcagcauuuuaguggacgaauacgccggagaugcgacuugcguucaaggucuucucgacauguuaaaugccuuuuuggaaccgacguuucguuuguugcaagaagaaaauggcuugaagaaccauccggauacuguggaugacuucuuuagguugugcgcccgguucguccagagggcgccgaaggcguuucuaagcggaggggcccaucuggcgcccauuaugcaaugcucccuucucgcugccaccuuagaucacaaggaggcuaacgugucugucaugaaauuuuucuacgauuuaauaaaucagggacugagcggcagaggggaacccgacuucgacgagagaaaagccuugguuaggagccugcuaaacgaauacggccaacaacucgugucuaauuuaauucacucuugcguauuuuaccugcauucauacauguuaagcgaagugggugacguuuuugugcaauuguuagauuucgauagacagauaacgagugaaugguuagcgaacgguuuggaauuauu

SEQ ID NO: 4089 - RNA, 747 nt, Phyllotreta armoraciae
agauuccacgauuaugcgaaagagauuggauauucaagaagcuuuaaagcguccgaugaaacagaaacgaaaauuaagaaucuucauuucaaacacuuucuauccggcgaaggagccccaacccgaaggccccgauggcccuugccaagaaggcacgguagccucuugggaacuuagaguggaaggaaggcucuuggaagacucgaagaacgauccgaacaaaguaaaacgcaaauucuccucguuuuucaagucgcuggucaucgagcucgacaaagaacucuacggccccgacaaccacuuagucgaauggcacagaaccuugaccacccaagaaaccgacgguuuccaagugaaaagacccggcgacaagaacgugagguguacaauucuacugcuccucgacuaccaaccgcugcaguucaagcucgauccgagacuagcccgguuacucgggguacacacgcaaaccagaccggugauuauaucagccuuguggcaguacauuaaaacgcaccggcugcaagacggucacgagcgcgaguacaucauuugcgacaaguaucuagagcagauuuucaacuguacucguaugaaguuugcagaaauuccccaacgauugaacccccugcugcauccgcccgauccgaucguaauaaaucacguuauaucagucgaaggcggugcugaaagcaaacagacagcuugcuaugauauagauguggaaguggacgauacccuuaagac

SEQ ID NO: 4090 - RNA, 663 nt, Phyllotreta armoraciae
cguuugggcucacaauuuagaagacgaauuucgaacuauaaggcaaauagugcagaaauaccaauaugucgcaauggacaccgaauuucccgggguuguggcuagacccauaggagaauuucgaaguucagccgauuaccaauaccaaauguuaaggugcaacguagacuuacugaggauuauucaacuagguuuaacguucuuagacgauaauggcaaaacgccgggaggaguuuauacuaccuggcaauucaauuuuaaauuuaaccuucaagaagacauguacgcacaagauagcaucgauuuacugcaaaacucagggauccaauuuaagaagcacgaagaugaagguaucgagccauuagaauuugccgaacuacuaauguccucuggaaucgugcucauggaaaauauuaaaugguuaucguuucauuccggcuacgauuuuggcuauuuaauaaaguuacuaaccgacaacaaucucccacaagacgaaaccgaauuuuucgaucuauuaaaauuguauuuuccuacgauauacgacguuaaguauuuaaugaaaucguguaaaaauuuaaaagguggucuucaagaaguugcagaacaacuagaauuggaaaggauugggccucaacaucaagccggaucugacucacuucugac

SEQ ID NO: 4091 - RNA, 731 nt, Phyllotreta armoraciae
ugacaaugagagaaacccagguguuguguuuauccccgacuagagaauuggcuguacaaauucaaaaaguuauacuagcucuaggcgauuucaugaauguacaaugucacgcuuguaucggggguacgaaucuuggagaagacaucaggaaguuagauuacggacagcauguuguuagcgguacacccggaagaguuuaugauaugauucguagaagagcuuugaggacuagaucggugaaaaugcugguccuagaugaagccgacgaaauguugaacaaaggcuucaaagaacaaaucuaugauguguacagauuucuuccuccguccacucaagucguuuuaauuucugcuacguuaccccacgaaauccuugaaauaacauccaaauucaugaccgaucccaucaggauucuaguaaaacgugaugaacugacgcuggagggaaucaaacaguuuuucgucgccguggagagggaagaauggaaauucgacacucuaugcgaucuguacgacacccuaaccaucacgcaagccguaauuuucugcaacaccaaaagaaaggucgauugguugacugaaaagaugcgagaaaacaacuucaccgugagcuccaugcacggagacaugccccagaaggagcgcgacaacauuaugaaagaauucagaucgggccaaagcagaguuuugaucacuacugacguaugggccagagguaucgacguacaacaa

SEQ ID NO: 4092 - RNA, 655 nt, Phyllotreta armoraciae
uacuguggaagauaccgaguugaucgaggguaucguuuucucgcagaaaucugccaacguaucuggcccgaagaaaaucgaaaaagccaagauugguuucauccaauucugcauuuccccuccuaaaaccgauauggaccacaacgugaucguaucugauuacgcugcgauggaucgaguuuugaaggaagaacgagcuuauaucuugaauauuguuaaacagauuaagaaagccgguuguaacguacuucugguucagaaaucgauucuccgagaugcuguauccgaucuggcccuucacuuuuuggauaaaauaaagugcauggucaucaaggaugucgaacgagaagacguugaauuugugugcaaaucguuggguuguagaccgaucgcaucucucgaucauuucaccgcagagaauuuaguaacagccgauuuggucgaagaaguuggacuaggcgguaaccgaauggugaaaaucacggguauucaaaaugcggggcguacugucacccugcucguaagaggcucgaauaaacuaguauuagaagaggccgaaaggucucugcaugacgcucuuugugucauucggugucuuguucgcaagaaggcguugaucgcagguggcggagcacccgaaauugaaguugcucuc

SEQ ID NO: 4093 - RNA, 692 nt, Phyllotreta armoraciae
gaaauuacagcagacguuggaguuuuuggaaguucaggaagaauacaucaaagacgagcagaggaauuugaaaaaggaguacuugcacgcccaagaagaagucaaacguauucagucaguacccuugguuaucgggcaauucuuagaagcaguugaucagaauaccggcauuguuggaucaacuacagguucuaauuauuacguucgcauucucucuacaaucgauagggaauuauugaagcccucagcuaguguagcccuacacaagcacagcaaugcucugguggauguguuaccccccgaagcagauuccucgauuagcaugcuucaggccgaugagaaaccagauguacaauacagcgauaucggagguauggauaugcaaaagcaggagauacgagaggcuguagaacuuccguugacccacuucgagcuguacaaacaaaucgguauagacccuccgagagguguguugauguacgguccgcccgguugcggcaagaccauguuagccaaagcuguagcucaucacaccacagccgcuuuuauucgaguggucgguucggaauucgugcagaaguaccugggcgaagggcccaggauggugagagacguguuccguuuggccaaggagaauuccccugccaucauauucaucgacgaaaucgaugcuauagccacuaaacgguucg

SEQ ID NO: 4094 - RNA, 340 nt, Phyllotreta armoraciae
cggugaccauaaaaaccauguuggaggaccucggcauggacgaggaagaggaagagguaguaccguugcccaacguaaacucagcaauucuacggaaggucauccaaugggccaccuaccacaaggacgacccgccgccgccugaagacgacgacaacaaggagaagagaacggacgacauauccucgugggacgcggauuuccugaaagucgaccaagggacccuguuugagcugauccuggccgcaaacuaucucgauaucaaagggcugcucgauguaacuugcaagacuguagccaacaugauaaaaggcaaagcaccggaggagauacggaaaac

SEQ ID NO: 4095 - RNA, 687 nt, Phyllotreta armoraciae
ugugugauaaggcgaaagaaauacuguccaaagaaucaaaugugcaggagguaaaaugcccugucaccguuugcggagauguacauggacaauuucacgaucugauggaauuauuuaggauaggcggccgaaguccagauacgaauuaccuuuuuaugggugacuaugucgaucguggauauuauuccgucgagacuguuacucuuuugguggcuuugaaagucagguauaaagaaagaauuacaauucugagaggaaaccacgaaucgagacaaaucacucaaguauauggauucuacgacgagugccuacggaaauacggaaacgcgaacguuuggaaauucuucaccgauuuguucgauuaucugccgcuuacagcgcucgucgauagucaaauauucuguuugcacggaggucucagucccagcaucgacaccuuggaccauauuagagcgcuagaucguuuacaagagguaccucaugaagguccgaugugcgaucuucucuggucggaucccgacgaucgcggagguuggggcauuucuccucgcggugccgguuauacuuucggacaggauauaucggaaacguucaaccacagcaacgguuugacauuggucucucgagcccaucagcucgucauggagggguacaauuggugccacgacagaaacgucgugacuaucu

SEQ ID NO: 4096 - RNA, 740 nt, Phyllotreta armoraciae
guaagcaauuggaagauggccguacucuuuccgacuacaacauccagaaggaaucuacucuucacuugguuuugagacuucguggugguaugcagaucuucguaaaaacucuuaccggcaagaccauuacucuugaagucgaaccaucagacaccauugagaacgucaaagccaagauucaggacaaggaagguaucccaccagaccagcagagauugaucuucgcuggaaaacaacuugaggauggccguacucuuucugacuacaacauucagaaagaaucuacucuucacuugguuuugagacuucgugguggaaugcagaucuucgugaaaacucucaccgguaagaccaucacucuugaagucgagccaucagacacaauugagaauguuaaggcuaaaauucaggacaaagaagguaucccaccagaccagcagagauugaucuucgcuggaaaacaacuagaagauggccguacucuuucugacuauaacauccaaaaggaaucuacucuucacuugguuuugagacuucgugguggaaugcaaaucuucguaaaaacucuuaccggcaagaccauuacucuugaagucgaaccaucagacaccauugagaaugucaaagcuaaaauucaggacaaggaagguaucccaccagaccagcagagauugaucuucgccggaaaacaacuagaagauggccguacucuuucugauuacaacauccagaaggaaucc

SEQ ID NO: 4097 - RNA, 718 nt, Phyllotreta armoraciae
gaagcaacugaaguccuacaucgaagaaggcgugcacccgaggaucaucaucaaagccguacgaaaggcaacgcagauuugcuuggagaaaaucaacucccuggccguuaaaaucgacaaaacgaacgccgaugacuacagaucgcuguuggagaagugcgccgcgacggcgaugagcucgaaauugaucaacaaacagaaaucguucuucuccaaaaugguggucgaugcugucuuacugcucgaugaacuucuaccguugaacaugaucggcaucaagaaggugcaaggcggugguuuggaggaguccauguuagucgccggaguggccuuuaagaaaaccuucucguaugccggguucgaaaugcagcccaagauuuacaaagacugcaagaucgcucuguugaauauagaauuagagcugaaagcugagagagacaacgccgagauccgucugagcagcgucaaggaguaccagaaaguugucgaugccgaguggaacauuuuguacaacaaacuccagaaaauuuacgaauccggagccaacguuguucugucgaaauuaccuaucggcgacguugcuacgcaauacuucgccgacagagacauguucugcgcuggaaggguccaagaagaagauaugaagaggaccuugaaagcaugcgguggcuccguaaugaccacagucaacgauuuaaaagacgaugugcuagguaac

SEQ ID NO: 4098 - RNA, 752 nt, Phyllotreta armoraciae
aaagaugaugacaacguccagccucccgaaggggaagaagaaaaagaacccguuacauacuauauuagcaaugaagugcacuauucaaauucaaaaauguccaguuuggugugcaucaagagagguccggugauagaagcagauaaaaguauucgagcucagguucguuugaugaacuucagcgaggggucgccauaugaaauucugcaugauuaugucagcagaacgguugccccuuacuucaaaucuuacguaaaagagucugguagagcugaucgugauggugauaaaauggcgccugcaguugaaaaaacaaucgcugaauuggaaaugggacugcugcauuuacaacaaaauauagauauuccggaaauuacgcuucaagugcacccguacguugccagucuuauaaagcaaugcgccgaugaaggaaggaagccgaaagucgccgauuuuagugacaaaguggacgacucgaacuuucuuaaccaacuucaacauggaguuaaucguuggaucaaagaaauucaaaaaguaacaaaauuagacagagaccccucuucuggcacagcucuucaagaaauuagcuuuuggcucaaucuggaaagggcccuucaccgcauccaagaaaaacgcgaaagcauggaagucgcucuaacauuagacauucugaagcacgguaaacguuuucacgccacagugucuuucgauaccgauacaggcuuaaaacaagccauagcuacaguuaacga

SEQ ID NO: 4099 - RNA, 698 nt, Phyllotreta armoraciae
gacgaugaguacuuguucgaggaggaaauauuaacggagagggaaaagaaggaacgccagcauaaaaaggaauuauugcaacuagcccaggaacaugaaaaggcacgggaacucgaacgaauacaacgcuaucacaugccgagggacuuggguaaggacucgacggcagauuacaucgaaguggacgagcucgagaaaguaccgcaauccgaacagaagaaaugggaaaaagaccaaauggccucagcugucuucaaauuuggugcuaaagaugucaagaaaaccgacgauuacgaacuguuacuggaagaucaaaucgauuucauacaagcucugcaaaugccgggauccaccgagaagaaagucucgcaacuauccgauguacaaaagaagaaacuaaccaucgaggaaacaaagaaaagccugccgauuuauccauucaaagaugauuuaauacaagccguuaaagaguaccaaguguugauuauaaaaggugaaaccgguucgggaaaaaccacgcaaauaccccaguaucuccacgaagcugguuucacagcugacgguaagaaaaucgguuguacacagccucggagagucgcugccaugucgguagcagccagaguagcccaagaaauggacguaaagcuaggcaacgaagucgguuacgcuaucagauucgaagauugcacuuccgaaag

SEQ ID NO: 4100 - RNA, 731 nt, Phyllotreta armoraciae
ggaagugggagaugucauuuacaucgaagccaccaguggggcuguuaaaagacaaggaagaucugaugcuuacgcuacagaauucgauuuggaagccgaagaauaugugccgcuuccuaagggagaugugcacaagaagaaggaaguuguacaggauguuacuuuacacgauuuggacgcugcuaaugcaaaaccacaggguggucaagacguguuguccaugauggggcaacuguuaaaaccaaagaaaacugaaauuacagacaaacucagaaaagaaauaaacaaaaucguugacaaauacauugaucaaggcauugcggaauugguaccaggaguauuauucauugacgaaguucauauguuggauauagaaacguucacuuaucuccauagagcuuuggaaagcgcuauagccccuauuguuauuuuugcuacuaauagaggucguugucucauuagaggaaccgaugauguauuuucuccacauggaauuccauuagaucuucuagauagacugcugauuauacgcaaaauuccuuacaacaaauccgaaauggagcaaauuauuaaauugcgagcuguuacagaagguuuggaaauugagcaggaagcaaucucgaguuugggagaagucgggacaaaagccacccugagauaugcaguucagcuuuuaacgccgucguuuuuaacugcuaaaauuaacggaagggguaacauucucaaaagcg

SEQ ID NO: 4101 - RNA, 775 nt, Phyllotreta armoraciae
cgaaggagcaagaaacaaucccuuccaguucaaauauuugcagcuaugccacaguuuaggggaguugagcaaagugcccaguccgaaggugguacuggcuaguucgccugauuuggagagcggauuuuccagggaacuguuuuuacagugguguucuaauccaaauaacaguauuauauuaacuacaaggaccucgccugggacuuuagccagggauuuaauugacaacggaggaggaagaaacauagacuugauaguagagcgaaggguuaaauuagaaggacaagagcuugaugauuaugaaagucgucaacggucuaaauaugacaaauuagaagaugaggaagccgauuccgauucagauuccgauauugaaauguuagucacaacuaaaggcaaacaugacauuguuaucaaacaagaaggcaaaauauccacaggauuuuuuaaagugacaaaaaaaauguacccgauguauccuuucaaggaagauaaaauaaaauccgaugaauauggcgaaauaauaaaagcagaagauuacaaacuagcugaaauuucagccgaagccgaagauaauaaagaaaacauagugauuaaaaaagaggaagaggaaauaaguaaauauuauucauuuauaaacgaucuaauaguuacgcaugaaucauuuuuagcugaaauuaccgagcaaccgaccaaauguauaauucuucaaagaaccguucaagugaguugucaaguucaguacaucgauuucgaagguagaucagacggagaa

SEQ ID NO: 4102 - RNA, 743 nt, Phyllotreta armoraciae
ugguaaaacuucgaguucgucuucgcucauucaaccgccuuugccgcccauacccgauaaagugcucguuaaaaaauacgauccuaaacaagcugucaaaguguccagaccgacaguaggcgacgauuaucuaguaucaccaaucacaggcgagaagauaccggccagcaaaguacaagagcacaugcgcauaggccucuuggacccaagaugggucgaacaacgugacaaacaaauguccgauaagaugaaucaagacacgguauaugcugcaggaagcgccaucgacgcuucguugaaauuacuagccgaaagacguacggacauuuuuggugugggagacgaagaaacggcaauugguaagaaaauaggcgaagaggacgugagaaaagacgaaaaagugacgugggacggucacaccagcagcguggaggcggcgacgagggcggcucgcgccaauaucaccuuagaagagcaaauacaucagauacauaagguaaaaggucuucuaccugacgaggagaaggagaagaucgguccgaagaauauugguucgaagaaaauuaacauacaaaguguuauuacuaccaaaccgccuaauccgucuucacagcaacccaaacaacagguuucuaugauucaaacgggcgcacagccaaucaugccgguuccaacgcaaccuacgaugcucgcgccccaaccgucuauuaugaugaugcccgccccuccuaugccuaacauuc

SEQ ID NO: 4103 - RNA, 672 nt, Phyllotreta armoraciae
aguggaccauuucaaucgaauggggaaaaucggcaaucaaaagcgcguugucgguguucuacucgguugcuggagggcuaaaggagucuuagauguguccaacaguuuugcagucccuuucgaugaggacgacaaagauaaaucuguaugguuuuuggaccacgacuacuuggaaaacauguacggcauguuuaagaaagucaaugcuagagaacgcgucguugguugguaccacacgggcccuaaauuacaccagaaugauaucgcuauuaacgaauuaauucgaagauacugucccaauuccgugcuggugauuauagaugcgaaaccuaaagauuuggggcuuccuaccgaagcuuaccaagcgguagaagaaguccacgaugauggcucucccacgucaaaaacauuugaacaugucccgagcgaaauaggcgcagaagaagcugaagaagucggaguggaacauuuacugagagauaucaaagacacuacagugggaacuuugucucagaggaucacuaaucaguuauuaggccuuaaaggguugcauuugcaauugagagauauuagagacuauuugaugcaagugugcgauaacaaacugcccaucaaucaucagaucaucuaucaauugcaagauauuuucaauuuguugcccgauauaaacca

SEQ ID NO: 4104 - RNA, 742 nt, Phyllotreta armoraciae
agaucgaaacgacaaaaacgccguagccgaagugguuaaagguugcauaggaacgaaauucuugagcaaauggucggauuuggccguaaauaucgcuuuagaugcggugaauaccguccuauuagaagagaauggucgaacggagguggauaucaagagauaugccaaagucgaaaagauuccuggugguucuguggaggaauccaaaauuuugagaggcguaauguugaacaaagacguuacccauccuaaaaugaagcgacacauuaagaauccgagaaucauccuuuuggauugcgcuuuggaauacaagaaaggagaaucucaaaccaacguugaaauuaguaccgaaacugauuuuaccaaacuucuugaauuggaagaagaucaugugaaacgccaaugcgacgagauuaucgcccucaagccggacguaguguucacagaaaagggaguauccgauauagcccagcauuuccugcucaaggccggcaucacugccaucaggcgugucagaaagucugacaacaaccgaaucgcuagagcuuguggagccgucauuguaaacagaaccgaggaacuccaggaguccgacgugggcaccggagcugguguauuugaaaucaaaaaaaucggcgacgaguacuucuguuuugucgacgaaugcaaagauccaaaggccuguacaauccuccuccgaggagccagcaaggauauucugaacgaaaucgagaggaaucug

SEQ ID NO: 4105 - RNA, 558 nt, Phyllotreta armoraciae
cguugaacgccagauuaauccguacgcugacaauggaggaagugucguagcaauugcaggaaaagauuucgugguuauuggugcagauacucgucuuaguuccggcuuuuccauuuacacuagaaaccaaaacaagcuguuuccucuuuccgaaacgacuguuuuaggauguucagguuguuggugcgauacuuuaacguugacucguauuuuaaagucucguaugcaaauguaccaucaagagcauaacaagaacaugucuacaacagcggcugcucaaauguugucgaccauguuguacuacaagcgauuuuucccuuauuacauaucgaacauucucguuggauuagauaaugagggaaaagguugcgucuacagcuacgaucccguugggcauugugaaaaagccacauacagagcaggugguucugcgggggcuuugcuucagccuuuguuggacaaucaaauugggcaaaaaaaucugcagaagccuucgcaagaagaucuuacucaggaaaaggccauuucuacacugaaagauguuuucauauccgcugc

SEQ ID NO: 4106 - RNA, 681 nt, Phyllotreta armoraciae
ucgaacguggaggaaaaauaaucaugccaccuucagcacuggaacagcucacucgauuaaacaucaacuaccccauguuauuuaaacuaguuaauaagaagacgagccgcacgacucauugcggcguguuggaguucguagcggacgaaggaaaagucuaccuuccauuauggaugaugcacaauuuaguacuauccgaaggcgauuugguucaaauggaaagcgucucgcugccggugggcacuuucucgaaauuccaaccguugaauccggauuuccucgacauaaccaauccgaaagccgugcuggagaauugccugcggucuuucgcuugucugaccaccggcgaugucauagcggugagguauaaucaaaaggcguacgaauugugcguguuggaaaccaaaccgggaaacgccaucagcauaaucgaaugcgacaugaacguugaauucgccgcuccgguuggcuacaaggagcccgaacaugcgaaaaaagaagaagaaaugucgguggaucccgcugauuugaugcccgaaccgucgggauucgucgcauuucggggggccgguaaccgauuggacgggaaaaaacgcaaggauucuuccuccagcgaugcuccuucguccaaaccggccuacguccggggaauucccgauuacgauuaucaaauaggcacgc

SEQ ID NO: 4107 - RNA, 727 nt, Phyllotreta armoraciae
gaaauaggggacggaacuaccgguguaguaguauuagcaggggcucuucuggaacaagcuggcgcucuucuggaccgcggaauccauccgauaagaauagccgaugguuucgaauuggcaugccaaacagcuguggaucaucuagagaaaaucgccgaacuguuuccaguguccgcugaaaacaccgagccccuuauuaaagucgcgaugacuacauuagguucgaagauaauuaacaaaugucacaggcaaauggccgaaaucgccguaaauggcguguuagcaguagcugaucucgaacaaaaggaugucaacuuugaacucauuaaaguagaaggaaagguuggagggaaauuggaagacaccacauuagugaaaggugucguuauagauaaaacaaugucucauccucaaaugccgaaggagcuaaagaauguuaaauuggccauccucaccugcccguuugaaccccccaaacccaagaccaagcauaaguuggaugucaccagcguagaagacuacaaagaacuaagauuguacgagcaagagaaauucaaggaaauuguuggcuugguaaaaaaagcaggagcuaccuuggcuauuugccaauggggauucgacgaugaagccaaccauuugcuguugcagcaggaguuaccugcuauuagauggguuggagguccugagauagagcuaauagccauugcgaccggaggaagaauaguuc

SEQ ID NO: 4108 - RNA, 208 nt, Phyllotreta armoraciae
gugaaaaaguggaaugcuguagcacuuugggcuugggauauuguuguugauaacugugcuauaugccgaaaccacauaauggacuugugcaucgagugccaggcaaaucaggccucugcaacuagugaagaaugcacuguagcuuggggaguaugcaaccacgcuuuucacuuucacuguauuucaagaugguuaaaaacuaggcagg

SEQ ID NO: 4109 - RNA, 800 nt, Phyllotreta armoraciae
accuugagcucgaaaauucuaucgcaacacaaagagcauuucgcgaagcucgccgucgacgcggugcugagauuaaagggguccggcgacuuacaagccauccaauugaucaaaaaaaccggcgggacccugcaggaauccuuccucgacgaagguuuucugcucgacaagagacccggcgugcaccagcccaagcgagucgagaacgccaaaauccugaucgccaacacuccgauggacaccgauaaaaucaaaguguuuggcucgcacaucaaagucgauucgauggccaaaaucgccgagcuggaaucggccgaaaaggauaaaaugaaagacaaggucaacaaaauccucaagcacaacgccaacgucuucaucaaccggcaacucauuuacaacuaucccgaacaguuguucgccgacgccggagugauggccauugagcacgccgauuucgaugguaucgaaagacuggcgcuggucaccggaggagaaauagucucaacuuucgaucaccccgagcuggugaaacuugguacuugcgaccucaucgagcaagugaugauaggagaagacacucuccugcguuucagcgguguggccuuaggagaagcuugcacgauagucauccgaggagccacccagcagaucauagaugaagcugaucgaucccugcacgaugcccuuugcguguuagccgcaacuguaaaagagagcaggaucguguucggaggcgguugcagcgagacuuuaauggcuacugcuguggcuagagcgucuguuaacacagcugguaagga

SEQ ID NO: 4110 - RNA, 671 nt, Phyllotreta armoraciae
aaggacgucuucaucaagucgaauaugcaauggaagcgguuaaucuugguucggcaacaguaggacuaaaaagcaacagucaugcuguuagaauagcauugaaaagagcuucaucugaauuaucugcuuaccaaaagaagauaauucaaaucgaugaucacauuggcauuacuauaucuggucuuacagcugaugcaagaauuuuaagcagauauaugagaaacgaauguuugaauuacaaguacuccuuagacgcuuacaugccuuugaauagauuaauuaauauuuuagguaucaaaaugcagcauuguacgcaaagauacgaucguagaccguuugguguaggucucuugcuagccgguuacgaugacaacggcgcccauauuuaccaaacauguacgucugcuaauuucuacaauugcaaggccaugucgaucggagcucgaucucaaagcgcuagaacuuauuuggaaaagaaacucgacgaguuaccuucgaguucuuuagaagauuugaucaaacacgguuugagagcucucagagauacucuuccaccggaagucgauuugaauacgaagaacgucuccauaggauacgucgguaaagggauuaccuuuaaaauuuuggaagaagaagaaacugcuccuuaucuugcuuuaaucgagggugaa

SEQ ID NO: 4111 - RNA, 728 nt, Phyllotreta armoraciae
guuacgguggcaguaaauuggaacgagcgcgugaucuauucgagcagugcuuggacgguugucccucgcaauucgccaaacaucucuauuuauuauacgcuaaguuggaagaggagcacggaauggccaggcaugcaauggccguguacgaaagggccacuaaagccguaccggaaaacgagauguucgacauuuuuaacauauacauaaaaagagccgcugaaauauauggcauaccgaaaacgaggcaaaucuacgagaaggccauugaaguccuuccggaggauaaaaccagggaaaugugcuugagauucgccgacauggaaacgaaauuaggugaaaucgaucgagccagggccauuuacgcgcauugcagccaaaucugcgauccccgagucacggccgaguucuggcaaauuuggaaggaguucgaaguucgacacgguaacgaggacacgaugagggaaauguugaggauuaaacgcagcguucaggcgguguacaacacucaggugaauaugaugucagcucagauguugagcucggcgggcagcucgagcggcaccauagcagacuuagcgccugggguuaaagacggaaugaggcuuuuggaggcaaaagcggccgagauggcgggcucggcggcggcgcagaaauccaacauaauguucguuagaggggaaacucaaggggacaauaaagacaaaguggucaaucccgaugaaauu

SEQ ID NO: 4112 - RNA, 705 nt, Phyllotreta armoraciae
auguacacaugcccaaagaucgcgucaccaugaugcaccagggcuacgguuuugucgaauucaugggcgaagaggacgccgauuacgcuauaaagauaaugaauaugauaaaauuguaugggaaaccuauaagagucaacaaagcuucugcucaucaaaagaauuuggacguaggagcgaacauuuucauagggaacuuggacccggaggucgacgagaaacucuuguacgauaccuuuucggccuucgguguaauauuacaaacgcccaagauaaugagagauccugagacuggaaauuccaaaggcuuugcguuuauaaacuuugccagcuucgaagcuuccgacgcuuccaucgaggccaugaacggccaguaucuuugcaaucgaccgauaucuguguccuaugcauucaaaaaggauuccaagggcgagagacacgguucggcggccgagcgauuguuagccgcccagaauccgcuaucgcaggccgacaggccucaucaguuguucgcagaugcuccaccaauaggaaugaugccgaugaguauggcgccgcccccuccgccucuaaucaccggcaugaugcccccuccaccaccaacgccgggcggcaugccaccucccccuccgccagucccuccaccgagcuccuuccccgcggguauaccgccgccgcccuuaccgccuucucagccaccuuuac

SEQ ID NO: 4113 - RNA, 658 nt, Phyllotreta armoraciae
uaaaaggaggaaaggagcacccaagcuccguuauuuagauuucuccgaaaggcauggcuacaucaaggguguagugaaagacaucauccacgaccccggucgcggcgcccccuuggcuuuaguucacuucagggacccuuacaaguuccaaacuaggaaggaaauauucauugcucccgagggaauguacacaggacaauuuuuguacuguggaaagaaagcuaaccuccaaauuggaaauguguugccuguaggaacuaugcccgaggguacaauugucuguaauuuggaagaaaaaacuggugaccguggccgauuggcucgagcaucugguaacuacgcaaccgugauugcccacaaucacgauacaaagaaaacuagaguuaaauugccaucgggagcuaaaaaaguuaucccaagcaacaacagagcuaugguugguauuguugccggagguggucguaucgacaagcccauccugaaagccggucgugccuaccacaaguacaaggugaagcguaacugcuggccgaaggugcgugguguugccaugaaccccgucgagcauccucacggaggugguaaccaccagcacauugguaaagcuuccaccgucaagaggggaacuuccgcuggucgcaaggucggucuuauugcu

SEQ ID NO: 4114 - RNA, 264 nt, Phyllotreta armoraciae
gaaaacaguuagcugccaaagccgcucgaaagucugcaccuucaacuggugguguuaagaagccucaccgauaccgcccugguacuguugcccuuagagaaaucagacgguaucagaaaucuaccgaacuacuuauccgaaaacuuccauuucaacgauugguucgagagaucgcccaagacuuuaagacugaucuaagauuucaaucaucagcuguuauggcacuccaggaaucugcugaagcuuaccuagucggguuguuug

SEQ ID NO: 4115 - RNA, 795 nt, Phyllotreta armoraciae
augguugagcucauggaaaugcagcacaaaacggagaccgacacccaacuggucaaagguuuagugcuugaucacggcggucgucaccccgauaugccgaagagcuugaagaauuguuacauccucaccuguaacgucagcauggaguacgaaaagagugaagucaauucagguuucuucuacaaaaccgcugaagagagggagaaauugguguuggccgaaagagauuuuaucgaacagcgaguuaagaaaguggucgaguugaagaaggcucuuugcaaagacacaaacaagacguuuguugucauaaaccaaaaagguauugaccccaugagcuuggacaugcucgccaaagaggggaucauugcucuccgaagggcuaagaggcguaacauggaacguuuggcguuagcuugugguggaacggcugugaacaguuucgacgauuuacaagaaucucaccuugguuaugccgggcauguuuacgaacacguccugggcgaaaacaaauauaccuuuguagaagaaugcaaagugccucaaucuguaacgauuuuaaugaaaggacccaacaagcacacuuuguuacagaucaaagacgcuguuagagauggcuugagagcuauuaauaacgccaucgaagacaaagcccuuauuccgggugguggugcuuuggaaguggcaguaaacaaggaauuacuggcguacaaggacgaaauaaagggaaaagcucgcuugggcguagccgcuuacgcugaagcucuguugguuauuccgaaaacucuggcuguaaac

SEQ ID NO: 4116 - RNA, 692 nt, Phyllotreta armoraciae
aggauuacgacgauugucuggccugggcgcgucuacauugggaggaccaauacgccaaucagauaaagcaacuguuguuuaauuucccgccggaucaacucaccagcaccggccagcuguucuggucuggaccgaagaggugucccgaaccgcucguauucgauaucaaugaagauuugcacguggauuacguaauagcugcggcuaauuugaaagcucaaguuuacggcaucccuacgaauagaaacagauguuaugccaaacaaguagucaccagcauugagguaccuccguuugugcccaaaucgggcgugaaaaucgccgugacggauucccaaauggccaugaacgguaacaacgucgacuuggaucguaucaaucaaaucaaacaggagcuacccucgauggaagagcucaacggccugacgcucacaccacuggaauucgaaaaggaugacgacaguaauuuccauauggacuucaucgucgcggccucgaacuugagagccgccaacuacaagauuccacuggccgaucgacacaaaucuaaacucauagcugguaaaauuauaccggcuauagcgacuacuacgucagugguagcuggucugguuuguuuggaauuguacaaacuggccaggaguaucaagaguuuaacgccguuuaaaaacgguuucguaaaucuggccuug

SEQ ID NO: 4117 - RNA, 786 nt, Phyllotreta armoraciae
auggguaaaacagcgguauuuguacuagccacccuacaacagcuagaacccaccgaaaaugucguuuacguacucguaaugugccauacgcgcgaauuggccuuccaaaucagcaaggaauacgaacguuucagcaaguacauguccaacaucaaagucggcguguucuucggaggcuugcccauccaaaaagacgaagaaguauuaaaaaacagcuguccgcacaucgucgucggaacgcccggucgaaucuuggcucucgucagaucgaagaaacucaaucucaagcacauaaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaagcgaaauugacguuacacggucuacaacaacauuauguuaagcuuaaagagaacgaaaagaauaaaaaauuauuugaguuacuugauguauuggaguuuaaucagguggugauauuuguaaaaucggugcaaagaugcguagcauuagcacaacuuuugacggaacaaaauuuucccgcgauuggaauacaccgaggaauggagcaaaaggaacgauuauccagauacgaacaauucaaagauuuccaaaagagaauauuaguggccacuaaucucuuuggucgugguauggauaucgag

SEQ ID NO: 4118 - RNA, 700 nt, Phyllotreta armoraciae
gcuugacacuacccaaacuaaagcuagaccggccaccaagucgcccguagcagaaaucgauaccuacaucaacuugcucugcuuagugcauuuaaucgacaccaacaaauuaguagaagccgaacgcuguucgcaaauccucaugaacaagaucaccagucaaaacagacgaacauuggaccuaaucgcagcgaaauguuacuuuuauuacuccagaguagcagagcucaccgacaagcuggacucgaucaggagauuccugcacucccgucuucgcacggccacgcucaggaacgauuucgaaggacaagccguacuaaucaacuguuuauuaaggaacuacuuacacuauucccuguaugaucaagcagauaaguugguuaauaaaugcguguuuccugagacugccagcaacaacgaaugggcgagauuuuuguacuacuuggggaggaucaaagcggcucgguuggaguacagcguggcgcauaagcaucuaauacaagcgaugcguaaagcgccucagaauacugcgaucgguuuucggcaaacuguucagaagcugacggucguagucgaauugcuguugggggauauaccggagagacaaauauuccggcaggcgagcaugcggcauucucuugcgcccuauuuccagcucacgcaggccgugagaaugggaaacuugcauagguuuggagag

SEQ ID NO: 4119 - RNA, 729 nt, Phyllotreta armoraciae
cggcaauuaaaauccgacaaauugaacgcaaacgaagaguccgaagacgaagaaaaagacgaggauaaauacgucgaugaaguggacaugcccggcacgaaagucgacaguaaacaaagaauaacggucaggaauuugcguauacgagaagauacggcuaaauacuugagaaauuuggauccgaacucggcguacuaugaccccaaaaccagaucgaugagggaagauccgaaccccgggaacgacgcuacauaccauggggaaaauuucguucgcuuuuccggcgacacuacaaaucacgccagagcgcagcuguucgcuugggaagcacacgguaaaggaguggacguucauuuacuagcagaacccacgaaauuggaauuacugaagaaagaauacgagaaaaagaaggaugaggugaagucgaauauucaggguacaguuuuagagaaauacggaggugaggaauaucuugaagcgccaccaaagaguuuguuguuggcucaaacugaaaacuacguugaauauucgagaucggguaagauuauuaaaggagcagaaaaagaaguuauuaaaucaaaguacgaggaagauguuuauauuaauaaucauacgucaguauggggcucuuacuggcgcggaggacaaugggguuaucgauguugucauuccuuuauuaagaauucuuauuguuugggcgaagcaggaaaaucaguaaacgcucaaccu

SEQ ID NO: 4120 - RNA, 477 nt, Phyllotreta armoraciae
ggcuaacacgaaacuaggaaccagaaggauccauuauguucguacaaggggaggcaacuugaaguaccgugcccuaagauuagacaccggaaacuuuucuugggguagcgaaggaacugcccgucaaacacguauuaucgaugucguuuacaacgcuaguaauaacgaauugguucguaccaagacguugguaaagaaugcuauuguuguuauugacgccaccccauucagacaaugguacgaaagucacuacaucuuaccauugggacgcaagaagggugccaaaaugacgccugaggaggaggagauuuucaauaaaaaacguagcaaaaaaguacagaagaaguacgaaacuaggcaaaaaaccgcuaaaguagaaccugcgaucgaagaacaguuccacacuggaagauuguuggcaugccuagcaucaagacccggacaaugcggcagggccgaugguuauguccucgaagg

SEQ ID NO: 4121 - RNA, 727 nt, Phyllotreta armoraciae
acugaaaaugcucaaacacggcagggccggcgugcccauggaagucaugggacucauguuaggugaauucgucgacgauuacacggugagagugauagacguguuugcuaugccccaaacgggcacaggagugagcguagaagccguagauccgguuuuucaagcgaaaauguuggauauguuaaggcagaccggcaggcccgaaaugguugucgguugguaccauucccauccggguuucggcuguugguuguccggcgucgauaucaacacucaacagagcuuugaggcccuuucugagcgagccguggccguagucguggaucccauucaaucggucaaaggaaaaguugucaucgaugccuuuagguuaaucaaucccaacaugaugguguugggucaggaaccccgucagacgacuucgaauuugggucauuugcagaagccuuccguacaagcgcugauacacgguuuaaaucgccauuacuacucuauaagcauuaauuauaggaagaacgaguuggagcaaaagaugcugcugaauuugcacaagaaauccuggauggacgggcucacuuuggccgauuacucggagaauugcagugugaacgagaaaaccguagccgauaugcuggaauuggcuaaaaauuacaacaaagcuuuggaggaagaggagaaaaugacgccugaacaacuggcuaucaagaauguugguaaacaggauccc

SEQ ID NO: 4122 - RNA, 760 nt, Phyllotreta armoraciae
uggucaaacccauggauaagaagaaaguacuugugaaaguccauccagagggaaaauuuguuguugauauugacaaaaauaucgacauuaaugacguuacaccaaauuguagagucgcucuucgaaaugaaucguacacuuugcauaagauuuuaccgaauaagguggauccuuuaguaucccucaugaugguugaaaaaguuccagauuccacuuacgaaauggucggugguuuggacaagcaaaucaaagagaucaaagaggugauugaauugcccguaaaacaucccgagcucuuugaugcauuggguauugcucagcccaaggguguguuguuguauggaccgccaggaacugguaaaacucuuuuggcuagagccguagcucaccacacugaauguacguuuauuagaguaucuggaucagaguugguacaaaaauucaucggggaagguuccaggaugguaagggagcuguucguaauggcuagggagcacgccccuucaaucauuuucauggaugaaaucgauucaauuggauccucucguaucgaaucagguucugguggugauuccgaaguucaaagaacuauguuggaguugcugaaucaacucgauggauuugaagcuacgaagaacauuaaagugauaauggcuacaaacagaaucgacauuuuggaucccgcuuugcugaggccagguagaauugacaggaaaaucgaguucccuccaccgaacgaggaagcccgauuggauauucu

SEQ ID NO: 4123 - RNA, 450 nt, Phyllotreta armoraciae
gucugcuuucgauuugcaaagcuucaguuucuuccaaagagggucuauacaggaauucaugucauucuuuuguaagacuauuguggaaaggacuauaccaucaucgagacaauccgucaaagaaggagaauauaugugccauguuuauguaagacaugauaacuuagcugguguugugauaucagaucacgaauauccgucuagggugucgcauacgcugauuacgaaaauuuuggacgaauuugccgcuaaaauaccugcuguuaauuggccuaccuugcaagagaaggauguaacguuuccgcugcuaaauacauaccuugccaaauaccaaaaccccaaggaagccgaugcaaugacuaaaauacaagaggaccuugacgaaaccaagauuauucugcauaauacgauucaagcuguccuggaaagaggcgaaaaauuggaugacuu

SEQ ID NO: 4124 - RNA, 604 nt, Phyllotreta armoraciae
uggaauaugccauugaagcuauuaaauugggauccacagcuaucggaauaugcaccagcgaaggggucgugcuagcagucgaaaagcguauuacuucuccauuaauggagccuacaacgauugaaaagaucguagaaguagauaaacacaucggcugugcuguuucggggcucauggcagauucacgcacaaugaucgauagggcaagaguagaaugccaaaaucauugguuuguuuacaaugaaaacaucacuaucgaaucaugugcucagggaguaucgaacuuagcuauucaauucggagauucggacgaugauggugcugcuaugucgaggccauuugguguggccauuuuguuugcuggcauagacgaaaaagggccucaacuuuaccacauggauccuucagguacauuuguucaguucgaugcgaaagcuauaggaucugguucagagggcgcacagcaaagcuuacaagaaguauaucaccguagcaugacuuuagaggaagcuaccacagcagcauugacuauucucaagcagguuauggaggagaaauugaacucguccaauguagaagucaugacaaugacgccaaaggauau

SEQ ID NO: 4125 - RNA, 745 nt, Phyllotreta armoraciae
caauuaguugggcuauccgacgauuugggaaagcuggaugguuucguggagcagguuacucggaagguggcucaguaccucggcgagguucuugaagaccagagggacaaguugcaggagaauuugcaggcgaacaacaccgauuugccaaguuauuuaaccagauuccaaugggacaucgccaaauaccccaucaagcaaucgcuccgcaacaucgcugauauaaucagcaagcaaguuggacaaaucgaugccgaucuuaagaccaaguccucagcguacaauaauuuaaaagggagucuucaaaauuuggagaaaaagcaaacagggaguuugcuaacccguaacuuggcagaucuggucaagaaggagcacuuuauuuuagauucugaguacuugcaaacguugcucgucaucguucccaaaucucaguuuaaugaguggaacgccacuuacgaaaaaaucacggacaugaucgucccucgaucgucggagcuuaucauucaggaccacgacuacggcuuguucaccgugucgcucuuuaagaaagucgucgaggaguuuaagcugcacgccagagagaagaaguuuaucgugcgagauuucacguacaacgaggaggaauuggcggccggcaaaaacgaaaucaccaagcucguuaccgauaagaagaagcaauacgguccguuagugagaugguugaaagugaacuucagcgaaugcuuuugugcuuggauacacguua

SEQ ID NO: 4126 - RNA, 717 nt, Phyllotreta armoraciae
gccgauacauacaagaccauuugacuauaccaguagaggaauugggcaaggaauccaucguaaacgucgccaagacuucgaugagcuccaaaauuaucggagcugaugcugauuucuuuucgcaaaugguagucgacgccgcgacagccgugaaaguaacggacuccaaaggcaacucgauguaucccauaaaggcggugaacguguugaaagcgcacggcaaaagcgcccgggagaguuuccugguggccggcuacgccuugaacugcacggucgccagccaggccaugcccaagaagauuuuaaacgccaaaaucgccugucuggauuucucauugcaaaaggccaaaaugaagaugggcgugcaaguucugauuacggaccccaaucaauuggaaggcgugcgcgccagagagcuggacaucaccaaggagcgcauccagaagauccuggcuaccggcgugaacguggugcuucuguccggcggcaucgacgacgucuguuugaaguacuucguggagcgcggcgccauggccgugcggcgcgucaaaaaggccgauuugaaacgcaucgccaaggcuacgggcgccgcuuucgucacgucguugagcaacauggagggcgaggagaccuucgacgccgccauggugggcgaggccgcagaggucguacaggagaggauauccgaugacgaauugaucguuaucaaaggaccga

SEQ ID NO: 4127 - RNA, 639 nt, Phyllotreta armoraciae
ggaaccgaauggaaaccuauaacaaacccaauaacucauacucaaucuccuguaacuacuucaacuucuauugugucuauaacguacgauaaaggaguacuaauagccggagacuugcuggccucuuacgggucuuuagcuagauacaaaaauugcccuaggguaaucgaaaucaauccgaauaucauccuaggagcaggaggagauuacgcugauuuucaauauguuaaaagcuuuaucgagcagaaaauaaucgaugaagauugccuagaugaugguuugaaaaugaaaccgaaaucucuuuauugcuggcugacuaggauuauguaccaacggagaaguaaacucgacccguucuggaacaacuuaguugucggagggauacaggaugguguaccauuccuaggaacagucgauaaacuugguacagcuuacacagauaaaguaauuuguaccgguuacggggcucauauagcccuuccuguccugcgagaugcccucgauaagaaaccaaauuuaaauuuaaacgaagccaagcagcuuauuaaaaaguguauggaaguuuuguucuacagggaugcgaggaguuacccgaaauaucaguuggggaugaucgaugcggaugaaggugugaagauu

SEQ ID NO: 4128 - RNA, 665 nt, Phyllotreta armoraciae
gcagaacaauuuaacggagguguugaugaaggaauuagaaguaaacccggauaaaucgcugcagggcgguuugagagcggcucgcagggcugugagauugcugaaucaauuaggaagggaaacacaaucuuguacgcuguuccuaaaguugugcagcagcaugcuaaggacucagugcaaacgaguuaaaagagaaggcucuacuaccacuuacauaaagcaucuuucgagcgugguuuucaccaauaugugucacaugucugaugaauuucugagagcuuuccccgacucuccagccugcgccucagcguaugugguuugggcgagcaaugaacugcugcaauuuacuacccauuuuauuaagcagguuuucaugccucagacuuccuuaucaacggugaccgaaugcauaguuuuagugagacaacagugugaaaggcuguacguuuacggauuagaccuuuguuaucaauuagacggugcuuugagaucuucccugaugaaagcauugaaagacgcucgagauaaacuaaucgacucgauaaaguugcgaguucuagaugauaaauggauaccuauuaauuugcacagcaaaucggcuuuaagucguugcgugcaagaguauucccaaaugggacucacuaacguuggaaguuacguuucug

SEQ ID NO: 4129 - RNA, 789 nt, Phyllotreta armoraciae
gaagacggugaagcugauauugaaauugaauugguugaagaugagccaccauuuuuacaaggucacgguagagcuguucacgaucuaagccccguaagaauaguaaaaaauccagaugguucgcuagcccaagccgcuaugaugcaaucggcuuuggcaaaggaaagacgcgaacagaaaaugcugcaaagagaacaagaaguggauucgcagccuucuggaaagaacaaaaacuggaucgauccccuuccagaagaggaaucuaaaucgauggcaagaggaauaggucuucaaagucaagauuugcccgaauggaaaaaacacguuaucggcgguaaaaagucaucuuuugguaaaaaaacuaacuuaacgaucgucgagcaaaggcagucucuuccuauuuacaagcucaaagaagaguuacgaaaagccguaacagaaaaucaaauauugaucguuauuggugaaaccggcuccggaaaaacaacacaaaucacccaguauuuagcugaggccggguucacagccagagggaaaauuggaugcacgcagcccagaagaguugcugcaaugucgguggcuaaaagaguggccgaggaguuuggaugcagauugggccaagaaguugguuacaccauuagauucgaagauugcaccagucccgaaacgaugaucaaauacaugacagacgggauguugcuacgugaaugccuuauggauuuggaucuuaaaaauuacucuguaauaauguuggacgaagcucacgaacguacgauucacacugacgua

SEQ ID NO: 4130 - RNA, 786 nt, Phyllotreta armoraciae
augacggucacaaauucucagccaaagaaguuacaagacacgaaacuggaggaaacguagucaugaauuguuguguguuuagugauaggaaaaauucauuuuuaguagcuggucaagaaaacuacucucaacuuuauaaagucaauacgaaauuaaucgagcaugaacaaguagaaacaguuggagacacugcaagcguucggcacagaaauaccaaguccaaagaacacguagauaauaauaaaaacauuaaaaaggagcugguuuuugaccugaauccuuuagauagcauacaaaccgauuuuaaggguucugaaccccuauguagaguaguuagaauuaaucacucgggaaagauauuagcuacuggaggaacugacggcgauguaagacuuuggaaauucccuaugaugcagcccuuguccauucuaaaaggacauacaaaggaaauagacgauauagauuucaguaaauuugauaaccucaucauaacuuuggcaaaagacgguuuggcuauuuugugggacgcccaaacgggaaaauugaaaucaaaauugacauggaaaacuccagagggaucgaaauauuuguacaagaggugcagauuuggcguuaucgaagaccaaaaaaauaagugcaugcuguacaugauagcgaaugcgacuaauucgaagcaaacaucguuucuucaacaauggauaccugaggagaauacuuuaaaaaaguucucggaauucaaugaaacccuaucggcacuugcggugagagacgauggacgauuuguag

SEQ ID NO: 4131 - RNA, 662 nt, Phyllotreta armoraciae
aagcaauuuacccaaagcacgagccgcucuaacauccgcuagaacgaccgcgaacgcuaucuauugcccuccgaagaugcaggccgcccuagaccugcagucaggcgugcuacacgcagccgacgaaaaggauuucaagacugcuuacuccuacuuuuacgaagccuucgaagguuucgacagcgucgagucucccaaagcucuaacugcucucaaguacaugcuucuguccaaaauuaugauuaauaguccugaagauguacagcaaauuguuaguggaaaauuagccauaaaguaugccgguaaagauauugaugccaugaaagcagucgcacaagcagcccacaaaagaucucuugcagauuuucaacuugccguaaaacaauucaaacaugagcuggaagaugacguuaucguaagagcacauuuaggaacccucuacgacaauauguuagaacaaaacuuaugcaggaucauugaaccuuacucacguguccaaguagaauauauagccaagacgauuaagcuuccuguguuacaaguagagaagaaacuaucgcagaugauuuuagaugccaaguuucauggaauuuuagaccagggugaugguguccugauaguguuugaagaaacgccgguagacaaaaccuacgaaauggcuc

SEQ ID NO: 4132 - RNA, 681 nt, Phyllotreta armoraciae
uuggagaaauugcucgagaacgagcgcauucgucacgccgaagaucuggcguuggucgagagggaauugcacaggcugcgagaggaaauggcccaacaacuucaggaauaccaggaccucauggauaucaaaguaucgcucgauuuggaaaucgcagcuuaccguaaacuucucgaagcagaagaagcucgauugaacaucacaccgacaggcauggaacacgaggugcaccauaggaguucuucucaacgucggacgccggugagaaugggggccaaaaggaaacgagcccugcucgaggagacucaggagucgagcuugucggauuacagcgugaacaguucaucuaaaggggacaucgaaguggccacagucgauccggacggucaguuugugagauugcacaacaaaaguaaccaagaggugccgcucagcggauggcaagucauaaggcgggcgggugaugaggagacuuucuacaaauuccacaggacuguuaaaguagaaggaaaugguacaguaaccauuuggaguucggauuuaaauaaagaucacgaacccccuaguaaccugguuaugaaaggccaaaaauggguuacuggagacaacaugauuacgauaguauugaacaacaauggagaagaaguagcgucaucugaaaggguaagaaggcagauuuca

SEQ ID NO: 4133 - RNA, 745 nt, Phyllotreta armoraciae
gaucaaauagaugcggagguucucaauucguuggccgugaccauggagaacuuccguuacgcuaugacgaagagcaguccgagcgcucugcgcgaaacggugguagaaguaccgaacgucacgugggaggauaucggcgguuuggcuaacgucaagaaggaguugcaggaguuggugcaauauccggucgagcauccugauaaguuccucaaguuuggaaugcagccguccaggggagugcuguuuuacgggccgcccgguugcgguaagacccuauuggcaaaggccaucgcuaacgaaugucaggccaacuucauaucggucaaaggaccggaauuguuaacgaugugguucggugaaucugaagcuaauguuagggacauuuucgauaaggccagaucagcagcuccuuguguacuuuucuucgaugaguuagauucaaucgcuaagucgagaggcggaaauguaggagaugccggcggugccgccgauagggugauuaaucaaauuuuaacugaaauggaugguaugggagcgaaaaagaacguuuucaucauuggugcuacaaauagaccagauaucauugaucccgcuauauuacgucccggucguuuggaucaguugaucuacaucccauugccagacgaaaagucuagagaagcaaucuuuaaagccaacuuaaggaaaucaccuguagcuaaagacguagaucuuacuuauauugccaaaguuacacacggcuuuu

SEQ ID NO: 4134 - RNA, 650 nt, Phyllotreta armoraciae
auuuagugccaagucuuugcgaggaucuucuuucgucuguagaucaaccauuaaaaaucgcuaaggacaaggauucgggcaaggauuuucuauuaugugauuacaauagggacggggauucuuacaggucaccauggucgaauaccuauuacccuccauuagaagacggcucgaugcccuccgagaggcuaagaaaauuagaauuagacgccaauuuagcguucgaucaauauagagaaauguauuucgaagguggcguaucuucuguuuauuuuugggacuuagaucacgguuucgcaggaguaauuuuaauuaaaaaaacuggagaugguaguagaaaaauuaaagguuguugggauucccugcacguaguggaggugcaagagaagaguucuggaaggaauucccacuacaaaaugaccuccaccgcuaugcuguggcugcaaaccaauaaacaaggcucgggaaccaugaauuugggcgguagcuuaacccggcagaucgagcacgaugcagcaguaaaugacaucaacccucacaucgcgaacaucggucgaaugguggaagacauggaaaacaaaauucggaacacuuuaaacgaaaucuacuuuagcaaaaccaaggacauagucaauagcuugagaucggug

SEQ ID NO: 4135 - RNA, 792 nt, Phyllotreta armoraciae
uucaccaauugcuacguguacaaccagcccggcgaggacguagucgucauggcccaaacauuagaaaaaguauuuuuaaccaaaguggccgacaugccuaaacaagaauuugucguugaaauuccaaugaaaggcaagaaagggcgaguuagcgucggcggugggagcaccccaucuuccagcggaccggugccggcagcuguacccggaggugucagaggcaggccgcccgcgaccguuucuuccaccaguaccacaccaauugccaccacuacugguucguccggucuaccguugggcacacaagcgccugcgacguugccgggaagcacugccacgacgacgauagcgccggccaacaacaacaacagcucucugacgccgcagcagcucggcacgcccgucagcucgaugcacggaacccccggagcgccucuauccaauucccucgaucccacaggaguguugcccggaaacgucaugccgccggcgcaaccagccaagguaaaaaaaggcgugaagagaaaggccgacacaacgacgccggcgacggccuacgauuauccgacgguauuagaaucgaaaucggcgaagauuucgacucgcagagaaucgggcaggcagauaaagaaaccggcgcggcgggaaaucgaccuucauguaccucaaccggcgauccacaaacccaacgauaaguugacggaaucgcuuaaagcuugcaaugaaauucuuauggaauuguucuccaagaaacauucgaauuacgcauggccuuucuaucaaccggucgau

SEQ ID NO: 4136 - RNA, 762 nt, Phyllotreta armoraciae
caauuucguucaucagcaggucucaaugaaccaucgccagcccuacagcgucagcgacaaagcuggucaccaaaccuccgcggaguccuggggaacaggucgugccguagcccguauaccucguguacgcgguggcgguacccaccgaucgggucagggagccuucgguaacaugugucgcgggggucgcauguucgcgcccaccaagccguggcgccguuggcacagacgcgucaacaucaaccagcgucgcuacgcccuggcgucggccgucgccgccagcggcgugcccgcuuuggucaugagcaaggggcacguggucgaucagauacccgaguugccguuggucgucagcgauaaggugcaggagaugcacaagaccaaggaggccgugcaguuuuugagaaggaucaaagcaugggcugacauccagaagguuuacaagagccaacgguugcgugccgguaaaggaaaaaugcguaacaggagacguauccaacguaaaggaccacucaucguuuacuacaaagaucaaggucuucgucaagcuuuccguaacaucccuggcauugaccucauuaguguccaaaaguugaacuugcuaaaacuggcuccugguggucacguaggucgauuugucaucuggaccgaaucggcauuccaacguuuagacaaauuauucgguacauggaagaacccaucgaccgaaaagaaggguuacaauuuaccccaacccaagauguccaacaccgauuugucuag

SEQ ID NO: 4137 - RNA, 722 nt, Phyllotreta armoraciae
cgaggaagaggaagaagaugaugaagagaaaauuagagaagaauuaaaagaucuuaucgacgauaauccgauugaagaaagugaugcugaauccgauacuucaggucgugaaaaaagaaaaaaaucagacgaugaagaccucgaugaucgauuggaagacgaagauuacgaucuguuggaagaaaauuugggucauaaaguagaaagaaggaaauucaaacguuugcgucgguucgaugaugaagaaagcgaaggagaagaagaacaugaucccgagcaagaucgugaacaaaucgccauggacauauuuuccgacgaugaaaaagacgaucgucagaaaaaggaugaagaacgaaggucagaacgaagucaaagaccggucguugagcaagaaucuuucggagugggcgaagaggaagaagaaggcgauuauucagaugcugaugauuuuauuguagacgaugaugguagaccuuuaaucgagaaaaagaggaagaagaaaccgauuuucacugacgccgcgcugcaagaggcccaagaaacauucggcguugauuucgacuacgacgaguucaccaaauaugaccaagacgaguaugaagacgaggaggaugaagaagaagacgaauacgaagaagaugacaacgaacgaagaaaacauccgaagaaagcggcgcggaagaaguugaccaaaaaguccauuuuugaaguguaugagccga

SEQ ID NO: 4138 - RNA, 689 nt, Phyllotreta armoraciae
uaaagaugccgggaaaaucaucgauaauacugaaacaaaucuaauagcccuuagaaggacaauauauuugacuauacaaucuaguuuggauuucgaggaaugugcucauaagcuuuugaaaauggaguuaaaacccggccaagaaaucgaauuaugccauauguuuuuagauuguugugccgaacaaagaacauacgaaaaauucuacggacuucuagcucaaagguuuugccaaauaaacaaaauauacaucgagcccuuucagcaaauauucaaagacaccuacgcuacuacccaucgguuggacaccaauagauugaggaacgucagcaaauuuuucgcucacuugcucuucacggacgccauaggcugggagguguucgagauuaugaagcugaaugaagaagacacuaacagcucgagcaggauuuuuauuaaaaucuuguuucaagaauuagcagaguacaugggccuaggaaaguugaauaccagauugaaggaugaaacacuucagcagcauuuugcagggcuguuuccuagagacaauccgaaaaauaccagguuuuccauuaauuucuucacguccauugguuuaggaggucuaacagacgaacuucgggagcauuuaaaaaacgucccuaaaauuauggaaacuaaaacggccucugugaaggaagaaaguggcagua

SEQ ID NO: 4139 - RNA, 773 nt, Phyllotreta armoraciae
ugaacugacguuucaagcuauggccuacgacuugcuuccaaucgaaaaugacguguacaaauacgaagcuuccgcuggggugcagaaggagguccucuuggaugaaaacgacgagcuguggguggaauugcgccaucaacacaucgccgugguuucucaaagcguuaccaagaauuugaaaaaguucaccgauucaaagcgcaugacccagagugauaaacaauccaugaaggauuuguccacuaugauuaaaaagaugccgcaguaucagaaagaauugucgaaauacgcuacucacuuacaucucgccgaagacugcaugaaggccuaccaaggguauaucgacaaguuaugcaaaguugagcaggauuuggcaaugggaacugacgccgaaggggagaaaauuaaagaucacaugcgcaacaucguuccgauucuuuuagacaccaaaauaacaaacgaguacgauaagaugcgcaucauagccuuguacgcuaugacuaaaaauggaauaaccgaggaaaaucuuucaaaacuaggacaacaugcaucaauuaaagacaaacaaacuaucgcuaaucuacagcuccugggaguuaaugucauuaaugaugguggucccagaaaaaagcaguacaccguaccgcgcaaagagcgaauuacggaacaaacuuaccagaugucgagauggacuccuguuauuaaagacaucauggaggauugcaucgaggacaaauuggaucagaaacauuuucccuaucuaaguggaaggg

SEQ ID NO: 4140 - RNA, 705 nt, Phyllotreta armoraciae
cuauggagcugaagugucucaaagacagauguucaacuaacuuacaaaaauauuacgacucaaaaaaucaucaaaagaaacagauucaaucugggggcuuucaagaucuuagaagagauuuacaagcagugauagguacaagggcaaauauuaacauagcacaaauagaaaauuauggcggugaaacuuucuuaucagaggaauuggcuaucaugauucuucaggauacuaaacaagcuuuucaacguugcuuauuguuaucaaaaggcagugaaaaagcuucuaaugccacucaaauuuuggauagacuuauuaauaguuugcuaauagaacauguagacuaugcaguugaauugggucuacaagcuguacccguugucgaaggcguuaaaaaucccccuguuuuguauuuuuuuaaugucguccaucaaagcaauaauauaacccaucucgucgagaaacaguucauggauuugguggucccauuaguagaaaauacuccaaaauacagcgauugcguccagaagaaaaaauuuguuuuggaggauauagaaagaaaaauuaauacaggauuggauaggugcuugagugccauauuaaauugggugaaguuguauuuacaaucugaacaaaagaaaucagauuuuaagccagagucugaugauuuugauacaguggccucaucagcuugcaagaacguacuua

SEQ ID NO: 4141 - RNA, 653 nt, Phyllotreta armoraciae
uagaaaccaucgaucugcagaaggaccccuauuuuaugaaaaaccaccugggcuccuacgaauguaagcuuugccuaacauuacacaacaacgaaggaaguuacuuggcgcacacgcagggcaaaaagcaccaggccaauuuggcucggagggcagccaaggaggccaaagaugcccccucguugcuccagcccgagaagcccagaguggagcccaagaaauucgugaaaaucgguagacccgguuaucggguaacuaaacagagggaucccgaaaccggccaacagaguuuacucuuccaaaucgauuauccagaaauaagcgacuugguuuugccucgacaccguuucaugucugcguacgagcaaaaaaucgaaccgcccgaccguaaauggcaauacuuacucuucgcagccgaacccuacgaaaccauagccuuuaaaguacccagcagagaagucgaaaaaaccgauacuaaauuuuggacucauuggaacagagacaccaagcaauuuuuucugcaauucgcuuucaagaacgagaacaaacgauccguuaacuccguuguucaaaggcauucgaucgucgguggaguuccaccgccucccaugcugccgguaccgccgccgcccaggccuccuauguuuaauccc

SEQ ID NO: 4142 - RNA, 253 nt, Phyllotreta armoraciae
uaaccugcgaaaccauaaccggcgaaguuuacagggguaaacucauagaagccgaggauaauaugaauugccaaaugacccagauaacuguaacguacagagacggacgaguggcacaauuagaaaacguuuacauuagagguuccaaaauaagguucuugauauuaccggauauguugaagaaugcuccgauguuuaaaaagcaaaccaaagcuggcacugcagguagagggaagucugcaauucuacgagc

SEQ ID NO: 4143 - RNA, 654 nt, Phyllotreta armoraciae
caagucggagccaauuuaacggccacauccgacagagaaacuaucuguuacacguuggaagguacccccgaagcuguggaaugcgcuauaccauucuuaaccgaaguagccacccaacaagaauuuagaccuugggaaguuuccgaauuguccaguagauugcaguuggauaucgccacuagaccauugcaguugagagcuaucgauuugcugcacaacgcugcuuuuagaggacgcggcuuggguaauucuuuguuuauuccgaaaacucaaauuggcaaaauaucguccgaaacucuacaacauuacguuagcucgaacuucuugagcggacguauggcagucguugguucggggaucagccaaaaggaauugacgucuuuugcuaauuccuuaaaaguagaaaacggcgaaggcaauaacgccccuucuccuuacguaggcggugaauuaagaucgaacaaagguggucaacuggccuuuauugcuguagcaggagagggcgcugcucucaaaaaccacaaggaagcuuuagcuuuugcuguacuucaaggagcccuuggaggaggcccccaaguuaaauacggaguuucugauaauggaaucuuccgaaaggcucuuggaaauaacccuagcguuaguucaguagccaua

SEQ ID NO: 4144 - RNA, 199 nt, Phyllotreta armoraciae
ggucuucauccucucucucuaaucaucggacggcugaagagcuggaaucucagaacgaugaagccaucgaugggcuaagugcaaaaguuaaaaugcuaaaggagauuacaguugggauuggaaaugaagugaaagaaucgucuaagcuuaucacuggaaucaaugauucuuuuucagaagcuagugggaucuuaagugg

SEQ ID NO: 4145 - RNA, 729 nt, Phyllotreta armoraciae
cguugguaauccucgaagaugucaaauuuccgaaauucaacgaaaucguccagcucaaacuggccgauggcagcuugcgauccggucaaguauuggaagugagcggcucaaaagccguaguacaaguguuugaagguacuucgggaaucgacgccaaaaacaccaugugcgaauuuaccggcgauauucucagaacgcccgugucagaagacauguuggguagaguguuuaacggcucaggaaaacccaucgacaaagggccuccgauuuuggcugaggacuacuuggacauccaaggucaaccgaucaauccuuggucgcguaucuacccggaggaaaugauccaaaccgguaucuccgcuaucgaugugaugaacucgaucgcucguggucagaagauucccaucuucucggcggccggucugccucacaacgaaaucgccgcgcaaauuuguagacaagccggucuugucaaagugcccggcaaguccgcuuuggacgaucacgaagacaacuucgccaucguguucgccgcuaugggagucaacauggaaacugcucguuucuucaaacaagauuucgaagagaacgguucgauggagaacguaugucuguucuugaauuuggccaacgauccuaccauugagagaaucaucacgccucguuuggcucugaccgcagccgaauuuuuggccuaucaaugcgagaaacacguguuggucauauuga

SEQ ID NO: 4146 - RNA, 763 nt, Phyllotreta armoraciae
ggccaucaaaaacaucaacaccaucaucgccccggagcugaucaaggccggcuucgaggagacacaacagaagaaaaucgacgaguucaugaucaagcuggacggcaccgagaacaaguccaaauugggcgccaacgccauccucggcguuuccuuggccauuugcaaagccggagcggccaggaaaaacgugccguuguacaaacauaucgcagauuuggccgguaacaaggauaucauccuaccaguacccgcuuuuaacguuaucaacggugguucccacgcuggaaacaaacuggccaugcaagaguucaugauucucccuacuggcgccacaaccuucaccgaagccaugcgaauggguuccgaaauauaccaucaccugaagaagguaauccacgccaaguucggcuuggacgcgacggccgucggcgacgagggcgguuuugccccgaacauccucaacaacaaagaaggucucgagcucaucaaaguggccauccaaaacgccggcuacaccggcaaaaucgacaucggcauggacguggccgcuucggaauucuucaaagaagguaaauacgauuuggacuucaagaaccccaacagcgacaaaucgaaauggauauccuccgacgaacuagaagcuuuauaccaggaguucaucaaagaguacccgaucguuuccaucgaagaccccuucgaucaggacgauugggccgccuggagcaagcucaccggcaacaccaaaauccaaaucguaggc

SEQ ID NO: 4147 - RNA, 676 nt, Phyllotreta armoraciae
gaaaauggcgguuagauuggccgggggauugcagaaaaugguggcguugcuccagagaaaccacgucaaauucuuggcuauucucaccgacuguuugcaaaucuuggcuuacggcaaucaagagagcaagcucaucauacucgccucucaaggcccuaucgaauuggucagaauaaugagaucguacgauuacgagaagcuuuuguggacuacaucgagaguauugaaaguguugucgguguguuccagcaauaaaccggcuauuguagaagcuggcgguaugcaagcccucgccaugcauuugggcaaccccagcacucgguugguucaaaacugccuuuggacccucagaaaucuaucggacgcggcuacuaaagucgacggauuggagaguuuguugcaaucauuaguucaagugcugcaaucgucugacgugaacguggugacuugcgccgccgguauccugucgaauuuaacgugcaacaaucaacgcaacaaagugacggugugccaagugggcggcguggacgcccuggugcguaccaucgucagcgcgggcgaucgcgaggagaucaccgagccggcggugugcgcccuacgccaccuuacaucgaggcacgucgaguccgagauggcgcagaacgccguucggcugaacuacggcauacaagugauc

SEQ ID NO: 4148 - RNA, 689 nt, Phyllotreta armoraciae
cgaaaucgacaagcacaaaaaacgccggcccuauuuggcguccgaaugcaagagccuguacgccugcgagaaauggcgcaugcagauaaucagggaaauagcgaaaaaaguggcccaaauccagaacgccgggcugggcgaguuccggauacgcgaucugaacgacgaaaucaacaaacuccugcgcgagaaacgccacugggaggaccaaaucaaggaguuaggaggcccagauuaccagcgagucggcccgaggaugcuggaucacgaaggcaaagaaguacccggcaacaggggcuacaaguacuucggagccgccaaggaacuaccaggcguucgagagcuguucgaacaggaaccgccgccuccgccuaggaagagccgggccgagcugaugaaggacaucgaugccgauuacuacggcuacauggacgacgacgacgggauauuaauaccgcucgaagucaaagcugaaaaaaucgccguucaaaacgccguaucggaaugggugagcaacaaggaaaagaaccuggacucgagcaagguaaucgaagagagcauuuacgcgguggaggacuccgacgaagaggaugccguucaacaguucgauggcucgcaacagcgauucguugcucacguacccguaccgucacaacaggacaucgaacaggcuuuguugaggagaagaa

SEQ ID NO: 4149 - RNA, 510 nt, Phyllotreta armoraciae
aaaaccacuuucgucaaacgccacaugaccggcgaguucgagaaaaaguacguagccacccugggugucgaaguccaucccuuaguguucacgacaaaccgaggcaaaaucugcuuuaacgugugggacacggcgggccaggagaaguucgggggccucagagacgguuauuacauucagggacagugugccauuaucauguucgaugucacguccaggguuacauacaaaaacguucccaacuggcacagggauaucgucagggugugcgaaaacauaccgaucguacuauguggaaacaaggucgacaucaaggauaggaagguuaaggcuaaaaguaucguguuccauaggaagaagaaccuucaguauuaugacauaucugccaagucgaacuacaacuucgagaagcccuucuugugguuggcgcgaaaacuuauuggcgaucccaacuuagauuucgucgcugaaucggcccuucucccuccggaaguucaaauggauccccag

SEQ ID NO: 4150 - RNA, 724 nt, Phyllotreta armoraciae
cgugaugaaauacggcaaaaaucaaugguccagaauagcaucucugcuucacaggaagucugcgaaacaauguaaagcccggugguucgaauggcuagacccuagcauuaaaaaaaccgaaugguccagggaagaagaugaaaaguugcugcauuuagcuaaacuaaugcccacucaauggagaacuauugcgccuauaauaggcaggaccgcagcccaaugucuagaaagauacgaauauuuacuggaucaagcgcaaaaaaaggaagaaggcgaggacgccguggaugauccgaggaaguuaaaacccggagaaauugaucccaauccagaaacuaaaccggcaagacccgauccuaaagauauggacgaagacgaauuagaaaugcuuuccgaagcuagagccagacuggccaauacccaaggcaaaaaagccaaacguaaagcucgcgaaaagcaauuggaggaagcucgccguuuggcagccuugcagaagcgacgagaacugagagcagccgguauugaagucacuucgaggcgcaagaagaaacgcgguguagauuacaacgcggaaauuccauucgaaaaacaaccagccaucgguuucuacgacacuuccaacgaagcccuagacuugauggccccagauuuuuccaaaaugagacaacaacaucuagacggugaacucagaagcgaaagagaggagagagaacggaaaaaggac

SEQ ID NO: 4151 - RNA, 330 nt, Phyllotreta armoraciae
auguggcucauccagauaagcugaagaaaaaaauuacuagggaauuaauuacuaccauucuugccagaaaaccaaaaaugugcaguuucuuagaauggagggauuugaaaaucguuuacaaaagguaugcuagcuuguauuuuugcugcgcgauagaacagugcgacaaugaacuguuaacuuuggaaaucauucaucguuacguugaacuuuuggauaaguacuucggaagcguaugcgaauuggacauaauuuuuaacuucgaaaaggccuauuucauucuggacgagcugaugcuugguggcgaggugcaggaaaccaguaagaaga

SEQ ID NO: 4152 - RNA, 700 nt, Phyllotreta armoraciae
gaaagcugguaaauucaccgaagaagugggaaaaacuacucacaaaaucagcgaaaccgcacaagaaaucagcaagaccggagcguuucaaagcauaucggaggccaccaaagcgguuaaacaagaaaucgacaacaccagcauggaaggucgaguguacgugagcccuaaaaagcugcgaaaacgaaccgaaaccagcgcgguaguccaacaaaaguacuacgaaccgaacacagacgcaaccggcguagagcuacacaaagacuccaaauucuacgaguccuggcaaaacuucaaaaacaacaacccguacgugcacaaagucauggacuggaaacucaaauucgacgaaagcgaaaaccccaucauucgagccucccgagcgcucaccgagaaagucggcgacauaaugggaggccucuuucaaaaaaccgaacucuccgaaacccucacggaaaucuguaaaaucgaccccgcuuucgauacgaaacgauuccugaaacagugcgaaaccgacaucaucccgaacgugcucgaagccaugacgagaggagaccucgaaguccugaaggacuggugucacgaaggacccuucaauuuguucgccgugcccaucaaggaagccuacaagaaaggcuacagaaucgagucgaaaauccuggacguagaccacguggauuuggugauggguaaagugaug

SEQ ID NO: 4153 - RNA, 654 nt, Phyllotreta armoraciae
agaugguaagcugaaaccuggauuaaauaaaaucgaagaagccccuaaacaauucgugaacaacauaagcggcuuaaaucagaaaaucgaagaauucaaauugaaacugccauggaucgaacggcuggauuguacgaaugcccaagcccccuuggcgcccgaguuagcggcagaaauguugguucacgaggaaaagaggaguaaucaacugagaaacaacaaaaaacuuccccaauuucaacccgcccaagaucccguucugaacgauuucaaacgagaacucauauuccaccggcaagcacaagcuacaauucuagaggcaauuccgaaaaucaaagaauuagggauacuuacuaaaaggccagaugauuauuuugcugaaauggccaaaucggaugagcacaugcacaagaucagagagaaccugaagcaaaagcaggagcaacagaagcggauugaacgggugaagcaauugaggcagcaaaggaaagagggaaaaucgcugcaggugcagaugaaauugcaacgcuccaaagagaagaaagaaaugauggaucaagugaagaaggcaagaaaaaacuucgacuuuuuggaugauaaaaauaagcccaugggaaggaaggcugcagaaaaacggaagaugaaggacaagaa

SEQ ID NO: 4154 - RNA, 661 nt, Phyllotreta armoraciae
gauccaucgauaacaaggcuauguacgauacuuucucugccuucgguaacauucucagcugcaaaguggcucaagacgagagcggagucagcaagggauacgguuuuguccacuucgaaaccgaagaagcugccaauaaauccauugaaaagguaaaugguaugcuguugaacggcaaaaaggucuacguuggucgauucaucccacgcaaagaaagggaaaaggaauugggcgaaaaagccaagcucuucacaaacguuuacguuaaaaauuucggagaggacuuguccgaggaacagcugcgaacgauguucgagaaauacggcaagauaacuagcuacaaaauaaugagcaaggacgauggaaaaucgaaaggauucggauucgucgcuuucgagagccccgaggcagccgaaacagcugucgaggcccucaacggcaaagaaauauuggaaggcaaaccuuuguacgucggcagagcccagaagaaggccgagcgucaacaggaauugaagcggcgcuucgaagcucugaaaauggaaaggcugaaccguuaccaaggcguaaaucucuacgugaaaaacuuggaugauaccauagacgacgagcgccuucgcaaggaauuuucaccguucggcaccaucacuucggccaaaguaau

SEQ ID NO: 4155 - RNA, 766 nt, Phyllotreta armoraciae
uuguugaauugagcaccaacacgauaaacaagcuucuaacagcucuaaacgaaugcaccgaauggggccaaguuuucauacucgauucccugucgaacuacaccccacgagacgaaagagaagcccaaaguauaugcgaaaggaucacuccacguuuagcccacgcuaacgcugccguaguacuaucagccguuaaaguauugaucaaaaugauggagauuuuggcaggagauaccgaauucugcaacacgcucagcaaaaaauuagcgccuccuuugguaacucugcugaguucagaacccgaggugcaguauguugcauugagaaacaucaauuugaucguacaaaagaagcccgacauauugaaacacgaaaugaagguguucuucgugaaauacaaugacccgauuuacgugaaacuggagaagcucgacauaaugauucgauuggcuucucaagucaacaucgcucaaguucucagcgaacucaaagaauacgcgaccgaagucgauguugacuuugugaggaaagccgugagagccaucggucggugugccaucaaaguggagccuuccgcagaaagaugcguagccacgcuguuggauuugauucaaacuaaaguuaauuacgucguacaagaggccaucguagucaucaaagacauauuuagaaaauauccgaauaaauacgaaaguauuaucagcaccuugugcgaaaauuuggauacucuggaugagccagaagccagagcuaguaugguguggau

SEQ ID NO: 4156 - RNA, 363 nt, Phyllotreta armoraciae
gaggagaaguaggagcuacaucauccuuggcuccgaaaaucgguccccuugguuugucucccaaaaaaauuggugacgauauugccaaagguacagcugacuggaaagguuuaaaaauuacgguccaauugaaaauucaaaaccgucaagccaccaucuccgucguaccaucggcugcuuccuuaauuauuaaggcuuugaaagaaccuccucgugacagaaagaagcagaaaaacauuaaacacaguggaaauauuacauuugaugaagugauuuccauugccaagcaaaugaggcauagaucaauggccaagagccuugcuggaacuguuaaggaagugcuggguacagcucaaucuguag

SEQ ID NO: 4157 - RNA, 712 nt, Phyllotreta armoraciae
uaucauaucgugccaagcaaauggaggaagaacuuacaguugaagcggcuaaacugggcauuucuauaguauuuucgcaugagacugagccuuuaggcaccgcaggaccaauagcauuagcuaaagaacacuuaucgaaaaguacaaaaccguuuuuuguauugaauuccgauauaauaugcgacuucccguuuagggagcuagagaaguuccacgaaggccacggaaaggaaggaacuauagucguuacaaaggucgaagaaccauccaaguacggcguuguaguuuacgaucaaaacaacugcaucgagaguuucguugagaaaccgcaggaauucauuucgaauaaaaucaacgccggccuguacauucuaaaucccagcgugaucaacaggauugaacuccgaccgacuuccauugaaaaggaaguguuuccuuacauggcaucugacaagcagcuuuaugcuuucgagcugaaaggguuuuggauggacguugggcaacccaaagacuuccugacuggaaugugcuuguauuuaaaccauuugcgggaaacuaauagccagaagcuguacaaaggacccgguguagucgggaacgugcuggucgauccgacagcaaaaauuggcagcaauugccaaauuggacccaacguuacaaucggaccagguguuguaauagaagaugggguuuguauaaaacgcucgacgau

SEQ ID NO: 4158 - RNA, 694 nt, Phyllotreta armoraciae
gaauaacgacgaccuucugaaagaaggcguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauagugucgauacgacggcggagcccuggcgggccgcucuagauaacgaguuuauacaauauacgagaaaccauuauaaagacggcguuuguagcguguucggucgcagucaaaacggugcgaucacccuuacugcuugcaucgaagaccaccaauuucagcccaagaacuuuuggaacggucgauggagaucccaaugguccguuagccuaaccgaugaaucuacugcagaaguacggggcguccugaaagugcaaguccauuauuacgaagaaggaaacguucaacuggugaguacuaaggaaaucaaggagucgauuccgguuucuaacgaagcgcaaacggcuaaggaaaucauccacguaauagagaacgcugagaaucuguaucaaacugcgauuucugagaauuaccagacgaugucggacacgacguuuaaggcucugcgaagacuccugcccgucaccaggacaaaaauggau

SEQ ID NO: 4159 - RNA, 783 nt, Phyllotreta armoraciae
aucccuuacuccauuaccgaaaacagguuagcugaaaucaggaaaaacuuuauguacccguacuucgauaaagggggcaacguggacaacgagggggauuaccagaaggaaauccaauccuccacgccccaaguccacaagaaucugaacuuccaagugccuuuuuucggauucagguauaauuacacgagaguuuccaucaaugguuauuuggaauucagcgauccaccuuccaacuuaaauuauccacuggucuuucccauaaaggacuggccuaagcaaaacgauccuucguuuauugguauuuucuacaguaaauguaaaaucgguaaucuucgugacgaagacguggacaaaaggaaacccggcguguacuucagaauggaacgagaccucagggacaggcaagacaggaugggaguugaaauaagggagagauugaaaugggauauaagagaaggagugaucgguucggauaccuucgauccaaaacacgcuauaaucgugacguggaaaaacgugucauuuaauggaggauaugcaaacgcaguuuaucaaaccaacacauuccaaaugguacucgcuaccgacgagguauucacuuacgcaauauucaacuaucuaaauuuggcguggaccagucacacggaagccgguggagacaccagaacaggcgaaggcgguguaccggcguuugucggauucaacgccgguaaugguacgagaagcuuccaguacgcgcccuacagucaagcgucugucauucgagauuugguaucgacc

SEQ ID NO: 4160 - RNA, 210 nt, Phyllotreta armoraciae
aaaaauccuuggcuccguaggaguugaagccgaagcugaaaaggucaagaaagucuuaggcgaacucaacggcaaauccaucgaagagcucauuacuaaaggucgcgagaaauugaguuccaugccaguagguggugcagccccuguagcugcugcugcaguugccgcugcuccugcugccgcagaagaaaagaaagaagccaagaagga

SEQ ID NO: 4161 - RNA, 708 nt, Phyllotreta armoraciae
aacagagcugacgaagauuuggaucccgaagacgucgaacucgaugaaaacuaucugauugagaccaggaguaaaucgagugcucauacuggagaacauggcguugaugaauauccugauaucaguggaaucacaaccgcuagggaagccauggguaagaugcccgaagaggauaagcaaaaaauauugcagcaaguggaguuuuucaagaacgagaagcucaaguucgauaacgaagucgcuaaaugggacgauacuggcaacgacaucaucguuuuggcuaaacacaugugcaugaucaugauggaaaugacagauuuuaccaggggaaaaggcccucugaaaacuaccauggacgucauaaaugcggccaagaaaauuucagaagcagguacuaaauuggacaagcuaaccagacagauugccgaacaguguccggaaaguucaacgaagaaagacuuacucgccuauuuacagcguaucgcucucuacugccaucagaugaauauuacuucuaaggucaaagcagacguccagaauaucaguggagaauugauugugucuggucuugacagugcuacaucauugauacaagcagccaaaaauuugaugaacgcugucguucugacggugaaagcuucauacguugcaucuacuaaguauccuagaccaggaacuguagcuucuccgauuguuguguggaagaug

SEQ ID NO: 4162 - RNA, 645 nt, Phyllotreta armoraciae
agcagcacuacuacaauagccaguguccccgcuuuagguuuaucgacuacuguuucuuccgcugcuucaacaacuccaucgacuucauuagguacaacaacagcagcuccuccagcuuauucaacaucgacacuuccuucuucugguucguuaacuuucagccaacuagaagauucuaucaacaaauggacuauugauuuggaagagcaaggcaaauuuuucauuaaucaagcgaaacagcuuaaugcuugggauucgcuacuuauuucgaauggcgaaaagauucucaaucugaaugguaguaucgagagaguuaagcagcagcaacagcaauuggaccaagaacucgauuucgucuuggcgcaacagaaggaauuagaagaguugauaacaccacuagaaaaagaauuguuggaaauuccuguaacggacauagaucgaaaucaaauguaucaauuuucggaaauaaucgauucucaauugaagcaaauguccgaugauuugaaggaaauuaucgagcauauuaaugaaucuaauaaaagcgaagaaauuucaaauccguugacgcaaauuagccgcauaaugaaugcucacaugaauucacuccagugguuagacagaaauacggcacaaauuguuucucau

SEQ ID NO: 4163 - RNA, 455 nt, Phyllotreta armoraciae
uuuaggacuggauaacgcugguaaaacgaccuuauuacacaugcuuaaagacgacagacuggcccagcacuugcccacauugcauccgaccuccgaggaacuguccaucggaaacaugagauucacuacguucgauuuaggagggcauucgcaagcuagaagaguguggaaggauuacuuccccgccguagacgcuaucguauuucuuauugaugcuaacgacagaucgagauucgucgagagcaagcaagaauuagaugccuuguuaacggacgaaacccuagccaauugccccgugcugauuuuaggcaauaaaaucgauuuaccggacgccgccucugaggaugaguuacgaaacguuuacucgcuguacgggcagacgaccgguaaagguaaaguggcucgaucggauuugcccggacgaccgcucgagcuuuucaugugcuccauucuga

SEQ ID NO: 4164 - RNA, 575 nt, Phyllotreta armoraciae
acuaauauuaacgagcaauuucgauaaaaaaucgaaacgaaccgauacagccagccuuucagucauggacccgaucgccgugcuggaaaaacgcaucgaggcgcucgagcugcagguguucccuuugggugacuacaaucaaauaucgaacaagacgcugaccauaacgaaucugcugguggagacgcaaacgaugauaaauucggcuuuaacuugucgcgaauccaucacgucgaugcugcaacaccugguggugaucaacgacuaccugaaccccgucagcgaggcggacgagcuggaggucgaagcgaaaaggcaguauuuacucgaauuguaucccgaauugaaggauacgauacagacggugagcacguuggaaucgcuguugccuuuuaucgauucaauuaauauauccaaagugguggaguucucggggaagcuggaggagguggccgugagcaaucucaaguuguacggggaaugcagggauaucacgaagaaggugcuggucgcguuacagcaauauaacgacauauccaauuccauuaaauuguuauuuucgcaauuggauacgg

SEQ ID NO: 4165 - RNA, 780 nt, Phyllotreta armoraciae
aaggauuucugcggguuaauagguauaauccaacuguuagcuugucccuacuuaguaguagcaguucaaagagaauuagucgguuauauagcagguugcgcuaucuggcgccucgccaaagcugaauuaauaccauacaggagcuccgcacacuugacuccugaaaagcaagcagacaacgaugucuauuuguccaugguguauuccguacuauccacuccauuucuauacuuuuccuacgacuacgaucuuacgcauuccuugcaacgcuugcacggcauaagccccgauuuuuggaagcaaucguuguuugagcgagccgaucaaagguuuguuuggaauggaaaccuauuguauucguucaaaggauuuucgauacacagauuuugccugccucucaugcacggauucauuuccauaaauuucugcguagugaacgggcacaguuuaaacuggucaauuguuaguagaagaagcauucaacgagccggcaccagauuacacagaagagguuuagauaaagaaggaaacguggcuaauuucguugaaaccgagcagauagucgaauaucaaggcgaucgggcgaguuucgugcaaauacgaggcagcauuccccuguuuuggcaacaagaucccgaccugagauacaaaccaccgccuacuauacucgaugucgauccacaagaucagcacucgaugugucuaaagcacaugaacgauuuaaugacuuucuacggaaaggucguuugcgugaaucuagucgaucaaaaaggagcagaa

SEQ ID NO: 4166 - RNA, 730 nt, Phyllotreta armoraciae
ucgcaaauaaaggcuaucgaaaaaacguucgaagauaccaaaacgaccauugauaagcauuacagcaagccgaacguaguccccguggauguccugccaguuuauccagauuucaguuuguggaaauauccuugugcgcagguuauuuucgauucugauccagcucccgugggaaaacaaguacccgcucaaaucgaagagaugucucaagccaugaucagagguguaauggaugaaaguggugagcaguucguagccuacuuccuucccaccgaagagacucuccaaaagcgcagggaagacgucgcgaaccaaguccaauaccaagaugaagaggaauacgaauacaaaauggccagagaguacaacuggaacguuaagagcaaggcaagcaaaggcuacgaggagaauuacuucuucgucguacgaucgagcgguauuuacuacaacgaauuagaaaccagaguuagguuaagcaagcgaaggcagaaaguaggccagcccccgagcaacacucggcucaucguuaaacacaggccuauggaugcuaaugaauuuagaaugcaacgguacagggaaaagcagcuggaaccuacaggcgaggaugacgaagagauggaaaucgacgagccccaagacgaggaaaacgugcucgagccggacaacgaaagccgcgacaaagaaaccgagagcgacaacgaaaagaaacgauccagagcuuccucaguau

SEQ ID NO: 4167 - RNA, 790 nt, Phyllotreta armoraciae
acuccuuugcaaagagguaggcuggaaguuggacucggccuugcugaaggcccucaaggccaagaaugccgaaaaggucaagcuccuggacgaagccaucgaggacgcggagaaaaacuugggagagauggaggugcgggaggcuuauuugcguaaagcggaguuuuacagcaggaucggcgacaaagaaaacgccgugaguaccuucaggcaaacuuacgauaaaacagugucuuugggccaccguuuggacaucauauuucacuuaauuagaauaggcuuguucuuuauggaccaugaccucaucaccaggaauaucgacaaagcgaagagccuaaucgaagaaggaggcgauugggacaggagaaaccgauugaaagucuaccaaggugcuuauuguaugucggugagagacuucaaaaccgccgcuaaccuauuuuuggacacugugagcacauucacgucuuacgagcucauggacuacaaggcguucgugagauacaccgucuacacuuccauaaucagccugccgagaaaccaacuaagagauaaaguaauaaaaggcucggagauacuagagguccuccacucugagccguucguuaaagacuaccuguuuucguuguacaacugccaguacgcggaguuuuucucgaauuuggccgaggucgagacgauucugaggaaagacuacuuccugaauccucauuaccgguauuacguuagggaaaugaagauuucggcuuacacgcagcugcuggaguccuaucgaucucucacguugcaguau

SEQ ID NO: 4168 - RNA, 762 nt, Phyllotreta armoraciae
acgauuuggaugacaguucaacgacgccuccgguaaccccaccguuggccucgaccagcagggguauggugucgaagaagaagaaucucgagcuucaagcgcaaaaagaauccgugaucgucaugcacaguccggacgauaacaaacagcucgaaauaauggauuacgacgacgacaacaauacuguucugucuucagaaguuucuuugaguucagcagcucgaaacgacgacgacuugguggaaaucgaaacgauaucgcaagaccucgccgaagggcuauccagcccguuggaauccgaucaaaucggagacgaauuccuguuguuuccaggcaauauggugguggauaugucaggcgaggggcauuacucggagaaagaggaagaagaaaccgaggaauucaccgaucagaacaugcacaucgugauacgcagcccgacgaccagcgacgacgaguucaucaugccgugcaaagucaagcaguacaacgaggacgagcaggaggacaaucccgaaucgccggaucaagaggaauucggcgaauccuccgacauguugaccgguuacgauaacgaagaaaccgauauuauccucuccgaucaaacuaccagcguucccgaagacucgauauccacuaaagaggacuucgaggagcucaucgacgaggggucacggaaaaacaacaucagcaaacaggaggugaccgcgaaacacauucaggauuuccacagguacaccgaauuguucgauuacggcaaac

SEQ ID NO: 4169 - RNA, 784 nt, Phyllotreta armoraciae
ucuguugaaauuacggcugauguuccauucguaaaagucgaagggaaaaauguguuuagguucuuuuggugggaugcuuacguggauccacuauaucaacaaggaacuguuuuccuguuugguaaaacauacugcgaaacuuccaagaaauaugaaaguugcugugugccuguaaagaacauagaacgaacaauauuuguuuuaccuagaccuuuugaacuagaugagaacggaaagcccacagaaaaaccggucacguuuaaaacaguucacgaugaauuuaacaaucagguuuuaaagcgaaugggcauuacaucuuucaaaucgagauugaucacgaaaaaauucgcauucgauccaagcguaccagucgaauccgaauacuuagaagucagauauccugcuucauuuccacggauuuuuugcaaugaugacgaggaccaaaaagacgauuuaagugacuucgaugaucccagcuauaaaacuuuuucaaagauauucggcauaaaaacgaguuucuuggaaucgcuuuuucucgaacguaaaaucaaaggccccuguuggaucgacauaucugaccccgaacccgcaacuaauccgaugagcuuuugcaaauucgaaguaaacugucuuaaaccuaccaacuugaaaaucacccaauucgagaaaccuguuccuccuccuccgcuuguaguugccacuauaaacaugagaaauuucaucaaucgaggaucguccuaucacgaaaucgucaugauuucuuguuuggugcaaaaucgauacg

SEQ ID NO: 4170 - RNA, 678 nt, Phyllotreta armoraciae
uguaugauuugggcgguaaaaugauugauaguauucuaaaagaaaaaguucaaucuggugauguuauaaccauugauaaagcuacaggaaaaauuacgagauugggcagaucuuuugcuagagcuagagauuaugaugcuacuggccaacaaacgagauucguucaauguccggaaggugaauugcaaaaacgcaaagaaguuguccacacagugacuuugcacgaaauugauguaauuaacagucgcacucacggguucuuggcacucuuuucgggugauacgggagaaauuaaaucagaaguaagagagcagauuaauggcaaaguagccgaauggcgugaagaaggcaaggcugaaaucauaccaggcguacucuuuauugaugagguucacauguuggauauagaaugcuucuccuuuuuaaacagagcuuuagaaaaugaaaugucuccaaucgucauaauggccaccaauagaggaaucacgaaaauucgagguacaacuuacaaaucuccucacggcauaccauuggacuugcuggaucgaacaauuauuguuccuacucagccauaugacgaaaaggaauugaaagaaauauuaaacauucgaugcgaagaagaggacugucaaaugucugauaaugcuuuagugguuuuaacgaggaucuguaaggaga

SEQ ID NO: 4171 - RNA, 768 nt, Phyllotreta armoraciae
ucuucgacucuucagaggaucccuauacaaaaaguacccuggaauguucaggaggucuauaaccaaugaagaaagaaggagguugauugaacucgguuugagccagcacguucuagcgaguagcguaucacugcuuagagcagaagaaguugaagauauaauugaaggaaaugaugaaaaguauaaagcuguaucuguacacacuucugaaccuccuaugccaagagaaggaaaauccaagaaaaacaugcaguggguaccuucauuacccaauuccagucauuuagaugccguuccgcaagcuacacccauuaacaggaacagaguagcugcuaaaaaggugagaacauuuccacuauguuuugaugauaccgauccccaauuaaacauagaaaacgcuugucaacaagaauugcuaguuccuauuagacuggauauggaaaucgaagggcagaagcucagagauacauuuacuuggaauaaaaaugagaguuuaauaacgccugaacaauuugcugaaguccucugcgacgaucuugauuuaaaucccuuaacuuuuguaccagcgauugcucaagcaauuagacaacaacucgaagcauucccgacagaaccucccaguauuauagaggaaaccugcgaucaaagagucauuauuaaguuaaacauucacgugggaaauacuucuuuagucgaucaaguugaaugggacaugagugaaaaacagaauaaucccgaagaauuugcguugaaacuuugcgcagaauu

SEQ ID NO: 4172 - RNA, 417 nt, Phyllotreta armoraciae
cuuacacuacgggcgaauuuccagaggaauacauaccgacaguauuugaacauuauggacaagaaauuacggucgaugguacacauuacaauaugacuuuaugggacacugcaggucaagaagauuaugaaagacuaaggccucuaucuuaucccaauacaaacuguuuucuaguuuguuuuucuguggacaaaaaucuagccuccuacgacaacguaugguugaaauggguaccagaaguucggcauuuuaacccaaacgugccgauuauauuaguagcgaccaaaacugaucuaagagacgauccgagccuggcuuguuacucgaccgaggaaggcaagaaguugaaaagaaaagucagggcgcaaugcuacauggaaugcucggcauugagguaccaaggacucgaggaaauuu

SEQ ID NO: 4173 - RNA, 788 nt, Phyllotreta armoraciae
augcagcauuuucaaaagcugucgaaauauuaaaaaugacacggacaauucaaaacaacgaugaaaaggaggagaugauccaaucggcucugcagauuugcaaaucaaucggccccacuauuaauauaacugauauaugcaaggaauucgcuaaucucaaagcguauaaagcuguuacggaauugugugcgcauuucggcaagaaaaucgauccggauaaaauagcagaaaguuacuauaacgcggaagacaacaguggugaccaagaaggguacaauuauuaucaaagaagguuggaaauuuaucgucauauuuuaaauauguuggaucaauuauacaacgaacaaaaucaaacgcaagucguuaguagagauccagcauacucaguuaaucagaccauauuacuggaugguguggaacagucucaaguaggauaugugaugaagcaaguaauaaaagacguuauggaaacgcccgaugaaauuaugcacuucgcccuuuacgauuggcuaguauucaagaacaugacuggagauuugauaaacauccaaaauccgucuuuggaaacguauuugaaacgaacauccacccagaaccccaacaacaucgaggccaugaauuuguuauggaaauacuaugaaaguuguaacaaccacgcggccgcugccaaaauuuugaacaaccucgccucaaggacuggcauaaacguuccuuugaaagagagacugucuuaccuggcgagagcuaucaugugcaugcgaagcgauaaaauagguuaugcgccguau

SEQ ID NO: 4174 - RNA, 792 nt, Phyllotreta armoraciae
ucuuaggcaccucguuaguagcccaaaguuuucgacaacaagcugaaaucagauuucaaauuugccgcaauuuguugcuccuaugcaacuucuuggugauggacaggacguugaacgggggcguuuuggaagggguucgaucggucuguaugccggauauugucguuuuaacccaagccaguuucgucgugcucuggcuaagcggcuugacgauguucgaaagugacucgauucgggauucuucaaugagcacgcugaauccguuaaaauuaacgcccguuuacaaucuguugccguucacucguugcacgucuuuauuggaaguguuuauaucuucaucgggcguucaagaugccaggaaaucguucgcuagagucucuugcaaagacgaagccuuggcucguuggcauuggucucuguugcccuacgugaaucacaucaggcaucuuauuuggcccauaagcggguguacgguguucgaggaauggcucuuaucgaguggccagcacguguggcugcagcaguauguucgguuacucagcaauuggugcgaauggaacguuuguacacgaaacuucuuauuggccucgucguuucugacuuccggcgaauuuuacaaggccgaagagcucuucgaaaccgcgucgaaaggcguuuuuaccgacacguuuuugaaaaacagaaucaaaagugucgaugaaaauaauauuagaaccacuauucauuauuauuuaaaggugauccaauuauucgaguuguguaacgcuagaagucaugugauuaauguggcca

SEQ ID NO: 4175 - RNA, 686 nt, Phyllotreta armoraciae
ugcucuccguugauguuaaagcgcuacaaagccaagaagacagcgaagcugguguauuagaacagcugaaaucacaagugugcgauaacguagcuuuauaugcccaaaaguacgaugaagaauuccagccguacuugccucaguucguuacggacguuuggagcuuacuagucgcuacaaauuuacagcccaaauacgauuuguugguuucgaacgcccugcaauuccuuucgucuguggccgaacguucgcaguacaggaaccucuucgaggacgauaacguacugagcagcauaugcgagaaaguuauuauaccaaacauggaauucagaacuuccgaugaggaauuguucgaagacaacccggaagaguacacgagaagggacaucgaaggcuccgauaucgacacgcgcagacgagccgccugcgauuuggucaacacauugagucagaacuucgagcagagaaucauagaaauauucgggcguuauuuacaagugaugcuggcgaaguacgcggagaauccgaagcaguauuggcgcagcaaagacgccgccuuguacuuaguaacgucucuaguuagcaggggcucuacucagaagcacggggucacgcaaaccagccaguugguggacauuacgcaguucugucggcagcacauuuugcccgaauuagaacgaccugau

SEQ ID NO: 4176 - RNA, 450 nt, Phyllotreta armoraciae
cgagugcauagaggaauugaaagaagauuuagaauggaagaugauuuacguagguuccgcugaaaccgaagaacacgaucaaaucuuagacucuguguuuguaggaccuauuccagaagguaaacacauguucgucuuucaggccgauccuccgaacgucucccguauaccugaaaaugaugccauugguguaacaguuguucugcucacuugcuccuacaagagucaagaauuuauucguguagguuacuuuauaaauaacgaauacagcgauccggaaaugagggaaaauuugcccagcccaccucaguucgauaagguaauuagaaauauauuggcgucagagccaagggugacgagguuuaaaaucaauugggaagaaucaaguggcacucaggaaaacggaaccacaauugccgaagcacccgcuaaccaaacaaccgaaacuuc

SEQ ID NO: 4177 - RNA, 657 nt, Phyllotreta armoraciae
cagcaacaacaaagucuaccuacuacuaacucacaagugccuccucuagcuccaaugggagguucuacuccaacacuuggucuagguuuaggccaugcuauguccaugccacauacgaaguauguaacuggauuuucacugccuaucaguucuaugacuccucaaacaccacaacauacaaugaugaguccuaugguaaauguagguggaacugguaccacuaguuccgguguaacgccuacguuaggucccucuacaccuucaccaaugacuccuaugacaccacacucggcagauccuggaaucguuccacaauuacaaaacaucgucucaacaguaaacuugagcuguaaauuagauuuaaagaaaauugccuugcaugcgagaaaugccgaauauaauccuaaacguuuugcugcugugauuaugagaauacgagagccgagaacgacagcuuugauauuuucgucggguaaaaugguguguacgggugcgaaaagugaggaagacucgaggcuagcugcgagaaaguaugcucgaauuauacaaaaauugggauucccugcgaaauuuuuggauuucaaaauacagaauauggugggaaguugugauguuaaauuuccaauacgauuggaaggauugguucugacucacagu

SEQ ID NO: 4178 - RNA, 425 nt, Phyllotreta armoraciae
aagucccuuuucaaagcucauaaaauggcugcaauucguuccaugucucgccuguuauucuccagaucauuacaaacuacuguaaaaagggguuacgcugaucaaaugagcuucacuuuugcugcuggaaaucaggucuucuaugacgcaaaaucuauaaaacaaguggauguuccuucuuucuccgguagcuucgguauccucccagcucauguucccacucuugcuguucugaaaccuggaguaguuacuguuuacgaagacggcggugcagucaagaaaauuuuuguauccagugguacggucacuguuaaugacgauucaucaguucaaaucuuagcugaagaggcccacccaguagaaaauuuagauguuagugcggccagagaucuucuuaacaaagcacaaagucaauugucaucggc

SEQ ID NO: 4179 - RNA, 693 nt, Phyllotreta armoraciae
cuuuugugaacuuccugagcagaaaaacggacuuuuucacgggcggaaaggaaggagaaugggaaaagcuaguauugaauacguucaagaaauacgagaagucgagcagggaacaacacgcugccgaauugaaagagaaacucgagcaggaagcgcguaggaaggcgaaaaaagaggccgaaucggccaaacaggcucaaauaaccgaauuaacggacgaacaagcggagaaacuacaagccgaacucaacgcuaaaaagucccccucaucggcagccccuucgaauagcucaaauacuccuucgacuucgaagaucgaagaagacgaagacgaguccgagaaggguaaauuauuaccgaacaaaggaaacggcugcgauuuagaaaaauacaauuggacacagacgcuuagugauauagagcugcgcgugccgcucgaaugcgauuucagaguaaagcaaaaggaucucacggugaacauaacuaaaaagcaccucaccugcggccugaaaggccguccgcccaucaucgacgacgauuuccagcacgagaucaagcuggaagaguccaauugggucaucgaggacgggaaaucgcugcucuucgccauagagaaggugaacaaaaugaauugguggagcaaaaucgucaaguccgauccggagauuagcaccaagaaaaucaauccggagc

SEQ ID NO: 4180 - RNA, 336 nt, Phyllotreta armoraciae
gcgauagagaaagguggauuugcguuuauccagcguacauuaauugcaaaaaaaccauagcccaaggcaggaaauuaaacaaagaaaaaugcguggagaaccccacucaucaagagaucagagacguuuuggucgcagcagguuugaagguuggcguagaaaauaaauuguacagcagggaacgaagcaaagaauuguuguaucgaggacgaauuagaguucaauugaaaaacgacgaugguacacugugcaauccaaauuuugcuaccagagauagcauaaugcuccauuugggagacaugauuccuaaauuaaaaaguagacaaaacaagggca

SEQ ID NO: 4181 - RNA, 776 nt, Phyllotreta armoraciae
aacaagcuuggcaaacuuacauuaauuucgaacugagauacaaagaaauugauagagccaggcaaauauacgaaagauuuguuauaacgcauccggaaguaaaacauuggauuaaauaugcccguuucgaagaaaaucaugguuuuauucauucugcuagacagauuuaugaaagagcuguacaguuuuauggagacgaucauuuggacgaaaagcuuuacauagcuuucgccaaauucgaagaaaaccaaaaagagcacgauagagcgagaguuaucuacaaguaugcucuagaacacauuccaaaggaugaaacgaaggaacuguauaaggcuuauaccauccaugaaaagaaauauggagacagaagcgguaucgaggaaguuauaaugucuaaaagaaaacugcaauacgaacaagaaauacuccaaaaucccaccaauuaugaugcuugguucgauuaucucagauugguagaaggugaagcagauuuggaaacaacccgagaaaccuacgagagagccaucgcaaacauaccuccaucaaaaaacaaacaauacuggagaagauacauuuauuuauggaucaauuaugcuuuauucgaagaacuugaugcaaaagauuaugaacgaacuagacagguuuauaaagcuugccuggaaauccugccgcacaaaacauucacauuuuccaaaauuuggcugcucuaugcgcaguucgaagugcgacagaaaaauuuaaaagcagcccguaaaauucuaggcauguccauagga

SEQ ID NO: 4182 - RNA, 682 nt, Phyllotreta armoraciae
gacgaucauauggaaggcuuucucgccggcuacugucaauacuggaagaggaaccgaauucgaaggagcuguuaucgccuuguuccacuugcucaccaccagacaggauaagauuagaggauuacgagaggcuuucuaccgucagaaucuuccuaauuugaugaaccuccuagcaacaguuuuaguguuugcuauaguaauauacuuccaagguuuuagagucgauuugcccauuaagagugccagauaccguggccagcauucgagcuaucccaucaaacuuuucuacacuucuaacauuccgaucauuuugcaaucugcuuugguauccaacuuguauguuauaucccagauguuggccguuaaauuucaaggcaacuucuucaucaaucucuuaggggugugggcugacguuggaggcggcggcccggcuaggucuuacccaaucggcgguuugugcuauuacuugucuccgcccgaaagcguaagccacauuuuggaagaucccguccacgcuguuauguacauuauuuucauguuggguucuugcgcuuucuucucgaaaacguggaucgaaguauccggcaguucggcuaaggacguugccaaacaacuuaaagagcaacagauggugaugaggggucacagagaccauucuaugauacacgaacucaaccgauac

SEQ ID NO: 4183 - RNA, 342 nt, Phyllotreta armoraciae
gcaggacaaguuauuaaggcuuucuacgacguuguauguaggaaaccuaucauuuuacaccacagaagaacaaauuuaugaauuauuuucuaaaugcggcgacauuagacgaaucgugaugggucuggacaaguauaagaaaacaccuuguggguuuuguuucaucgaguauuacacucgcaaugaugcggagaauuguuuaagguauauuaacgguaccagauuggacgauagaauaguacguacagacugggaugcggguuuuauagaaggcagacaauacggaaggggaaaaaccggugggcagguaagggaugaauacagaacugauuuugacuccgg

SEQ ID NO: 4184 - RNA, 665 nt, Phyllotreta armoraciae
aauuuaaccaccaucggucagaucggcucuuauucgacggccaaagaauggacuagagguaaaaaagcacuguuaggaacauuagggauguuagcaggcggcacgggugccguauuaauugcucucgaccaauccguuaaagcaucggaacuagaacugcacccgccgaagaacaucuggagccacagcggaauauucagcucguuggaccacgcuagcguccgaagggguuucgaaguguacaaacaagucugcgccgccugccacucguugcguuucguagccuaccguaaccuaguaggaguaucccacacggagcucgaagcgaaggccgaagccgaggaacagaugauccaagacgggccgaacgauguaggagaaauguuuaugcgucccggcaaguuaucggacuacauccccagcccguaccccaacgaggaggcugcccgugcggccaacaauggcgcuuacccgcccgauuugagcuacauuacagcugcgagacacggagccgaagauuauauauucgcgcuuuugacggguuacugcgaggcuccggcagguguggugcucagagaagggcaauauuacaauccguauuuccccggaggugccauuucgauggcucaggcuuuguauaacgagacgauugaauacggagaugg

SEQ ID NO: 4185 - RNA, 698 nt, Phyllotreta armoraciae
ucaucuucuguuaucagccggaauggacugucguauuaaaauuugggaggucuacaaugaaagacggugcauaaggaccuacuaugggcaucgacaagcuguuagggacaucaauuucaauaauuccggaaagcauuuucuuucugccgguuacgacagguauaucaaacugugggauacggaaacaggucagguuuugucucgcuucaccagcagaaaaauacccuauugcguuaaauuuaacccugauaagaacaaacaacauuuguuuguggccgguacaucggauaagaagauaauuuguugggauacgaggucaggggauaucgugcaggaguacgauaggcauuugggugcugucaauaguauuacauuuguggaugaaaaucgacgauucgugaccacaucagacgauaaaucguugagaguaugggaaugggacauucccguugauaugaaauacauugcugauccuacaaugcacaguaugccuucaguaacuccagcaccaaacgguaaaugguuagcuugucaaaguauggacaacaaaguggucauauucucuuccaugaauagauuuaagauuaaucguaaaaagacguucagcggucauaugguggccgguuaugcaugcuccuuggacuuuucgcccgacaugaguuaccuaacaucuggagaugccgaugguaaaguuuaca

SEQ ID NO: 4186 - RNA, 655 nt, Phyllotreta armoraciae
caaccccuuauucgaaaagcgacccaggaauuucggaauaggccaagacauccaacccccgagggacuugucgagguucgugaaauggcccaaauacauccguauccaaaggcagaaagccgucuugcagaaacgcuugaaaguuccgccgccgaucaaccaguucucccaaaccaucgacaaacaaacggccacucaauuauucaaaguauuggagaaauaccgaccggaaaccgccuugcagaaaaagaaccgacugaaggccaaagccgaagcuaaaguggccaagaaggaagaggccccgacuaaaagacccaacacuuugagagccgguacuaacacaguuaccaaauuggucgaacagaaaaaagcccaauuagucgucaucgcacacgacguagacccuauugaauugguacucuuccuucccgcgcuuugcagaaaaaugggaguccccuacugcauagucaaagguaaagccaggcuaggguugcucguuaggcguaaaacuugcgcgacugucgcucuuacgcaagucgauuccggagacagguccaacuucaacaaacucuuggagguuaucaagaccaacuucaacgaccgugccgaugaaaucaggagacacuggggaggcgguauccucgguucgaaauca

SEQ ID NO: 4187 - RNA, 697 nt, Phyllotreta armoraciae
cuuuucgaaaagcacaucgacuucauaaaggaauacggucaaaaggaaaacaacuuugaauaugcaaugaccgacuauuugaggauauccggcauguauuggggccucacggcucucgaguugaugaaugccucgccuccgcacacuauagaagagauuucagauuacaucaaacauugucaagaccccgaaagcgguggaauaagcucuugccugaaccacgacccucacauacuccacaccuugagcgccguccagauacugugcauguacgacaauuuaaaagccaucgacguggagggcgucgugaaauacgugaaaaaccuacaauuaccugaugguagcuucacgggagacaaauggggcgaaguagacacgagauucucauucugcgccgucgccacccugucgcucuugaacagaauggacgcuauugacguuaauaaagcagucgauuucguagcuucguguaaaaacuucgacggaggcuucggcucgaggccucuuuccgaaagccacgccgguuuaauauacugcugcuuaggauuuuugucuguuaccaauagauuggauauuguggaucgagacaugcuggcuugguggcugugcgaacgacaacuaccuucgggcgguuugaacgggcguccggagaagcugcccgacgucugcuacuccuggugggugcuuucuucucuaa

SEQ ID NO: 4188 - RNA, 668 nt, Phyllotreta armoraciae
accaaggcuaacuucgauuugaccaccgaaagaaauuacauuauggagguuguuugcgaagcuacacaaucgccggugucgcaaauuaagguggccgcuuugcaauguuuagugaaaauaaugucgcuguauuaucaacacauggagcccuacauggcucccgcuuuguuucccauaacguuagaggccaugaaauccgagaacgaugccgucgcccugcaagguauagaauuuuggucaaacguaagcgacgaagaagucgauuuggccaucgaagauacggaagcugccgaagcuggaagacccccuacgagaguaucgaggcauuaugcgaaaggugcucugcaguacauaauaccgauuauucuucaaaaacuaacgaaacaagaggaauuggacgacgaggacgauuggaaucccaguaaagcggccggcguuugccucaugcuucuugccacuugcugcgaagacgaaaucguuccgcaugugcugccuuuuauuaaagaaaauaucaagucagacaauuggcguuuccgagacgcuuccuugauggcauucgguucuauucugggcggauuggaaccaaacacucugagaccgcucguugaacaagcaaugccgacuuugauugaauuaauguacgacaacagcgucauugugagagauac

SEQ ID NO: 4189 - RNA, 775 nt, Phyllotreta armoraciae
caucgaauaccuuacgugguucgugcaacgcaucaggccucugauggaucucgauagcgauuuacaggaacaagucgaucaggcgauggguaauugggauaacggaacggugcccggguggccgaaagaaacaggcucggcuuuggccaacgugggcgcccauuuggaccuaucggccuucuccaguugggaggaauuggcuucguugggcuuggaucguuuaaaaucagcccucauggcgcuaggauugaaaugcggaggaacguuagaggagcgagcccaaagguuguucucgacgaaaggcaaagguucucuggacccuucgcucaugacgaagaacagcaagaaccgagugacgaaggagaaggaagcgcucaggcaaagagaacuggccacguuagaagcgcaaauuuacagauuggccgaucuggugucagcccaacgagcagccaccaaagagaacgugcagaggaaacaagcccguacagacggcgaacgggacgacagcgagaacgaagaaagcgaagaagagagccccgacgaggccgacgacgacgugcccuacaaccccaagaaccucccgcucgguugggacgguaaacccauuccguauuggcuguacaaauugcacggguugaauauaagcuacaauugcgagauaugcgguaacuacguguacaaaggccccaaggcuuuucaaaggcauuuugccgaauggagacacgcgcacggaaugcgguguuugggcauaccgaauacggcucauuucgcuaau

SEQ ID NO: 4190 - RNA, 562 nt, Phyllotreta armoraciae
guuuaucggcaccuucaaagcuuucgacaagcauaugaacaugauacucggcgacugcgaagaauuccgaaaaauuaaacccaaaaacucuaaagucgaacgagaagaaaaacggguauuaggauuuguauugcugagaggcgagagcauagucucgcugaccguagaagggccuccaccaccagaagagggacuucccagaguacccauucccggagcagcccaagggccagguauaggaagagcagcagguaggggaaugccacccggcauggcuggaguuccaguaggucuccaaggucccgugagaggagucggaggaccgucccagcaaguaaugacaccuacagguagaggacaggucucagcgccgccacaaaugaaccaagcgccuccaaggauggguggcccuccgccuggcaugauggggccuccgcccggcaugaugggcaugccgccccaaaugggcaugggccguggagggcccccuccgaugggcaugaggggucccccgcccgguaugaugagaggcgggccgcccggaccgccgagaccuuauuaa

SEQ ID NO: 4191 - RNA, 270 nt, Phyllotreta armoraciae
accugcgaauagugacucuauguucuucaauuauaaacaauauuuuucaauggugcuuuuugcaaugguugauagcaauuauuuauuuacauuugucgacauuggcucauauagaaaaucuagugacucuggaauuuucaaaaauuucgcacuauaugaaaaaauguuaaaugguacacugaacauacccacagcaacgcccaucgaaggagauuugguagaauauccauuuguaaucguaggagaugaagccuuuccccuaucugaaaa

SEQ ID NO: 4192 - RNA, 762 nt, Phyllotreta armoraciae; identical to SEQ ID NO: 4168

SEQ ID NO: 4193 - RNA, 721 nt, Phyllotreta nemorum
aagaagaagucgaugcuguugaaaugcacgaaccauauacuuaccucaacgguuugcaaaucaaagaccuagaagacuuagucgaggacaucaaagucuacaaagaacuagaaaggggaaaaaaccuagacuacuggaacgauauaaccguaauaguugaagacgagcuucaaaagcuuagaaaaauagaaaaacaaaacgauuucgacuugggauugaaccgaagggaagggauacaucaaucagucgcuaccgauguaacuucaguauuuaaaggcaaaacagccgcacaauuagcugcgcuagaaaaacaaaucgggaguaaaauuagcagcaaagccgauggaauagacauaggcuacugggaaucucuacugucccaacucaaagcccacauggcaagggccagacuacgggacaggcaucaagauagcuugagaaggaaacugcagguucuaaaagccgaacaagccaucacaggaguagguaaaacucacagcgaaacucauucaaccgauaacgaagaaaccacuauggaaccuaaaccaggcacgucccaggauuccuuggaaacgauggaagaaagcaacgaaaaaagcgaagacgcugcccaugcguggcuaagcgaaugcuuuucggcauaccaagcaggcggguacagccccaaguuuuuaacuccggacgauaccgagcccggcacgauuguagucucggaggaaga

SEQ ID NO: 4194 - RNA, 651 nt, Phyllotreta nemorum
gcgaaguaggccaaguauuauccuucaagcuggucuuugaccgcgaaacgggcaagcccaaaggcuauggguucugcgaauaccgagaccaagagaccgcccucagcgccaugaggaauuugaacgguuacgaaauaggcggcaggaauuuacgcgucgacaacgccuguacggaaaagucccgcauggaaaugcaaaaccuccucaaccagccgcccaucgagaaucccuacggagaaccuauucaagccgaaaaggcgcccgaggccaucaguaaagccguggcuucgcugccucccgagcagauguuugaacucaugaagcaaaugaaaacuaccauacaaaauaaucccacagaggcuagacaaauguuauugcagaauccccaguuggcuuacgcucuauuacaagcucaagucgucaugaagauaaucgauccucacacggcugccagccuacuacacccugucaaucaaguaccggccacucugcugccgggcgauaagaacgugaccguacaaguaccgaucggcaaccaguaccgggaaccuccggcuccgguacaagcaccucgacaggaauaccagccgguaccgccgcccgccguccauccaaaucacguucaacaacccguuuuuaccggucaagaug

SEQ ID NO: 4195 - RNA, 661 nt, Phyllotreta nemorum
gaagcaacugacagaagagaaauucauuguaaaggcgacaaacgguccccguuauguaguuggcugccgucgucaguuggauaaggccaaguuaaaggccggcacaagaguagcucucgacaugaccaccuuaaccauaaugcgguacuuaccgagagaagucgauccuuuaguguacaacaugagccacgaagaucccggagaugucacuuauuccgccauagguggacuuuccgagcagauuagggaacuacgagaagucaucgaauugccucucaugaauccugaauuguuuaugcgagugggcauuacaccaccgaaagguugucuucucuacgggccuccuggaacugguaaaacucugcuagccagagccguagcuucucaauuggacgcgaacuuuuuaaaggucguaucgagugcuauuguagauaaauacauaggugaaucugcuaggcuuauuagagagauguuuaacuacgccaaagaccaucagccuugcaucauuuuuauggaugaaauagaugcuauagguggucguagguuuuccgaggguacaucggcugacagagaaauucaaaggacacuuauggagcugcugaaucaaauggacggauuugacucguuaggacaaguaaaaaugauuauggcgaccaauagg

SEQ ID NO: 4196 - RNA, 654 nt, Phyllotreta nemorum
guaucaagucgaguaugccauggaggccauaucccaugcaggaacgugucuaggcauccuggcaaacgacggaauccuucuugccgcagaaaggcguaacaccaacaagcuucuggacgaaguuuuuauuucugagaaaauauacaaacuuaaugaugauaugguuugcaguguggcaggaauuaccucugacgcuaauguucuaacuaacgaauugcguuugaucgggcaaagguacuuguaucaguauggggaaucgauucccugcgaacaauuaguuucgugguugugcgauguaaaacaagcuuauacucaguacggaggaaaaaggccuuuugguguaucgaucuuguacaugggcugggauaagcauuauggguaucaauuguaccaauccgaucccaguggaaauuauuccgguuggaaagcgacuugcauaggaaacaacaguucugcugccauuucgaguuugaaacaggaauacaaggaaggcgauaugauguugaaggaugcgaaaaguuuggcuguaaaaguucuggcaaaaacguuagauauggcuaaauugacgucugaaaaaguggaaauggcuacgcugacacguagaaaugauaaaaccaucauaaauauauugaauagcaaagaaguggaagaacu

SEQ ID NO: 4197 - RNA, 733 nt, Phyllotreta nemorum
uacuucacauuugcuccgaacauuacgauggcgacagcucagacaagaguucuaaggauaaggacaaaaaagacgcuucagagaaggagaaagaucuuuccucgagacaagcaguggccgugcuggguauagcuuugaucagcaugggugaagacauugguagcgaaauggccuaccguaccuucgggcauuugcugcgcuacugcgaacccguaauuagaagagcgguaccguuagcuuuaggacucauuucaguaucgaauccuaaguugagcauacucgauacuuugaguaaauucucgcacgacagugaugcugaaguagcccauaacgccauauuugccauggguuuagucggagcugguacgaauaacgcaagauuggccgcgauguugaggcaauuggcgcaguaucacgcuaaagauccuaacaaccuauuuaugguucguauugcucaaggucuuacgcauuuagguaaaggaacauugacgcugaguccuuaucacagcgaccgucagcucaugagcccuguagcaguagcaggauuaauggcuacccuuguuggauuuuuggauguuaaaaauauuauuuugggaagaucgcauuaucuccuauacacucuagcagcggcuaugcaaccuaggaugcuugugacauuugaugaagauuugaauccauugccggugccugugagagugggauuggcuguagauguaguuggucaagcugguaa

SEQ ID NO: 4198 - RNA, 654 nt, Phyllotreta nemorum
acauaaacguccuucaagcugauucgacucaagcuuucgcagguccuuacauaaacgcgaccuggucgucgaauucgauggaggacggacggcaaucuagucaagagguacuagugaaagagugcguuaauuguggugcuagcguuacaccacuuuggcguagagacgguacggggcauuaucuauguaacgcgugugguuuauaccacaaaauuaauggggugcacagaccgccgacuaagccaaccaaaaaaccacaggcgaccggaaauagaagaaacggcguaacgugcgcaaauugcaaaacuaacaacacuacacuuuggagaagaaacaaccaaggcgagccagucuguaacgcuugcgggcuuuacuauaaauuacauaauguuaacaggccgaucaguaugaaaaaagaagguauccaaacgcgcaaaagaaggcccaaaaacucuucgguuggaaacccugccagugcugcaggucaaguaagaauggggcuucccucuuaucaauaucaagauauugaaguacagcaggaucaguaccaauuaccagugagcguuuauucucaaagaccacaaguaucuuaucgacauuacggggcagaaaauauuggaacuauaaaugcacaaccacugcagccaauuauua

SEQ ID NO: 4199 - RNA, 710 nt, Phyllotreta nemorum
aaagugagcuaugagcacaaggagaucgccuuggauaaucugcugcagcuguggagggugccgggguuccacgcggagcucuacgugaacuacgauugcgacauguacugcgcgaauuuguacgaggagcuuacggagcugcuggccgaacgggcuguuucuaaugugggaguguaucacucucauuugcugucgcuugaugggcuuuugauuauaauugacgggauagggaagagauuugacgaagcgaaggaucgaucagauaccgaugagauuagcaguuauacuggggaaaauacgagaguuaaagguuguguuagagcuccugauaagaagguuuuggcugccaagaaagggauuaaaaaaugguugccccaagguacggaguauuucaaucagaagccgaagaaagguauacaguuccugcaggagcacggcguuuugaagcaggagcuggacgucgaggagaucgccagauuucugagggagaauccugcguugaacaaggcgaugaucggggaguauaucagcaaucgagggaauuugaagauacuggaggcuuuugugggcacguucgauuucacagggauacggaucgacgaggcgcucagagcguuuuuggagacguuucgauugccuggugaggcuccgacgauuucgcugauccuugaacauuucgccgagcauuggcauaaaagcaacggagaacc

SEQ ID NO: 4200 - RNA, 525 nt, Phyllotreta nemorum
gucgauuuuggcguacaacgggggcgcgaugguggccaugaagggcgagaacugcguagccauagcggccgaccgccgguucggcauacaggcccaaaccgucgccaccaacuucgagaaagucuucgaaaugggcccccaccucuucgucggccuccccggccucgccaccgacacccaaacggucauggagaagcucagguuccgcaagaaccuguacgaguugaaagagaaccgccggaucucccccaagguguucgcggccaugauaucgaacauguuguacgagaagagguucgggccguuuuucguggaacccgugguggccgggcuggcgcccgacacguucgagccuuacauaugcaacauggauuugaucgguuguauuaacgagcccagcgauuucgucgugggcggcacggcguccgcucagcuguacggaaugugcgagucgcugugggagcccaaucucgcgccggaggaccuguucgaaaccauaucgcaggcuuugauuaacgcuuucga

SEQ ID NO: 4201 - RNA, 756 nt, Phyllotreta nemorum
ugcucgaaaaaggagaugaauuuaaagauuuuaggaugaaagucuccgaucuaauaaaggacgucgucuuuauaguagguagcagcaguugcuucagacaaauguuuaucaauuugcaaaccccugguguaacgugggaugccagcgaagccgcucucuuugugaugcaggcuguagccaaaaacguucuacccacggaaaacgaaguuguuccuaaagucgucgaagcaauacugaacauacccagcagcgcacacgucgcugugaaguacacaucuguucuucuacugggcgaacuggccgaauggauagaaaaacacccggacgcuuuggaucccguccugaauuuccuaguuugcugccuccggagcggcgccgaaggaggaggcgucgccacggcggcggcggcggcgcugcagaacgugugcacuugcuguggggcucacaugggcaggcacguucccauucuguuacaguuacuucaacagucggauucguucgguaucggcaacacggcgaucauaggauuauugaagggcgucgcgucgguggugagcugcggcauuggcagcggcgccgaaacggcuuccgccguacgggaauugugcuccuugcaauugucgccgcugugcaguuugaucgaaaacggcguucgacccguuaagggaacucuaacggauccggugcugugguuggaucgauugaguucaguuuugagauacgucaaugucaauguaguugaaggggaaauccauc

SEQ ID NO: 4202 - RNA, 784 nt, Phyllotreta nemorum
cgaugaagcagaaacgaaaacugcgaauuuuuauuuccaacacuuucuacccggcgaaagagccccaacccgagggccccgacggcccuugccaagaaggcacgguagccuccugggagcucagagucgaaggcaggcugcucgaagacuccaagaacgauccgaacaaagucaaacgcaaauucuccucguucuucaagucccucgucaucgagcucgacaaagaacucuacggccccgacaaccacuuggucgaauggcaccgaacgcugaccacccaagaaaccgacgguuuccaagucaaaagacccggcgacaagaacgugaggugcaccauccugcugcuccucgacuaccagccgcugcaguucaagcucgacccgagacuggcccgauuacucgggguacacacccaaaccagaccggucauuauuucggccuuguggcaguacaucaagacucacaggcugcaagauggccacgagcgcgaguacaucaucugcgacaaauaccucgagcagaucuucaacuguacucgaaugaaguucgccgaaaucccccaacgguugaacccccugcugcacccgcccgaucccaucgucauaaaucacguuauaucggucgaaggcggcgcugagagcaagcaaacggccugcuacgauaucgacgucgaaguggacgauacucugaagacccagaugaauaauuuccuguugagcacggccagccagcaggagauucagggauuggacgcgaagauucacgagacugucgacacgauaaa

SEQ ID NO: 4203 - RNA, 685 nt, Phyllotreta nemorum
aaguucagccgauuaccaauaccaaauguuaaggugcaacguagacuuacugagaauuauucaacuagguuuaacguucuuagacgauaauggcaaaacaccgggaggaguuuauaccaccuggcaauucaauuuuaaauucaaccuucaagaagacauguacgcacaagauagcauugauuugcugcagaauuccgggauccaauucaagaagcacgaagaugaagguaucgaaccgcuagaauuugccgaauuacuaauguccucuggaaucguucuuauggaaaauaucaaaugguuaucguuccauuccggcuacgauuucggcuauuuaauuaaguuacuaaccgacaacaaucucccgcaagacgaaaccgaauucuucgaucuguugaaauuguacuuuccuaccauauacgacguaaaguauuuaaugaaaucguguaaaaauuuaaaagguggucuucaagagguggcggaacaacuggaauuggaaaggaucgggccucaacaucaagcuggaucugacucgcuuuugaccuucgaucuauugaaauuguacuuuccuaccauauacgacguaaaguauuuaaugaaaucguguaaaaauuuaaaagguggucuucaagagguagcggaacaacuggaauuggaaaggaucgggccucaacaucaagcuggaucu

SEQ ID NO: 4204 - RNA, 678 nt, Phyllotreta nemorum
uuacggacagcauguuguuagcgguacacccggaagaguuuacgauaugauucguagaagagcuuugaggacuagaucggugaaaaugcugguccuggaugaagccgaugaaauguuaaauaaaggguuuaaagaacaaaucuacgauguguacagauuccuuccacccuccacucaagugguuuuaauaucagcuaccuuaccccacgaaauucuggaaauaacauccaaauucaugaccgaucccaucaggauccuaguaaaacgugaugaacugacgcuggagggaaucaagcaguuuuucgucgccguggaaagggaagaauggaaauucgacacgcucugcgaccucuacgacacccugaccaucacgcaagccgucauuuucugcaacacgaagagaaaggucgauuggcugaccgaaaagaugcgagaaaacaacuucaccgugagcuccaugcacggggacaugccccagaaggagcgcgacaacaucaugaaagaguucaggucgggccaaagcagaguuuugaucaccaccgacguuugggccagggguaucgacguacagcagguuucuuugguuaucaauuacgauuugccgaacaaucgugaauuguauauccaucgaaucggucgguccggucgauucggcaggaagggugucgcuaucaauuu

SEQ ID NO: 4205 - RNA, 678 nt, Phyllotreta nemorum
uacuguggaagauaccgaguugauugaggguaucguguucucgcagaaaucagccaauguaucaggccccaagaaaaucgaaaaagccaagauugguuucauccaauucugcauuucucccccgaaaaccgauauggaccacaaugucauaguauccgauuacgcugcgauggaucgaguccugaaggaagagcgagcguauaucuugaacauuguuaaacaaaucaagaaagccgguuguaacguacuacugguucagaaaucgauucucagagaugccguauccgaccuggcacuccacuuuuuggauaaaauaaagugcauggucaucaaggaugucgagcgagaagacgucgaguuugugugcaaaucguuggguugcagaccgaucgcuucccucgaucauuucaccgccgaaaaucuaguaacagccgauuuggucgaagaagucggggugggcgguaaccgaauggucaaaaucacagguauucaaaacgcugggcguacugugacccugcucguaagaggcucgaauaaacuaguauuagaggaggccgagaggucccugcaugacgcucuuugcgucauucggugucuuguucgcaagaaggcgcuuaucgcaggcggcggggcacccgagauugaaguugcucucaagcuggcugcuauggcuaauaa

SEQ ID NO: 4206 - RNA, 779 nt, Phyllotreta nemorum
aucaguaccguugguuaucggucaauuccuggaagcaguugaucagaauaccggcauuguuggaucaacuacaggcucuaauuacuacguucgcauucucuccaccaucgacagggaguuguugaaaccguccgcuagcguagcccuacacaagcacagcaaugcccugguggacguguuaccccccgaagcggacuccucuaucagcaugcuucaggccgaugagaaaccggacgugcaguacagcgauaucggagguauggauaugcaaaagcaggaaauccgagaggccguggaacuuccgcugacccacuucgagcuguacaaacaaauaggcauagacccgccgagaggcgugcugauguacggcccgcccgguugcggcaagaccauguuagccaaagccguggcucaucacaccacugccgccuucauucgaguggucgguucggaguucgugcagaaguaccugggcgaggggccucguauggugagagacguguuccgcuuggccaaggaaaacucgccggccaucauauucaucgacgaaaucgacgccauagcgacgaagcgguucgacgcccaaacgggggcggaccgcgaggugcagcggauccugcuggaguugcugaaccaaauggacggguucgaucagaccaccaacgugaaggugaucauggcgacgaaucgggccgauacguuggaucccgcgcugcugaggccgggucguuuggauaggaagaucgaguuuccguugcccgauagaagacagaaacggu

SEQ ID NO: 4207 - RNA, 367 nt, Phyllotreta nemorum
cggugaccauaaaaaccaugcuggaggaccucggcauggacgaggaagaggaagaggucgugccguugcccaacguaaacucagccauccuacguaaagugauccagugggccaccuaccacaaagacgacccgccgccgcccgaagacgacgacaacaaggagaagcgaacggacgacauauccucgugggacgcggauuuccucaaggucgaccaaggcacccuguucgagcugauccuggccgcgaacuaucucgacaucaaaggccugcuggaugugaccugcaagaccguggccaacaugauuaagggcaaagcgccggaggagauacggaaaacguucaauaucaaaaacgauuucacgcc

SEQ ID NO: 4208 - RNA, 727 nt, Phyllotreta nemorum
ugugugauaaggcgaaagaaauacuguccaaagaaucaaaugugcaggagguuaaaugucccgucaccgucugcggagauguucacggacaauuucacgaucugauggaauuauuuaggauaggcggucgaaguccagauacgaauuaccuuuucaugggcgauuacgucgaucguggauauuauucggucgagacuguuacucuguugguggcucugaaagucagguauaaagaaagaaucacgauuuugagaggcaaccacgaaucgaggcaaaucacucaaguauacgguuucuacgacgagugccugcggaaauacggcaacgccaacguuuggaaauucuucaccgaucuguucgacuaccugccucugacggcgcucgucgacagccaaauauucuguuugcacggcggccucagucccagcaucgacaccuuggaccacauucgagcccuagaucguuuacaagagguaccucaugaagguccgaugugcgaucuucuguggucggaucccgacgaucgcggaggcuggggcauuucuccucgcggcgccgguuauacguuuggacaggauauaucggaaacguucaaccacagcaacggucugacguuggucucgcgcgcccaucaguuggucauggagggguacaauuggugucacgacagaaacguggugacgaucuucagugcucccaauuacugcuauagauguggcaaucaggc

SEQ ID NO: 4209 - RNA, 703 nt, Phyllotreta nemorum
uauugagaacgugaaagccaaaauccaagacaaagaggguauucccccagaucagcaacgucuuaucuuugccggaaagcagcuagaagauggacgaaccuuguccgacuacaauauucagaaagaaucuacucuacacuugguacuucgucucagaggaggaaugcaaauauucgugaaaacucucacugguaaaacuauuacucuugaaguugaaccaucugauaccauugagaacgugaaggccaaaauucaagacaaagaggguauucccccagaucagcaacgucuuaucuuugcuggaaagcaacuggaagauggaagaaccuuaucugacuacaauauucaaaaagaaucuacucuacauuugguacuucgucucagaggaggaaugcaaauauucgugaaaacucucacugguaaaacuauuacucucgaaguugaaccaucugauacuauugagaacgugaaggccaaaauccaagauaaagagggaaucccaccagaucagcagcgucucaucuuugccggaaagcaacuggaagauggaagaaccuuaucugacuacaauauucagaaagaaucuacucuacacuugguacuucgucucagaggaggaaugcaaauauucguaaaaacucucacugguaaaacuaucacccucgaaguugaaccauccgauacuauugaaaacgugaaggcc

SEQ ID NO: 4210 - RNA, 792 nt, Phyllotreta nemorum
cguucaagaaaaccuucucguacgccggcuucgaaaugcagcccaagaucuacaaagacugcaagaucgcccugcugaacaucgagcuggaacugaaagccgaacgggacaacgccgagauccggcugagcagcgucaaggaguaccagaaagucgucgacgccgaguggaacauccucuacaacaaacuccagaaaauccacgaauccggagcgaacgucguccuauccaaacuccccaucggcgacgucgccacgcaguacuucgccgacagggacauguucugcgccggacggguccaagaagaagauaugaagcgaacccucaaggccugcggcggcuccauaaugaccacagccaacgauuugaaagacgaggugcugggccgcugccagcucuucgaagagaaacaaaucggaggcgaacgguacaacuucuucaaaggcugucccaacgccaagaccugcaccauaauccugcgaggaggcgccgagcaguuucuggaggaaaccgagcggucccugcacgacgccaucaugaucguacgcagaacgaucaagaacgacucgguaguagcgggcggaggggcgauagaaauggagcugucgaaguuacucagggacuauucccguacuauugcugguaaagagcagcuccugauaggagccauggcuaaggcgcuggaaauaaucccuaggcagcugugcgacaacgccggguucgaugcuacuaauauauugaacaaguugaggcagaagcaugcucaggguaauucuugguaugggguugaug

SEQ ID NO: 4211 - RNA, 768 nt, Phyllotreta nemorum
gaaggggacgaauacacuacucuaaugacacagugcaaagagggagcccaaagagaaggauuaauguuggauucgaacgaugaacuguacaaaugguucacacagcaaguuaugcgaaauuugcauguaguuuuuacgaugaauccaucaacagauggguuaaaggacagggcugcuacaucuccugcuuuauucaacagauguguuuugaauugguuuggagauuggucagauggagcucuuuuccaggugggaaaagaauuuacgaaccguuuggaucucgacaaacaaaguuggaaauguccagauuucuucccugcuucuugcaaccacauuuccgcuacgcccaaucacagggaagccgucauuaacgccugcguuuacguccaccagacgcuucacaaagccaacggcagauugguaaagagaggaagucgcaccauggccaucacccccaggcacuacuuggauuucauacaccaucucgucaaauuguacaaugaaaaacgguccgauuuggaggagcaacagcuccaucucaacgucgguuugaacaaaaucgccgaaaccguagaacagguggaagagaugcaaaagaguuuggcugugaaaucgcaagaauugcaagcgaaaaacgacgccgccaacgccaagcucagacaaauggugaaagaucagcaagaagccgaaaagaagaagguucaaagucaggaaauccaacagcagcucgcucagcaaacugugcacaucaagcagaagaaauccgaa

SEQ ID NO: 4212 - RNA, 707 nt, Phyllotreta nemorum
aucacuucaauuccaggaccggaauggagagucugaugguggugcccauaucgaaagcuucggccaaccagcgagccgggagggcugggaggguggcggccgggaagugcuucaggcuguacacggccugguccuauaagcacgaguuggaggaagcgaccguuccggagauacagaggaucaauuuggggaaugcaguguugauguugaaggcguuggggaucaacgauuuggugcacuucgauuuucuggacccgccuccgcacgaaacgcucguguuggcucuggagcagcuguacgcuuugggggcucugaaucaucacggggaauugacuaaauuggggaggaggauggcugaguugccgguggaucccaugauggcuaaaaugauauuggcguccgaaaaauacaaguguucugaagaaauagucacgauaggcgccauguugucggugaacggggccauauuuuacagaccgaaagacaagauuauccacgcagacacagccaggaagaauuucaaucaccuggcuggcgaucacuugagccuucugaacguuuacaaucaauggagagacuccgauuacucgcugcaauggugcuacgaaaauuuuauccaacacaggucgaugaaacgagccagagacgucagagagcaacuagucaaucuaaugaccagaguagaaaucgaaauagugucgggaauc

SEQ ID NO: 4213 - RNA, 758 nt, Phyllotreta nemorum
gaaaaccgaagugcuaauggaaaauuucagacgagccauuggccuuagaauuagagaaacgaaggaagucuacgaaggagaagucagcgaacugacaccugucgaaacagaaaauccagcaggagguuacgguaaaacuguuagucacguuguaaucgguuugcggacagccaagggcagcaagcagcugaaacuagaucccagcauuuacgaagcccugcaaaaggagaaaguggaagugggagaugucauuuacauagaagccaccaguggggcuguuaaaagacagggaagaucugaugcguacgcuacagaauucgaucuagaagccgaagaauaugugccgcuucccaagggagaugugcacaagaaaaaggaaguuguacaggauguuacuuugcaugauuuggaugcugcuaaugcaaaaccacaggguggucaagacguguuguccaugauggggcaacuguuaaaaccaaagaaaaccgaaaucacagacaaacucagaaaagaaauaaauaaaaucguggacaaauacauugaucaagguauugcggaauugguaccaggaguauuauucauugacgaaguucacauguuggauauagaaacguuuacauaccuucauagagcuuuggaaagcgcuauagccccuauuguuauuuuugcuacuaauagaggucguugucuuauuagaggaacagaugauguauuuucuccgcauggaauuccauuagaucuucuggauagacugcuga

SEQ ID NO: 4214 - RNA, 677 nt, Phyllotreta nemorum
cuaucauuugggggcucuaccauacgcaguggguaaauuaggcuuaaauuguccaauauacgccacuauaccaguguacaaaaugggucagauguuuauguacgaucucuaccagucucaguacaauaugaaggaauuuuguauuuuuucucuugaugaugucgaugccacuuucgaaaagguuguucagcuaaaauauaaccaaacggucccuuuaaaagguaaaggauacggcauaacuguuacaccucuaccagccggucauaugaucggaggaaccauauggaagauaaugaaaguaggcgaggaagauauuguauacugcaacgauuuuaaccauaaaaaagaaaggcacuugaacgguugcgaacugaagaaacuucaacgaccaucauuacuuauaaccgaugccuuuaaugcaacauaucaacaggccagacgacggacgagagaugaaaaauuaaugacaaauauucuccagacuuuacgaaaccacgggaacguccucauagccguagacacugcuggaagaguacuggaauuggcucacauguuggaucaacuguggagaaacaaggaaucggggcucuuggcuuacucuuuggcuuuuuugaacaacgucaguuacaauguagucgaauuugccaaaucgcaaauagaauggaugagcgauaacc

SEQ ID NO: 4215 - RNA, 652 nt, Phyllotreta nemorum
agaagaugauccuucgaacgcugaugaugguuugagcuccaugcaggauaagacgaaacgcaaaggaggcgaugauaauaggcugcaggacauggaagaagacacuucugaugaagauaaugaugaugaaguugguaaaacuucgacuucgucuucgcucauucaaccgccuuugccgcccauacccgauaaagugcucguuaaaaaauacgaucccaaacaagcugucaaaguauccagacccacaguaggcgacgauuauuuaguaucgccaaucacaggcgagaagauaccggccagcaaaguacaggagcacaugcgcaucggccuacuagacccgagaugggucgaacaaagagacaaacaaauguccgauaaaaugaaucaagacacgguauacgcagccggcagcgccaucgacgccucgcugaagcugcuggccgaacgacguacggacauauucggcgugggcgacgaggagacggccaucggcaagaaaaucggcgaagaggacgugcgaaaggacgagaaggucacgugggacgggcacacgagcagcgucgaggcggcgacgagggccgcccgcgccaacaucaccuuggaagagcaaauacaucagauucauaaggugaaaggccuuuuaccugaugag

SEQ ID NO: 4216 - RNA, 741 nt, Phyllotreta nemorum
aaaggagucuuggauguguccaacaguuuugcagucccuuucgaugaggacgacaaggauaaaucuguaugguuuuuggaccacgacuacuuggaaaacauguacggcauguuuaagaaagugaaugcuagagaacgcgucgucgguugguaccacacgggcccuaaauugcaucaaaaugauauugcgauuaacgaauugauucgaagauacugcccgaauuccgugcuggugauuauugacgcuaaaccuaaagauuuggggcuucccacugaagccuaccaagcgguagaagaaguccacgaugauggcucucccacguccaaaacauuugaacacgucccgagcgaaaucggcgccgaagaagcugaagaggucggcguggagcauuuacugagagauaucaaagauacuacagugggaacuuuaucccagaggaucaccaaucaguuauuaggccuuaaagggcugcauuugcaauugagagauauaagagacuauuugaugcaagugugcgauaauaaauugcccauuaaucaucagaucaucuaucaguugcaggauauuuucaauuuguugcccgauauaaaccaagaugcguucaacaauucguuuuauguuaaaaauaacgaucaaaugcuuguaguuuauuuagcggcucucguucgaucuaucgucgcacugcacaaccuaaucaacaacaaacucaccaacagagacgcggaggaagguaaaaaggaa

SEQ ID NO: 4217 - RNA, 774 nt, Phyllotreta nemorum
agaaauagccagaacccaagacgaagaggugggagauggaaccacuucuguaauaguauuagcuggagaaauguuggccgcugccgaacaguuccuugaacagcaaauucaccccacgaucaucauccgacaauacaggcaggcccuggaagauauggugcaguuucuggaagguccuuugagcgugcccuuggaccgaaacgacaaaaacgccauagcugaagugguuaaagguugcauuggaacgaaguucuugagcaaauggucggauuuggccgucaauaucgcuuuggaugcggugaauaccgucuuauuggaagaaaacggucgaacggagguggauaucaagagauacgccaaagucgaaaagauuccuggugguucgguggaggacuccaagauuuugagaggcguaauguugaacaaagacguuacccaucccaaaaugaagcgacacauuaagaauccgagaaucauccuuuuggauugcgcuuuggaguacaagaaaggagaaucucaaaccaacguugaaauuaguaccgaaaccgauuucaccaaacuccucgaauuggaagaagagcacgucaagcgccaaugcgaagagauuaucgcccucaagccggacguuguguucaccgaaaagggaguauccgauauagcccagcacuuccugcucaaggccggcaucacugccaucaggcgugucagaaaauccgacaacaaccgaaucgcuagagcuugcggcgccgucaucguaaacagaaccgaggaacu

SEQ ID NO: 4218 - RNA, 552 nt, Phyllotreta nemorum
acgccagauuaauccuuacgcugauaauggagggagcgucguagcgauugcaggaaaagauuucgugguuauuggcgccgauacgcgucuuaguuccggcuuuuccauauacacuagaaaccagaacaagcuguucccucuuucugaaacgacuguuuuaggauguucagguuguuggugcgauacuuuaacgcugacucguauuuuaaagucucgcaugcaaauguacuaucaagagcauaacaagaacaugucuacgacagcggcugcucaaauguugucgaccaugcuguauuacaagcgauuuuucccuuauuacauaucgaacauucucguuggauuggauaaugagggaagagguugcgucuacagcuacgaucccguugggcauugcgagaaagccaccuacagagcaggugguucugcaggggcuuugcuucagcccuuauuggacaaucaaauuggacaaaaaaaucugcagaagccuucgcaggaagaucuuacucaggaaaaggccauuucuacgcugaaagauguuuucauauccgcugc

SEQ ID NO: 4219 - RNA, 706 nt, Phyllotreta nemorum
aaaauaaucaugccgccuucggcgcuggaacagcucacuagauuaaacaucaacuaccccauguuauuuaagcuuguuaacaagaagacgagccguacgacucauugugguguuuuggaguucguagccgacgaaggaaaagucuacuuaccauuauggaugaugcacaauuuggugcugaccgagggagauuuaguucaaauggaaagcguaucguugccggucggcacguucucgaaauuccagccguuaaacccggacuuccucgacaucaccaacccgaaagccgugcuggagaauugccugcgguccuuugcuugucugaccaccggcgacgugauagccgucagguacaaucaaaaggcguacgaauugugcguguuggaaaccaagccgggcaacgccaucagcauaaucgaaugcgacaugaacguugaauucgcggccccgguuggcuauaaagagcccgagcaggcuaaaaaagaagaagaaaugucgguggaucccgccgacuugaugccggagccgucgggguucguggcuuuuagaggggcugggaaccgauuggacgggaagaaacggaaggauucgucuucgagcgacgcuccuucggcuaagccggcuuacguucgggggauacccgauuacgauuaucaaauaggcacgcuggacuuuaucaggcguacgauagcgaagccuaaggaaa

SEQ ID NO: 4220 - RNA, 766 nt, Phyllotreta nemorum
cuagagaaaaucgcugagcuguuuccaguuucugcugaaaacaccgagccccuuauuaaagucgcgaugacuacacuagguucgaaaauaauuaacaaaugucacaggcaaauggccgaaauugccgucaauggcguauuagcuguagcggaucucgaacaaaaggaugucaacuuugaacucauuaaaguugaaggaaagguuggugguaaauuggaagacacgacauuagugaaaggugucguuauagauaaaacaaugucucauccucaaaugccgaaggagcuaaaggauguuaaauuggccauccucaccugcccguuugaaccucccaaacccaagaccaagcauaaguuggaugucaccagcguagaagacuacagagaacugagauuguacgaacaagaaaaauucaaggaaauuguucgccuggucaaaaaaucgggagcuaccuuggcuauuugccaauggggauucgaugacgaagcuaaccauuugcuguugcaggaggaguuaccugcuauaagauggguuggaggaccugagauagagcugauagcuaucgcgaccggaggaagaauaguuccacgauucgaggaacuuagcccugaaaaacuugguucggccgguuuggugcgugagauauccuuuggaaccaccaaagauaagaugauggugauugaagauugcucgaauucccgugccguuaccauucuugucagaggugguaaucaaauguugguugaugaagccaagaggaguuuac

SEQ ID NO: 4221 - RNA, 208 nt, Phyllotreta nemorum
gugaaaaaguggaaugcuguagcacuuugggccugggauaucguuguugauaacugcgcuauaugccgaaaccacauaauggauuugugcauugagugccaggcaaaucaggccucugcaacuagcgaggaaugcacuguagcuuggggaguuugcaaccacgcuuuucacuuucacuguauuucaagaugguuaaaaacuaggcagg

SEQ ID NO: 4222 - RNA, 657 nt, Phyllotreta nemorum
accuugagcucgaaaauucuaucccagcacaaagagcacuucgccaagcucgccgucgacgccgugcugcgauuaaagggauccggcgacuugcaagccauccagcugaucaaaaaaaccggcgggugccugcaagauuccuuccucgacgaaggcuuccugcucgacaaaaaacccggaguacaccagcccaagcgagucgagaacgcuaaaauccuaaucgccaacacuccgauggacacggauaaaaucaaaguguucggcucgcacaucaaagucgacucgauggccaaaaucgccgaacuggagucagccgagaaagacaaaaugaaagacaaggucaacaagauccuccagcacaaagccaacgucuucaucaaccggcaacucaucuacaacuaccccgagcaguuguucgccgacgccggcguaauggccauagagcacgccgacuucgacgguaucgaaagacuggcgcuggucaccggaggagaaauagucucaacauucgaucaccccgagcuggugaaacuuggaacuugcgacuugaucgagcaagucaugaucggagaagacacucugcugcguuucagcggaguggccuuaggagaagccugcacgauagucauucgaggagccacccagcagauuauagac

SEQ ID NO: 4223 - RNA, 667 nt, Phyllotreta nemorum
acgucuucaucaagucgaauaugcaauggaagcgguuaaucucgguucggcaacgguaggacuaaaaagcaacagucaugcuguuauaauagcauugaaaagagcuucauccgaauuauccgcuuaccaaaagaagaucauucaaaucgacgaucacaucggcauuacuauaucuggucugacagcagacgcaagaauuuuaagcagauauaugagaaacgaauguuuaaauuacaaguacuccuuggacgcuuacaugccauugaauagauuaauaaacauauuagguaucaaaaugcagcauuguacgcaaagauacgaucguagaccguucgguguaggucuauugguagccgguuacgaugacaacggagcccacauuuaccaaacauguccgucugcuaauuucuacaauugcaaggccaugucgaucggagcucgaucucaaagcgcucgaacuuauuuggagaagaaacucgacgaauuaaauuuguguucuuuagaggauuugauuaaacacgguuugagagcucucagagauacucuuccuccugaagucgauuugaauacgaagaacgucuccauaggauaugucgguaaagggauuaccuuuaaaauuuuggaagaagaagaaacugcuccuuaucuugcuuuaaucgagggugaa

SEQ ID NO: 4224 - RNA, 751 nt, Phyllotreta nemorum
uuaccggguucguacaaauugugguacaauuaucuacggaccagaaggaaucaaaucaaaagcaaaugcaucaccgauccggguuucgaagagguaaacaacgccuucgagcguucgcugguauucaugcacaagaugccucguauuuggauggacuacugcacguuccucaccgaucaauguaaaauaacgagaacucgaaagguuuucgaccgggcccuucgagccuuacccguaacucagcauaacaggauauggccuuuguauuugaaauucgugcagaaacaugauauaucagaaacggccguucgaguuuucagaagguauaugaaauugugucccgaaaacgccgaagaauacaucgauuaccuaacgaaagcagaacgauuagacgaagccgcuauaauaacagcuaaaauaguaaacgacgauaauuucgugucccaacagggcaaaucgaaacaccaacuguggaacgagcugugcgagcugauuucgaaaaacccggaaaaaguucgcucgcuaaacgucgacgcgaucauaagaggcggccugcgaagguacaccgaccaauugggccaccuguggaacucuuuggccaauuauuacguucgcagcggcuuauucgaacgggcuagagacauuuacgaagaggccauccaaaccguuacgaccgucagagauuucacccaaguauucgaugcguacgcgcaauucgaagaauuaagucugagcaaacgaauggaagaag

SEQ ID NO: 4225 - RNA, 657 nt, Phyllotreta nemorum
ggcgguuuagacgauaaaguaucggaaucccugcuaugggagcuguucguacaagccggaccauuggugaacguacacaugcccaaagaucgcgucaccaugaugcaccagggcuacgguuuuguggaauucaugggcgaagaggacgcagauuaugcuauaaaaauaaugaauaugauaaaauuguacggaaaacccauaagagucaacaaagcuuccgcucaucaaaagaacuuggacgucggagccaacauuuuuauagggaacuuggacccggaggucgaugagaaacucuuguacgauacguuuucagccuucgguguaauauuacaaacgcccaagauaaugagagauccagagacugggaauuccaaaggguucgcguuuaucaacuucgccagcuucgaagccuccgaugcuucaaucgaggccaugaauggccaguaccucugcaaucgaccgauaucuguuuccuacgcauucaagaaggacucgaagggcgagagacacgguucggccgccgagcgauuguuagccgcccagaacccgcuaucgcaggccgacaggccccaucagcuguucgcagacgcuccaccgauaggaaugaugccgaugagcauggcgccgcccccaccgccucuaaucaccggcaugaug

SEQ ID NO: 4226 - RNA, 658 nt, Phyllotreta nemorum
uaaaaggaggaaaggagcacccaagcuccguuauuuggauuucuccgaaaggcauggcuacaucaaggguguagugaaagacaucauccacgaccccggucgcggcgcccccuuggcucuaguucacuucagggacccuuacaaguuccaaacuagaaaggagauauucauugcccccgagggaauguacacagggcaauuuuuguacuguggaaagaaagcuaaccuccaaauuggaaauguguugccuguaggaacuaugccugaagguacaauugucuguaauuuggaagaaaaaacuggugaccguggccgauuggcucgagcaucugguaacuacgcaaccgugauugcccacaaucacgauacaaagaaaacuagaguuaaauugccaucaggagcuaagaaaguuaucccaagcaacaacagagcuaugguugguaucguugccggugguggucguaucgacaagcccauccugaaagccggucgugccuaccacaaauacaaggugaagcguaacugcuggccgaaggugcgugguguugccaugaaccccgucgagcauccucacggaggugguaaccaucaacacauugguaaagccuccaccgucaagagaggaacguccgcuggucgcaaggucggucuuauugcu

SEQ ID NO: 4227 - RNA, 267 nt, Phyllotreta nemorum
aaacaauuagccacgaaagcggcccgaaaaagugcuccggcaacgggaggaguaaagaaaccucaucguuacaggcccgguacgguagcucuucgagaaauuagacguuaccaaaaaaguaccgaacuccugauuagaaaauuacccuuccaacguuuagugagagaaauugcccaagauuuuaaaaccgauuugcguuuucagaguucggcuguuauggcguugcaagaggcuagugaagccuauuuggucggucuuuuugaagau

SEQ ID NO: 4228 - RNA, 773 nt, Phyllotreta nemorum
gccguuaauauaacugcagccaaagguauuucugaagugaugaaaaccaacuugggaccgaagggaaccaugaaaauguugguguccggugccggugacauuaaaauaaccaaagacggcaacguucucuugcacgagaugcaaauccaacaucccacggcuucguuaauagccagagcuucgacggcucaagaugauaugacuggugacggaaccacaucuaccguuuuaguuaucggggaacuccugaaacaagccgacauauacaucgcagaaggcuuacaccccagaacacucacagaagguuucgacaaagcgagagcaaaggcccuagaaauuuuggagaagcugaaaguacccaucgaaaucaacaaagaaucguugacugauguuugucgaacaagcuuaagaacaaaauugcaccaaaauuuggcugaccuccucacugaugugugcgucgaggccauucucgccaucaaacaguccgacaaaccagucgacuugcacaugguggagcucauggaaaugcagcacaaaaccgagaccgacacucagcuggucaaaggauuggugcucgaucacggcgcucgucaccccgacaugccgaagagcuugaagaauuguuacauccucaccuguaacgucagcauggaguacgaaaagagcgaagucaauucgggcuucuucuacaaaaccgccgaagagagggagaaacugguguuggccgaaagagacuucauugaacagcgaguuaagaaagucgucgaguugaa

SEQ ID NO: 4229 - RNA, 771 nt, Phyllotreta nemorum
aaauaguacucgagccgaacagcuccguauaagcgagauaacgcauaauaacgauaucgcuuugauuguagccgauacgaaagguuuauucgcccagguguucugcgacuucggcaaggccuucuccgugguggacgugaacggggaaccccccgucuccaccaugauagccgauauaucgaacgauacggagagcguggucaccugcauagacgauacgagacacggcauggaggagggcgauuacgucaccuucucggagauccugggcaugaccgagcugaacaacugcaagcccaucaagaucaaggugcuggggccguacacguucagcauuggcgacaccaccaaguucuccaaguacguacgaggcgguaucguaacgcaggucaaaaugccuaaggaggugcauuuuaagccgcugaaggaggccuugcagaaucccgaauucguggugaccgacuucgccaaguucgaucacccgauucagcugcaccucgccuucuccacucuccacaaguucguggagaagaccgggcgguugccgaaggccuggaauaaagacgacgccucggaguuuaucgcucuggcgaagucguuggcuguaaacgguucuacggauaccgaggucaauacugauauucucaauauuuucucuaaauguugcucgggugaucuaaauccuauuaaugcuacuauuggggguaucguggcgcaggaagucaugaaagccuguucggggaaguucuaccccauuuaccagugguugua

SEQ ID NO: 4230 - RNA, 671 nt, Phyllotreta nemorum
gggguuaaaggaacauacgucucgauacacaguuccgguuuucgggauuuccuucuaaaaccagaaauccuccgagcuauugcagacugcgguuucgaacacccuucagaaguacaacacgaauguauuccucaagcgguaauuggcauggacauccuuugccaagcgaaaagugguauggguaaaacggcgguguuuguacuagccacgcuacaacagcuagaacccaccgaaaacgucguuuacgugcucgucaugugccacacgcgcgaauuggccuuccaaaucagcaaagaauacgaacguuucagcaaguacauguccaacaucaagguuggcguguucuucggaggccugcccauucaaaaagacgaagaaguauuaaaaaacagcuguccgcacauuguagucggaacgcccggucgcauccuggcucucgucagaucgaagaaacucaaucucaagcacauuaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaagcgaaauu

SEQ ID NO: 4231 - RNA, 678 nt, Phyllotreta nemorum
aucaagccgauaaguugguuaauaaaugcguguuuccggagacugccagcaacaacgaaugggcgagauuccuguacuacuugggcaggaucaaagcggcccgauuggaguacagcguggcucauaaacaucucauacaagcgaugcguaaagcgccccagaacaccgccaucggguuccggcagaccguccagaagcuaacaguuguuguggaauugcuguugggggacauuccggagaggcagauauuccggcaggcgagcaugcggcauucucuggcccccuauuuccagcugacgcaggcggugcgaauggggaacuugcagagguucggagagguguuggagaauuucgggccgcaauuuaggcuggaucauacguuuacuuugauccugcggcuucggcauaauguuaucaaaacggcuauuagaucgaucggucugucguacuccagaauauccccgcaggauauagccaagaaacuggggcuugacucagcagaggaugcggaguucaucguagcgaaggccauucgugaugguguaaucgaagcuauuuuagauccccaaggagguuauaugaggaguaaagagagcacugauaucuacugcacuaaagagccccaacuagcuuuucaucagaggauauccuucuguuuggauuugcacaaucagagug

SEQ ID NO: 4232 - RNA, 729 nt, Phyllotreta nemorum
cggcaauuaaaauccgacaaauuaaaugcaaaugaagagucugaugaugaagagaaagacgaggauaaauacgucgaugaaguggacaugcccggcacgaaaguagacagcaaacaaagaauaacagucaggaauuugcguauacgagaagauacggcuaaauacuugagaaauuuggaucccaacucggcuuacuacgaccccaaaaccaggucgaugagggaggaucccaaucccggaaacgacgcuacauaccauggggagaauuucguucgcuuuuccggcgacacgacgaaucacgccagggcgcagcuguucgcuugggaagcacacggcaaagggguggacguucaucugcuagcggaacccacgaaauuggaauugcugaagaaagaauacgagaaaaagaaggaugaggucaagucgaauauucaggguacuguuuuggagaaauacggaggugaggaauaccucgaagcgccaccgaagaguuuguuguuggcucaaaccgaaaacuacguugaauauucgagaucggguaaggugaucaaaggagcugaaaaagaaguuaucagaucaaaauacgaggaagauguuuauauuaauaaucacacgucagugugggguucuuauuggagcgcuggacaaugggguuacaagugcugucauucuuuuaucaagaauucuuauuguuugggagaagcuggaaaaucaguaaacgcucaaccu

SEQ ID NO: 4233 - RNA, 413 nt, Phyllotreta nemorum
uaccgugcccuaagauuagacaccggaaacuuuucuugggguagcgaagguacugcccgucaaacacguauuaucgaugucguuuacaacgcuaguaauaacgaauugguccguaccaagacguugguaaagaaugcuauuguugucauugacgccaccccguucaggcaaugguacgaaaaucacuacaucuuaccauugggacgcaagaagggugccaaaaugacgccugaagaggaggagauuuucaauaaaaagcguagcaaaaaaguacagaagaaguacgagacuaggcaaaaaaccgcuaaaguagaacccgcgaucgaagaacaguuccacaccggaagauuguuggcaugccuugcaucuaggcccggacaaugcggcagggccgaugguuauguccucgaagg

SEQ ID NO: 4234 - RNA, 652 nt, Phyllotreta nemorum
cugcugaaaaugcucaaacacggcagggccggcgugcccauggaagucauggggcucauguuaggugaauucguggacgauuacacggugagggucauagacguguucgcaaugccccagacggguacgggugugagcguagaagccguagauccgguguuccaggcgaaaauguuggauaugcugagacagacgggcaggccggaaaugguggucggcugguaccauucccauccggguuucggcuguugguuguccggagucgauaucaacacucagcagagcuucgaggcccucucggagcgggccguggccgucgucguggauccgauucaaucggucaaaggaaaaguugucaucgacgccuuuagguuaaucaauccgaacaugaugguguugggucaggaaccccgucagacuaccuccaauuugggacauuuacagaaaccauccguacaggcucugauucacggccugaaccgccauuacuacuccauaagcauaaauuauaggaagaacgaguuggagcaaaagaugcugcugaauuugcauaaaaaaucguggauggacgggcucacguuggccgacuauucggagaauugcagcguaaacgagaagaccguagccgauaugcuggaauuggcaaagaauu

SEQ ID NO: 4235 - RNA, 678 nt, Phyllotreta nemorum
cgacauuaacgacguuacaccaaauuguagagucgcucuucgaaaugaaucguacacuuugcauaagauuuuaccgaauaagguggauccuuuaguaucacucaugauggucgaaaaaguaccagauuccacuuacgaaauggucggugguuuggacaagcaaaucaaagagaucaaagaaguaauugaauugccagugaaacaucccgagcucuuugaugcguuagguauugcucagcccaaggguguguuauuguacgggccuccaggaacuggaaaaacucuccuggcuagagccguagcucaccacaccgaauguacguuuauuagaguaucuggaucggaauuggugcaaaaguucauuggugaaggcuccaggaugguuagagagcuguucguaauggccagggagcaugccccuucgaucaucuucauggaugaaauagauucuauuggauccucccguaucgaaucagguucugguggugauucggaaguucaaagaacaaugcuggaguugcugaaucaacucgacggauucgaagccacuaagaacauuaaagucauaauggcuacuaacagaaucgacauuuuggaucccgcuuugcuaaggcccgguagaaucgacaggaagaucgaguucccgccaccgaacgaggaagcccgauuggauaucuu

SEQ ID NO: 4236 - RNA, 467 nt, Phyllotreta nemorum
ugcuuucgauuugcaaaguuucaguuuuuuccaaagaggauccguacaggaauucaugucuuucuuuuguaagacuauuguagaaaggacuauaccaucaucgagacaaucugucaaagaaggagaauacaugugucauguuuauguaagacaugauaacuuagcugguguugugauaucagaucacgaauaucccucuagggugucacauacgcucauuacgaaaauuuuggacgaauucgccgcaaaaauacccgcugccaauuggucuaccuugcaagagaaggauguaacguuuccacagcuaaacacauaccuugccaaauaccaaaaccccaaggaggccgaugcaaugacuaaaauucaggaggaucuugacgaaaccaagauaauucugcauaauacgauucaggcuguccuggagagaggcgaaaaauuggaugacuugguaaacaaaucagagggcu

SEQ ID NO: 4237 - RNA, 582 nt, Phyllotreta nemorum
uggaauaugccauugaagcuauuaaacugggauccacagcuaucggaauaugcaccagcgaaggggucgugcuggcggucgaaaagcguauuacuucuccauuaauggagcccacgaccaucgagaagaucguagaaguagauaaacacaucggcugugcuguuucggggcucauggcagauucacguacaaugaucgauagggcaagaguagagugccaaaaucauugguuuguauacaaugaaaacauuacuaucgaaucgugugcucagggaguaucgaaccuagcuauucaauucggagauucggaugaugauggugcugcuaugucgaggccauuuggcguggccauuuuguuugcuggcauagacgaaaaagggccucaacuuuaccacauggaccccucagguacauuuguucaguucgaugcgaaagccauaggauccgguucggagggcgcacagcaaagcuuacaagaaguguaccaucgcagcaugacuuuagaggaagcuaccacagcggcguugacuauucucaagcaggucauggaggagaaauugaacucguccaauguagaaguca

SEQ ID NO: 4238 - RNA, 708 nt, Phyllotreta nemorum
gauuugaagguugggacucuugaccaauugguugggcuauccgacgauuugggaaagcuggaugguuucguggagcagguuacccggaagguggcucaguaccugggugagguucucgaagaccagagggacaaguugcaggagaauuugcaggcgaacaacaccgauuugccaaguuauuuaaccagauucacaugggacaucgccaaauaucccaucaagcaaucgcugcgcaacaucgccgauauaaucagcaagcaagucgggcaaaucgaugccgaucuuaagaccaagucgucagcguacaauaacuuaaaggggagucuucaaaauuuggagaaaaaacaaacagggaguuugcuaacccguaacuuggcagaucuggucaagaaggagcacuucauuuuagauucugaguacuugcaaacguugcucgucaucguucccaaagcucaguuuaaugaguggaacgccacuuacgaaaaaaucacggacaugaucgucccucgaucgucgcagcugaucauucaggaccacgauuacggccuguucaccgugucgcucuucaagaaggucgucgaggaguucaagcugcacgccagagagaagaaguucaucgugcgagauuucacguacaacgaggaggaauuggcggccggcaaaaacgaaaucaccaagcucguuaccgacaagaagaagcaauacggu

SEQ ID NO: 4239 - RNA, 750 nt, Phyllotreta nemorum
ugucuggauuucucauugcaaaaggccaaaaugaagaugggcguccaagugcugauaacggaccccaaucaacuggaaggcgugcgcgccagggagcuggacaucaccaaggagcgcauccagaagauccuggcuacuggagugaacguggugcuucugucgggcggcaucgacgaucucuguuugaaguacuucgucgagcgcggcgccauggccgugcggcgagucaagaaggccgauuugaaacgcauagccaaggcuaccggagcggccuucgucacgucgcugagcaacauggagggcgaggagaccuucgaugccuccauggugggcgaagccgccgaggucgugcaggacaggauauccgacgacgaauugaucgucaucaaaggaccuaaagcucguacagcggcuucgauaauccugcgagguccgaacgauuucuacugcgacgagauggagcguucggugcacgacgcccugucgguggugaagcgcgugcuggaaucgaagagcgucguggccggcggcgguagcgucgaggcggcguugucgaucuaccuggagaauuucgcuacgacguugaguucgcgcgaacagcuggccaucgccgaguucgccaaaagccuguuggucauaccgaagacguuggcugugaacgcggcgcaggacgccaccgaccucguggccaaauugagagccuaucagaacuccagccagaccaagaaggaucacgcucaucugaaguac

SEQ ID NO: 4240 - RNA, 623 nt, Phyllotreta nemorum
cgcaacgaauccaauaacucauacucagucuccugugaccacuucaacuucaauuguauccauaacguacgacaaaggagugcugauagccggagacuugcuggccucuuacgggucucuagccagguacaaaaauugccccagggugaucgaaauuaauccuaauaucauccugggagccgggggagauuacgccgauuuucaauacgugaaaagcuuuaucgagcagaaaauaaucgaugaagauuguuuagaugacgguuugaaaaugaaaccgaaaucucuuuacugcuggcugacuaggauuauguaccaacgaagaaguaaacucgacccguucuggaacaauuuaguagucggaggaauacaggauggcgugccuuucuuaggaacuguagauaaacucgguacagcuuacacugauaaaguaauuuguacggguuauggggcccauauagcucuuccgguguugcgagaugcgcucgauaagaagccgaauuugaaucugaacgaagccaagcagcuuauuaaaaagugcauggaaguuuuguucuacagagacgcgaggagcuacccgaaguaccaguuggggaugaucgaugcggaugaaggggugaagaucg

SEQ ID NO: 4241 - RNA, 797 nt, Phyllotreta nemorum
ccuagcagucguaaacguaagagaucuggggaacgucaagcacgccuuuaagcuucucauuuuccccgauaccagaguuuuucaaugcuccuccaacucgaacaaaaaagaguggcuggacaaguucgaucaggccaagaaaaccaagcuggcccaagaacagcaaaaaagggaauccguaucggagaaaucgcccacucgcgucucauucgaaucgcccagcuacaauccuuucgaugaagcagaagaagaaaccggcgcgucgcauccggaaugguucguggagauucccgaagagcuggacguuugcguggcccaaaggcauuucgaagacgccauuucucugcugcaaaaagccaaggaauauuuggcucgaacgucuuccacguccggugauaagcgggacaccgucuuuacggauauccagagaaaaguggagcaaagacagaacaauuuaacggagguguugaugaaggaauuggaagugaauccggauaaaucgcugcagggcgggcugagggccgcucgcagggcugugagauugcugaaucaauuaggaagggaaacacaaucuuguacgcuguuuuugaaauuaugcagcaguaugcugaggacgcaaugcaaacgagucaaaagagaagguucuacgaccacuuacauaaagcaucuuucgagcgugguuuuuaccaauaugugucacaugucugaugaauuucuaagagcuuuucccgauucuccggccugcgcgucagcguaugugguuugggcgagcaaugagcuauugcaauuuaccaccc

SEQ ID NO: 4242 - RNA, 712 nt, Phyllotreta nemorum
cagauuaggucaagaggucgguuacacuauuagauucgaagauugcaccagucccgaaacgaugaucaaauacaugacagacgguauguugcuacgugaaugccucauggauuuggaucuuaaacaguacucuguaauaauguuggacgaagcucacgaacguacaauucacacugauguacuauucggacuccugaagcaagcugucaugaagcgagacgaacugaaauugaucguaacuucugcuaccuuagacgccgucaaguucucgcaguauuucuucaaagccccgauauucacgauucccggcaggacguuuccggucgaaguauuguacaccaaggagccggagaccgauuauuuagacgcuagcuuaauaacagucaugcaaauacaucucagggaacccccgggcgauauuuugcuguuucugacgggucaagaagaaaucgauacugcuugcgaaauauuauacgaaagaaugaaaaguuugggucccgacguacccgaauuaaucauucuuccuguguacucugcuuuaccguccgaaaugcagacuagaauauucgaaccggcuccuccuggcaguaggaaaguugugauagcuacgaacaucgcagaaacuucacuaacaaucgauggaauauauuauguaguagauccuggauucgucaagcaaaaaguuuauaauuccaagacuggaauggauuca

SEQ ID NO: 4243 - RNA, 718 nt, Phyllotreta nemorum
ggccaagaaaacuacucucaacuuuacaaaaucaauacgaaauuagucgagcaugaagaaguagaaacaaucggagacacugcaagcguucggcauagaaacaccaagcccaaagaacacguagauaauaauaaaaacauuaaaaaggagcugguuuuugaccugaauccuuuagauugcauacaaaccgauuuuaagggguccgaaccccuauguagaguacuuagaauuaaucacucgggaaagauauuagcuacuggaggaacugacggcgauguaagacuuuggaaauucccuaugaugcagccauuguccauuuuaaaggggcauacaaaggaaauagacgauauagauuucaguaaauacgauaaccucaucaucacucuagcaaaagacgguuuggcuauucugugggacgcccaaacgggaaaaaugaaaucaaaacugacauggaaaacuccagagggaucaaaguauauguacaagaggugcagauuuggcguuaucgaagaucaaaaaaacaagugcaugcuauacaugauagcgaacgcgacuaauucgaagcaagcaucguuucuucaacaguggauaccugaggaaaauacuuuaaaaaaguuuucugaauucaaugaaacccuaucggcacuugcagugagagaugacggacgauuuguugcugucgggacaauguucagcggcuccguuuccauucacauug

SEQ ID NO: 4244 - RNA, 741 nt, Phyllotreta nemorum
uguacaccgaugcuuuacaacuggaauccaccuuguuaaaagagcugaagaaacuggacgacaaaaaucugcuggucgaaguacagcugcucgaaagcaaaacauaucacgcccuaagcaauuuacccaaagcacgagccgcccuaacguccgcuagaacgaccgcuaaugcuaucuauugcccuccgaagaugcaggcagcccuagaccugcagucuggcguacuacaugcagccgacgaaaaggauuucaagaccgcuuacuccuacuuuuacgaagccuucgagggcuucgacagcgucgagucucccaaagcucuaacugcucuuaaguacaugcuuuuguccaaaauuaugauuaauaguccugaagauguacagcaaauuguuaguggaaaauuagccauaaaguaugcagguaaagauaucgaggccaugaaagcagucgcacaagcagcccacaaaagaucucuugcagauuuucaacuugccguaaaacaauucaagcacgagcuggaggaugacguuaucguaagagcacauuuaggaacccucuacgacaauauguuggaacaaaacuugugcaggaucauugaaccuuacucgcguguccaaguagaauauauagcaaagacgauuaagcuuccuguguuacaaguagagaagaaacuaucgcagaugauuuuagaugccaaguuucauggaauucuagaccagggugaugguguccugauaguguuug

SEQ ID NO: 4245 - RNA, 673 nt, Phyllotreta nemorum
auacgaauccagguguaacgaguaccagcucaaguccaaccaagcuucugcagacgccaagaaggccaucgccgaugccaaggaguuggaaaaggaaagggacaagcugaagaagcuccucgaugcugcucguaaacaacuggaagaggaaucucuggccagaguagaggucgagaaucacaaucagagcuuaagggaagagcuaaccuuuaaagaucagauccaucaacaagagcucacagagacccgcacucgccggcaggucgagaucagcgaaaucgacggccgucuggcgcagaaauacgaggccaagcugcaagaggcccugcaggaucugcgcgaccaguacgaaucgcaaauggccaacaaccgacaggagaucgaauugcuguacgagcagaaaaucaaaaaccuccaagcggccgccgacaggcaccagucgaccgccuccggcgcgcucgacgaacugagacagguucgcucgaggaucgacaccuucucgucgaagaucgacgaccuggagaaccagaaccgcggucuggcagcuagaaauagggauuuggagaaauugcucgagaaugagcgcauucgucacgccgaagaucuggcguuggucgagagggaauugcacaggcugcgggaggagauggcccagcaacuucaggaauaccag

SEQ ID NO: 4246 - RNA, 767 nt, Phyllotreta nemorum
cugagaauccacaccaagaacaugaaguuggccgacgacgucgauuuggagcaaaucgcggccgagacucacggucacgugggcgccgauuuggccucgcucuguucggaagcggcgcuacaacaaaucagagaaaagauggaccugaucgaucucgaagacgaucaaaucgacgccgagguccucaauucguuggccgugaccauggagaacuuccguuacgccaugacgaagagcagcccgagcgcucugcgcgaaacgguggucgaaguacccaacgucacgugggacgauaucggcggucuggccaacgucaagaaggaauugcaggaguuggugcaauauccggucgagcaucccgauaaguuccucaaguucggcaugcagccguccaggggagugcuguuuuacgggccgcccgguugcgguaagacccuguuggcaaaggccaucgccaacgaaugucaggccaacuucauauccgucaaagggccggaguuguugacgaugugguucggugaaucugaagcuaauguuagagacauuuucgauaaggccagaucagcagcuccuuguguacuuuucuucgacgaguuggauucgaucgcuaagucuagagguggaaaugugggagaugccggcggugcagccgauagggugauuaaucaaauuuuaacugaaauggaugguaugggagcgaaaaagaacguuuucaucauuggugcuacaaauagaccagauaucauugauccggcuauauuacgucc

SEQ ID NO: 4247 - RNA, 650 nt, Phyllotreta nemorum
auuuagugccaagucuuugcgaggaucuucuuucauccguagaucaaccguuaaaaaucgcuaaagacaaggauucgggcaaggauuuucuuuuaugugauuacaauagggacggagauucuuacaggucaccauggucgaauacuuacuaccccccauuagaagacgguucgaugcccuccgagagguuaaggaaauuagaauuagacgccaauuuagcguucgaucaauauagagaaauguauuucgaagguggcguaucuucuguuuauuuuugggacuuggaucacgguuuugcaggaguaauuuuaauuaaaaaaaccggagaugguaguaggaaaauaaaagguugcugggauucccugcacguaguggaggugcaagagaagaguucgggaagaaauucccacuacaaaaugaccuccaccgccaugcuguggcugcaaaccaauaaacaaggcucggggaccaugaauuugggcgguagcuuaacccggcagaucgagcaagaugcagcgguaaaugauaucaacccccacaucgccaacaucggucgaaugguggaagacauggagaacaaaauucggaauacguugaacgaaaucuacuuuagcaaaaccaaggacauagucaauagcuugagaucggug

SEQ ID NO: 4248 - RNA, 733 nt, Phyllotreta nemorum
cuuucuaucaaccggucgaugcggaacuacugggccugcacgacuaccacgacaucaucaagcgacccauggacuuuggcacggucaaagagaaaauggacaacagagaguaccgcacgccgcaggacuuugccgccgacguuagacugauuuuuaguaauuguuacaaguacaaucccucugaccacgauguggucgccauggcgcggaagcuccaggacguguucgaagucaaauuugcgaagauccccgaugagccugugaaccggauaggaggaguuguaaauaauuugccuauaaaauccgaaucgaguaguuccgguucgaguucggauucguccagcgaaucggaggauucggaggaggaaaggcguaacaaacaauugaaagugcuggagaaagaguugacggcguugcaagagaagaugcgcaagcuggucgaggagaguucgcgccggaaaaaggagaaaaagaaaaacaaaaugaaaaagaaaccgagcggcgcgggggcgcugacggcggcgggcgcgcugccgaacagcagcagcggucucgguuugcgcggcaacaaacccgccgccgcuucgaacgccgcccccaagcgggcgaaggcgaacaacaagaccggcgccggcaggaagaagaacgccgcccagccgcccccgaugccguucgacucggaggacgaggacaacgccaagccgauguccuacgacgagaaacgacaacuuuc

SEQ ID NO: 4249 - RNA, 661 nt, Phyllotreta nemorum
caauuucguucaucagcaggucucaaugaaccaucgccagcccuacagcgucagcgacaaagccggucaccaaaccucggccgaguccuggggaaccggucgcgccguggcccguauaccgcguguacgcggcggcgguacccaccgaucgggccagggagccuucggcaacaugugucgcggcggucgcauguucgcgcccaccaagccguggcgccgcuggcacagacgcgucaacgucaaccagcgucgcuacgcgcuggcgucggccgucgccgccagcggcgugcccgcccuggucaugagcaagggccacguggucgaucagauacccgagcugccguuggucgucagcgauaaggugcaggagaugcgcaagaccaaggaggccgugcaguuccugaggaggaucaaggcuugggcugacauccaaaagguuuacaagagccagcgguuccgugcugguaaaggaaaaaugcguaacaggagacguauccaacguaaaggaccucuaaucguuuacuacaaagaucaaggucuucgucaagcuuuccguaacaucccuggcaucgaccucaucaguguccaaaaguugaacuugcugaaacuggcucccgguggucacguaggucgguucaucaucuggacugaaucugcuuuc

SEQ ID NO: 4250 - RNA, 722 nt, Phyllotreta nemorum
ucgagcaagaaucuuuuggagugggcgaagaggaagaagaaggcgauuacucagacgccgaugauuuuaucguagacgaugacggcagaccuuuaaucgagaaaaagaggaaaaagaaaccgauuuucaccgacgccgcgcugcaagaggcccaagaaacauuuggcguugauuucgauuacgaugaguucagcaaauacgaccaagacgaguaugaagacgaggaggacgaagaagaagacgaauacgaagaagaugacaacgaacgaaggaaacauccaaagaaagcggcgcgaaagaagcugacgaaaaaguccauuuucgaaguguacgagccgagcgaacugaaaaggggcuuuuucaccgaucucgauaaugaaguucguaacaccgauauaccggaacgaaugcaacuucgugacguucccauuacccccgucacggacgauucgaccgagcuggaagacgaggcggaguggauuuacagacaagcguucuguaacaaggcaauauccaauguugaugcccaccuuucggccgaggccagagagaagaugaagaaggguucccaaacuguagggaaaauaaagaaagcgcuggauuucaugaggaaucaacagcuagaggugcccuucauugccuuuuacagaaaggaguacguucaaccugaacugaauauuaacgauuuauggaaaguuuauaaauaugaugccaaguggugu

SEQ ID NO: 4251 - RNA, 673 nt, Phyllotreta nemorum
ugcucgaugauguaaaggaggcuaaugcugaagauauucuaaauguauucaaguuugaugaacauuaugaagaaaacgaaggcaaauacaaaacucugaguaaagaaaucuugggcagcgauagcgagucagauacaggaucggaggggucugaagaggaauccgaaggugaagacgaggaugaagaaguuaaagaugccggaaaaaucauagacaauacugaaacaaaucuaauagcccuuagaaggacaauauauuugacuauacaauccaguuuggauuucgaggaaugcgcucauaagcuucugaaaauggaguuaaaacccggccaagaaaucgaauuaugccacauguuuuuagauuguugugccgagcaaagaacauacgaaaaauucuacggacuucuagcucaaagguuuugccaaauaaauaaaauauacaucgagcccuuccagcagauauucaaagacaccuacgccacuacccaucgucuggacaccaacagauugaggaacguuagcaaauuuuucgcacaccugcucuucaccgacgccauaggcugggagguguucgagauuaugaagcugaacgaagaagacaccaacagcuccaguagaauuuuuaucaagauuuuguuccaagaauuagccgaguauaugggccuaggaaagcu

SEQ ID NO: 4252 - RNA, 675 nt, Phyllotreta nemorum
ugguaucggcuuguuguaaaaugcacgacauaucugcugagggcauuacacuggucgaagauaucaugaagaagagggagccccuugcuacaauggaagcuguguacuugaucacuccuuccgagaagucuguccaugcucucaugaacgauuucgaaucuccgaggcccauguauagaggagcacauguauuuuucacagaagcauguccagacgaauuauuuaacaaauuaaguaagagucaugcggcaaaauauauaaaaacguuaaaagaaaucaacauagcauuuguuccgacagagucacagguauuuucuuuagauuccccagacacuuuccaauguaguuacgauccuuccuuugcugccgcacgaaaugcgaauauggaaagaauggccgaacagauugcuacguugugcgccacucugggggaauacccgcacguccgauauaggagcgauugggaacguaacguagaguuggcgcaauugauucagcagaaauuggaugcuuacaaagccgacgagccgacuaugggagaagguccugagaaagccagaucgcagcugcugaucuuagaccgaggcuucgauugcguuucgccguugcugcacgagcugacguuucaagcuauggcuuacgacuugcuuccaaucgaaaacgacguguacaaau

SEQ ID NO: 4253 - RNA, 716 nt, Phyllotreta nemorum
uucaaucuggggguuuucaagaucuaagaagggauuugcaagcgguaauaggcacuagggcaaacauaaacauagcucaaauagaaaauuaugguggugaaacuuuuguaucggaggaauuggcaauaaugauucuucaggauacuaagcaagcuuuucaacguuguuuauuguuaucaaaaggcagcgaaaaagcuuccaacgccacccaaauuuuagacagacuuauuaacaguuugcucauagaacauguagacuaugcaguagaauugggccuucaagcuguacccguugucgaaggcguuagaaaucccccuguuuuguauuuuuuuaaugucgugcaccaaagcaauaauauuacccaucucgucgaaaaacaguucauggauuuggugguuccauuaguagaaaacacuccaaaauacagcgauugcauacagaagaaaaaauuuguuuuggaggauauagaaagaaaaauuaauacgggauuggauaggugcuugagugcgauauuaaauugggugaaauuguauuuacaaucugagcagaagaaauccgauuucaagccugagucugaugauuuugauacaguggccucaccagcuugcaagaacguacuuaauuauguaaauagcauuaucaaagaaaucaaaacaaauuuggauggcaauaauguaacagcuuuucuucaagaauuggggauuagacugcauaga

SEQ ID NO: 4254 - RNA, 655 nt, Phyllotreta nemorum
uagaaaccaucgaucugcagaaggacccguauuuuaugaaaaaccaccuggguucuuacgaauguaagcuuugcuugacgcuacacaacaacgaagguagcuacuuggcgcacacgcaaggcaaaaagcaccaggccaauuuggcccggagggcggccaaggaagccaaagaugccccgucguugcuccaacccgagaagccccgaguggagccgaaaaaauucgugaaaaucgguagacccgguuaucggguaacuaaacaaagggaucccgaaaccggccaacagaguuuacucuuccaaaucgauuauccagaaaucagcgacuugguuacgacccgacaccgcuucaugucagcguacgagcaaaaaaucgaaccuccagaccgcaaauggcaguacuuacucuucgcagccgaaccguacgaaaccauagccuucaaaguaccgagcagagaagucgagaaaacggauaccaaauuuuggacucacuggaacagagacaccaagcaguuuuuccugcaauucgcuuucaagaacgaaaacaaacgaaacguuaacgcagucguucagaggcauucgauugucgguggaguuccaccgccucccaugcugccgguaccgccgccacccaggccucccauguuuaaucccau

SEQ ID NO: 4255 - RNA, 253 nt, Phyllotreta nemorum
uaaccugcgaaaccauaaccggcgaaguuuacagggguaaacuuauagaagccgaggauaauaugaauugccaaaugacucagauaacuguaacguacagagacggacgaguggcgcaauuagaaaacguuuacauuagaggauccaaaauaagguucuuaauauuaccggauauguuaaagaaugcuccgauguuuaaaaagcaaaccaaagcuggaacugcagguagagggaagucugcaauucuacgagc

SEQ ID NO: 4256 - RNA, 670 nt, Phyllotreta nemorum
guuugcucgaacuucuugagcggacguacggccgucguagguucggguaucagcgaaaaggauuugacgucuuuugccaauuccuugaaaauagaaaacggcgaaggcgaaaccgccccuucuccuuacguaggcggugaacuaagaucgaacaaagguggugaacuggcguuuauugcuguagcaggagagggagcugcucucaagaaccacaaggaagcucuggcuuuugccgugcuucagggagccauuggaggaggcccucaggucagacacggaguuucggacaacggaaucuucaggaaggcucuuggaaguaaccccaacguuaguucuguagccauaaacgccaguuacucggacaccggucucuuuggacugcuacuggccguuccuacgaaguccgccagaggugcuauagaaagcgcuguuaaaguacucaagagcgggacgguuucugaugaggaugucagcagagguaaaaaucaauugaaagcgucgauccucuucaaugcugaaagcggggcagauauuguaagaacucuuggacaagaggcuguuuugacgcaaaaaguuacgaguguugaugcacguuuggccgaaguggauucgguuucuaccagugaugucgcaaaugcucuuaagaaagcaggcaagaaguuaucgcuag

SEQ ID NO: 4257 - RNA, 199 nt, Phyllotreta nemorum
acgaaaaugaucggaugacuaacgaauugcaagagaaaaucggaguucugaaaucccuaacuauagauaucggaaaugaaguuaaauaccaggauagaaugcucagggauguugacgacgauuuagaaaagacuggaggguuccugggaacaacuaugaacaaaguauuaaggcugucgaaaggaggccacaauuacau

SEQ ID NO: 4258 - RNA, 729 nt, Phyllotreta nemorum
cguugguaauccucgaagaugucaaauuuccgaaauucaacgaaaucguccagcucaaacuggccgacggcagcuuacgauccggucaaguguuggaagugagcggcucgaaagccguaguacaaguguucgaagguacuucgggaaucgacgccaaaaacaccaugugcgaauucaccggcgauauucucagaacgcccgugucagaagacauguuggguaggguguuuaacggcucaggaaaacccaucgacaaaggaccuccaauuuuggcugaggacuaccuggacauccaaggucagccgaucaauccuuggucgcguaucuacccggaggaaaugauccaaaccgguaucuccgcuaucgacgugaugaacucgaucgcucguggucagaagauccccaucuucucggcggccggucugccccacaacgaaaucgccgcgcaaauuuguagacaagccggucuugucaaagugcccggcaaguccgcucuggacgaucacgaagacaacuucgccaucguguucgcugcuaugggagucaacauggaaaccgcucguuucuucaagcaagauuucgaagagaacgguucgauggagaacguaugucuguucuugaacuuggccaacgauccuaccauugagagaaucaucacgccccguuuggcccugaccgcugccgaauucuuggccuaucaaugcgagaaacacguguuggucauauuga

SEQ ID NO: 4259 - RNA, 731 nt, Phyllotreta nemorum
ggaaacaaugggcaucaaaaccgucuuggcucgccaaauauucgacuccagaggcaaccccaccgucgaagucgacaucaccaccgacuugggccucuuccgagcggccguaccaucaggagccaguaccggcaucuacgaggcgcucgagcuucgcgacaacaucaaaaccgaguaccacggcaaaggcgugaaccaggccaucaaaaacaucaacaccaucaucgcccccgagcugaucaaagccggcuucgaggugacccagcagaaggaaaucgaugaguucaugaucaagcuggaugguaccgagaacaaguccaaauugggagccaaugcuauccuuggaguauccuuagcuauuugcaaggcuggagcagccaggaaaaacgugccguuguacaagcauaucgcugauuuggcuggaaacaaggauaucauuuuaccaguaccggcuuuuaacguuauuaacgguggaucccaugcugguaacaagcuggccaugcaagaauucaugauucuuccuacgggggcuacaaccuucacugaagccaugcgaauggguuccgaaaccuaccaucaccucaagaagguuauucacgccaaguucggcuuggacgcgacagccguuggagaugaaggcgguuucgccccgaacauccucaacaacaaagaggggcucgaguugaucaagguggccauccagaacgccggauacaccggaaaaaucgaca

SEQ ID NO: 4260 - RNA, 730 nt, Phyllotreta nemorum
acuacggcauacaagugaucgucaagcuguugaacccgccgucgcguuggccgcuggugaaggcggucaucggcuugaucaggaacuuggcgcuguguccggccaaucacgcuccgcugagggagcacggcgccauccaucaucuggugcagcugcucaugagggccuuccaagacacucaaagacaacgggguagcgucgccagcggggguagccagccgccugggacguacgcggacgggguucgcauggaggagauuguagaaggaacggugggagcguugcauauauuggcgagggaaucgcacaaucgggccaucaucagacagcaaauggugauuccgauuuucgugcaguugcuguucaacgauaucgagaacauacagcgcgucgccgccggcguucuuugcgaauuggccgccgacaaggagggggccgaaaugaucgaaaacgagggcgccaccgccccuuugacugaguuguugcauucgagaaacgaagguguugcuacguacgcagcggcgguuuuguucagaaugagcgaagacaaaccgcaggauuauaaaaagcgacuaucaauggagcugacuaauucuuuguuuagagaagaaaaucuuuggaaucccgaccuaggcauggguccggauuugcaggauauuuuaagucccgaccaggcauacgacaauauguaugcucagggucccccgaguguucauaguagccauggagg

SEQ ID NO: 4261 - RNA, 678 nt, Phyllotreta nemorum
cgaaaucgacaagcacaaaaaacgccggcccuauuuggcguccgaaugcaagagccucuacgcgugcgagaaauggcgcaugcaaaucauccgagaaauagcgaaaaaaguggcccaaauccagaacgccgggcucggcgaguuccgcauacgcgaucucaacgacgaaaucaacaaacuccugcgcgagaagcgccacugggaggaccaaaucaaagagcucggcgggcccgauuaccagcgagucggcccccggaugcucgaccacgagggcaaggagguccccggcaaccggggcuacaaguacuucggagccgccaaggagcuaccaggcguccgggagcuguucgagcaggagccgccgccuccgccgaggaagagccgggccgagcugaugaaggacaucgacgccgauuacuacggcuacauggacgacgaugacggcauacugauacccuuggagaacaaagcugaaaaaaucgccgugcaaaaggccauaucggauugggugagcaacaaggagaagaaccuggacucgagcaaagggaucgaagagagcauuuacgugguggaggagucggacgaagaggacgcuguccaacaguucgacgguucgcagcagcgguucguggcucacgugccgguaccgucccagcaggacaucgaacaggccuuguu

SEQ ID NO: 4262 - RNA, 496 nt, Phyllotreta nemorum
guucgagaaaaaguacgucgccacccugggcgucgaaguucaucccuuaguguucacgacaaaccgaggcaaaaucugcuucaacgugugggacacggcgggccaggagaaguucggcggccucagagacgguuauuacauucagggacagugugccauuauuauguucgaugucacguccaggguuacauacaaaaacguucccaacuggcacagggauauugucagggugugcgaaaacauaccgaucguacuauguggaaacaagguugauaucaaggauaggaagguuaaggcuaaaaguaucguguuccauaggaagaagaaccuucaguauuaugacauaucugcaaagucuaacuacaauuucgagaagcccuucuugugguuggcgagaaagcuuauuggcgaucccaacuuggacuucgucgccgaaucggcccuucucccuccggaaguucaaauggauccgcaguggcagaaacagcuagaaaac

SEQ ID NO: 4263 - RNA, 229 nt, Phyllotreta nemorum
gaguaggaggaacauggaacuuaaacgaagaaaaaaauccugaugcggaaauuguggcaucuggaaucuuugucgguuucaugaucuacacugucguaucucuuauaaguuucuguuuugccagcggugaucacaaaacaucuuucaccgauauuuuaaugaacauaguuggaguauucauguggguggccguuggggcaacagcucuucacuacuggcucgguuauuu

SEQ ID NO: 4264 - RNA, 724 nt, Phyllotreta nemorum
cgugaugaaauacggcaaaaaccaaugguccagaauagcaucucugcuucacaggaagucugcgaaacaaugcaaagcccguugguucgaauggcuagacccuagcaucaaaaaaaccgaaugguccagagaagaagaugaaaaguugcugcauuuagcuaaacuaaugcccacucaauggagaacuaucgcgccuauaauaggcaggaccgcagcccaaugucuagaaagauacgaauauuugcuggaucaagcgcaaaaaaaagaagaaggcgaggaugcuguggaugaucccaggaaguuaaaacccggagaaaucgauccuaauccagaaaccaaaccugccagacccgauccuaaagauauggacgaagacgaauuagaaaugcuuuccgaagccagagccaggcuagccaacacccaaggcaaaaaagccaagcguaaagcucgcgagaagcaauuggaggaagcccgucguuuggcugcuuugcagaagcgucgagaacugagagcagccggcaucgaagucaauucgaggcgcaagaagaaacgaggcguagacuacaaugcugaaauuccguucgaaaagcaaccagcaaucgguuucuacgacacuuccaacgaagcccuagacuugauggcgccggauuucuccaaaaugagacaacaacauuuagacggugaacucaggagugaaagagaagagagagaacggaaaaaggac

SEQ ID NO: 4265 - RNA, 330 nt, Phyllotreta nemorum
auguggcucauccagauaagcugaagaaaaaaauuaccagggaauuaauuacaaccauucuugccagaaaaccaaaaaugugcaguuuuuuagaauggagggauuuaaaaaucguuuacaaaagguaugcuagcuuguauuuuugcugcgcuauagaacagugcgacaacgaacuguuaacuuuggaaaucauucaucguuacguugaacuuuuggacaaauacuuuggaagcgugugugaauuggauauaauuuucaacuucgagaaagccuauuucauccuggacgagcuauugcuuggcggcgaggugcaggaaaccaguaagaaga

SEQ ID NO: 4266 - RNA, 779 nt, Phyllotreta nemorum
aagagaucgucguuucucagucgauuauacgacaauuucaaagacgaaaugaacaaaaacaaagaaaugaaagaaucuuuaaaaaaauuccgugaagaagcccaaaaacuggagcaaagcgacgccuuaaaagccgcccgacaaaaguucgaaaccguagagaaagaggccagcaaaggcggcgaagucuucaaagagaguuuagguucgauuaaagaaagagucaaaggaguuauagacgaggccagcaaaucggauuuagccaagaaagccgguaaauucaccgaagaaguaggaaaaaccacacacaaaaucagcgaaaccgcacaagaaauuagcaagacaggagccuuccaaagcaucucggaagccaccaaagcuguuaaacaggaaaucgacaacaccagcauggaaggucgaguguacgugagcccuaagaagcugcgaaaacgaaccgaaaccagcgcaguaguccaacagaaauacuacgaaccgaacacggacgcgaccggcguggagcuacacaaagacuccaaauucuacgaauccuggcaaaacuucaaaaacaacaacccguacgugcacaaagucauggacuggaagcucaaauucgacgaaagcgaaaaccccaucauccgagccuccagggcgcucaccgaaaaagucggcgacaucaugggcggcuuguuccaaaaaaccgaacuguccgaaacccucacggagaucugcaaaaucgacccggacuucgacaccaaacgauuccugaaacaaugcgaaac

SEQ ID NO: 4267 - RNA, 656 nt, Phyllotreta nemorum
guaagcugaaaccuggguuaaauaaaaucgaagaggccccuaaacaauucgugaacaacauaaguggcuuaaaucagaaaaucgaagaauucaaauugaaacugccauggaucgaacggcuggauuguacgaaugcccaagcccccuuggcgcccgaauuagcagcagaaaugcuaguucacgaggaaaagagaaguaaucaacucaggaacaacaagaaacuuccccaauuccaaccauccgaagaucccguucuaaacgauuuuaaacgagagcuaauauuucacaggcaagcacaagccacaauucuggaggcaaucccgaaaaucaaagaguuuggguuaccuacuaaaaggccagaugauuauuuugcugaaauggccaaauccgaugagcacaugcacaaaaucagagaaaaccugaagcaaaagcaggagcaacagaagcggauugaacgggugaagcaauugaggcagcagaagaaagaaggaaagucgcugcaggugcagaugaaauugcaacgguccaaggagaagaaagaaaugauggaucaagugaagaaagcgaggaaaaacuucgacuuuuuggaugacaaaaauaagcccaugggaaagaaggcggcggaaaaacguaaaaugaaggacaagaaauucggu

SEQ ID NO: 4268 - RNA, 712 nt, Phyllotreta nemorum; identical to SEQ ID NO: 4242

SEQ ID NO: 4269 - RNA, 763 nt, Phyllotreta nemorum
ccaaagucaugauggaggaaggccgaagcaagggcuucggcuucgugugcuucuccuccccggaggaggccaccaaggccgugaccgagaugaacggccggaucgucggcacgaaaccgcucuacgucgcccuggcccaacgcaaagaggaccgcaaggcccaucugacgucgcaguacaugcagcgcauggccaacaugcguaugcaccaaaugggccaguucauccagccgggcggcucgagcggcuacuucgugccgaccauucaagcgacggcgccgcguuucuacgggccggcccagaugccgauucgcacuaguccgagauggcaggcgcagacgccggugcgucccggcgcccagggcggcaccgccgccuacgcgggaaugcagaacagcuacagggccgcggcgaggccgcccggucaaucgacgaugcgcagcaacaucagcgugccgcgacccaucaccggacaacaaccaccaaguguugcugcugcuggaaaucgugcagccaacuucaaauacaccgccaacaugcguaauccgccgcaggcguuguugccgggagcucaggcucaagugcaacaggcagugcacauucaagggcaggaaccgcuuacugcgaccauguuggcagcggcuccgccgcaggagcagaaacagauguugggagagagauuguucccucugauucaaaggauguauuccgauuuggcugauguugcagguaaaaucaccgguauguuguuggagaucgacaa

SEQ ID NO: 4270 - RNA, 793 nt, Phyllotreta nemorum
acccgauauacgugaaacuggagaagcuugacauaaugauucgauuggcuucucaagugaacauugcucaaguucugagcgaacuuaaagaauacgcgacugaaguggacguggacuuuguaaggaaagcuguaagagcuauuggccggugugcuaucaaaguggagccuucggcggagagaugcgucgcgacgcuguuggauuugauucaaacuaaaguuaauuacgucguacaagaagcuauagucguuaucaaagauauauuuagaaaauauccgaauaaauacgagaguauuaucagcaccuugugcgaaaauuuggauacucuggaugagccggaagcgagagcuagcaugguguggauuauaggagaauacgccgagagaaucgauaacgccgaugaguuacuggauaguuucuuggaagguuucggugacgagaacgcucaaguacaacuccaguugcugacggccguugugaagcuauucuuaaagcguccccaacacacgcaagguuuaguccagcacguacucagcuuagccacucaggacuccgacaauccagauuugagagacagagguuucauauauuggagauuguugaguacagauccggccgcagccaaggaggugguucuggcagauaaaccgcucauaucagaagaaaccgaccucuuggagcccacucuucucgacgagcucaucugucacauaucaucucuggccagcguuuaucacaagccaccuacagcguucguggaaggucgaagcgcugguaucaggaagacguuacc

SEQ ID NO: 4271 - RNA, 363 nt, Phyllotreta nemorum
gaggagaaguaggagcuacaucauccuuggcuccgaaaaucgguccucuugguuugucucccaacaaaauuggugacgauauugccaaagguacagcugacuggaaagguuugaaaaucacgguccaauugaaaauucaaaaccgucaagccaccaucuccguaguaccgucggcugcuucauuaauuauuaaggcuuugaaggaaccuccucgugacagaaagaaggugaaaaacauuaaacacaguggaaacauuacguuugaugaaguuauugcccuugcccagcaaaugaggccuagaucaauggccaaggcccuuucuggaacaguuaaggaagugcuggguacagcucaaucuguag

SEQ ID NO: 4272 - RNA, 784 nt, Phyllotreta nemorum
gcaaauggaggaggaacuuacagucgaagcgaccaaacugggcguuuccauaguauuuucgcacgagacugagccucuaggcaccgcagggccaauagccuuagcuagagaacaccuuucgaaaaguacaaaaccguuuuuuguauugaacuccgauauaauaugcgacuucccguuuagggagcuggccaaguuccacgaaggccacggcaaggaaggcaccauagucgucacgaaggucgaagagccuuccaaguacggcguaguaguuuacgaugaaaacagcugcaucgagagcuuuguggaaaaaccgcaggaguucauuucgaacaaaaucaacgccggccuguacauucugaaccccagcgugaucgacaggauugaacuccggccgacuuccaucgaaaaggaaguguuuccuuacauggcuaaggacaagcagcuguacgccuucgagcugaaaggguucuggauggacgucgggcagcccaaggacuucuugaccgggaugugcuuguacuugaaccauuugcgggaaacuaacagccagaagcuguacaagggacccgguguggucgggaacgugcugguagauccaacugcaaaaauuggcaguaauugccaaaucgggcccaacguaacaaucggaccagacgugguaauagaagacgggguuuguauaaagcgcucgacgauacugaggggugcggucgugugcucgaacucuugguuggagagcugcauugugggguggaagugucacguggguaaaugggugagaaug

SEQ ID NO: 4273 - RNA, 732 nt, Phyllotreta nemorum
ggacggugaagaagugauaagugaccaagaaaaagugaaaauaguuucggauuucauccuccauuccccgcccggcgaauucaacgaaguuuucaaugauguaaggaaacuuuugaauaacgacgaccuucugaaagaaggcguaaccggggcguucgcccaauacaauaaagaccaacucacccccguuaggauagaaaacgccgaucaaauggugcugauuacagaauacaacgauuuagguaacaauagauucuucgacccccguaguaaacaaaguuucaaauacgaacauuuaagaaaggaagcuucugauuaccagccuuauagugucgauacgacggcggagcccuggcgggccgcucuagauaacgaguuuauucaauacacuagaaaccauuauaaagacggcguuuguagcguauucggucgcagucagaacggugcgaucacccuuacugcuugcaucgaagaccaccaauuucagcccaagaacuucuggaacggccgauggagaucccagugguccguuagcuuaaccgaugaauccacagcugaaguacguggcguccugaaagugcaaguccauuauuacgaagaaggaaacguucaauuggugaguacuaaggagaucaaggagucgauuccgguuucuaacgaagcucaaacggccaaggaaaucauccauguaauagagaaugcugagaaucuguaccaaacugcgauuucuga

SEQ ID NO: 4274 - RNA, 726 nt, Phyllotreta nemorum
gaccgaaucgauaaaggucaacacuuacacuacaaacaaucaaaacgucgauaucacaccaauaauauggagcaggccgauuccgcuggguugguacuuccaauuccaaugggagaaucaauacgguaaaaauuggcccaaauaccucugcgaugauuggcucagaacggacagauaucugaagaauuuugcccaugaauugccgcaauguccuugcacggugcagcaagcuuuggcggacaaaggaaaauucaugccugacuuugauugcgacaaagauucaaauccuguuuguuauuacaacaaucaagcuuuacauugcgucaaaacuggugcucccacaauggaagguuccgaacaacaauguugcuacgacaaaaacggcuaccugaugcuguccuacgaucaacaaugggguucaaguccucgucgaugccacaaccucggcaaaaugccuuacaacgaggccaccaagguccccacgcuaucucaaugguucaacgacgucgugcccaaguaccucuguugccucuggcaggaagagcaagccgucggcugcgaaacacugcgauucgagagaaggccgucgcaggacugcgucgcauaucaagcgcccgccguagcgggaguuuacggugacccccacauagucaccuucgaugauguggaauacacguucaacggcaaaggagaguacuccuuggugaaaucgguuaaaguggacga

SEQ ID NO: 4275 - RNA, 256 nt, Phyllotreta nemorum
  misc_feature (187)..(223): n is a, c, g, or u
ugguucuguaggaguugaagccgaagcugaaaaggucaaaaaaguuuugggcgaacucaauggcaaauccaucgaagagcucaucacuaaaggucgcgagaaauugaguuccaugccaguggguggugcugcuccuguagcugcugcugcuguugccgcugcuccugcugccgccgaagaaaagaannnnnnnnnnnnnnnnnnnnnnnnnnnnnnnnnnnnncagaagacgacgacaugggcuuuggucuuuuug

SEQ ID NO: 4276 - RNA, 783 nt, Phyllotreta nemorum
auagacgacuuuuuggcuguguccgaaaaccacauccuagaagacgucaacaaaugcgugcuagcccuucaagaaggcgaugcugauacguuggaccgcacagccagcggcauaaagggccguucaaacagaguuugcaauguuguaacagcugaaauggauaacuacgaaccuugcauuuacaccaaacgcguuuuggaagcggugaaaguuuugaacgaucaagugaugcccaaguucacccaaagagugcagguggcuguacaggccuuggguaacagcccgccuaaggaagucgacgaaaacgauuucaucgaugcuuccagauugguuuacgacggugucagggagauaagaagagcugugcucaugaacagagccgaugaagauuuggauccugaagacgucgagcucgaugagaauuaccugauugagaccaggaguaaaucgagugcucauacuggggaacauggcguugaugaguauccugauaucaguggaauuaccaccgccagggaagcuauggguaagaugccggaagaggacaagcaaaaaauauugcagcaaguggaguuuuucaagagcgagaagcucaaguucgaucgcgaagucgcuaaaugggacgacaccggcaacgacaucaucguuuuggcuaagcacaugugcaugauuaugauggaaaugacagauuucaccaggggaaaagguccucugaaaaccaccauggacgucauaaacgcagccaagaaaauuucagaagcaggcacuaaauuggacaagcuc

SEQ ID NO: 4277 - RNA, 715 nt, Phyllotreta nemorum
uuguuuggaucaacugcaacugcagcugcgacgccuauuucagcuucgacuggacuuaguuucggaacaacaguuucaacaaccccaguuucagcaacuccagcugcuacagggaccccccuuuuuggagcugcuccuaccucaagcagcacuacuacaauauccagugugcccgcuuuagguuuaucgacuacaguuucuucagcugcuucaacaacuccgucuacuucauuaaguaacacaacaucagcuccuccuccugcuuauucggcaucgacacuuccuucaaccgguucguugacuuucagccaacuggaagauucuauuaacaaguggacuauugauuuggaggagcaagggaaguuuuucauuaaucaagcgaagcagcugaacgcuugggacucguuacuuauuucgaacggggaaaaaauucucaaucugaacgguagcaucgagagaguuaagcagcagcaacagcaauuggaccaggagcucgauuucguguuggcucagcagaaggaguuggaggaguugauaacgccgcuggaaaaggaguuguuggaaauuccuguuacggacauagaucgaaaucaaauguaucaauuuucggaaauaauugacucccaacugaagcaaaugucugaugaucugaaagaaauuaucgagcauaucaaugaaucuaauaaaagcgaagaaauuucgaauccuuugacgc

SEQ ID NO: 4278 - RNA, 456 nt, Phyllotreta nemorum
acugcucuuuuuaggacuggauaacgcugguaaaacgacccuauuacacaugcuuaaagacgacagacuggcccagcacuugcccacguugcacccgaccuccgaggaauuguccaucgguaacaugagauucaccacguucgauuuaggagggcauucgcaggccaggagaguguggaaagacuacuucccugccguagacgcuaucguauuucucauugacgccaacgacagaucgagauucguagaaagcaagcaggaauuagacgcuuuguuaacggacgaaacucuagccaauugccccgugcuaauuuuaggcaauaaaaucgauuugccggacgccgcgucugaagaugagcugcgaaacguuuacucuuuguacggccagacgaccgguaaagguaaagucgcucgaucggaccugcccggccggccucucgagcuuuucauguguuc

SEQ ID NO: 4279 - RNA, 430 nt, Phyllotreta nemorum
agcaaaauccacgcaauuaccgggcuauuguugcaaacuagaaugaugauaaauucagcucucaguugccgagaagcauuaacaucaauguuacaaccuuuaacgacuguuaacgauuauuugaauccuucgacuaguagcaaugauguagaaguggaagcaaaaaggcaguauuuacucgaaucguaucccgaauuaauagguaccguacaaacaauaggaaccuucgaaucgcucuuaccguuucuuggaucgauuaauauaucuaaagugguggaguuuugcgagauuuuggaagaauuggcuucgaacaacacugaacucuacggagaauguagagauguuauaaaggaaguucuuggugcauugcaagauuauaaugauauaucaaauucaauuaaagcauuacuuucacagugggauuuuacca

SEQ ID NO: 4280 - RNA, 798 nt, Phyllotreta nemorum
ucuggaacggaaaccuauuguauucguucaagggauucuccauacacagauucugcuugccucuaaugcacggauucguuucgauuaacuucugcguagugaacgggcacagccuaaacuggucgauuguuaguagaaggagcguucaacgagccggcaccagguugcaccgaagaggcuuggacaaggaagggaacguggccaauuucgucgaaaccgagcagauagucgaguaccaaggcgaccgggcgaguuucgugcaaauacgaggaagcauuccgcuguuuuggcaacaagauccggaccugagguacaaaccgccgccuacuuugcucgacgucgacccgcaggaucagcacucgaugugucugaagcacaugaacgauuuaaugacucucuacgggaaggugguuugcgugaaucuaguagaucaaaaaggagccgaaggaaacauggaagucgcguuuaaggacgccguuagcaacgugucgucuccuucgguuaaguacgaaucguucgauuuccacgccgagugcagcaaaaugagaugggacagacugucgauucugaucgaucgguuggcgcacgaucaggacgagaugagcuucuuuuuguugcucagagacggcucguugaguucgcugcaagacgguguguucagaacgaacugcaucgauugcuuggaccgcacgaacguggugcaaagcaugcuggcccaucggaaucucgagggcguguugaggaaauugcaaauccuccaucagaaucaaacguuggaauuccaguauucguucgagg

SEQ ID NO: 4281 - RNA, 661 nt, Phyllotreta nemorum
acgaucaucgacaagcauuacagcaagcccaacguagugccuguggacguccugccggucuauccagauuucagcuuguggaaauauccuugugcucagguuauuuucgauuccgauccggccccagugggcaaacaaguaccggcucaaaucgaggagaugucgcaagccaugaucagagguguaauggacgaaagcggcgagcaguucguagccuacuuccuccccacagaggaaacucuacaaaagcgcagggaagacgucgcgaaccagguccaauaccaagacgaugaggaauacgaguacaaaauggccagggaguacaacuggaacguuaagagcaaggcgagcaaaggcuacgaggagaacuacuucuucgucguucgaucgagcgguaucuauuacaacgaauuagaaaccagagucagguugagcaagcgaaggcagaaagugggccagcccccgagcaacaccaggcucaucguuaaacacaggccuauggaugcuaaugaauucaggaugcaacgguacagggagaagcagcucgaaccuacaggcgaggaugaugaagagauggaaaucgacgagccccaagacgaggaaaacgugcuggagccggauaacggcaaggaaacggagagcgacaacgaaaagaaacgau

SEQ ID NO: 4282 - RNA, 780 nt, Phyllotreta nemorum
caaagaaguaggcuggaaguuagacucugccuugcugaagacccucaaagccaagaaugccgaaaaggucaagcuucuggacgaagccaucgaggacgcggagaagaacuugggagagauggaggugcgggaggcuuauuugcguaaagcggaguuuuacagcaggaucggcgacaaagaaaacgccgugagcaccuuuaggcagacuuacgauaaaaccgugucuuugggccaccgcuuggacaucauuuuccacuuaauuagaauaggcuuguucuuuauggaccacgaccuuaucaccagaaauaucgacaaagcaaagacccucauagaagaaggaggcgauugggacaggagaaaccgauugaaagucuaccaaggugcuuacuguaugucgguaagagacuucaaaaccgccgcuaaccuauuuuuggacaccgugagcaccuucacguccuacgagcucauggacuacaaggcuuucgucagauacaccgucuacacuuccauaaucagucugccgagaaaccagcuuagagauaaaguaauaaaaggcucggagauacuggagguacuccacuccgagccguucguuaaagacuaccuguuuucguuguacaacugccaguacgcagaguucuucucgaauuuggccgaggucgagacgauucugaggaaagacuacuuucugaauccgcauuaccgguauuacguuagggaaaugaagauuucggcuuacacgcagcugcuggaguccuaucgaucucucacauugcagua

SEQ ID NO: 4283 - RNA, 727 nt, Phyllotreta nemorum
agagaaaugguccaguguuccaguugcaagaaguuuguucauggaaccugcgaucccgaagcagacguugucaccuacagucaaaagaaagaaauaagcauggacuacgaauacguuugcuugcauugcaaaaauagcacggccagacaaauaaccgcgaaacgagcgaguaucgacgauccuuccgacguauccgcuucucacgauucccuguacgacgauacguccgaauuggaccuuccuucgcccgacgaguucgccagaaacauggguuugggcaaagggaagccguauagcgcgaauaaaauagccaagaagcgccuuaguuucacaguaaauccggucggcaggccgaaaggcaccggaaaggugccucccgggaaaaugggguuuaugaaacgcuaccgacuuaccgaauucaacagaaaacggggccccaaggccaaaaugagagguauuuucggagugcccggcgugggucugcaaagaccgauuucagauggaaaaaccgacgaagaaccaggagucgaaaaccgauuaguacuguguucagcuaaagauaaauuuacgcuuacacaagauauaugcguaaugugcggggcguucggaaccgaucaagagggcuguuugaucagcugcguacaaugcgggcaauguuaccaccccuauugcaucaacgucaaaguaacuaaagugauccuacagaaaggauggagaugcuuagacu

SEQ ID NO: 4284 - RNA, 685 nt, Phyllotreta nemorum
uuugaugaugacuuggacguggagucuguagcccaagcuucaaguaaaggcaaagguuugaagagaaaacauaaaaauguaucggaaaaugcuggcaagggaaaauugcagcaaauguuuuccaccaugccaacuaaacagaaaacggcagcaaaagucgaugacgacgaaaugcucucagaaaucuugggugaaaucgauuccgacacaccaaauaccucuaccguugagaaaccgaaaauaucccaguacucuucacuagccauuaacuuaucggccaaggauuacaugaaaaauuuggcacagccuguuaaaaaacgcgcaaucgaaaaaaguaccaaaguaccaaaauuucugcccaguguauccaaaccgauugaaaaaguaccaauuaaaccaguaccaauuaaaccaguaccagauaaaaccguaccaguugaaauucaaaacaccgcaaaggaacaggucaauccugaugaaaaugucgaaaaagaaauaauaaauccagcuaaaaauguugaagaggaaaagacagauccagauacaucacacuuacaauuugaugaugauuuggaugaaacuuuacuagaagaauuuagcgaagaucuaaaugaaaccgccacuacaucccaaacaacagaaucugaaaugaacggggacgauuucacaggggaaauggauacaa

SEQ ID NO: 4285 - RNA, 689 nt, Phyllotreta nemorum
augaguaaaaccgaggcauugacucaagccauuagaaagagcaucggaguaagaauaaaggaggagagcgaaauuaucgaaggagaaguugucgaucugagcauugaacguccagccacaggaguugguacuaaaguggguaaacuaauucuuaaaacuaccgauauggaaacuguauaugauuugggcgguaaaaugauugauaguauucuuaaagaaaaaguucaaucuggugauguuauaaccauugacaaagcuacaggaaagauuacgagauuggguagaucuuuugcuagagcuagagauuaugaugccaccggucaacaaacaagguucguucaaugcccggaaggugaauugcaaaaacgaaaagaaguuguccacacggugacuuugcaugaaauugauguaauuaacagucguacccacggauucuuggcacucuuuucuggugauacgggagaaauuaaaucagaaguaagagagcagauuaauggcaaaguagcugaauggcgcgaagaaggcaaggcugaaauuauaccaggcguacucuuuauugaugagguucacauguuggauauagaaugcuucuccuuuuuaaacagagccuuagaaaacgaaaugucuccaaucgucauaauggccaccaacagaggaaucacgaaaauucgaggcacaacuuacaaauc

SEQ ID NO: 4286 - RNA, 766 nt, Phyllotreta nemorum
uucgacucuucagaggaucucuguacaaaaaguacccuggaauguucaggaggucuaucacuaaugaagaaagaaggagguugauugaacucgguuugagccagcacguucuagcgagcagcguaucacugcuuagagcagaagaaguugaagauauaauugaaggaaaugaugaaaaguauaaagcuguaucuguacacacuucggagccuccuaugccaagagaggggaaauccaagaaaaacaugcaguggguaccuucguuacccaacuccagucauuuagaugcaguuccacaagcuacacccauuaauaggaacagaguagcugcuaaaaaggugaggacauuuccacuauguuuugaugacaccgauccccaaauaaacauagaaaacgcuugucaacaagaauugcugguuccuauuagacuagauauggaaaucgaaggccagaagcucagagauacguuuacuuggaauaaaaaugagaguuuaauaacgccugaacaauuugcugaaguccuuugcgacgaucuugauuuaaauccuuuaacauuugugccagcaauugcucaagcaauaagacaacagcucgaugcguuuccgacugaaccucccaguauuauagaggaaaccugcgaucaaagagucauuauuaaguuaaauauucacgugggaaauacuucuuuagucgaucaaguugaaugggauaugagugaaaaacagaauaaucccgaagaauuugcguugaaacuuugcgcugaauu

SEQ ID NO: 4287 - RNA, 358 nt, Phyllotreta nemorum
gaacucgccuuaugggauacggcgggccaggaggacuacgaccgccugcggccccuuuccuacccggacacggacgugauuuuaauguguuucucgaucgacucgcccgacucccuagaaaacaucccggaaaaguggacgccggaggugaaacauuuuuguccgaacgugccgauuacccugguaggcaagaagaaggaucugcguaacgaucccacuaccauuaacgaacugaaaaaaaugaagcaggagccugucaagccgcaagacggucggucgauggccgaaaagauaaacgccuucgccuacuuggaauguucggccaaaagcaaggagggcgucagagaaguguuugaga

SEQ ID NO: 4288 - RNA, 706 nt, Phyllotreta nemorum
agaugacacggacaauucaaaacaacgaugagaaggaagagaugauccaaucggcucugcagauuugcaaaucaaucggccccacuaucaacauaaccgauauaugcaaggaauucgcuaaucuuaaagcguacaaagccguuacggaauugugcgcgcauuucggcaagaaaauugauccggauaaaauagcagaaagcuacuauaacgccgaagacaacagcggugaccaagaaggguacaauuauuaucaaagaagguuggaaauuuaucgucauauuuugaauauguuggaucaguuauacaacgaacaaaaucaaacacaagucguuaguagagauccugcauacucaguuaaucagaccauauuacuggauggugucgaacagucccaaguaggauacgugaugaagcaaguaauaaaagacguuauggaaacgcccgaugaaauuaugcacuucgcccuuuacgauuggcugguguucaagaacaugacuggagauuugauaaacauccaaaauccgucuuuggaaacguauuugaagcgaacauccacccagaaucccaacaacaucgaggccaugaauuuguuauggaaauacuacgaaaguuguaacaaucacgcagcagcugccaaaauuuugaacaaccucgccucgagaaccggcauaaacguuccauugaaagagaggcugucuuacuuagc

SEQ ID NO: 4289 - RNA, 718 nt, Phyllotreta nemorum
gcgauuuuaaagaaagccgaagauggaaacaguuccgaaaacauucugguucuauuccugaguuucggaaauaaaugccaguuucauguauugaaaccuucaguuagagaccaagaaaucucucugcauagauuagccacucucgaaucgccucugaacgauuugauagacuucgccgcacaaguagacugcuuguggucgguauggcggucggacgugggcgaaacggugguguacauggcuucguucaaauccaaccgauggacucaaguaauacucgaauccgaaccgaccgauaaauuuuucccuguaaaaugcaacgacgucaagacgcuuuaccuacagcacauuuuccauccaggcagauucccucugcacgucauuaacaaaacucuuucgauuuauaaaaugccuacgauugggucagacagccacauguccauuucagcgcugaagcaaagaguuuguauggccguggaaaaugacauacaaaaccuguucaauaaagacgguacugauauuaacagcguugaaguugaugaguauguagagugugcugaaugguguuggcaaaaguucgacuccugcugcguucaguaccagauagccagcaggaaaccgcuggguuugaugcuucuaccguccguaucgggagcuauguugcugaagaaaucggcuuuuucguuccugcgacccguagauucguuggaacacauga

SEQ ID NO: 4290 - RNA, 696 nt, Phyllotreta nemorum
gcagaggaucguggaaauauucgggagauaucuacaagugaugcuggcgaaguacgcggagaauccgaaggaguauuggcgcagcaaagacgcggccuuguacuugguaacgucgcuggucagcaggggauccacucaaaagcacggcgucacgcagaccagccaguuaguggacauuacgcaguucugucagcagcauauuuugccugaauuggaacgacccgacguuaacgauuuaccgguauugaaagccgacgcuaucaaguacguaaugacguucagaucgguacuucccagcgaucuagucguaucgacuuuaccucaacuaaucaggcacaugccgagcgaaagcugugugguccacacguacgcugccugcacguuagaaaagauccucauguugaaauucaacaaucagcccauugugaccggagccgagcuggagccuuuggccucggaauuguugaccaauuuguucgccgugcuccagaagccggucuccgaggagaacgaguacauaaugaaggcgcugaugaggacguucgcuacccuacaggacaggaucauaccguauuugaacguggccuuacccaaaaugaccgaaaagcugcaaauggucgccaagaauccauccaaaccgcucuucaaucauuaucuguucgagugcuuuucguuggccauaaagaucguuugcaa

SEQ ID NO: 4291 - RNA, 457 nt, Phyllotreta nemorum
aucacguucgaaugcauagaggaauuaaaagaagauuuagaauggaagaugauuuacguagguucagcugaaacugaagaacacgaucaagucuuagacucuguguucguaggaccuauuccagaagguaaacacauguucgucuuucaggcagauccuccgaacgucucccguauaccugaaaaugaugccauugguguaacaguuguucugcuaacuugcucuuacaggagccaagaauucauucgcguaggcuauuuuauaaauaacgaauacagcgauccggaaaugagggaaaacuugccuaguccaccccaguucgauaagguuauaagaaauauauuggcguccgagccgagggugacgagguucaaaaucaacugggaggaaucuagcgguacucaggaaaacggaacuacaguugccgaagcacccgcuaaccaaacagccgaaacuu

SEQ ID NO: 4292 - RNA, 798 nt, Phyllotreta nemorum
gccauacaacaacaacaacagcagcaacaacaacaaagucuaccuacuacuaacucacaagugccuccucuagcuccaaugggagguucuacuccaacacuuggucuagguuuaggccaugcuauguccaugccacauacgaaguauguaacuggauauucacugcccaucaguucuauggcuccucaaacaccccaacauacaaugaugagcccuauggugaauguaggaggaacugguaccacuaguucugguguaacgccuacguuaggucccucuacaccuucaccaaugacuccuaugacaccgcauucagcagauccuggaauuguuccacaauuacaaaacaucgucucgacuguaaauuugagcuguaaauuagacuugaagaaaauugccuugcacgcgagaaaugccgaauauaauccuaaacguuuugccgcagugauuaugaggauacgagagccgaggacgacagcuuugauauuuucgucggguaaaaugguguguacgggugcgaaaagugaagaagacucgagacuagcugcgagaaaguacgcucgaauuauacaaaaauugggauucccugcgaaauuucuggauuucaaaauacagaacauggugggcaguugugauguuaaauuuccaauacgauuggaaggauugguucuaacucacaguucguucagcaguuacgagcccgaauuguuuccuggucuuauauaucguauggugaaaccaagaauuguucuguuaauauuuguguccgguaagguuguucugacuggugcuaaaguc

SEQ ID NO: 4293 - RNA, 513 nt, Phyllotreta nemorum
gcugucauacucaucugucauauuuauaauuuuuugacaguuuugggguuauugaagauuuuugaagaaucuuuuauauuuuaucuaccaaaguccccuuucaaagcucacaaaauggcugcaauucguuccaugucucgccuguuauucuccagaucauuacaaacuacuguaaaaaggggcuacgccgaucaaaugagcuucaccuuugcugcuggaaaccaggucuucuaugacgcaaaaucuguaaaacaaguagacguuccuucuuucuccgguagcuucgguauacugccagcccauguucccacccuugcuguucuaaaaccuggaguaguuacuguuuacgaagacggcgguucaguccaaaaaauuuucguauccagugguacugucacuguuaaugacgauucaucaguucaaaucuuagcugaagaggcccacccaguagaaaacuuagaugucagugcggcccgagaucuucuccacaaagcacaaggucaauugucaucg

SEQ ID NO: 4294 - RNA, 669 nt, Phyllotreta nemorum
agaaauacgagaaguccagcagggagcagcacgcggccgaauugaaggagaaacucgagcaggaagcgcgcaggaaggcgaaaaaagaggccgaaucggccaaacaggcucaaauaaccgaauugacggaagaacaagcugagaaauuacaagccgagcucgacgcuaaaaaguccccugcuucggcagcaccuucgaauagcuccgauacuccuucgacuucuacugcgaagauugaggaagacgaggacgaguccgagaaggguaaauuauugccgaacagagggaacggcugcgauuuagaaaaauacaauuggacacagacgcuuagugauauagagcugcgcgugccgcucaaaugcgauuucagaguaaagcaaaaggaucucacggugaacauuacuaaaaagcaccucaccugcggccugaaaggccacccgcccaucaucgacgaugauuuccagcacgagaucaaacuagaagagaccaauugggucauagaagacgggaaaucguugcucuucuccauagaaaaggugaacaaaaugaacugguggaguaaaaucgucaaguccgauccggagauaagcaccaagaaaaucaauccggagccaucgaagcugagcgaucuggacggcgagacgcgcggcauggucgagaagaugaugu

SEQ ID NO: 4295 - RNA, 334 nt, Phyllotreta nemorum
gcgauagagaaagguggauuugcguuuauccagcguacauuaauugcaaaaagaccauagcccaaggcaggaaacuaaacaaagauaaaugcguggagaaucccacucaucaagagaucagagacguuuuggucgcagcagguuugaagguuggcguggaaaauaaauuguacagcagagaacgaagcaaagaauugcuguaucgagggcgaauaagaguucaauugaaaaacgacgaugguucguugugcaauccaaauuuucccacuagagaugccauuaugcuccauuuaggagacaugauuccuaaguugaagaguagacagaacaaggg

SEQ ID NO: 4296 - RNA, 700 nt, Phyllotreta nemorum
auucguaauaacccauccggaaguaaaacauuggauuaaauaugcucguuucgaggaaaaucaugguuucauucauuccuccaggcaaauuuacgaaagagcuguccaguuuuauggagacgaucauuuggacgagaagcuuuacauagccuucgccaaauucgaggaaaaccagaaggagcacgacagagcgagaguuaucuacaaguacgcuuuagaccacauuccuaaggaugaaacgaaagaacuguauaaggcguauaccauccaugagaagaaauauggagauagaagcgguauugaggaaguuauaauguccaaaagaaagcugcaguacgaacaagaaauacuccaaaauccuacaaacuaugaugcuugguucgauuaucucaggcugguagaaggagaagcagauuuggaaacgacccgagaaacuuacgagagagcuauugcaaauauaccuccgucaaaaaacaaacaauacuggagaagauacaucuauuuguggaucaauuaugcuuuauucgaagaacuugaugcuaaggauuacgaacgaaccagacagguauauaaagcuugccuggaaauccugccgcacaaaaccuucacauuuuccaaaauauggcugcucuaugcgcaguucgaagugcgccagaaaaaucuaacagccgcccguaaaguucuaggcauguccauagga

SEQ ID NO: 4297 - RNA, 749 nt, Phyllotreta nemorum
aucaucauccagcuguuuguggccggucucaucgugcugcugcucgacgaauugcugcagaaaggguacggucuggguuccgguauuucucuuuucaucgcuacgaacaucugcgagacgaucauuuggaaggcuuucucuccggcuacugucaacaccgggagaggaaccgaauucgaaggggcuguaaucgccuuguuccacuugcucaccaccagacaggauaagaucagaggguuacgagaggcuuucuaccgccagaaccuucccaauuugaugaaccucuuggcuacaguuuuaguguuugcuauaguaauauacuuccaagguuuuagagucgauuugcccauaaagagcgccagguaccguggccagcauucgagcuaccccaucaagcuuuucuacacuuccaacauucccaucauccugcaauccgcucugguguccaaccuguacgucauaucccagauguuggccguuaaauuucaaggcaacuucuucauuaaucuccugggggugugggcugacguugggggcggcggcccggcuaggucguacccgauaggcgguuugugcuauuacuuguccccgcccgaaagcgugagccacauuuuggaagaucccguccacgcuguuauguacauuauauucauguuggguuccugcgcuuucuucucgaaaacguggaucgaaguguccggcaguucggcuaaggauguugccaagcagcuuaaggagcaacagauggu

SEQ ID NO: 4298 - RNA, 340 nt, Phyllotreta nemorum
gcaggacaaguuauuaaggcuuucuacgacguuguauguaggaaaucuaucauuuuacaccacagaagaacaaauauaugaauuauuuucgaaaugcggcgacauuaggcgaaucguuaugggucuggacaaguacaagaaaacaccuuguggguuuuguuucaucgaguauuacaaccgcgaagaugcggaaaauugcuuaagguacaucaacgguaccagauuggacgauagaauaguacguacagauugggaugcggguuucauagaaggcagacaauacggaaggggaaaaaccggugggcagguaagggaugaauacaggacugauuucgauucc

SEQ ID NO: 4299 - RNA, 669 nt, Phyllotreta nemorum
cgucaaagcaucggauuuagaauugcacccgcccaagaacaucuggagccacagcggaauauucagcucguuggaccacgccagcguucgaaggggcuacgaaguguacaaacaagucugcgccgccugccacucguugcguuucgucgccuaucgcaaccugaucggcgugucccacacggaggccgaagcgaaggccgaagccgaagagcagaugauccgagacgggccgaacgacguaggcgaaauguucacgcgccccggaaagcuauccgacuacuuccccagcccguaccccaacgaggaggcggcgcgcgccgccaacaacggggcauacccgcccgauuugagcuacauuacggccgccaggcacggagccgaggauuacauauucgcgcuguugacggguuacugcgaggccccggcgggcguggugcugagagaagggcaauauuacaauccguacuuccccggcggggccauuucgauggcucaggcucuguauaacgagacgaucgaguacggagacgguacgccggcgacggcgagccagcuggccaaagacgugucgacuuucuugaaguggaccgccgagccggagcacgacgacagaaaaaggaugcugauuaaaguuauuggaauauucucguuccuguuaggguugacuug

SEQ ID NO: 4300 - RNA, 679 nt, Phyllotreta nemorum
acgucagcgaauuucaauucgaaaaccagaggagaacguucgccaguuacgguuacgcuuuggacccuuccguaacuaacgacgggcaaauaaaaguggucggauccucggaagccgacgauagcagcauuaagacuguguucgaagcuuccaaaacgagaccguuagauaaacgaaaaaggaagaaaaacgacgaucccagugauguggacggguucuuaggcccaugggguggguucauagacgaacaaaaaauaucuaaaccgaccgaggaggagcaaaucgaacuggacgagauaucguccaaaaagaauaaaaaggguaaacccaacgaagauaaaccccucgaagaaaaaucaguccugcacaucaaagacgccguggauuaccaaggacguucguuccuccacgcgccccaagaugucggcgucaaccucagaucggacacaccgccugauaaauguuuccuaccaaaggcucacauucacacuuggacuggccacucgaagggcaucgcugcuauccgauuguuccccaggacggcucaucuucucuuaucagccggaauggacugucgcauuaaaaucugggaggucuacaacgaaagacgguguguaaggaccuacuaugggcaccgacaagcuguuagggauauuaauuucaauaauuccgggaagca

SEQ ID NO: 4301 - RNA, 691 nt, Phyllotreta nemorum
cuuuggcagucaagaaagucgagccgaaaaaagaagucaaucccuuauucgaaaagagacccaggaauuuuggaauaggucaagacauccaacccccuagggacuuaucgagguucgugaaauggcccaaauacauccgcauccaaaggcagaaagccgucuugcagaaacgucugaaagugccgccgccgaucaaccaggucucccagaccaucgacaaacaaacagccacccaauuauucaaaguguuggagaaauaccgaccggaaaccgccuugcagaaaaagaaccgacugaaggccaaagccgaagcuaaaguggccaaaaaggaagaggccccgacuaaaagacccaacaccuuaagagccgguaccaacacggucaccaaguugauugaacagaaaaaagcccaauugguggucaucgcccaugacguagacccuauugaauuggugcucuuccuccccgcccugugcagaaaaaugggaguccccuacugcauagucaagggcaaagccagguuagggcugcuggucaggcguaaaacuugugcgacugucgcccuuacccaagucgauuccggagacaggucgaacuucaacaaacuccuggaggucgucaagaccaacuucaacgaccgcgccgaugaaaucaggaggcacuggggaggcgguauccucgguuccaaauc

SEQ ID NO: 4302 - RNA, 789 nt, Phyllotreta nemorum
uacgcaaugaccgauuacuugaggauauccggcauguacuggggccuuacggcucucgaauugaugaaugccucgccuccgcacacaauagaagagauuucagauuacaucaaaaacugucaagaccccgaaagcggcggcauaagcuccugccugaaccacgauccucacauacuccacacccugagcgccguccagauacucugcauguacgacaaucuaaaagccaucgacguggagggcgucgugaaguacguuaaaaaccuacagcuacccgacgguagcuucacgggagacaaauggggcgaaguggacacgagguuuucguuuugcgcuguugccacgcugucgcuuuuaaacagaauggacgcuauugauguuaauaaagcuguggaguucguagcuuccuguaaaaacuucgacggaggcuucggaucgaggccacucuccgaaagccacgccggcuugauuuacugcugcuuaggauucuugucaguuaccaauagauuggauauuguggaucgggacaugcuggcuugguggcugugcgaacggcagcuaccuucgggggguuugaacgggcguccggagaagcugccagacgucuguuacuccuggugggugcugucuucgcugaccauacugggcaagcugcauugcaucgacgccggcgcuuugaagagauucauauuggccugccaggacacggagagcggaggguucgcugauaggccaggggacauuccggauccuuuucauaccguguucgguauaucggcgcuuucuuug

SEQ ID NO: 4303 - RNA, 727 nt, Phyllotreta nemorum
gcuggaaaguuugauaaccgauuugaaagcggagccccgcguggcggccaacgugugcugggcauucuccggauuggccgaagcugcuuaugaagcggccgcuguuaacgaggaaacggggacgccggauaccuacauuuugucgccuuacuacgaauucauuauacagagauuacucgagacaacugauagagccgacggggcucaggcgaacuugagaccggcagcguacgaggcccugauggagaugguuaaaaauucaccuaaagauugcuacguuacgguucagaaaacuacgaugguuauuuuagaaagacugcaacagguacugcagauggaaacucacauuaccagccacaacgacagaucacaauuuaacgauuugcaaagucuuuugugcgccacauugcagucgguuuugaggaaagucacgccugaggaugccccgcauauuuccgaugccauuaugacggccaugcugaccauguucaauucgaauucuuguaaaaguggaggcguacaagaagacgcucugauggccguuucgacgcucgucgagguucuaggugaaaauuucauaaaauacauggacgccuucaagcccuuccucuauaucggcuugaagaaucaucaggaauaucaagugugcggcaccgcagucgguuugacgggcgacauuuuucgcgcauuaaaacucaaagcgcuucccuauugcgacgaaaucaug

SEQ ID NO: 4304 - RNA, 793 nt, Phyllotreta nemorum
agagggcuaugggaaguauuuggauuuacacgagugcuacgagaaguacauaaauuuaaaaggcaucgagaaaguggauuauaucacuuaccuggccauguucgaucagcucuacgacauaccgaaagaacgaaagacgggggaauacagaaaauaucuucuauaccuuauugaauaccucacgugguuugugcaacgcauucggccccugauggaccucgacagcgaucugcaggaacaagucgagcaggcuuuggucaauugggauaacggcauggucccgggauggccgaaagaaacaggcucggcuuuggccaacgugggcgcccacuuggaccuaucggccuucuccaguugggaggaauuggcuucguuggguuuggaucgcuuaaaaucagcccuaauggcucuaggauugaaaugcggaggaacguuagaggagcgagcccaaaggcuguuuuccacuaaaggcaaaggcuccuuggauccuucucucaugaccaaaaacagcaagaaucgaauaacuaaagagaaagaagcccugaggcaaagagaacuggcuacucuagaagcucaaauuuacagauuggcugaucuggucucagcccaacgagcagccaccaaagagaacguacaaagaaagcaagcucguacagacggcgaaagagaugauagcgagaacgaagagagcgaggaagagagcccggacgaaggugacgaugacgucccguacaaucccaagaaccucccgcucggcugggacgguaaacccauuccguauuggcuguacaaa

SEQ ID NO: 4305 - RNA, 563 nt, Phyllotreta nemorum
cguuuaucggcacuuucaaagcuuucgacaagcauaugaacaugauacucggcgacugcgaagaauuccgaaaaauuaaacccaaaaacucgaaagucgaacgagaagaaaaacggguauuaggauuuguauugcucagaggcgagagcauagucucacugacuguagaagggccuccaccaccagaagagggacuuccuaggguaccuauccccggagcagcccaagggccagguauaggaagagcagcagguagaggaaugccucccgguauggcuggaguuccaguaggucuccaaggcccuguaagaggagucggaggaccgucccagcaaguaaugacgccuacggguagaggacaaguuucagcgccaccacaaaugaaccaagcgccuccaagaaugggcggcccaccgccugguaugaugggaccaccgcccggcaugaugggcaugccaccgcaaaugggcauggggcgcggaggaccgccuccgaugggcaugaggggucccccgcccgguaugaugagaggcgggccgcccggacccccgaggccauauuaa

SEQ ID NO: 4306 - RNA, 690 nt, Phyllotreta nemorum
cauccgcuaaauacacaacguuuaaauuuaggacaauuucacugcuuauucggugaauugcggaaguauccggaaagauuuuucaauuauuacaggaugucgaucacuuccuucgacgaauuaguuuuguuucuucgaccucggcugcaaaagaacaauacucgauuuugcaaaguaauaagcguagaggagagguuaacaauaacucuaagauauuuggcgacggguacgaauuuugcugcaaugcagcacucauucguuaugggaagaacuacaauagcggaaauaguuaaagauacgugcacugcucuauggauaacauuacaacccauugaaaugccugaaccuaccacagaaagaugguugcaauaugcuaacgaauucuggucgcguucuaauuuucccaacuguauuggagcuguugacggaaaacauauucgucuaaugucuccacaacauagcgggucacaauacuuuaauuacaaaaaguauuuuucacuaauguuaauggcaauugcugaugcaaacuacuguuuuauugcugucgauauuggugccuauggcagagaagccgauuguaacguuuuuaagcaaucuaccuugggagugaaaauguauaauaauacuuuaaaucuuccccccccucgagguuugcccggaaccaaugaaccaugucagccauuuguguuu

SEQ ID NO: 4307 - RNA, 321 nt, Phyllotreta nemorum
cgaauccucggauaugauggccgguuacgaucacgaagaaaccgauauaaucaucucagauccaaccaccagcguucccgaagacucaauuuccacuaaggaagacuucgaggagcucauugacgaaggaucgcgcaaaaacaacaucagcaaacaggaagugaccgccaaacacauucaggauuuccacagguacaccgaauuguucgauuacggcaaaccugacgcaguuaagaaaccgggcggcaaaaaauuccaaccgaaagugucucucguuggaggaguagcuuugccgaguaagcccaacgcagagaagauuau

SEQ ID NO: 4308 - RNA, 800 nt, Phyllotreta cruciferae
gcucgauugagaucucacauuagaauacaagacggacgagccaagccgauugaucuacuagcgaaguacauaagcgccgaagaagaagucgaugccguugaaaugcacgagccuuacacuuaccugaauggcuuacaaaucaaagaccuagaagacuuaguagaagacaucaaagucuacaaggaacuagaaagaggaaaaaaccuagauuacuggaacgauauaacaguaauagucgaagacgagcuucagaaguugagaaaaauugaaaaacaaaacgauuuugacuugggauugaaccgaagggaaggaauacaucagucugucgccacugauguaacaucaguauuuaaaggcaaaacagccgcacaauuagcagcguuagaaaaacaaaucggaagcaaaaucagcagcaaagccgauggaauagacauaggcuauugggaaucuuugcuaucgcaacuuaaggcccacauggcgagggccagacuacgugacagacaucaagauagcuuaagaaggaaacugcaaguacuuaaagcagaacaagccaucacaggaguaggucaaagccauagcgaaacccauucuacugauaacgaagaaaccacuucggaacccaaaccaagcacuucccaggauacuuuggaaacgauggaagaaagcaacgaaaagaccgaagacgcugcucaugaauggcucaacgaaugcuuuucagccuaucaagcaggcggguacaguccuaaguuuuuaacucccgaugacaccgagccugguacgauuguagucucggaggaaga

SEQ ID NO: 4309 - RNA, 741 nt, Phyllotreta cruciferae
uguaccgaaaaaucccgaauggaaaugcaaaaccugcugaaucaaccgcccaucgagaacccguacggggagcccauucaagccgaaaaggccccagaggccaucagcaaggccguggcuucccugccacccgaacagauguucgagcucaugaagcaaaugaagacuaccauacaaaauaaucccacagaggcuagacaaaugcuauugcagaauccccaacuggcuuacgcuuuauuacaagcccaaguggucaugaagauuaucgauccccauacggccgccagccuacugcacccgguuaaccaaguaccggccacuuugcugccgggggacaagaacguggccgugcaaguaccaauaaacaaccaguaccgggagcccccugcccccguacaaccgcccaggcaggaguaccagccgguaccgccgcccuuaguacaucccaaucacguucaacaacccguguuuaccggucaagauguggacuugcgaucgaugggaaaugugacugauccgagaaucaggcccaugauuguggaucaggauaugagacaaaugccggccguuauccagaauccucuaccgccuacuauuagcgaaaguuuuucgagggauccccgaagcggcaccaguuucccaucggauccaaggcaagcuaggauggacccgcgucaaaaaaauauaguaccaccgacgagccaacaaguacccccaacggugaaucccaagauaaugccc

SEQ ID NO: 4310 - RNA, 661 nt, Phyllotreta cruciferae
gaagcaacugacagaagagaaauucauuguaaaggcaacaaacgguccucguuacguagucgguugccgucgucagcuggauaaagccaaguuaaaggccggcacaagaguagcccucgacaugaccaccuuaaccauaaugcgguacuuaccgagagaaguugauccguuaguuuacaacaugagccacgaagauccaggagaugucacuuacucagccaucgguggacuuuccgagcagaucagggaauugagagaagucaucgaauugccucucaugaaucccgaguuguuuaugcgagugggcauuacaccaccaaaggguugucuguuguauggaccgccuggaacugguaaaacucuguuagccagagcaguggcgucucaacuggaugcgaauuucuugaaagucguauccagugcuaucguagacaaauacaucggugaaucugcuaggcuuauuagagaaauguuuaacuacgccaaagaccaccaaccgugcaucauuuuuauggaugaaaucgaugcuauugguggccgaagguucucugaagguacaucggcugauagagaaauccaaaggacgcuuauggaguugcugaaucaaauggauggguucgauucguuaggacaaguaaaaaugauuauggcgaccaauagg

SEQ ID NO: 4311 - RNA, 641 nt, Phyllotreta cruciferae
uaugccauggaagccauaucacaugcaggaacaugccuaggcauucuggcgaacgacggaauccuucuugccgcugaaagacguaacaccaauaagcugcuggacgaaguuuuuauuucggagaaaauauacaaacucaacgaugauaugguuugcagcguagcaggaauuacuucugacgcaaauguuuuaacaaacgaauugcgucugauaggacaaagauacuuguaucaguacggcgaaucgaucccuugcgaacaguuaguuucuugguugugcgauguaaaacaagcuuauacucaauacggaggaaagcggccuuuugguguaucgaucuuguacaugggcugggauaagcauuaugguuaucaauuguaccaaucagauccgaguggaaauuauucugguuggaaagcgacuugcauaggaaauaacaguucugcugccauuucgaguuugaaacaggaauacaaggaaggcgauaugacuuugaaagaugccaaagguuuggcugugaaaguuuuggcaaaaacguuagauauggcuaaauugacuucagaaaaaguggaaauggcuacucugacacguagaaacgauaagaccaugauaaauauauuaaauagcaaagaaguggaagaacu

SEQ ID NO: 4312 - RNA, 670 nt, Phyllotreta cruciferae
guguaccuuaugucgcugaucccgaaaauacuacucuucuucaaacugcuuuaaugcuguucaggaaauucaagcaguacccucaagcacuucgguuggcuaugcaacugaacgaucacagucucaucgaggaaauauuccuaaauugccccgauacugacguacaaaaacaguuggcguucauguugggcaggcagcagauuuacaucgaaguucccgacagcacgccggaguacgaagaucucaucgaaauuauggcgaauugucaccugaauaaccacuuuuugaaucuagcacgugaauuggauauuauggaccccaaaaccccagaagauguuuacaaaucccacuuggaaaacagccguccuccauucgguggaagccaagucgauucggccaggcagaacuuggcugcaaguuuugucaacgguuucguaaacgcugccuucgggcaagauaagcucuuaauggaagauggaaacaaauggcuguauaagaacaaagaacauggcaugcuaagcgcuacugccucuuuggguuuaguauuauuaugggauguagaugguggucuuacgccuauugauaaauacuuguacuccucugaagaucacauuaaauccggagcucuauuggcaugugguauugucaauuguggagucagaaaugagug

SEQ ID NO: 4313 - RNA, 742 nt, Phyllotreta cruciferae
caaccaucaguaccagaacauguacauagagagaacuacaguugauaauucuccuucugcuacuguuuuguaucgggaugaucccaauuugggagcuucuagauuccaaggaaauuacgacauauccagcucucaaucgcaagugaaccuucuuccauccgcaccaggagaaaccuacuauacaucaacaccuaacuggacgccgacgagcagcgguacuuaccaacagcaguacccaucugggaccauaaacguccuucaggcggauucgacucaagccuucgggaguccauacauaaacgcgacauggucgucgaauucgauggaggacggacggccgucuagucaagagguacuagugaaagagugcguuaauuguggugcuagcgucacaccacuuuggcguagagacgguacggggcauuaucuauguaacgcgugugguuuauaccacaaaauuaauggggugcacagaccgccgacuaagccaaccaaaaaaccacaggcgacuggaaauagaagaaacggcguaacgugugcaaauugcaaaacuaacaacacaacucuuuggagaagaaacaaccaaggcgagccaguuuguaacgcuuguggacucuauuacaaauuacauaauguuaacaggccgaucaguaugaaaaaggaagguauccaaacgcgcaaaagaaggcccaaaaacucuucugugggaaaccccgccagugcugcaggucaaguaagacuu

SEQ ID NO: 4314 - RNA, 667 nt, Phyllotreta cruciferae
uuaggacucaguuugcucacaguagcguucgaaauuagcgcagauaacauaggcaaauacagcacauuguugacccuaguggaagacgauuugugcaggaaucuguucgcuuugaugaacaccgaucguuugacgauauucgcugcgaaucugcaagugucguuucugcuguucgaaucgcugagagcccacuugaaguaccaauuggaaugcuauuugaagaaacugauggaaaucuugcguagcgaaucgaacaagguuagcuacgagcacaaggaaaucgcgcuggauaauuugcugcaauuguggagagugcccggguuccaugcggagcuguacgugaacuacgauugugauauguauuguacuaauuuguacgaagagcucaccgaacugcuggccgaacgguccauuuccacuauaguaggugucuaucaugcgcauuuacugucgcucgauggacuucugauuauaaucgauggcauagggaagagauucgacgaagcgaaagaucguacagacaccgaugagauuaguaguuauauaggagagaauacgagaauuaaagguuguguuaaaguucccgauaagaaggugcuggcugccaagaaagggaucaaaaagugguuaccgcaagguacggaguauuucaaucagaagccgaaga

SEQ ID NO: 4315 - RNA, 480 nt, Phyllotreta cruciferae
auacaagcccaaaccgucgccacggauuucgagaaagucuucgaaaugggcccccauuuauucgugggccuccccggccucgccaccgacacgcaaacagucauggagaagcucagauuccgcaagaacuuauacgaauugaaagagaaccggcggaucucgcccaaaguguucgcagccaugauaucgaacaugcuguacgagaagagauucgggccguucuucguugaaccgguuguagcaggucuagcuccugacacauucgagccuuauauaugcaacauggauuugaucgguuguauaaacgaacccagugauuucgucguaggaggcacagccuccgcgcaauuauacggaaugugcgaaucuuuaugggaaccuaaucuagcccccgaugauuuauucgagacuauaucgcaggcuuugauuaaugcuuucgauagagaugcuauauccgguuggggcgcuacgguuuauauc

SEQ ID NO: 4316 - RNA, 722 nt, Phyllotreta cruciferae
aauacaccuccguccuucuacugggcgaauuagccgaauggauagaaaaacacccggacgcccuggaccccguccugaauuuccuaguaugcugucuccgcagcggcgccgaaggaggaggcgucgcgacggcggcggccgcggcgcugcagaacgucugcacgugcugcggcgcucacaugggcaggcacguucccauucuguuacaguuacuucaacagucggauucguucggaaucggcaacacggcgguggugggauuguugaagggcgucgcgucgguggugaguugcggcaugggaggcggcgccgagacggccuccgccgucagggaauuguguucuaugcaauugucgccgcugugcaguuugauggagaacgacguucggccgguuaaagggacucugacggauccggugcugugguuggaucgauugaguucgguuuugcgauacguuaacgucaauauagucgaaggcgaaauccauccuugcaaaccgguaauauuggagauauggccgauacuaucccgcgcauucgacaccuaccacagcgacguucgaauaauggaaaggugcugucgcucggugcguuucauguugcguugcguggcccgacaacuccaggauuugcugcccucuuuggucggacaaaucgugcauauuuacugucucuacgggcauucguguuguuuguacgugggcagcaucuuaguagacgaa

SEQ ID NO: 4317 - RNA, 712 nt, Phyllotreta cruciferae
acauccaagaagcccuaaagcgccccaugaagcagaaaagaaaacuacgaaucuucauuucuaacacuuucuacccggcaaaagaaccccaacccgaaggccccgacggcccuugccaagagggcacgguagccucaugggaacugagagucgaaggcaggcuucucgaagauuccaagaacgauccgaacaaagucaaacgcaaauucuccucguucuucaagucuuuagucaucgagcucgacaaagagcuauauggccccgacaaccacuuggucgaguggcacagaaccuuaaccacccaagaaaccgauggauuucaaguuaagagacccggagacaagaacgugagaugcacaauucucuugcuccucgacuaccaaccucugcaauucaagcucgauccgaggcuggcccgauugcuugguguacacacacaaacaaggccagugauuaucuccgcucuguggcaguacaucaaaacgcaccggcuacaagacggccaugaacgcgaguauaucauuugcgacaaguauuuagagcagaucuucaacuguacucgcaugaaguucgcugaaaucccccaacgauugaacccccugcuacacccaccugauccgaucguuauaaaccacguuauaucagucgaaggcggcgcugagagcaaacaaacggcuugcuaugauauagauguggaaguugaugacacucu

SEQ ID NO: 4318 - RNA, 282 nt, Phyllotreta cruciferae
ucgagccaacuuuagaugaauuggaacaaaaaaugagagaggccgagaccgaaucacacgaaggaaagcgaaagaacgaaucauuguggcccauauucaaaauucaccaccaaaaaucccgauacaucuucgaccucuuuuacagaagaaaggcaaucagccgggaauuguacgaauauugcuuacuggaaaacaucgcagacaagaauuuaaucgcaaaauggaagaaacaaggcuaugaaagccuuuguugccugagaugcauccaagcaagagacacua

SEQ ID NO: 4319 - RNA, 679 nt, Phyllotreta cruciferae
aauaugucgcaauggacacugaauuucccggaguuguggcuaggcccauaggugaauuucgaaguucggccgauuaccaauaccaaauguuaaggugcaacguagacuuacugagaauuauucaacuagguuuaacguucuuagaugauaaugguaaaacaccaggagguguuuauacuaccuggcaauucaauuuuaaauucaaccuucaagaagacauguaugcacaagauagcauugauuuacugcaaaauucaggaauccaauucaagaagcacgaagaugaagguaucgagccguuagaguuugccgaauuacuaaugucaucuggaaucguucucauggaaaauaucaaaugguuaucguuucauuccggcuacgauuuuggcuauuuaauaaaguuacuaaccgacaacaaucucccacaagaugaaacugaauucuucgaucuguugaaauuguauuuuccuacgauauacgacgugaaguauuuaaugaaaucguguaaaaauuuaaaagguggucuucaagaaguugccgaacaauuagaauuggaaaggauugggccucaacaucaagcuggaucggacucgcuuuugaccggaauggccuuuuucaaaaugaaagagauguuuuuugaggauacuauugacgauucgaaguuuucgggccaucuuua

SEQ ID NO: 4320 - RNA, 750 nt, Phyllotreta cruciferae
caucuucgcauaugguuucgagaagccuucggcuauucagcaaagggccauuauuccugugaugaaaggccgagauguuauagcccaagcacagucagguaccgguaaaaccgcuacauucuccauagcuauucugcaagcucuggauuuaacgaugagagaaacgcagguguuguguuuauccccuacgagagaauuggcuguacagauucaaaaaguuauauuagcucuaggggauuucaugaacguacaaugucaugcuugcaucggggguacgaaccuuggagaagacauuagaaaguuggauuauggacagcauguuguuagugguacaccuggaagaguuuacgacaugauucguagaagagcucugagaacuagaucagugagaaugcuaguacuagaugaagcugaugaaaugcuaaacaaaggcuucaaagaacaaaucuacgauguguacagauuucuuccaccguccacucaagugguucucauaucugcuacguuaccccacgaaauuuuggagauaacauccaaauucaugaccgaucccaucaggauucuaguuaaacgugacgaacugacgcuggagggaaucaagcaguuuuucguggccguggagagggaagaauggaaauucgacacucuaugcgaucucuacgacaccuuaaccaucacccaagccguaauauucugcaauacgaagagaaagguggauugguuaaccgagaagaugcgagagaacaacuu

SEQ ID NO: 4321 - RNA, 678 nt, Phyllotreta cruciferae
uacuguggaagauaccgaguugauugaggguaucguuuucucgcagaaaucugcuaacguaucuggcccgaagagaaucgaaaaggcuaagauuggucucauccaauucugcauuucuccuccgaaaacugacauggaccacaauguuauuguaucagauuacgcugcgauggaucgaguuuugaaggaagaaagagcuuacauuuugaacauuguuaaacagaucaagaaagccgguugcaacguucuuuugguucagaaaucgauucucagagaugcuguaucugaucuagcucuucacuuuuuggauaaaauaaagugcaugguugucaaggauauugagcgagaagauauagaauuuguaugcaaaucguuggguugccgaccaauugcaucacucgaucauuucaccgcagagaaucuaguaacugcugauuuggucgaagaaguuggaguaggcgguaaccgaaugguaaaaauaacagguauucaaaacgccgggcguacuguuacccuacucgugagaggcucgaauaaacuaguauuagaggaggcugagaggucucugcaugacgcucuuugcgucauucguugucuuguucgcaagaaggcgcugaucgcagguggcggggcaccggaaaucgaagucgcccuuaagcuggcugcuauggcuaauaa

SEQ ID NO: 4322 - RNA, 741 nt, Phyllotreta cruciferae
gcaagaucuagacauggaggauuuguacacgaaauacaagaaacuacagcaaaccuuggaauuccuugaaguccaggaagaguacaucaaagacgagcagaggaacuugaaaaaggaguaccuacacgcacaagaagaagucaaacguauccaaucaguaccgcugguuaucggccaauuccuagaagcaguagaucagaauaccggcaucguuggaucaacuaccgguucgaauuacuacguucgcauucucuccaccaucgacagggaauuacugaaacccucugcuagcguagcccuacacaagcacagcaaugcuuugguggacgugcuaccccccgaagcggacuccucgauuagcaugcuccaagccgacgagaaaccagacguacaauacagcgacaucggagguauggauaugcaaaagcaggagauucgagaggccguugagcugccguugacccacuucgagcuguacaaacaaaucgguauagaccccccgaggggugugcugauguacggaccacccggguguggcaaaaccaugcuagcuaaagccguagcucaucacaccacagcugcuuucauucgagugguggguucggaguucgugcagaaguaccugggcgaggggccgaggaugguuagagacguguuccgucuggcuaaagagaauuccccugcuauuauauucaucgaugaaaucgaugcgauugcuacuaagagauucgaugcucagac

SEQ ID NO: 4323 - RNA, 362 nt, Phyllotreta cruciferae
gacgauaaaaaccaugcuggaggaccucggcauggacgaggaagaggaggaaguggugccguugcccaacguaaacucagccauucuacggaaggucauccaaugggccaccuaccacaaagacgacccacccccgcccgaagacgacgacaacaaagagaagcgaacggacgacauauccucgugggacgcggauuuccugaaagucgaccaaggcacacuauucgaacugauccuagccgcgaacuaucucgauauaaaaggcuugcuggauguuacuuguaagacuguggccaacaugauaaagggcaaagcgccggaggaaauacguaaaacguuuaacaucaaaaacgauuucacgc

SEQ ID NO: 4324 - RNA, 705 nt, Phyllotreta cruciferae
ugugugauaaggcgaaagaaauacuguccaaagaaucaaaugugcaggagguaaaauguccugucaccguuugcggagauguacacggacaauuucacgaucugauggaauuauuuaggauagguggccgaaguccagauacgaauuaccuuuuuaugggugacuaugucgaucguggguauuauuccgucgagacuguuacucuuuugguggcuuugaaagucagguauaaagaaagaauuacgauccugaggggaaaccaugaaucaagacaaaucacucaaguauauggauucuacgacgagugccugcgaaaauacggaaacgcgaacguuuggaaauucuucaccgauuuguucgauuacuugccgcuuacagcgcucgucgauagucaaauauucuguuugcacggagggcucaguccuagcauugauaccuuggaccauauuagagccuuagaucguuuacaagagguuccucaugaagguccgaugugcgaucuucucuggucggaucccgacgaucgcggagguuggggcauuucuccucgcggugcaggauauaccuuuggacaagauauaucggaaacguucaaccacagcaacgguuugacguuggucucucgggcccaucaacuugucauggagggguacaauuggugccaugacagaaacguuguaacaaucuucagugcuccaaacuacu

SEQ ID NO: 4325 - RNA, 770 nt, Phyllotreta cruciferae
uuaaagccaagauccaggacaaagaagguaucccaccagaccaacaaagauugaucuucgccggaaagcaauuggaagauggccguacucuuuccgacuacaauauccagaaggaaucuacccuucacuugguacuuagacuucguggugguaugcagaucuucguaaaaacucucacuggcaagaccaucacccuugaagucgagccaucugacaccauugagaauguuaaggcuaaaauucaggacaaagaagguaucccaccagaccaacagagauugaucuucgcaggaaaacaauuagaagauggccguacucuuuccgacuacaauauccagaaggaaucuacucuucacuugguacuuagacuucguggugguaugcagaucuucguaaaaacucuuacuggaaagaccaucacccuugaagucgagccaucugacaccauugagaauguuaaggcuaaaauccaggacaaagaagguaucccaccagaccaacagagauugaucuucgccggaaaacaacuugaagauggccguacucuuuccgacuacaauauccagaaggaaucuacccuccacuugguacuuagacuucguggugguaugcagaucuucguaaaaacucuuacuggcaagaccaucacccuugaagucgaaccauccgacaccaucgagaauguuaaagccaagauccaggacaaagagggaauucccccagaccagcaaagauugaucuucgcaggaaaacaauuagaagauggccgu

SEQ ID NO: 4326 - RNA, 702 nt, Phyllotreta cruciferae
agaggcauggacaaauugaucguuuccaacagaggcucggccaccaucucaaacgacggagcgacaauacuaaauuuacuagacguggugcauccagcagcgaaaacucuaguugacauagcgaagucacaagacgccgaaguaggcgauggcacgaccucgguggugcuguuagccggcgaguuuuugaagcaacucaaguccuacaucgaagaaggcguccacccgaggaucaucaucagagccgugcggaaggccacccagaucugcuuggagaagaucaacgcgcuggccgucaaaaucgacaaauccaacgccgaggaguacagaucgcugcuggacaaaugcgccgccaccgcgaugagcucgaaauuaaucaacaaacagaaaucguucuucuccaaaaugguagucgaugccguguuacuccucgacgaacuucuaccguugaacaugaucgguauaaagaagguccaaggcggugguuuggaggaauccauguugguagccggaguggccuucaagaaaaccuucucguacgccggauucgaaaugcagcccaagaucuacaaagacugcaagaucgcccuguugaacaucgaauuagaacugaaagcggagagggacaacgccgagauccgccugagcagcgucaaggaguaccaaaaaguagucgaugcggaguggaacauccuguacaac

SEQ ID NO: 4327 - RNA, 761 nt, Phyllotreta cruciferae
acccuuucagagacgaucuaauacaagccguuaaagaguaccaagugcugauuauaaaaggugaaaccgguucugguaaaaccacacaaauaccgcaauaucuccacgaagccgguuucacugcugaugguaaaaaaaucgguuguacacagccuagaagagucgcagcuaugucaguagcagccagaguagcccaagaaauggacguaaagcuaggcaacgaagucggauacgccaucagauucgaagauugcacuuccgaacgaaccguuauaaaauacaugaccgaugguacauuacacagggaguuucuaucagaaccagacuugcaaucuuacaguguaaugauuauagaugaggcucacgaacgaacacugcacacugauauauuauucgguuuggugaaagauauagccagauuuagaccagauuugaagcuguuaauauccagugcuacguuagauguuaccaaguuuucggaguucuucgaugaugcuccgguguaucaaaucccaggcaggagauuuccaguggauaucuacuacacgaaagccccugaagccgauuacguagacgcuugcguugucucuauacuacaaauacacguaacucaaccauugggugauauuuuaguauucuugaccggucaagaugagaucgaaacuugccacgaacuccugcaggaucgaguacgacguuuggguucaaaaguuaaagaacugauuauacuuccuuuauaugcuaaccuuccgagugaucug

SEQ ID NO: 4328 - RNA, 697 nt, Phyllotreta cruciferae
cgagcuauugggcuuagaauuagagaaacaaaggaagucuacgaaggagaaguuagcgaacugacaccugucgaaacagaaaacccagcaggagguuacgggaaaacugucagucauguuguaaucgguuugcgaacagccaaggggagcaagcaauugaaacuggaucccagcauauacgaagcccugcaaaaagagaagguugaggugggggaugucauuuacauugaagccaccaguggggcugugaaaagacagggaagguccgaugcuuaugcuacggaauucgauuuggaagccgaagaauacguaccucuuccgaagggagaugugcacaagaagaaggaaguuguacaggauguuacuuuacaugauuuggaugcugcuaaugcgaagccacaggguggucaagacguguuauccaugauggggcaacucuuaaaaccaaagaaaaccgaaauuacagauaaacucagaaaagaaaucaauaaaauuguugacaaauacauugaucaagguauugcugaauugguaccagguguuuuauucaucgacgaaguucauauguuggauauagaaacauucacuuaucuccauagagcuuuggaaagcgcuauagccccgauuguuauuuuugcuacuaauagaggucguugucuuauuagaggaaccgaugauguauuuucuccgcauggaa

SEQ ID NO: 4329 - RNA, 686 nt, Phyllotreta cruciferae
uaguucgccugauuuggaaaguggauuuucuagggaacuguuuuuacaaugguguucuaauccuaauaacaguauuauauuaacuacaaggaccucaccuggaacuuuagccagggauuuaauugacaauggaggaggaagaaccauagacuugauaguagagcgaagaguuaaauuggaaggccaagaacucgacgauuaugaaaggcgacaaaggucuaaauaugacaaauuagaagaagaugaagccgauucugauucggauuccgauauugaaaugucagucaccuccaaaggcaaacaugacauuguuaucaaacaagaaggcaaaauauccacgggauuuuuuaaagucaccaaaaaaauguaccccauguauccuuucaaggaagauaaaauaaaauccgacgaauauggcgaaauugugaaagcagaagauuacaaauuagcggaaauuucagcugaaggcgaagauaacaaagagaacauagugauuaaaaaagaggaagaggaaauaacugaaauuacugagcaaccaaccaaauguauaauucuucaacgaacaguucaaguaaguugucaaguucaauacaucgauuucgaagguagaucagauggagaaucguugaugaagauuuuaacgcaauugaaaccgagacgagugauuguuguacaugggacugaag

SEQ ID NO: 4330 - RNA, 679 nt, Phyllotreta cruciferae
acugcucaauucguagcuagaaauggucgagcuuuuuuaacccaauugaugaauagagagcagaggaacuuccaguucgauuucuugaggccgcagcauuccuuguuccaauauuucaccaagcuguuggaacaguacacuaaaguacuaauaccuccgaagagcauggagcagaggcucagagacgaagccaaaagcgccaaagccguccuagagcaagucaaguacagggccgaaugguugcgguaucaggaacagcaaaaggccaaggaagaggagauacucgagagagaacggguggcguacgcgcaaauagauuggcacgauuucguggugguggaaacugucgauuaccaaccguucgaaauagggaauuucccgccgccuacuacccccgaagaagugggugcuaggauacucauacaggagaggaucgaagaaggcgaagauaucgaaaugcaguuggagagcgaugaagaugacgauacgaacgcugaugacgguuugaguuccaugcaggauaagacgaagcgcaaaggaggcgaugauaaucguuugcaggacauggaagaggauacuucugaugaagauaaugaugaugauagcgguaaaacgggagcggcuucaucgcucauucaaccgccauugccgccuauaccggauaaagugcuggugaaga

SEQ ID NO: 4331 - RNA, 694 nt, Phyllotreta cruciferae
aguggaccauuucaaucgaaugggcaaaaucggcaaucaaaagcguguugucgguguucuacucgguugcuggagggccaaaggagucuuagauguauccaacaguuucgcagucccuuucgaugaggacgacaaagacaaaucuguaugguuuuuggaccaugacuaccuggaaaacauguacggcauguuuaagaaagucaacgcuagagaacgcgucguugguugguaccacaccgguccuaaauuacaccaaaacgacaucgcuaucaacgaauuaauucgaagauacugccccaauucagucuuggugauuauagaugcgaaaccuaaagaucuggggcuuccuacugaagcauaccaagcgguagaagagguccaugaugauggcucuccuacaucuaaaacguuugaacacgucccgagcgaaauaggcgcagaagaagcugaggaagucggaguagaacauuuacuaagagauauuaaagacacuacagugggaacuuuaucucaaaggauuacuaaucaguuauuaggccuuaaaggguugcauuugcaauugagagauauaagagacuauuugaugcaagugugcgauaacaaacugcccaucaaucaucagaucaucuaucaauugcaggauauuuucaauuuguugcccgauauaaaucaagaugcguucaacaauucguuu

SEQ ID NO: 4332 - RNA, 675 nt, Phyllotreta cruciferae
agaucgaaacgacaaaaacgccguagcccaaguggucaaaggcugcauaggaacgaaauucuugagcaaguggucggauuuggccgucaauaucgcuuuagaugcgguaaauaccgucuuauuagaagaaaauggucgaacggagguggacaucaaaagguacgccaaagucgaaaagauucccggugguucgguggaggaauccaggauauugagaggcguaauguugaacaaagacguuacccauccuaaaaugaagcgacacaucaagaauccgagaaucauccuuuuggauugcgcuuuggaauacaagaaaggagaaucucaaaccaacguugaaauuagcaccgaaacugauuuuaccaaacuccucgaauuggaagaagagcacgucaagcggcaaugcgacgagauaaucgcccucaagccggacguaguguucaccgaaaagggaguauccgauauagcccagcacuuccugcucaaggccggcaucaccgccaucaggcgugucagaaagucggauaacaaccgaaucgcucgagcuuguggcgcugucaucgucaacagaacagaggaacuccaggaguccgacgucggcaccggagccggcguauucgaaaucaagaaauucggcgacgaguacuucuguuucaucgacgaaugcaaaaaucc

SEQ ID NO: 4333 - RNA, 557 nt, Phyllotreta cruciferae
cguugaacgccagauuaauccguacgcugauaauggaggaagcguaguagcaauugcaggaaaagauuuugugguuauuggcgcagauacgcgucuuaguuccggcuuuuccauauacacuaggaaccagaacaagcuguuuccucuaucugagacaacuguuuuaggauguucagguuguuggugcgauacuuuaacguugacucguauuauaaagucucguaugcaaauguacuaucaagagcacaacaagaacaugucuacaacagcggcugcucaaaugcugucgaccauguuguacuauaagcgauuuuucccuuauuacauaucaaacauucuuguuggauuggauaaugagggaaaagguugugucuacagcuacgaucccguugggcauugugaaaaagcuaccuaucgagcgggugguucugcaggggcuuugcuucagcccuuauuggacaaucaaauugggcaaaaaaaucuacagaagccuucgcaagaagaucuuacucaggaaaaggccauuucuacacugaaagauguuuucauuucggcug

SEQ ID NO: 4334 - RNA, 691 nt, Phyllotreta cruciferae
uggaaaaauaaucaugccgccuucggcacuggaacagcuuacucgauuaaacauuaacuaccccauguuguuuaaacuaguuaauaagaagacaaaucguacgacucauugcgguguauuggaguucguagcggacgaaggaaaggucuaccuaccauuauggaugaugcacaauuugguacuaaccgaaggcgauuuggugcaaauggaaagcguuucguugccagugggaacguuuuccaaauuccagccguugaauccggauuuccucgacaucaccaacccgaaagccguacuggagaauugcuugcggucuuuugcuugucugaccaacggcgacgugauagccgugagguacaaucaaaaggccuaugaauugugcguguuggaaaccaagcccgguaacgccaucaguauaaucgaaugcgauaugaauguggaauucgcggcuccuguuggcuacaaggaacccgaacaugcuaaaaaagaagaagaaaugucgguggaucccgcagauuuaaugcccgaaccgucgggauucguggcuuuuaggggggccgggaaucgauuggaugguaaaaaacgcaaagauucuuccucuaaugauacuccuucgguuaaaccggcuuacguuaggggaauucccgacuacgauuaucaaauuggcacucuagauuucaucaggcguacg

SEQ ID NO: 4335 - RNA, 744 nt, Phyllotreta cruciferae
uuccaauuuccgcugaaaacaccgagccccuuguaaaaguugcgaugacuacauuagguucgaaaaucauuaacaagugucacaggcaaauggccgaaauugccguaaauggcguguuagcaguagccgaucuccaacaaaaggaugucaacuuugaacucauuaaaguagaaggaaagguuggugguaaauuggaagacacgacauuaguaaaaggcgucgucauagauaaaacaaugucucauccucaaaugccgaaggaacuuaagaauguuaaauuggccauccucaccugcccguuugaaccucccaaacccaagaccaagcauaaguuggacgucaccagcgucgaugacuacaaagaacuaagauuguacgaacaagaaaaauucaaggaaauuguuggcuuagucaaaaaagcuggagcuaccuuggcuauuugccaauggggauuugacgaugaggccaaccauuugcuguugcagcaggaguuaccugcuauaagauggguuggcgguccagaaauagaacucauagcuauugcgaccgguggaagaauaguuccacgauucgaggaacucagccccgagaaacuugguucugccgguuugguacgugaaauaucguuuggaacuaccaaagauaagaugauggugauugaagaaugcucgaauucccgugccguuaccauucucgucagaggcgguaaucaaauguugguugaugaagccaagaggaguuuac

SEQ ID NO: 4336 - RNA, 205 nt, Phyllotreta cruciferae
aaaaaguggaaugcuguagcacuuugggcuugggauauuguuguugauaacugcgcuauaugccgaaaccacauaauggacuugugcauugagugccaggcaaaucaggccucugcaacuagugaagaaugcacuguagcuuggggaguaugcaaccacgcuuuccacuuucacuguauuucaagaugguuaaaaacuaggcagg

SEQ ID NO: 4337 - RNA, 680 nt, Phyllotreta cruciferae
aacauugcuagaacgaccuugagcucgaaaauucuaucucaacacaaagaacacuucgcgaagcucgcugucgaugccgugcugagguugaagggcuccggcgauuugcaagccauucaauugaucaaaaaaaccggaggaacuuugcaagaaucguuccucgacgaagguuuccugcucgauaagagacccggcgugcaccagcccaagcgagucgagaacgcuaagauccugaucgccaauacuccgauggacaccgauaaaaucaagguauucggcucgcacaucaaagucgauuccauggcuaaaaucgcggaauuggaauccgccgagaaagauaaaaugaaagacaaagucaacaaaauccucaagcacaacgccaauguauucaucaaccggcaacucauuuacaacuaucccgaacaacuguucgcagaugcuggcgugauggccauugaacacgcugauuucgaugguaucgaaagacuggcgcuggucaccggaggagaaauagucucaacuuucgaucacccagagcucgugaagcugggaacuugcgaucuaaucgaacaaaucaugauaggagaagauacucuccugcguuucagcggaguggccuuaggugaagccugcacgauagucauucgaggggcuacccagcaaaucauagacgaggcaga

SEQ ID NO: 4338 - RNA, 654 nt, Phyllotreta cruciferae
gccuccaucaagucgaauaugccauggaagcggucaaucucgguucggcuacgguaggccuaaaaagcaacagucaugcuguuauaauagcauugaaaagggcuucaucugaauuguccgcuuaccagaagaagaucauucaaaucgacgaucacaucggcaucaccauuuccgggcuaacggcugaugcgaggauucuaagcagauacaugagaaacgaauguuugaauuacaaguacuccuuggacgcuuacaugccuuugaauagauuaauuaacauuuuagguaucaaaaugcaacauuguacucaaagauacgaucguagaccguucggugugggucuacuaguggccgguugcgaugacaacggggcccacauuuaccaaaccuguccgucggcgaauuucuacaauugcaaggccaugucgaucggugcgagaucccaaagcgcccgaacguauuuggagaagaagcucgacgaguugucuucguguucgcuggaagauuugaucaagcacgguuugagagcucugagggacacucuuccucccgaggucgauuugaacacgaagaacguuuccauugguuacgucgguaaagggauuaccuuuaagauuuuggaggaagaggagacugcuccuuaucuggcucuaa

SEQ ID NO: 4339 - RNA, 674 nt, Phyllotreta cruciferae
gagcaaacgaauggaagaaguggccacuaagcagaaccccagcgaagacgaugauaccgaauuggaacuacguuuggcucgauucgaauaucuuauggaaaggagauuguuacuuuuaaauucgguuuuguugcgacagaacccgcacaaugugcaagaguggcacaaacgagugcaacuuuacgaagguaaaccacacgaaaucaucaauacauauaccgaagcggugcaaacuguggacccuaaacuggccguaggaaagcugcacacguuguggguugaauuugccaaguucuacgaaagcaacgagcaaaucgaagaggcccgauugauauucgaaaaagccucccaagugccuuacgugaaagucgacgauuuggcuaccguuuggugcgaauggaccgaaauggagauucgcaacgagaacuacgacgaagcuuugaagcucaugcaaagggcaacuguaaugccuagccguaaaguggcuuaccacgaugauacagaaacaguucaaaguagacuuuacaagucgcugaaaguguggucgauguacgcagauuuagaggaaagcuucggcagcuucaaauccugcaaagccaucuacgacaggaucauugaacugaaaaucgccacgccgcaaauuaucaucaauuacggcguauuucuagaggaaa

SEQ ID NO: 4340 - RNA, 712 nt, Phyllotreta cruciferae
aucucugcuaugggaacucuucguacaagcagggccauuagugaacguacauaugcccaaagaucgcgucaccaugaugcaccagggcuaugguuucgucgaauucaugggcgaagaggacgccgauuacgcuauaaaaauaaugaacaugauaaaauuguaugggaaacccauacgagucaauaaggcuuccgcucaucagaagaauuuggacgucggagcgaacauauuuauaggaaauuuggauccagaagucgaugagaaacucuuguacgauacguuuucggccuuugguguaauauuacaaacgcccaagauaaugagagaucccgagacuggaaauuccaaaggcuuugcguucauaaacuucgccaguuucgaggccucugacgcuuccaucgaggcgaugaacggccaauaucuuugcaaucgaccaauaucugugucguaugcauucaagaaggauuccaaaggcgagagacacgguucggcggccgagcgauuacuggccgcacagaauccauuaucacaggccgauaggccccaucaauuguucgcagacgcaccgccgauaggaaugaugccgaugaguauggcgccuccaccuccgccuuuaaucaccggcaugaugcccccuccuccgccaacgccgggcggaaugccgccuccuccuccgccaguaccgccgccgaguucauucccagcugguaua

SEQ ID NO: 4341 - RNA, 666 nt, Phyllotreta cruciferae
cccacacuaaaaggaggaaaggggcacccaagcuccguuacuuagauuucuccgaaaggcauggcuacaucaaggguguagugaaagacaucauccacgaccccggucgcggcgcccccuuggcucuaguucacuucagggaccccuacaaguuccaaacuaggaaggaaauauucaucgcucccgagggaauguacacagggcaauucuuguacuguggaaagaaagcuaaccuccaaauuggaaauguguugccuguaggaacuaugccugaagguacaauugucuguaauuuggaagagaagacuggugaccguggccgauuggcucgagcaucugguaacuacgcaaccgugauugcccacaaucacgauacaaagaaaacuaggguuaaauugccaucaggagcuaagaaaguuauccccaguaacaacagagcuaugguugguauuguugcuggagguggucguaucgacaagcccauccugaaagccggucgugccuaccacaaauacaaggugaagcguaacugcuggccgaaggugcgugguguugccaugaaccccgucgagcauccucacggaggugguaaccaucaacacauugguaaagcuuccacuguuaagagaggaacuuccgcuggucguaaggugggucuuauugcug

SEQ ID NO: 4342 - RNA, 406 nt, Phyllotreta cruciferae
aacccaugccuaugaacuaccaccgcccaucaacgccaugccaggccagugaggucgagguggagcccaaguuugugaauguuguugaagcgagacgcuuaagaacgcucaccgcggagacggcgggcgagcuggauguccuugcucuggauggugacacgcuuggcguggauggcgcagagguugguguccucgaagagggagacgagguaggccucgacggacuccugaagagcaccgauggcggaggacuggaagcggagaucggacuugaaguccugggcaaucucacgaacaagacgcuggaagggcagcuugcggaugaggagcucagucgacuucugguagcgacggaucucacggagagcgacaguaccgggcuuguagcggugaggcuucuugacac

SEQ ID NO: 4343 - RNA, 669 nt, Phyllotreta cruciferae
uuggagaagcugaaaguacccaucgaagucaacaaagaaucguuaaccgauguuugucgaacgagcuugagaacaaaauugcaucaaaauuuggcugaucuccuuaccgaugucugcgucgaggccauucucgcuaucaaacaguccgacaaaccggucgauuugcacaugguggagcucauggagaugcagcacaaaaccgagacggacacucaacugguuaaaggaauagugauggaucacggugcucgacaccccgauaugcccaagagcuugaagaauuguuacauccucaccugcaaugugagcauggaguacgaaaagagcgaagucaauuccgguuucuucuacaaaacugccgaagaaagggagaaauugguguuggcugaaagggauuucaucgagcaaagaguuaagaaaguugucgaguugaagaaggcccuuugcaauggcacaaacaagucguuuguuguuauaaaccaaaaagguauugacccgaugagcuuggacaugcuggccaaagagggaaucguugcucugcgaagggccaagagacguaacauggaacguuuggcuuuggcaugcggcggaauagccgugaacaguuucgacgauuuacaggaaucucaccuugguuacgccgggcauguauacgagcauguauugggc

SEQ ID NO: 4344 - RNA, 652 nt, Phyllotreta cruciferae
uucgaucaccccauucaauugcaucucgcuuucuccacucuacacaaguucguggagaagacgggucgauugccgaaacccuggagcaaagaugacgccaccgaguucaucgcucuggcgaaaucguuggcuguaaacgguucuacggauaccgaagucaacaccgauauccucaacauuuucuccaaguguuguucgggcgaucugaaccccaucaacgcuacgaucggaggaaucguggcgcaagaggucaugaaagcuugcucggggaaguucuaccccauuuaccaaugguuguacuucgaugccaucgaaugccugccccaggacaaggaggagaucaccgaggaacucgcugcacccguugauaguagauacgauggacagaucgcuguguucggaaaagacuuccaaaagcgauuaggcgaacugaaauauuucaucguuggugccggagcgaucgguugcgaguugcugaagaacuucgccaugaugggacugggcacgcaaggcggucaagucaccguaaccgacauggauuugauugaaaagucgaauuugaauaggcaauuuuuguucaggccccacaacguccagcaacccaaauccgcuaccgcugcuaagguaaucaagaagaugaaucccgacguua

SEQ ID NO: 4345 - RNA, 718 nt, Phyllotreta cruciferae
uguucuugugaugugccauacgcgcgaauuggccuuccaaaucagcaaagaauaugaacgguucagcaaguacauguccaacaucaaagucggcguguucuucggcgggcugcccauccaaaaagacgaagaaguauuaaaaaacagcuguccgcacaucgucgucggaacgcccggucgcaucuuggcucucgucagaucaaagaaacucaaucucaagcacauaaaacacuuuauucucgacgaaugcgauaaaauguuggagcuucuagacaugagacgcgacguucaagaaauauacagaaauacgccgcacgaaaaacaaguaaugauguucagugcgacgcucagcaaagaaauucggccaguuugcaagaaauucaugcaagaucccauggaaguauaugucgacgaugaagcgaaauugacguuacacggucuacaacaacauuauguuaaacuuaaagagaacgaaaagaauaaaaaauuauuugaguuacuugauguguuggaguuuaaucagguggugauauuugucaaaucggugcaaagauguguagcauuggcacaacuuuugacugaacaaaauuucccugcaauuggaauacacagaggaauggagcaaaaagaacgauuauccagauacgaacaauucaaagauuuccaaaagagaauauuaguggcuacuaaucuauuuggucgugguauggauaucgag

SEQ ID NO: 4346 - RNA, 664 nt, Phyllotreta cruciferae
agaaacgauuucgaaggacaagccguacuaauuaacugcuuauugaggaauuauuuacacuauucgcuguaugaucaagccgauaaguuggugaacaaaugcguuuuuccggagacagccagcaacaacgaaugggcgagauucuuguacuacuugggcaggaucaaagcggcucgauuggaguacaguguagcucauaagcaucucauacaagcgaugcguaaagcgccccagaacacugcgaucggcuuccggcaaaccguccagaaacuaacagucguaguggaguugcuguugggggauauuccggagaggcagauauuccggcaggcgagcaugcggcauucgcuugccccguauuuccaguuaacgcaggcugugagaauggggaacuugcaacgguucggggagguguuggagaauuuugggccgcaauuuaggguagaucauacguuuacuuugauccugcggcuucggcauaauguuaucaagacagcuauuaggucgauugguuugucguauuccaggauaucuccgcaggauauagcuaagaaauugggccuggauucagcggaggaugcggaauucaucguagcgaaggccauucgagaugguguuaucgaagcuacuuuggacccacaagggggcuacaugaggaguaaag

SEQ ID NO: 4347 - RNA, 713 nt, Phyllotreta cruciferae
guauuacggaaccucuggacccacguugaagcaucaaaggccccaggaugauaaacagaaagaguauucagauuugaacgauugguauaagagaggcguugauacuucgaagauuguaacaaaguaucguaaaggggcuugugaaaacugcggagcgcuaacucacaaaaagagagauuguauggacaggccacguaaagucggagcgaaauuuucaggugcuaauauagcccccgaugaguuuauccaaaagaacuuaucacuaaguuuugacgguaaaagagauagguggagugguuacgauccuuccgaacauaaaacaguaauagaagaauuccagaaaguggaggaagccaaacggcaacuaaaauccgacaaauugaaugccaacgaagaguccgaagacgaagaaaaagaugaggauaaauacgucgaugaaguggacaugccugguacgaaagucgacagcaaacaaagaauaacagugaggaauuugcguauacgagaagauacggccaaauacuugagaaauuuggaucccaacucggcauauuaugaccccaaaaccagaucgaugagagaagauccgaaugcuggaauggacgcuacauaccauggggaaaauuuuguucgcuucuccggagauacuacgaaucacgccagagcccaacuguucgcuugggaggcacacgguaaaggagucgacguucauc

SEQ ID NO: 4348 - RNA, 502 nt, Phyllotreta cruciferae
aggaaguucgaauuaggucguccggcggccaacacgaaacuaggaaccagaaggauccauuauguucguacaagggguggcaacuugaaguaccgugcccuaagauuagacacuggaaacuucucuuggggaagcgaaggaacugcccgucaaacacguauuaucgaugucguuuacaacgcuaguaauaacgaauugguucguaccaagacauugguaaagaaugcuaucguugucguugacgcuaccccguucagacaaugguacgaaaaccacuacaucuuaccauugggacgcaagaagggugcuaagaugacuccugaagaggaggagauuuucaauaagaaacguagcaaaaaaguacagaagaaguacgaaacuaggcaaaaaaccgcuaaaguagagccugcaauugaagaacaauuccacaccggaagauuguuggcaugccuagcaucaagaccuggacaaugcggcagggccgaugguuacguccucgaag

SEQ ID NO: 4349 - RNA, 697 nt, Phyllotreta cruciferae
cauuucaucccuagcccuacuaaaaaugcugaagcacggcagggccggcguccccauggaagucaugggucuuauguuaggugaauucgucgacgauuacacagugagggucauagacguguucgccaugccccagacggguacuggagugagcguagaagccguggaucccguuuuccaggcuaaaauguuagauaugcuacgucaaaccggccggccggagaugguggucgguugguaccauucccauccagguuucggcugcugguugucgggaggcgauaucaacacucaacagagcuuugaagcccucuccgagagggcuguggcuguagucguagauccaauucaauccguuaaaggaaaagucgucaucgaugccuuuagguuaaucaauccuaauaugaugguguugggacaggagcccaggcaaacgacuucgaauuuggggcauuugcagaaaccgucuguacaggcucugauccacgguuuaaaucgccacuacuacuccauaaguauuaacuauaggaagaacgaguuggagcagaagauguugcucaauuugcacaagaaauccuggauggaugggcuaacguuggcugauuauucggagaauugcagcguuaacgagaaaaccgucgccgauauguuggaauuggcuaagaauuacaacaaagcguuggaagaagaggagaaa

SEQ ID NO: 4350 - RNA, 709 nt, Phyllotreta cruciferae
ugccagauucaacuuacgaaauggugggugguuuggauaagcaaaucaaagagaucaaagagguuaucgaauugccggugaaacauccugagcucuuugaugcuuuagguauugcucagcccaaggguguguuguuguauggaccuccaggaacuggcaaaacucuucuggcuagagcuguagcucaccacacagaaugcacguuuauuagaguaucaggaucggaguuggugcaaaaauucauuggggaagguucuaggaugguaagggaacuguucguaauggcuagggagcaugccccuucgaucauuuucauggaugaaaucgauucuauuggauccucucguaucgaaucagguucugguggcgauuccgaaguucaaagaacuaugcuggaguugcugaaucaacucgauggauuugaggcuacgaagaacauuaaaguuauaauggcuacaaacagaaucgacauuuuggaucccgcuuuacucaggcccggcagaauugacaggaagaucgaguucccuccaccgaacgaggaagcccgauuggacaucuugaaaauucacucgagaaaaaugaauuugaccagagggaucaauuugaggaaaaucgccgaauugaugccaggugccagcggugccgaagugaagggaguguguacugaggcaggcauguacgcccuaagggagagaaggguacacguaac

SEQ ID NO: 4351 - RNA, 499 nt, Phyllotreta cruciferae
guugaagucugcuuucgauuuacaaaguuucaguuuuuuccaaagaggauccguacaggaguuuaugucauucuuuuguaagacuaucguggaaaggacuauaccaucauccaggcaauccgucaaagaaggagaguacaugugucauguuuauguaagacaugauaacuuagccgguguuguaauaucagaucacgaauacccgucuagagugucacauacgcuuaucacaaaaauucuggaugaauuugcugguaaaauaccagcuguuaauuggccuaccuugcaagagagagacguagcguuuccacaauugaacacauaccuugccaaauaccagaacccuaaagaagccgaugcgaugacuaaaauacaagaggaccuugacgaaaccaagauuauucuggugagaaaaauguuaauuaucuugcguuauuuaucuaagcauaacacgauucaagcuguccuggagagaggggaaaaguuggacgacuuggua

SEQ ID NO: 4352 - RNA, 604 nt, Phyllotreta cruciferae
uggaauaugccauugaagcuauuaaauugggaucuacagcuaucggaauaugcacuagcgaagggguugugcuagcagucgaaaagcguauuacuucuccauuaauggaacccacaacgauugaaaagaucguagaaguugauaaacacaucggcugugcuguuucggggcucauggcagauucacguacaaugaucgaucgggcaagaguugaaugccaaaaucauugguucguuuacaacgaaaacaucaccaucgaaucaugugcucagggaguaucgaaccuagcuauucaguucggagauucggaugaugauggugcugcuaugucgaggccauuugguguggccaucuuguuugcuggcauagacgaaaaagggccucaacucuaccacauggacccaucagguacauuuguucaguucgaugcaaaagccauaggaucuggaucagagggcgcacaacaaagcuuacaggaaguauaucaucguagcaugacuuuagaggaagcuaccacagcagcguugacuauucucaagcaggucauggaggagaaauugaacucuucuaauguagaagucaugacaaugacgccaaaggauau

SEQ ID NO: 4353 - RNA, 684 nt, Phyllotreta cruciferae
caauuaguugggcuauccgacgauuugggaaagcuggaugguuucguggagcagguuacccggaagguggcucaguaccucggugagguucuugaagaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggacaaaucgacgccgaucuuaagaccaagucgucagcguacaauaacuuaaaaggcagucuucaaaauuuggagaaaaaacaaacagggaguuuguuaacccguaacuuggcagaucuggucaagaaggaacacuuuauuuuagauucugaguacuugcaaacgcugcucgucaucguucccaaagcucaguuuaaugaguggaacgccacuuacgaaaagaucacggacaugaucgucccucguucgucggaguugaucauucaagaccacgacuacggccuguucaccgugucgcucuucaagaaggucgucgaggaguucaagcugcacgccagagagaagaaguuuaucgugcgagauuucacguacaacgaggaggaacuggcggccggcaaaaacgaaaucaccaagcucgucaccgacaagaagaagcaauacggu

SEQ ID NO: 4354 - RNA, 755 nt, Phyllotreta cruciferae
agccgcagaacuacuuaaaaaugcagaugaacuuguaaaacaaaaaauccacccuacaucgauuauaagcggauacaggcuggcuuguaaagaagcuugccgauacauacaagaccauuugacuauacccguggaggaauuaggcaaggagucuaucguaaacguugcgaagacuuccaugagcucgaaaauuauaggagcugaugcggauuucuuuucgcaaaugguagucgaugcugccaccgcagugaaagucacggacuccaagggcaacucgauguaccccauuaaggcggugaacguguugaaagcccacggcaaaagcgcccgggagagcuuccugguggccggcuacgccuugaacugcaccgucgccagccaggccaugcccaagaagaucgucaacgccaaaaucgcgugucuggauuucucguugcaaaaggccaaaaugaagaugggcgugcaagugcugaucacggaccccaaucaacuggaaggcgucagagccagggagcuggacaucaccaaggagcgcauccagaagauccuggccaccggcgucaacguggugcugcuguccggcggcaucgacgacgucuguuugaaguacuucguggagcgcggcgccauggccgugcggcgcgucaagaaggccgauuugaaacgaaucgccaaggccaccggggccgccuucgucaccuccuugagcaacauggagggcgaggagaccuucgauucuaauauggucggcgaag

SEQ ID NO: 4355 - RNA, 647 nt, Phyllotreta cruciferae
gccuucuauaacuucccaggaacagaauggaaaccuguaacaaacccaauaacucauacccaaucuccaguaacgacuucaaccucaauuguaucuauaaccuacgauaagggaguacuaauugccggagacuugcuggccucuuacgggucuuuagccagauacaaaaauugcccgaggguaaucgaaauuaacccaaacaucaucuuaggcgcuggaggagacuacgcugauuuccaauauguaaaaagcuuuaucgagcagaaaauaaucgacgaagauugcuuagaugaugguuugaaaaugaaaccgaagucucuuuauugcuggcucacuagaauuauguaccaacgaagaaguaaacucgacccguucuggaacaauuuaguaguaggagggauccaagauggaguaccuuuccuaggaacagucgauaaacugggcacugcguacacagauaaaguaaucuguacugguuacggggcucauauugcccuuccugucuugagggaugcccucgacaagaagccgaauuugaaucuaaacgaagcuaaggcgcucauuaaaaagugcauggaaguuuuguucuacagagacgcgagaaguuacccgaaauaucaguuaggcauaaucgauguggacgaagg

SEQ ID NO: 4356 - RNA, 670 nt, Phyllotreta cruciferae
uguugaugaaggaacuggaggugaacccggauaaauccuugcaggggggacugagagcagcucgcagggcugugagauuguugaaucaauuaggaagggaaacacaaucuuguacguuguuccugaaguuaugcagcagcauguuaagaacgcaaugcaaacgaguuaaaagagaaggcuccacuacuacuuacauaaagcaucuuucgaguguaguuuucacuaauaugugucacaugucugaugaauuucuaagggcuuuccccgacucuccggcuugcgcuucagcguaugugguuugggcgagcaaugaacuacugcaauuuacuacccauuuuaucaagcaggucuuuaugccgcagacuuccuuaucaacggugaccgagugcauaguuuuaguuagacaacagugugaaagacuguacguuuacggauuggaccuuuguuaucaauuggacggggcuuugagaucgucgcugaugaaggcguugaaagacgcucgagauaaacucaucgauucgauuaaauugagaguguuagaugauaaauggauaccgauuaauuugcauuccaaaucggcguugagccguugcgugcaagaguauucgcaaaugggacucacuaacguaggaaauuacguuucuggcgauacuugguugcaauuaacagc

SEQ ID NO: 4357 - RNA, 742 nt, Phyllotreta cruciferae
ggccuaaaaagaagaugggaggguuuagugcacaucucucaacuaagagccgaagguagagucaccaacguuuccgaaguagucucuagaggaagcaaaguuaaaguaaagguguuaacuauaacuggucagaaaguaucccuuucgaugaaagaugucugccaaacgacaggaaaggauuugaauccucuaucacacgccacuacggaacgagaagauaaagaucguaacccugacaggccuacuaauaauagcacaucagugcugaggcuaccgguuaguaucgaugaaggugaagaagauuccaggaaaagaguaaccagaauauccaguccggaaagaugggaaauuaagcaaaugauuucuuccggauguauagacaaaagcgaauuacccgaauucgaugaugaaacugguuugcugcccaaagaugaagauggugaagcugauauugaaauugaauuggucgaagaugagccaccauuuuuacaaggucaugguagagcucuucaugaucuaagcccagugagaaucguuaagaauccggacgguucgcuagcccaagcugccaugaugcaaucggccuuggccaaagagagacgcgagcaaaaaaugcugcaaagagaacaggaaguggauucccagccaucuggaaagaacaaaaacuggauagauccccuucccgaagaggaaucuaaaucgauggcaagaggaaucggucugcaaagucaagauuuacccg

SEQ ID NO: 4358 - RNA, 761 nt, Phyllotreta cruciferae
aaacguagucaugaacugcuguguguuuagugauaggaaacauucauuuuuaguagcaggucaagagaacuacucucaacuuuauggagucaauacgaaauuaaucgaacaugaacaaguagaaacaauuggagacacggcaaguguucgacauagaaauaccaagcccaaagcgcacguagacaauaacaaaaacauuaaaaaggagcugguuuucgacaugaauccucuagauagcauacaaaccgacuuuaagggaucugaaccccuauguagaguaguucgaauuaaucacucgggaaaaauauuagcuacuggaggaacugacggcgauguaagacuuuggaaauucccuacgaugcagccauuguccauucucaagggacauacgaaggaaauagacgauauagauuucaguaaauucgauaaccucaucauaacuuuagcgaaggacgguuuggcuauuuugugggacgcccaaacggguaaauugaaaucgaaacugacauggaacacuccagagggaucgaaauauuuguacaagagguguagauuuggcguaaucgaagaucaaaaaaauaagugcaugcuauacaugauagcgaaugcgacuaauucgaagcaaaaaucguuucuucagcaauggauaccugaagagaauacuuuaaaaaaguucucugaauucaaugaaacacuguccgcacuugcaguuagagaugauggacgauuuguagcugucgggacaauguuuagcgguucug

SEQ ID NO: 4359 - RNA, 720 nt, Phyllotreta cruciferae
uggaauccaccuuguugaaagaguugaagaaacuggacgacaaaaaccugcuggucgaagugcaacugcucgaaagcaaaacauaucacgcucuaagcaauuuacccaaagcccgggccgcccugacguccgccagaacgaccgcgaaugccaucuauugcccuccgaagaugcaggccgcccucgaucugcagucgggcguacugcaugcagccgacgaaaaggacuucaagaccgcuuacuccuauuucuacgaagccuucgaggguuuugacagcgucgagucccccaaagcucugaccgcucugaaguacaugcuuuuguccaaaauuaugaucaauaguccugaagauguacagcaaauuguuaguggaaaauuagccauaaaguaugcagguaaagauaucgaggccaugaaagcagucgcacaagcagcccacaaaagaucucuugcagauuuucaacuggcuguaaaacaauucaaacacgagcuggaagaugacguuauuguaagagcacauuuaggaacacucuacgacaauauguuagaacaaaauuuaugcaggaucauugaaccuuacucacguguccaaguagaauauaucgcaaagacgauuaagcuucccguguuacaaguagagaagaaacuaucgcagaugauuuuagaugccaaguuucauggaauuuuagaccagggugaugguguccugauaguguuug

SEQ ID NO: 4360 - RNA, 795 nt, Phyllotreta cruciferae
caggagaucgaauugcuguacgaacagaaaaucaaaaaccugcaggccgccgccgacaggcaucaaucgaccgccuccggcgcucucgacgaguugagacaaguucgaacgaggaucgacaccuucucgucgaggauccaggaucuggagaaccagaaccagggccuggcagcuagaacuagggauuuggagaaguugcucgagaacgaacgcauucgucacgccgaagaccuagcgcuagucgagagggaauugcacaggcugcgagaggaaauggcgacucaacugcaagaguaccaagacuugauggacaucaaagugucccucgauuuggaaaucgccgccuaccguaagcuucucgaagcggaagaagcucgauugaacaucacaccaacagguguugagcacgaggugcaccaaaggagcuccucucagcgccggacgccggugagaaugggggccaagaggaaacgggcccugcucgaggagacgcaggagucgagcaugucggauuacagcgugaauaguucgucuaaaggggacauugaaguggccgcggccgauccggacggucaguuugugagauugcacaacaaaaguaaccaggaggugccgcucagcggauggcaagucaucaggcgggcgggcgaugaggagaccuucuacaaauuccacagaaccguuaaaguagagggaaaugguacaguaaccauuuggaguucugauuuaaauaaagaucaugaacccccuaguaaccugguuaugaaaagccaaaaauggguuacuggagacaac

SEQ ID NO: 4361 - RNA, 702 nt, Phyllotreta cruciferae
cgaacgucaagaaggaauugcaggaguuggugcaauacccggucgagcaucccgauaaguuccugaaguucggcaugcagccguccaggggagugcuguuuuacggaccgcccgguugcgguaaaacccuauuggccaaggccaucgcuaacgaaugucaggccaacuucauauccgucaaaggaccggaauuguuaaccaugugguucggugaaucugaagcuaauguuagagacauuuucgauaaggccaggucagcagcuccuugugugcuuuucuucgaugaguuagauucgaucgcuaagucgagagguggaaaugugggagaugccggcggugcagccgauagggugauuaaucaaauuuuaacugaaauggauggcaugggagcuaaaaagaacguuuucauaauuggugcuacaaauagaccagauauuauugaucccgcaauauuacgucccggucgucuggaucaguugaucuacaucccguuaccagacgaaaagucuagagaagcaaucuuuaaggcgaaccuaaggaaaucaccuguagcuaaagacguagaucuuacauauauugccaaaguuacacacggcuuuucgggcgccgauuuaacagaaauaugucaaagagcuugcaaacucgcuauaagacaaagcaucgaaacggagaucagacgagaacgagagagagcauugaauc

SEQ ID NO: 4362 - RNA, 650 nt, Phyllotreta cruciferae
auuuagugccaagucucugugaggaucuucuaucgucuguggaucaaccuuuaaaaaucgcuaaagacaaggauucgggcaaggauuuucuuuuaugugauuacaauagagacggagauucuuacaggucaccauggucgaauaccuacuauccuccauuagaagacgguucgaugcccuccgagaggcuaaggaaauuagaauuagacgccaauuuagcguucgaucaauauagagaaauguauuucgaagguggcguaucuucuguuuauuuuugggacuuggaucacgguuucgcagguguaauuuuaauuaaaaaaacuggcgaugguaguagaaaaauuaaagguuguugggauucccugcacgugguggagguacaagagaagaguuccggaaggaauucccacuacaaaaugacguccacugcuaugcuguggcugcaaaccaauaaacaaggcucgggaaccaugaauuugggcgguaguuuaacccgacagaucgagagugaugcagccguaaacgacaucaauccccacaucgccaacaucggucgaaugguugaagacauggaaaacaaaauucggaacacguuaaacgaaaucuacuuuagcaaaaccaaggacauagucaauagcuugaggucggug

SEQ ID NO: 4363 - RNA, 697 nt, Phyllotreta cruciferae
cguugauaugccgaugaaaggcgccaaaggcaagaaagggcgaguuagcgucgguggcggcggcggcagcacgccauccuccagcggaccgguaccagcagcuauaguaccaggaggugucagaggcaggccgcccgcgaccguuuccucuaccaguaccacaccaauugcgaccacuaccgguucguccgguuugccguuggguacccaagcuccugcgacgcugccgggaaguaccgccaccacgacgauagcgccggccaacaacaacaacagcucucugacgccgcagcagcucggcacgcccgucaguucgaugcacggcaccccgggggccccccuaucgaauucccucgaucccagcggagugcugcccuccaacgucaugccgccggcgcaaccagccaagguaaaaaaaggcgugaagagaaaggccgacacgacgacgccggcgacggccuacgauuauccgacgguauuggaaucgaagucggcgaagauuucgacgcgcagagaaucgggcaggcagauaaagaagccggcgcggcgggaaaucgaccuucauguaccucaaccggcgauccacaaacccaacgauaaguugucggagucgcugaaagcuugcaaugaaauccuuauggaacuguucuccaagaaacauucgaauuacgcuuggccuuucuaucaaccggucgau

SEQ ID NO: 4364 - RNA, 791 nt, Phyllotreta cruciferae
uuuaaggccccaauuagaccagaugucgucaauuucguucaucagcaggucucaaugaaccaucgccagccuuacagcguuagcgacaaagcuggucaccagaccuccgccgagucguggggaacaggucgcgccguggcccguauaccucguguucgggguggcgguacccaccgaucgggccagggagccuucgguaacaugugucgcggcggucgcauguucgcgcccaccaagccguggcgccgcuggcacagacgcgucaacaucaaccagcgucgcuacgcccuggcgucggccguggccgccagcggcgugcccgcucuggucaugagcaaggggcacguggucgaucagauucccgagcugccguuggucgucagcgauaaggugcaggagaugcacaagaccaaggaggccgugcaguuucugaggaggaucaaggcuugggcugacauccagaagguuuacaagagccaacgguuccgugccgguaaaggaaaaaugcguaauaggagacguauccaacguaaaggaccacucaucguuuacuacaaagaucaaggucuucgucaagcuuuccguaacaucccgggcauugaccucaucaguguccaaaaguugaacuuguugaagcucgcuccugguggucacguuggucgauuugucaucuggaccgaaucggcauuccaacguuuagacaaauuauucgguacauggaaaaacccaucgaccgaaaagaaggguuacaacuuaccucaacccaagauguccaacaccgauuugucuag

SEQ ID NO: 4365 - RNA, 708 nt, Phyllotreta cruciferae
guaacugacgauucgacugagcuggaagacgaggcagaguggauuuacagacaagcuuuuuguaauaaggcuguguccaauguugaugcgcaccuuucggccgaagcgagagagaaaaugaagaaaggcucccaaacgguggggaaaauaaagaaggcguuggauuuuaugaggaaccaacagcucgaggugcccuuuaucgcuuuuuacaggaaggaauauguacaaccugaacugaauauuaacgauuuauggaaaguuuauaaauacgaugcaaaguggugucaacuaaaaucucgaaaggaaaaucuccuuaaacucuuugauaaaaugaggcauuaucaacuggaucagcucguaaaaaauccggacgcuccuauuccagacaacgugcgagugaugaaagauucggauaucgaaaggcugaaaaacguccaaacugcagaagaacucaaugauguucacaaucauuucauauuguauuauuccggagacuugccugccaugcaugcagcuuggagaaucaaagaaaaagagcagaggaaauucgagaagcgacagaaaagacucaagcaaauugccgaagcggaggaaggugcugacauuccugaugaaccagaggaugacgaugaugaugaaccagaaacagaaacuuugaaauaugcuaaucgaucgggcaguuaugcauuguguucgaaagcuggauua

SEQ ID NO: 4366 - RNA, 754 nt, Phyllotreta cruciferae
aagaaaucuugggaagcgauagcgagucggaaucaggaucggagggaucugaagaggaaucagauggcgaaggcgaggacgaagaaaucaaagaugccgggaaaaucaucgacaauacugaaacaaaucuaauagcucuuagaaggacaauauauuugacuauacaauccaguuuggauuucgaggaaugcgcucacaagcuuuugaaaauggaguuaaaaccuggucaagaaaucgaauuaugccauauguuuuuagauuguugugcugagcaaaggacauaugaaaaauucuacggacugcuagcucaaagguuuugccagauaaauaaaauauacaucgagccuuuucagcaaauauucaaagacacuuucgcgacuacccaucgcuuggacaccaauagauugaggaacguuagcaaauuuuucgcccauuugcucuuuacggacgccauagguugggagguguucgagauuaugaaacucaacgaagaagacacuaacagcucgaguaggauuuuuauuaaaauuuuguuucaagaauuagccgaauauaugggcuuaggaaaguugaaugcgagauugaaagaugaaacgcuucaacaacauuuugcgggauuauuuccuagagacaauccuaaaaauaccagauuuuccauuaauuucuucacguccaucgguuuaggagguuuaacagacgaacuuagagagcauuuaaaaaacgucccuaaaauuauggaaauuaaaacgaccgc

SEQ ID NO: 4367 - RNA, 776 nt, Phyllotreta cruciferae
cccagacacuuuccaauguaguuacgauccuuccuuugcugccgcacgaaaugcgaauauggaaagaauggccgaacagauugcaacauugugcgccacuuugggggaauacccgcacguccgauauaggagcgauugggaacguaacguagaguuggcgcaauugauccagcagaaauuggaugcuuacaaagccgacgagccgaccaugggagaagggccggagaaggcccgaucgcaauugcugaucuuagaccgaggcuucgauugcguuucgccuuuacuucacgaacugacguuucaagcuauggccuacgauuuacuuccaaucgaaaacgacguguacaaauacgaggcuuccgcugggguacaaaaggagguucucuuggaugaaaacgacgagcuguggguggaguugcgccaucaacacaucgccgugguaucccaaagcguuacuaagaauuugaaaaaguucaccgauucgaagcgcaugacucaaagcgauaaacaguccaugaaggauuuguccacuaugauuaagaagaugccgcaauaucagaaagaauuaucgaaauacgcuacucacuugcaucuugccgaagacugcaugaaggccuaccaaggguauaucgacaaguugugcaaaguugaacaggauuuggcaaugggaacugacgccgaaggggagaaaauuaaagaucauaugcgcaacaucguuccgauucuuuuagauaccaaaauaacgaacgaauacgauaagaugcgcaucauagcuu

SEQ ID NO: 4368 - RNA, 650 nt, Phyllotreta cruciferae
aaaauuauggcggugagacuuucuuaucggaggaauuggcaaucaugauucuucaagauacuaaacaagcuuuucaacguugcuuauuguuaucaaaagguagugaaagagcuuccaacgccacucaaauuuuagacaggcuuauuaauaguuugcugauagaacauguagacuaugcaguugaguugggucuacacgcuguacccguugucgaaggcguuagaaaucccccuguuuuguauuuuuuuaauaucgugcaucagagcaauaauauaacccaucucgucgagaaacaguuuauggauuuggugguuccauuaguagaaaauacuucaaaauauagcgauugcauacagaagaaaaaauuuguuuuggaggauauagaaagaaaaauuaauacgggauuggauagauguuugagugcgauauuaaauugggugaaguuguauuuacaaucugaacaaaagaaaucggauuucaagccagagucugaugauuuugauacaguggccucgccagcuugcaagaacguacuuaauuauguuaauaguauuaucaaagaaauuaaaacuaauuuggauggcaauaauguaacagcuauccuucaggaauuagggauuagacugcauagaguuguuuacgagcacuug

SEQ ID NO: 4369 - RNA, 653 nt, Phyllotreta cruciferae
uagaaaccaucgaucugcagaaagaccccuauuuuaugaaaaaccaccuggggucuuacgaauguaagcuuuguuugacgcugcacaacaacgaggguaguuacuuggcccauacgcaaggcaaaaagcaucaagccaauuuggccaggagggcggccaaggaagccaaagaugcccccacguugcuccaaccggagaaaccucgaguggagcccaagaaggucgugaaaaucgguaggcccgguuaucggguaaccaaacaaagagaccccgaaaccggucaacagaguuuacuguuccaaaucgauuauccagaaauaagcgauuugguuuugccccgacaccgcuucaugucugcguacgaacagaaaaucgaaccccccgaccguaaauggcaauacuuacucuucgcugccgaaccguacgagaccauuggcuucaaaguaccgagcagagagguagaaaaaaccgauacuaaauuuuggacacacuggaacagggacaccaaacaguuuuuccuacaauucgccuucaagaacgagaacaaacgcaacguuaacucuguaguacaaaggcauucgauuguugguggcguuccaccgccucccaugcugccgguaccgccgccacccaggccuccuauguuuaauccc

SEQ ID NO: 4370 - RNA, 253 nt, Phyllotreta cruciferae
uaaccugcgaaacgauaaccggcgaaguuuacagggguaaacuuauagaagccgaggauaauaugaauugccaaaugacccaaauaacuguaacuuacagagauggacgaguggcgcaauuagaaaacguuuacauuagagguuccaagauaagguucuugauauuaccggauauguuaaagaaugcuccgauguuuaaaaaacaaaccaaagcuggaacugcuggcagagggaagucugcaauucuacgagc

SEQ ID NO: 4371 - RNA, 769 nt, Phyllotreta cruciferae
uauucgcaacauucagcaacugggggccaauuuaacggccacuuccgauagagaaacuaucugcuacacuuuagaagguaccccagaagccguggaaugugcuauaccuuucuugaccgaaguagccacccaacaggaauucagaccuugggagauuuccgaauugucugguagauugcaguuggauauugcuacaagaccguugcaguugagagccaucgauuugcugcacaacgcugccuuuagaggacgcggcuuggguaauucucuguuuauuccgaaaacucaaaucgguaaaauuucguccgaaacccuacaacacuacguugccucgaacuucgugagcggccguauggcuguaguaggcucagguaucagucaaaaggaacugacaucuuucgcaaacuccuugaaaauugaaaauggcgaaggcaacaacgcuccuucaccuuacguaggaggugaacuaagaucaaacaaagguggucaacuugcauucguugcuguagcaggagagggugcugcuaucacgaacaccaaggaagcucuggcuuucgcugugcuacaaggagccuuaggaggaggcccacagguugcacacggaguuuccgacaauggugucuucaggaaggcucuuggaagcaaccccaaugucaguucaguagccauaaacgccaguuacucagacaccggucucuuugggcuucuacuggcugugccaacgaagucugcaggaggugcucuagaaaccgcuguuaaagugcuuaag

SEQ ID NO: 4372 - RNA, 197 nt, Phyllotreta cruciferae
ugaucggaugacuaacgaacuacaagagaaaaucggagcccuaaaaucccucacuauagauauaggaaaugagguuaaauaccaggacagaaugcucagggaugucgaugaugauuuagagaaaaccggaggguuccugggaaccaccaugaacaaagucuugaggcugucgaaagggggccacaauuacaucauug

SEQ ID NO: 4373 - RNA, 705 nt, Phyllotreta cruciferae
cguugguaauccucgaagaugucaaauuuccgaaauucaacgaaaucguccagcucaaacuggccgauggcagucuacgauccggucaaguauuggaggugagcggcucgaaagccguaguacaaguguucgaagguacuucgggaaucgacgccaaaaacaccgugugcgaauucaccggcgacauucucagaacgcccguauccgaagacauguugggcaggguguucaacggcucaggaaaaccaaucgauaaaggaccuccaauuuuggcugaggacuucuuggacauccaaggucaaccgaucaauccuuggucgcguaucuacccggaggaaaugauccaaaccgguaucuccgccaucgaugugaugaacucgaucgcucguggucagaagauucccauuuucucggcggcuggucugccccacaacgaaaucgccgcccaaauuuguagacaagccggucuugucaaggugcccggcaagucggcuuuggacgaucacgaagacaacuucgccaucguguucgccgcuaugggagucaacauggaaacugcucguuucuucaaacaagauuucgaagagaacgguucgauggagaacguuuguuuguucuugaauuuggcgaacgauccuacuauugagagaaucaucacgccucguuuggcucuaacagcagccgaauuuuuggccuaucaaugcg

SEQ ID NO: 4374 - RNA, 671 nt, Phyllotreta cruciferae
aucagacgcagcuacuaaagucgacggauuggagaguuuguugcaaucauugguacaagugcugcaaucauccgacguaaacguggugacuugcgccgccggcauccugucgaauuugacgugcaacaaucaacgcaacaaagugacggugugccaggugggcggcgucgacgcccuggugcgcaccaucgucagcgccggcgaucgcgaggagaucaccgagccggcggugugcgcccuacgccaccucaccucccggcacguggaguccgagauggcccagaacgccgugcggcugaacuacggcauacaagugauugucaagcuguugaacccgccgucgcguuggccgcuggugaaggccgucaucggguugauuaggaaccuugcucuguguccggccaaucacgcuccguugagagaacacggcgccauucaucacuuggugcaguugcugaugagagcuuuccaagacacucaaagacaacggaguagcgucgcuagcggaggcagccaaccgcccggaacguacgcggacgguguucgcauggaggagauuguagagggaacggugggagcguugcauauauuagcgagagaaucgcauaaucgggccaucauuagacagcaaauggugauuccgaucuucgugcaauugcuguucaacgaua

SEQ ID NO: 4375 - RNA, 664 nt, Phyllotreta cruciferae
aaucgacaagcacaagaaacgccggccauauuuagcaucagaaugcaaaagccuguacgccugcgagaaauggcgcaugcaaaucaucagggaaauagcgaaaaaaguggcccaaauacagaacgcagggcucggggaauuccgcauucgcgaccuaaacgacgaaaucaacaaacuccugcgcgagaaacgccauugggaggaccaaaucaaggagcuaggcggcccugauuaccagcgcgucggccccaggaugcuagaucacgaaggcaaagaaguccccggcaacagaggcuauaaauacuucggagccgcuaaggaacuaccaggcgugcgagagcuguucgaacaggaaccgccgcccccgccuaggaagagccgugcagaacugaugaaggacaucgaugccgauuacuacggcuacauggacgacgacgacgggauacugaucccuuuggaaaucaaagcugaaaaaauagccguacaaaacgcgauagccgaaugggugaacaacaaggaaaagaaccuagaccccgccaaaggaaucgaagagaguaucuacgugguggaggauucagaugaagaagauguuguucaacaguucgaugguucgcaacagagauucguggcacacguaccggugccaucgcaacaagauaucgag

SEQ ID NO: 4376 - RNA, 659 nt, Phyllotreta cruciferae
cgugaugaaauacggcaaaaaucaauggucuagaauagcaucucugcuucacaggaagucugcgaagcaauguaaagcccguugguucgaaugguuagacccuagcaucaaaaaaaccgaaugguccagagaagaagaugaaaaguuguugcacuuagcuaaacuaaugcccacucaauggagaaccaucgcgccuauaauaggcaggaccgcagcccaaugucuagaaagauacgaauauuuacuggaucaagcgcaaaaaaaggaagaaggcgaagaugccguggaugauccgaggaagcuaaaaccuggagaaaucgaccccaauccagaaaccaaaccagccagacccgauccuaaagacauggacgaagacgaauuagaaaugcuuuccgaagccagagccagacuggccaacacccaaggcaaaaaagccaagcguaaagcucgugaaaagcaguuagaggaagcccggcguuuggcggcuuugcagaaacggcgagaacugagagcagccgguaucgaagucaccucgaggcgcaagaaaaaacgagguguagauuacaaugcggaaauuccguucgaaaaacaaccagcaaucgguuucuacgacacuucuaacgaagcccucgacuugauggccccugauuucucuaaaa

SEQ ID NO: 4377 - RNA, 324 nt, Phyllotreta cruciferae
gcucauccugauaagcugaagaaaaaaauuacuagggaauuaauuacuaccauucuugccagaaaaccaaaaaugugcaguuuuuuggaauggagagauuugaaaaucguuuauaaaagguaugccagcuuguauuuuugcugcgcgauagaacaaugcgacaaugaacugcuaacuuuggaaaucauucaucguuacguugaacuuuuggauaaguacuucggaagcguaugcgaauuggauauaauuuucaacuuugaaaaagcguauuuuauucuggacgagcugaugcuugguggcgaggugcaggaaaccaguaagaaa

SEQ ID NO: 4378 - RNA, 707 nt, Phyllotreta cruciferae
uaaaucggaucuggccaaaaaagcugguaaauucaccgaagaaguaggaaaaacuacgcacaaaaucagcgaaacggcacaagaaaucagcaaaaccggagccuuucaaagcauaucggaggccaccaaagccguuaaacaagaaaucgacaacaccagcauggaaggucgaguguacgugagcccuaagaagcuucgaaaacgaaccgaaaccagcgcaguaguccaacaaaaguacuacgaaccgaacacagacgccaccggcguagagcuacacaaagacuccaaauucuacgaguccuggcagaacuucaaaaacaacaaccccuacgugcacaaagucauggacuggaaacucaaauucgacgaaagcgagaaccccaucaucagagccuccagggcgcucacggaaaaagugggagacauaaugggaggguuguuucaaaaaaccgaacucuccgaaacccuuacagaaaucugcaaaaucgaccccgacuucgauacgaaacgcuuccuaaaacaaugcgaaaccgacaucauccccaacauccuagaagccaugaccagaggcgacuuggauguuuuaaaggacuggugucacgaaggcccuuucaauuuauucgcuguaccgaucaaggaggccuauaaaaaaggcuacaaaaucgaguccaagauccucgauguagaccauguggaucuagugaugg

SEQ ID NO: 4379 - RNA, 752 nt, Phyllotreta cruciferae
agaugguaagcugaaaccugguuuaaauaaaaucgaacaggcuccuaagcaauucguaaacaacauaagugguuuaaaucagaaaaucgaagaauucaaauugaaucuaccauggaucgaaaggcuggauuguacgaaugcccaagcccccuuagcgcccgaguuagcggaggagauguuagcucacgaagaaaagagaaguaaucaacugcgaaacaacaaaaaacuuccccaauuccaaccgucggaagauccaguucugaacgauuucaaacgagaacuaauauuccauaggcaagcucaagcuacaauucuggacgcaauuccgaaaaucaaagaauuagggauaucuacuaaaagaccggacgauuauuuugcugaaauggcaaaauccgaugagcaaaugcacaaaaucagagagaacuuaaagcagaagcaggagcagcagaagcggagugaacgggugaagcaauugaggcagcaaaggaaagagggaaaaucgcugcaggugcagcucaaguugcaacgcucuaaggagaagaaagagaugauggaucaagugaagaaagcgagaaaaaauuucgauuuucuggaugagaaaaauaagcccaugggaaagaauaagguggcagaaaggcguaagaugaaggauaaaaaauucgguuuuggugguaagaaaaaggggaugaagaaaaauacaaaggacagugcgggcgauauuagcgaguauagaaauccuggaaaagccaaga

SEQ ID NO: 4380 - RNA, 674 nt, Phyllotreta cruciferae
cuucgcaaagaauucucaccguucggcaccaucacauccgccaaaguaaugauggaagaaggccgaagcaaaggcuucggcuucguuugcuucuccucgccagaggaggccaccaaggcagugaccgaaaugaacggcagaaucgucggcacgaaaccacucuacgucgcccuggcccaacgcaaggaagaccgcaaggcucacuuaacaucgcaauacaugcaacgcauggccaacaugcgcaugcaccagaugggccaguucauccagccgggcggcuccagcggcuacuucgugcccaccauucaagcgacggcgccccgauucuacgggccggcucagaugccgauucgcacgagcccgagauggccggcgcagacgcccgugcgccccggcgcccaagggagcaccgccaccuacaccggcaugccgaacagcuacagggccgccgccagaccgccgggucaguccacgaugcgcagcaacaucagcgugccgcgacccaucaccggacaacaaccaccaaguaugcacggucguccacuuguuggacaaguguggcugcugccggaaaucgugcagccaacuucaaauacaccgccaacaugcguaauccaccgcaagcguuguuacccggagcucaagcucaaguacagcaagcaguccauauucaa

SEQ ID NO: 4381 - RNA, 662 nt, Phyllotreta cruciferae
uucuuggaagguuuuggugacgagaacgcucaaguacaacuacaauugcuaacagccguugugaagcuauucuuaaaacguccacaacauacccaaggcuuaguccaacauguacugaguuuagccacucaagacuccgacaaucccgauuugagagacagagguuucauauauuggagauuguugaguaccgauccggccgcugccaaggaggugguucucgcugauaaaccucuuauuuccgaagaaacggaucucuuagagccgacucuucucgacgagcucaucugccacauaucaucccuggccagcgucuaucacaaaccacccacggcguucguagaaggccgaagugcagguaucagaaagacauugccggcuagacaaggcucugaugacacagccgccgcucccgaaaccacuguuauuccgaaccaagaaagccucauuggugauuugcuuucuauggauauuaacgcuccugcuccagcugcugcugcuccugccgccccucagacuaguaacguugauuuacucggcgguggauuggauguuuuguugggaggagguaaugauauuggggcagcaccugcuagugcugcugcucccaccacuacuggucuucucggggacauauucggcauaccuacugcaccuaccau

SEQ ID NO: 4382 - RNA, 362 nt, Phyllotreta cruciferae
caucuuuggcuccgaaaaucgguccccuugguuugucucccaaaaaaauuggugacgauauugccaaaggcacagccgacuggaaagguuugaaaauuacgguccaauugaaaauucaaaaccgucaagccaccaucuccgucguuccaucggcugcuuccuuaaucauuaaggcuuugaaagaaccuccucgugacagaaagaagcagaaaaacauuaaacacaguggaaacauuacauucgaugauguaauuucuauugccaagcaaaugaggcauagaucaauggccaagagccuuucuggaacuauuaaggaagugcugggcacugcucaaucuguagguuguacaauugacggcaaa

SEQ ID NO: 4383 - RNA, 653 nt, Phyllotreta cruciferae
cugaggccucuaacuuugagccggcccaaaccucuagucgaauucgcgaacaaaccaauccuguuacaucaaauagaagcccuaguagacgccggaguaacggaagucauauuggccgugucguaucgagccaagcaaauggaggaagagcuuacagucgaagcggcuaaacugggcauuucuauaguauuuucgcacgagacugagccuuugggcaccgcaggaccaauagccuuagcuagagaacaccuuucgaaaagcacaaaaccguuuuucguacugaauucggacauaauaugcgacuucccguucagagagcuagagaaguuccacgaaggccacggcaaagaaggcaccauagucgucacaaagguagaagaacccuccaaauacggaguuguaguguacgaucaaaacaacugcaucgagaguuucguggagaaaccccaggaguucauuucgaauaaaaucaacgcuggucuguacauucuaaaccccagcgugauuaacagaauagaacuccggccgacuuccauugaaaaggaaguguucccuuacauggccucugaccagcagcuguacgcuuucgaguugaaaggauucuggauggacgucgggcaaccgaaagauuucuugacuggaaugugcuugua

SEQ ID NO: 4384 - RNA, 678 nt, Phyllotreta cruciferae
cugaaagaaggaguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauaguguugauaccgcggcggagcccuggcgggccgcucuagauaacgaguuuauacaauacacgagaaaccauuauaaagacggcguuuguagcguguucgcucgcagccaaaacggcgccaucacccucaccgcuugcaucgaagaccaccaauuccagcccaagaacuucuggaacggucgauggagaucccaguggucuguuaguuuaaccgaugaagccaccgcagaaguacggggaguucucaaagugcaaguccauuauuacgaagaagguaacguucaacuggugagcacuaaagaaaucaaggaaucgauuccgguuucgaacgaagcgcaaacggcuaaggaaaucauccacguaauagaacaggcugagaaucuguaucaaacggcgauuucugagaauuaccagacgaugucugauacgacguuuaaggcucugcgaagacuccugcccgucaccaggacaaaaauggau

SEQ ID NO: 4385 - RNA, 769 nt, Phyllotreta cruciferae
cacaccgauaauauggagcaggccgauuccucuagguugguauuuccaauuccaaugggagaaccaauacggcaaaaauuggcccaaacaacucugcgacgauuggcucagaaccgauagauaucugaaaaacuucgcucacgaauuaccccaauguccuugcacgguccaacaggcucuggcugauaaggggaaauucaugccagacuuugauugcgacaaagauucgaaucccguuuguuauuacaacaaccaagcuuugcauugcgucaaaaccggugcucccacaauggaaggcuccgagcaacaauguugcuacgacaaaaacggcuaccuaaugcuguccuacgaucaacaaugggguuccagcccccgucgaugccacaaccuuggaaaaaugccuuacaacgaagccaccaagguccccacacuaucccaaugguucaacgacaucguacccaaguaccucugcugucuuuggcaggaagagcaagccgugggcugcgaaacgcugcgauucgaaagaaggccuucgcaggacugcgucgccuaucaagcgccggcuguggcaggaguguacggugauccgcacauugucaccuucgaugacguagaguacacguucaacggcaaaggagaguacgccuuggugaaauccuugaagguggacgauaauuuggaaauacaggcuagauucgagcaaauggacaucaaugcuuauggagaggucagagccacgcaacuuacggcaaucguagccaaaggaaac

SEQ ID NO: 4386 - RNA, 216 nt, Phyllotreta cruciferae
cuccgcugaugucgaaaaaauccucggcuccguaggaguagaagcugaagcugaaaaggucaagaaaguccuaggcgaacuuaaaggcaaauccaucgaagaacucaucacuaaaggucgugagaaauugaguucuaugccaguagguggcgcagccccuguagcugccgcugcaguugccgcugccccggcugccgccgaggaaaagaaagaauc

SEQ ID NO: 4387 - RNA, 786 nt, Phyllotreta cruciferae
accgaacauuccaauaagcucguagaaguagccaaccucgucugcagcaugucgaacaacgaagacggcgucaaaaugguucgauacgcugccgcucaaaucgacaaucuauguccugaaguaauaaacgccgcuaggauccuagcggccagaucucgcaguaaaguugcucaagaaaauauggaagcuuucaaacaaucaugggaaaaccaagugcgcaucuugaccgaagccguugacgauaucacaacuaucgacgacuuuuuggccguguccgaaaaucacauucuggaagacguuaacaaaugcguacuagcucuucaagaaggcgaugcugauacauuggaucguacugcuagcggcauaaagggcagaucaaacagaguaugcaauguuguaacagccgaaauggauaauuacgagccuugcauuuacacuaaacgcguuuuggaggccgugaaaguuuugaacgaucaagugaugcccaaguuuacccaaagaguacagguggcuguacaggcuuugggcaacaguccgccuaaagaaguggacgaaaacgauuucaucgacgcaucgagauugguuuacgacggugucagagaaauaagaagagcuguacucaugaacagagccgacgaagauuuggaucccgaagacgucgaacucgaugaaaauuauuugauugagaccagaagcaaaucgagugcucauacuggugaacauggcguugaugaauauccugacaucaguggaauuacaaccgcucgggaagcuauggguaagaug

SEQ ID NO: 4388 - RNA, 742 nt, Phyllotreta cruciferae
agcgguuucuacaacaucuucagccaccacagcugcuacuggaacuccccuuuuuggaguugcuccaaccucaagcacuacuacaauagccaguguaccugcuuuagguuuaucgacuacaguuucugccgcugcuucaacaacuccuucgacuucauuaaguacuacaacagcacccccagcuuacucaacaucgacacuuccuucuagugguucauuaacauuuagucaacuagaagauucuauuaacaaauggaccauugauuuggaagaacagggcaaguuuuucauuaaucaagcgaaacagcuuaaugcuugggauucguuacuuauuucaaauggcgagaaaauucucaaucugaaugguaguaucgagagaguuaagcagcagcaacagcaauuggaucaagaacucgauuuugucuuggcgcagcagaaggaauuagaagaguuaauaacaccucuggaaaaggaauuauuggaaauucccguaacagacauagaucgaaaucaaauguaucaauuuucggaaauaaucgauucgcaauuaaagcaaaugucugaugauuugaaagaaauuauugagcauauuaaugaaucuaauaaaagcgaagaaauuucaaauccuuugacccaaauuagccgcauaaugaaugcccacaugaauucccuucagugguuagacagaaauacagcacaaauuguuucucaucuggaacaaaucaguaaaaugcaggacucc

SEQ ID NO: 4389 - RNA, 468 nt, Phyllotreta cruciferae
ccgggaaauugcuguuuuuagggcuggauaacgcugguaaaaccaccuuauuacacaugcuuaaagacgauagauuagcccagcacuugcccacguuacaucccacuucugaagaacuguccaucgggaacaugagguuuaccacguucgaucuaggaggccauucgcaggcucgaagaguauggaaggacuacuucccagccguagacgccauuguauuccuuaucgacgcuaacgacagaucucgauucggagaaagcaaacgggagcucgacgcgcuguugacagacgaaacccuggccaacugccccgugcugauucuaggcaauaaaaucgauuuacccgacgcggcgucugaggaugaguugagaaacguuuacucguuguacggccaaacgaccgguaaagguaaagucgcucgaucggaucugccggggagaccguuggagcuguuuaugugcucgauuc

SEQ ID NO: 4390 - RNA, 433 nt, Phyllotreta cruciferae
uacgcucaaaucuccaacaaaacgcaaaccaucaccaaccugcugguggagacgcaaaccaugaucaacucggcgcugaccugccgcgaguccaucacuuccaugcugcagcaccugguggucaucaacgacuaccucaacccggccagcgaggccgacgagcuggagguggaggccaagcggcaguaccugcucgagcucuaccccgaauugaaggacaccauacagacggugagcacgcuggagucgcuguugccguucaucgauucgaucaacauaucgaaggugguggaguucucugggaagcuggaggagguggccguggggaaucuuaaguuguacggggagugcagggauaucaccaagaagguguugguggcguugcagcaguacaacgacauauccaauucgauuaaguuguuguuuucgcagc

SEQ ID NO: 4391 - RNA, 652 nt, Phyllotreta cruciferae
agacccugacuuacgauacaaaccaccgccuacucugcucgaugucgauccgcaggaucagcacucgaugugccugaagcacaugaacgaucuaaugacuuucuacgggaagaucguuugcguuaaucuagucgaucagaaaggagccgaagggaacauggaaguggcguucaagaaugcgauaaacaacguaucgucgccaucggugaaguacgaaucguucgauuuccacgccgagugcagcaaaaugagaugggacagacugucgauucucaucgaucgauuggcgcacgaucaagacgagaugaguuucuuucuguugcugagagacggcucguugaguucccuucaagacggcguauuuagaacgaauugcaucgauugcuuggaccgcacgaacgucgugcaaagcaugcuggcccaucggaaucuggaaagcgugcucagaaaauugcagauucuccaucagaaccaaacguuggaguuccaguauucguuugagguguuguuuaagaacguuugggcggauaaugcggauauaauaaguacccaguauucggguacuggugcuuugaagacggauuucacgaggacugggaaacguacgcgguacgguuuacuucaggaugguaugaauucgaugacgagguac

SEQ ID NO: 4392 - RNA, 651 nt, Phyllotreta cruciferae
uauauacgcaaucggagcaggcgccgccuuggacccggccgacgagaaacuccuagaagaagacauccucacuccucaagacucuaagagaucccgccaccaugccaaauccgucucguggcuucgacgaaccgaauacaucuccacggaacagaccagauuccagccccaaacuauggacaaagucgaagccaaagugggcuacagcaucaagaagucccugaacaacgaaacccuuuacauggacagggacucgcaaaucaaggcuaucgagaaaacguucgaagauaccaaaacgaucaucgauaagcauuacagcaagccuaauguagucccuguggauguuuugccaguuuauccagauuucaguuuguggaaauauccuugugcccaggucauuuucgauucggauccggcuccaguuggcaaacaaguaccggcucaaaucgaggagaugucucaagcuaugauucgggguguaauggacgaaagcggugaacaauucguagccuacuuccuccccacggaggaaacccuccaaaaacgcagggaagacguggccaaucaaguccaauaucaagacgaagaggaguacgaauacaaaauggccagagaguacaauuggaacguuaagagcaaggcuaguaaagg

SEQ ID NO: 4393 - RNA, 698 nt, Phyllotreta cruciferae
aucaagaaggacgauauggcuccaugguacgaacuccucugcaaagaagucggcuggaaguuagacgcugccuugcugaaggcccucaaagccaagaacuccgaaaaggucaagcuucuggacgaagccaucgaagacgcggagaagaacuugggggagauggaggugcgggaggcuuauuugcguaaagcggaguuuuacagcagaaucggcgacaaagaaaacgccgugaccacuuucaggcagacuuacgauaaaacaguaucuuugggccaccguuuggacaucauuuuccacuuaauuagaauaggcuuguucuucauggaccacgaccuuaucacuagaaauaucgacaaagcgaagacccuaaucgaagagggaggcgauugggacaggagaaaccgauuaaaagucuaccaaggugcuuauuguauguccgugagagacuucaaaaccgccgcuaaccuguuuuuggacaccgugagcaccuucacauccuacgagcucauggacuacaaggcuuucgucagauacaccgucuacacuuccauaaucagccugccgagaaaccaacuuagagauaaaguaauaaaaggcucugagauacuggaggugcuucauucugaaccguucguuaaagauuaccuguuuucuuuauauaacugccaguacgcggaguucuucucgaauuuggcuga

SEQ ID NO: 4394 - RNA, 737 nt, Phyllotreta cruciferae
auuguucgauuacggcaaaccugaugcccaaccgguuaagaaaccagucgccaaaaaauuccaaccgaaagucucucuaguuagaggaguagcuuugcccaguaagcccaacaccgagaagauuaucaucacgcaaaauucgaacguguugaauacuucacaggcuucgaaagucaccagcaucauuuuaacccacaacgcaaauguuagaaggaacauuauaagcguaccgaaaauagugaguaccguuucaccggcuauaacuauagugagcgccaguaccucgcaaauggccucuauauuaccaucuaaauucaccgugccgguuauaagcgccagugcgguacgccagcuauccaacgucaaagucaucgacaaaccauccacuucuucguugucgauuucuaccagagacaacguccugccgaagaagauauucgaggacgauucggugucgccggacaguucgaauugcgacgacgagaaauccaaagauucauucgacgauaaagucaagucggagucuccgccgcgggaggucaaacaguucgugaaaucggaucagcaggucauaucgcugaaaucgaagaacuacuccgaucaaucgaagaagaucgagcaucugcaaauagugaauauaucugcgaaggaugugguucaaaggcagaggauaccgaguccuuugauaucgaaagcuucuccgguuaucauucacaauacgccagaguugaaaauga

SEQ ID NO: 4395 - RNA, 678 nt, Phyllotreta cruciferae
aguccaacaggcgaauuaauaaccacuaaagaguacaaaggauuagauauagugcguagggauuggucgcaauugucuucggaaacuggaaaauugguccucgagcaccuccucagcgaucaauccuccgaugaaaaaguacagaacaucuacgacuacuuggcuaaaaucaaaucugauuugguugaggguaaaauaccaauaccacuauuagcgaucacgaagcagcugaacaaggccccucaccuguacaccgauaaaaacucuaugccucacguucagguggccuugcgauacaacaagaagagccgcgaucacuucagaaugggcgacacagugcccuacguaauaugcauagacaacacgaguaacaaccccaugcagcgagccuaucacguggacgaauugaaggguaaccccgaguugaaaaucgacuacgauuacuaucuggagcagcagauucauccggugauaucgagaauuugcgagcccauagagggcuuggacuccuaccaguuagccgaauuucugggcgccaaucugaagcgaaugaagaggcccaaaccgaaagggggcaacgagaacauucaaggggagaacgucguuaaagccgaggugaaguucaagaacgccgagaaauuuucguucguuugcuacauuugcaaacaccagaauguc

SEQ ID NO: 4396 - RNA, 743 nt, Phyllotreta cruciferae
gacgcaggcuauuagaaagaguauuggaguaaggauaaaggaagagagugaaauuaucgaaggugaaguugucgaucugaguauugaacguccagcuacaggaguugguacuaaagucgguaaauugauucucaaaacuacagauauggagacuguauacgauuugggcgguaaaaugauugauaguauucuaaaagaaaaaguucagucuggugauguuaucacuauagauaaagcuacaggaaaaauuacgagauuggguagaucuuuugcuagagcuagagauuaugaugcuacuggccaacaaacgagguucguucaaugcccagaaggugaacuacaaaaacguaaagaaguuguccacacagugacuuugcaugaaauugauguaaucaauagucgcacucacggauucuuggcacuauuuuccggugacacgggagaaauuaaaucagaaguaagagagcagauuaauggcaaaguagcugaauggcgugaagaaggcaaggcugaaauuauuccugguguacuguucauugaugagguucauauguuggauauagaaugcuucucauuuuuaaacagagcuuuagaaaaugaaaugucuccaaucgucauaauggccaccaauagagguauaacaaaaauucgagguaccacuuacaaaucuccgcacggcauuccuuuggauuuacuggaucgaacaauuauuguuccuacucagccauaugacgagaaggaau

SEQ ID NO: 4397 - RNA, 799 nt, Phyllotreta cruciferae
cgaagaaagaaggagguugauugagcucgguuugagccagcauguuuuagcgagcaguguaucacugcuuagagcagaagaaguugaagauauaauugaaggaaaugaugagaaguauaaagcuguaucuguacacacuucggaaccuccuaugccaagagaggguaaauccaagaaaaacaugcaauggguaccaucguuaccuaauuccagucauuuagaugccguuccacaagcuacgcccauuaauaggaacagaguagcugcuaaaaaggugagaacauuuccacuauguuuugaugacaccgauccccaaauaaacauagaaaaugcuugucaacaagaauugcuaguuccuauuagacuggauauggaaaucgaaggacagaagcucagagauacauucacuuggaauaaaaaugagaguuuaauaacgccugaacaauuugcugaaguucucugugacgaucuugauuuaaauccuuuaacauuuguaccagcgauugcucaagcaauuagacaacaacucgaugcauucccgacugaaccuccugcuauuauagaggaaaccugcgaucaaagagucauuauuaaguuaaauauucacgugggaaauacaucuuuagucgaucaaguugaaugggauaugagugaaaaacagaauaaucccgaagaauuugcguugaaacuuugugcagaauugggucuugguggugaguuugucacugcgauugcuuauucuauuagaggucaacucucuuggcaccagaggacuuaugcuuucagugaagcuccucuu

SEQ ID NO: 4398 - RNA, 479 nt, Phyllotreta cruciferae
cgguaaaacgugucuuuugauaguauuuaguaaggaucaauucccggaaguguacgugcccaccguauucgagaauuauguggccgacaucgagguggacggcaagcaaguggaacucgccuuaugggauacugcaggccaggaggacuacgaucgccugcggccccuuucauauccagacaccgacgugaucuuaaugugcuucucgguggauucgccggacucccucgaaaacaucccggaaaaguggacgccggagguaaaacauuuuuguccgaaugugccaauuauccugguaggcaauaaaaaggaucugcguaacgauccgacuaccauuaaugaacuuaaaaaaaugaagcaggagccuguuaagccgcaggacggucguucgauggccgagaaaauaaacgccuuugcguauuuagaauguucggcuaaaaguaaggagggcgucagggaaguauucgagaaugccacuc

SEQ ID NO: 4399 - RNA, 672 nt, Phyllotreta cruciferae
uaccaacacaauuuuccccaugccaucucgcccggggcaaaugcauacgaauugaccaguccauucguuuucucucccaagcacaacggccucuauuuauauuuaaguagaauauuaagaccuauuuggcaucgaaggacaguggauaagcuuugcuuagauggaaaaauuguuacaaaucacaguacagugacuagugaagacugcauauuuauuuugaacuacauaacgucccugcauaauuuccuaaugcgcaauacucagcuuucaaccuuaagcgccgguccuggucccggucaaaauccucaaaccuucaauaauacuacaauuaauaugaccagauugaaccauaccauucaagauguucaauuggaggaaagggcaucucuggaugcuuugaaaacauucguuugccacuguugucaaauauuaggucuauggagaauucuuugcgagcaucaauuccacacauuaauagcuucuuugccugaaacugagcagcagauuuugcaaaauacgacuuucaaggaucuacuuuuauaucgacaugauaucuguucguuguugauugcgacauuagucgauaguuacuuaggugauaacgccucagucgauucgauuagcagcaaauugagagaagucuguccgcuguuuuacaagacggaagaugca

SEQ ID NO: 4400 - RNA, 734 nt, Phyllotreta cruciferae
ucguucgaaacagaacuucucaaucuccaaucaccugacguugugacagaggagcuguugaaaagaauuuacguugaaauggauuccgauuuuuucucgcauauuuugcaccuaaucaaagacgucaacgauuuguacaaagccauacacaaaauccuggagcuguugagauaugaaaacaccuuggccaaccccgauaacgacauuaacccauccgcuauguacuauuucaauucacuguuaggcacuucauugguggcccaaaguuuccgacaacaagccgaaaucagauuucaaauuugccgcaauuuguugcuauuaugcaacuucuuggugauggacaggacgcuagauuggggcguuuuggaaggcguucgaucagucuguaugccagacauugucguucuaacccaagccaguuucguuguucuguggcuaagcggguugacaauguucgaaagcgacucgauucgugauucuucgaugagcauccugaacccguuaaaacuaacuccaguuuacaauuugcuaccguucacucguugcacgucuuuguuggaaguauucauaucaucaucaggcguucaagaugccaggaaaucguucgcaaggguuuccugcaaggacgaggccuuggugcauuggcauuggucguuguugccuuacguaaaccacaucaggcaucuuauauggcccauaagcgguuguacgguguuagaagaguggcuguuguc

SEQ ID NO: 4401 - RNA, 694 nt, Phyllotreta cruciferae
ccagaacuauccccuauugcugcucaaucuagugcacaagcccgaggcggacaugaccaucaggguggccggcucgguggccuucaaaaacuacauaaaaaggaacuggguagucgaagaggaccagaccgaucguauacacgaauccgaucgauuggccaucaaaaaucucauuguaacuuuaaugcugagcucaccggagucaauucaaaagcaacucagcgaugcuaucagcaucaucggaaaaacugauuuuccuuugaaauggccggagcucaucaccgagauggucgagaaauuuucuaccggcgauuuuaacgugauuaacggcgugcugagaacggcccauucgcuauuuaagaaguaucgauacgaguucaaguccaacgaauuguggacggagauuaaauauguacucgagaagcuagcgaagccucuuacugaucuguuaguugcuacgauaaaucuaucgcaaacccacgcgaacgacguagcagcauugaaaaucaucuacaguucgcucgugcucaucugcaaaguguucuauucguugaauuuccaagauuugccggaguucuucgaggauaacauacaaaucuggaugaccaauuuccauacgcuucucuccguugauguuaaaucguuacaaagccaagaagacagcgaggcagggguacuagagcagcugaagucu

SEQ ID NO: 4402 - RNA, 458 nt, Phyllotreta cruciferae
aucacguucgaaugcauagaggaauuaaaagaagacuuagaauggaagaugauuuacguugguucggccgaaacugaagaacacgaucaaaucuuagacucuguauuuguaggaccuaucccagaaggcaaacacauguucgucuuucaagcagauccuccgaacgucucccguauaccugaaaaugacgccaucgguguaacaguuguucuccucacuugcuccuacaagagccaagaauuuauucguguagguuauuuuauaaauaaugaauacagcgauccugaaaugagggaaaauuugccuaguccaccucaguucgauaagguaauuagaaauauauuggcguccgaaccgagggugacgagguuuaaaaucaacugggaagaaucgaguggcacucaggaaaacggaacuacaauugccgaaacccccgcuaaccaaacaaccgaaacuuc

SEQ ID NO: 4403 - RNA, 702 nt, Phyllotreta cruciferae
uuuaccaaacgccauucaacaacaacaaagucuaccuacuacuaacucacaagugccuccucuagcuccaaugggagguucuacuccaacgcuuggucuagguuuaggccaugcgauguccaugccacauacuaaguauguaaccggauuuucacugccuaucaguucuauggcaccucaaacaccacaacauacaaugaugaguccuaugguaaauguugguggaacugguaccacuaguucugguguaacgcccacguuaggucccucuacaccuucaccaaugacuccuaugacaccacauucagcagauccuggaaucguuccacaauuacaaaacauugugucaacuguaaacuugagcuguaaauuagauuuaaagaaaauugccuugcaugcgagaaaugccgaauauaauccuaaacguuuugccgcugugauuaugaggauacgagagccaaggacgacagcuuugauauuuucgucggguaaaaugguguguacaggugcgaaaagugaagaagacucgagacuagcugcaagaaaguaugcucgaauuauacaaaaacuggguuucccugccaaauuuuuggauuucaaaauacagaauauggugggaaguugugauguuaaauuuccaauaagauuagaaggauugguucuaacucacaguucuuucagcaguuaugagcccgaauuguu

SEQ ID NO: 4404 - RNA, 329 nt, Phyllotreta cruciferae
gcugaucaaaugagcuucacuuuugcugcuggaaaccaggucuucuacgaugcgaaaucgauaaaacaaguagauguuccuucuuucuccgguagcuucgguauccuaccagcccauguucccacucuugcuguucuaaagccuggaguaguuacuguuuacgaagacgcugguaaugucaagaaaaucuucguauccagcgguacagugacuguuaaugacgauucaucuguucaaaucuuagcugaagaggcccaucccguagaaaauuuagacguuagugcagccagagaucuucuuaacaaagcacaaagucaauugucaucggc

SEQ ID NO: 4405 - RNA, 695 nt, Phyllotreta cruciferae
agaauugaaggagaagcaggaacaggaggcccgcaggaaggcuaagaaagaggccgaaucggccaagcaagcucaaauuacugaauuaacagaagagcaggcugagaaauugcaagccgagcucgaugcuaagaaguccccagcuucgguuaccccuucgaauagcucgaguggcccuucgaccuccacgacgaagaucgaagaagacgaagacgaguccgagaaggguaaauugcuacccaauaaaggcaacggaugugauuuagacaaguauaauuggacccagacucuuagugauauagagcugcgagugccgcuccagugcaauuuccgagccaagcaaaaggaucucacggugaauuugaccaaaaaacgccucacuugcggccucaaaggccauccccccaucaucgaugacgauuuccagcacgaaaucaaacuggaagagaccaauugggugauugaagacgggaaaucguugcuguuuuccauagaaaaagugaauaaaaugaauugguggaguaaaaucgugaagaaugauccggagaucagcacuaaaaagauuaauccggagccuucgaaguugagcgauuuggauggggagacgaggggcaugguggagaagaugauguacgaucagaggcagaaagagaugggauuacccacuagugaugaaagaaagaaacaggacgugu

SEQ ID NO: 4406 - RNA, 333 nt, Phyllotreta cruciferae
gcgauagagaaagguggauuugcguuuauccagcauacauuaauuccaaaaaaaccauugcccaaggcaggaaaauaaacaaagaaaaaugcguggagaaucccacucaucaagaaaucagagacguuuugcucgcagcagguuugaagguuggcguagaaaacaaauuguacagcagagaacgaagcaaagaauugcucuaucgagggcgaauuagaguccaauugaaaaacgacgacgguacgcugugcaauccaaauuucccuaccagagacagcuuaaugcuccauuugggagacaugauucccaaauugaagagcagacaaaacaagg

SEQ ID NO: 4407 - RNA, 776 nt, Phyllotreta cruciferae
aacaagcuuggcaaacuuacauaaauuucgaacugagauacaaggaaauugauagagccaggcaaauauacgaaagauuuguuauaacgcacccggaagugaaacauuggaucaaauaugcccguuucgaagaaaaucacgguuucauucauucagcuaggcagauuuaugaaagagcuguccaauuuuacggagacgaucauuuggaugagaagcuuuacauagcuuucgccaaauucgaagaaaaccagaaggagcacgauagagcuagaguuaucuacaaguacgccuuagaccacaucccuaaggaugaaacgaaagaacuguauaaggcguacaccauccaugaaaagaaauauggagacagaagcgguaucgaggaaguuauaaugucuaaaagaaagcugcaguacgaacaagaaauacuccaaaaucccaccaauuacgaugcuugguucgauuaucuucgacugguagaaggagaagcagauuuggaaauaacucgagaaaccuacgagagagcuauugcaaauauacccccaucgaaaaacaaacaauacuggagaagauacauuuauuuguggaucaauuacgcuuuauucgaagaacuggaagcuaaggauuacgaacgaaccagacagguauauaaagccugccuggaaauccugccgcauaaaacauucacguucuccaaaaucuggcugcucuacgcacaguucgaagugcgacagaagcauuuaaaagcagcccguaaaguucuaggcauguccauagga

SEQ ID NO: 4408 - RNA, 694 nt, Phyllotreta cruciferae
auuggguauuucuccgaucguaacaucuggauugaucaugcaacucuuagccggagcgaagaucaucgaaguuggcgacacuccgaaagacagagcuuuguuuaacggagcccagaaacuguuugguaugguuauaacggucggucaagccaucguguauguaaugaccggaauguacggagacccagcugaaauaggagcuggagucugccugcuuaucaucauccaacuguucguagcaggucuuaucgugcuccuucucgaugaacuguugcagaaaggauacgguuuggguucugguauuucccuguucaucgcuacgaacaucugcgagacgaucauauggaaggcuuucucuccggcuacugucaacacuggaagaggaaccgaauucgaaggagcuguaaucgcuuuguuccacuugcucaccaccagacaagacaagauuagaggacuacgagaggcauucuaccgccagaaucuuccuaauuugaugaaccuccuagccacaguuuuaguguuugcuauaguaauauacuuccaagguuuuagaguugauuuacccauaaagagcgccagauaccguggccagcacucgagcuaccccaucaaacuuuucuacacuucuaacauuccgaucauuuugcaaucugcguugguguccaauuuguacguuauaucccagauguuggcg

SEQ ID NO: 4409 - RNA, 712 nt, Phyllotreta cruciferae
aauuuaaccaccaucggucagaucagcucuuauuccaccgccaaagaauggaguagagguaaaaaggcacuuuuaggaacauuaggguuauuagccggaggcacuggggccgugcugguggcccucgaccagucgguuaaagcgucggaucuagaacugcacccgccgaagaacaucuggagccacagcgggauauucagcucgcucgaucacgccagcguccggagggguuacgaagucuacaaacaaguaugcgcugcaugccacuccaugcguuucguggccuaccgcaaucuaauaggcguuacgcacaccgaggccgaagccaaagccgaagccgaagaccagaugaucgaagauggccccaacgaugagggcaacauguucaaacgccccgggaaauuauccgauuacuuccccagcccuuaccccaacgaggaggcggccagggcugccaacaacggggccuacccgcccgauuugagcuacauuacgucugcuagacacggaggugaggauuacauuuuugcgcuguugacugguuacugcgaggccccggccggcgugauuguuagagaagggcaguacuacaauccguacuuccccgguggggcuauuucgauggcucaggcuuuguacaaugaaacgaucgaguacgaugaugguacuccggcuacggcuagucaauuggcuaaggaugugucgacguuuu

SEQ ID NO: 4410 - RNA, 715 nt, Phyllotreta cruciferae
cuccugcugaauauucgucaaaaagcaagcucgcgguuugcgcagcaccagaaguccuucccacaggacuagaggaggaccaaaugcacaucgauguagacacaaaagagcuagcguuuaaccccaaguucgauguccuguucgcaccugcccuagguccugcuaauccuuuuaaaacgcaacaacaguugguugaacgaaacaugcucucaggccacaucgagagagcccacgucagcgaauuccaauucgaaaaccaaaggaggacuuucaccaguuacgguuacgcuuuggacccgucuguaaccaaugacgggaaaaucaaagugguaggaucuucggaagccgaugauaguagcaucaagacuguauucgaagccucuaaaacgaggccuuuggauaaacgaaaaaggaagaagaaugaugaccccagcgauguugaagguuucuuaggcccuuggggugguuucguagacgagcaaaaaguuuccaaaccuaccgaggaagaacaaaucgaauuggaugagauauccuccaagaagaauaaaaaggguaaacccaacgaagauaaaccccucgaagaaaaaucagucuugcacaucaaagacgccguggauuaccaagggcgcucauuccuccaugcgccacaagaugucggggucaaucucagaucggacaccccuccggaaaaauguuuccugccaaaagcucauau

SEQ ID NO: 4411 - RNA, 454 nt, Phyllotreta cruciferae
caaccccuuauucgaaaagcggcccaggaauuucggaauaggccaagacauccaacccccgagggaucuauccagguucguaaaguggcccaaauacauccgcauccagcggcagaaggccgucuuacagaagcgcuugaaagugccgccgccaaucaaccaauucucccaaaccaucgacaaacaaacggccacccaauuauucaaaguuuuggagaaauaccggccggagaccgccuugcagaaaaagaaccgacugaaggccaaggccgaggccaagguggccaaaaaggaagaggcccccgccaagagaccuaauacuuuaagagcugguacuaacacuguuaccaaauuagucgagcagaagaaagcccaauugguggucaucgcacaugauguagacccuaucgaauugguacuauuccuucccgcccuguguaggaaaaugggaguc

SEQ ID NO: 4412 - RNA, 659 nt, Phyllotreta cruciferae
gauccucacauacuccacacuuuaagcgccguucaaauacuuugcauguacgauaacuuaaaagcuauagacguagaaggcguugugaaguauguaaaaaaccuacaacuacccgacgguagcuucacaggagacaaauggggcgaaguagacaccagguucucauucugcgccgucgcgacgcucucgcuuuuagacagaauggacgccaucgacgugaauaaagcaguagacuuuguagcuucuuguaaaaacuucgauggugguuucggcucgaggccccucuccgagagccacgccggguuaauauacugcugcuuaggauuccugucuguuaccaaucgauuggauauuguggaucgagauaugcuggcuugguggcucugcgaaaggcaauuaccuucgggcgguuugaaugggcguccggagaagcugccugauguuugcuacuccuggugggugcugucuucuuuaacuauauuaggaaaacugcauuguauagacgccaaugcguugaagaaauucauacuagcaugccaggauaccgagagcgggggcuucgcugauaggccuggggacauuccagauccuuuccacacaguguuuggaauaucagcgcugucuuuacucggaaacgacacgguccagaaaguuaaucc

SEQ ID NO: 4413 - RNA, 732 nt, Phyllotreta cruciferae
gccgguuuacaacugaaaaaccagcucacuucgaaagacccgaccaucaaagucggcuaccaacagcgcuggcugcucuucgccgaagaagucagagacuacaucaagaagaacgugguuggcgcccucgggaccgagaccaacaggccgucgucggccgcccaaugcgucgccuacauagcagugaccgaauuaccgcaaggacaauggccggaucucauaucgacgcuggugagcaacauuugccaggggaacuccacggaaaugcagaaggaggccacgcucgaagccaucgguuacaucugccaggaaaucgaauccgauguguuagucuuacaaucuaacgauauacuaacagccaucgugcacggcaugagauccuccgagcccagcaaucacguucgauuagccgccacgcaggcuuuacuaaacucauuggaauucacuaaagcuaacuucgauuugaccaccgaaagaaauuacauuauggagguuguuugcgaagccacgcagucgccggugucgcaaaucaaaguggccgcuuugcaaugucuagugaaaauaaugucgcuguauuaucaacacauggagcccuacauggcgcccgcucuguuucccauaacguuagaggccaugaaguccgagaacgaugccguagcccugcaggguauagaauuuuggucgaacguaagcgacgaagaaguggauuuguccaucgaagauacugaagca

SEQ ID NO: 4414 - RNA, 677 nt, Phyllotreta cruciferae
ccaccgaaagacuaaucgauuuguacgaagacaaagacggccaacgcaaggccgagguggccgcccugacgggccccaacgaauucaacgaguucuacagcagacugaaacaaaucaaagacuucuacagaaggcaccccaacgagaucagcguaccgauguccguggaguucgacgaauucgccaaagcuagagagaaccccaacgaagauauggccaauuucguggaauucaccgacgaagaaggcuacgggaaguaccuagauuugcacgagugcuacgagaaguacauaaacuuaaaaggcaucgagaaagucgauuauaucacauauuuggcaauguucgaucagcuguacgauauaccgaaagaacgcaagaccggcgaguaccgcaaauaccugcuguaccucaucgaguaccucacgugguucgugcagcgcaucaggccgcugauggaccucgauggcgauuugcuagagcaggccgagcaggcugcggccggaugggagaacggaucggugcccggguggccgaaagaaaccggcucggcuuuggcgaacgugggcgcucauuuggaccuaucggcuuucuccaguugggaggaauuggcuucguugggccucgaucgauugaaauccgcucuuauggcguugggauugaaaugcggaggaacuuua

SEQ ID NO: 4415 - RNA, 507 nt, Phyllotreta cruciferae
uaucggcaccuuuaaagcuuucgacaaacauaugaacaugauacucggcgauugcgaagaauuccgcaaaauuaaacccaaaaacucaaaagucgaacgagaagagaagcggguauuaggauuuguacugcugagaggcgagagcauagucucacuaacuguggaagggccuccaccaccagaagagggacuucccaggguaccuauccccggagcagcccaagggccagguauaggaagagcagcagguaggggaaugccucccgguauggcugguguaccaguuggucuccaagguccugugagaggagucggaggaccgucucagcaaguaaugacuccuacggguagaggacagguuucagcgccgccacaaaugaaccaagcaccuccaaggauggguggcccuccgccugguaugaugggaccuccgccgggaaugaugggcaugccgccgcaaaugggaauggggcgcggaggaccgccuccgauggguaugaggggucc

SEQ ID NO: 4416 - RNA, 664 nt, Phyllotreta cruciferae
acuuguuuggccauauggaauguuauucaaccucaagaaauuccauuuccuacgaaggagcugugguuagagaaguccaaggaauuuuaugagauuacacaguuucccaauuguauuggaaguaucgacgggaaacauaucaggauaauuugucccccuaacucuggcucagaguauuucaauuacaagaaauacuucucgauuguccuuuuggcgguugcugacgcaaauuauuacuucacagcugucgauauuggaucuuuuggacgcgaaggagacucuacgaucuucaaaaagucaaauuuuggacuaagacucaaaaauaacgaacuagaccugccugcagauaauccccuaccaguaccugacaauguggagcaagguuccgagguacccuauguuuugcucggggaugaggcuuuuggguugucaaagcaugugaugcggccauacccguccaagggauuaucgcaagaaaagaggaucuacaacuacagacacugccgagcucggcgugucguagaaugcucuuucggaauucucucuaacaaauggcgugugcuacauucuucuauguuaauacauccugaauuugcugucaucguagugcaggcuuguuguguuuugcauaguuuugugcgaagaggagauggcuaccuuuuug

SEQ ID NO: 4417 - RNA, 737 nt, Phyllotreta cruciferae; identical to SEQ ID NO: 4394

SEQ ID NO: 4418 - RNA, 727 nt, Phyllotreta striolata
uugaugaagaaagaggcgaaggaaagaaggcgaaaagagaaaaugggcugggacaacgaauacuuacauuacacgaacagcgacaauccauucggagauggaaauuuacugaccacauucguuuggaacaaaaaauuguccaaagaaggcaucaaaaacgucggucacgcagaaaucgaagcaauaaaccgguuaaaacaagaggagaauaagagggaacucgaaaaagucaagaaacguaggcuagagagggaauuggagaggcaaaaaagagaggaagaaacccaaaugaugcaaagaaguaaagaagcugcccaauucgaggaaugggaaaggcaagaagauaaauuccacuuggagcaggcccgacugagaucucacaucagaauucaagauggucgagccaagccgaucgaucuacuagcaaaguacauaagcgcagaagaagaagucgaugccgucgaaaugcacgagccuuacacuuaccucaacggcuugcaaaucaaagaccuagaagaccuagucgaagacaucaaagucuacaaggaacuagaaagaggaaagaaccuagauuacuggaacgacauaacagucauaguagaagacgagcuucaaaaguugagaaaaauugaaaaacaaaacgauuucgacuugggauugaaccgaagagaagggauacaucaaucuguugccacugauguaacaucaguguuuaaaggcaaaacgg

SEQ ID NO: 4419 - RNA, 711 nt, Phyllotreta striolata
cgaagagaaacugaaggacauuuucggggaaguggggcaagugcugucguucaaacuggucuucgaccgugaaacgggcaaacccaaaggcuacggcuucugcgaguaccgagaccaggaaaccgccuugagcgccaugaggaaccuaaacggauacgaaauuggcgggcggaauuuacgcguggacaacgccuguacggagaagucucgaauggagaugcagaauuugcucaaucagccgcccgucgagaaucccuacggggagcccauccaggcggagaaggcuccggaggcgaucagcaaagcgguggcuucgcugccuccggagcagauguucgagcugaugagacagaugaagaguaccauacagaauaacccaaccgaagcgagacagaugcuuuugcaaaauccccaauuggccuacgcccuucuacaagcccaagucgucaugaaaaucaucgauccucauacggcagccaguuuacugcaccccgucaaucaaguaccggccacuuugcuggcgggcgauaagaacguaggccugcaaguacccaucgggaaccaauacagggagcccccgggacccgugcaggcccccaggcaggaguaccaacccguaccgcccccgacugcagucguacauccgggucacgugcaacaacagccaguuuuuaccggucaagacgucgauuugagaucaaugggaaacgu

SEQ ID NO: 4420 - RNA, 753 nt, Phyllotreta striolata
aguggaauccaggcuaaaagaaaugcgagaacagcucaaagauuuaacuaagcaguacgauaagucagaaaaugauuugaaagcccugcagaguauggggcaaauuguaggugaaguuuugaagcaacugacagaagagaaauucaucguaaaggcaacaaacgguccucguuauguaguuggcugccgucgucaguuggauaaggccaaauuaaaggccggcacuagaguagcucucgacaugaccaccuuaaccauaaugcgguauuuaccgagagaagucgacccguuaguuuacaacaugagccacgaagauccaggagacgucacuuacuccgccauaggaggacuuuccgagcagauuagggaguugcgagaagucauugaacugccucucaugaaccccgaauuguuuaugcgagugggcauuacacccccgaaagguugucuguuguacgggccgccugguaccgguaaaacucuguuagcuagagcuguggcaucucaacuggacgcgaacuuuuuaaaagucguaucgagugcuauuguagacaaauacaucggcgaaucggccaggcuuauuagagaaauguucaacuacgccaaagaccaucaaccgugcaucaucuucauggaugaaaucgacgcuaucgguggucguagguucuccgaagguacaucggccgauagagaaauccaaaggacgcuuauggaguugcugaaucaaauggacggauucgauucguuaggaca

SEQ ID NO: 4421 - RNA, 657 nt, Phyllotreta striolata
auuguaccaagucgaguacgccauggaggccauaucccaugccggaacguguuuaggcauccuggcuaacgacggaauccuucuugccgccgaaagacggaacaccaacaaguugcuggacgaaguuuucauuucggagaaaauauacaaacuaaacgaggauaugguuugcagcguggcgggaauuacgucggacgcuaauguucuaacuaacgaauugcguuugaucgggcaaagguauuuguaucaguacggagagucgaucccaugcgagcaguugguuucgugguugugugauguuaagcaagcuuauacucaauacggagguaagaggccauucgguguaucgaucuuguacaugggcugggacaagcauuacgguuaucaauuguaccaguccgauccgaguggaaauuauuccgguuggaaagcgacuugcauaggaaauaacaguuccgcugcuauuucgaguuugaagcaggaauacaaagaaggcgauaugaccuuaaaagaugcgaaagguuuggcugugaaaguucuggcgaaaacuuuggauauggcuaaauugacgucggaaaaaguggaaauggcuacacugacgcguagaaacgauaaaaccaucauaaauauauuaaauagcaaagaaguggaagaacu

SEQ ID NO: 4422 - RNA, 736 nt, Phyllotreta striolata
uacuucacauuugcuccgaacauuacgauggcagugacagcacagacaagagcucuaaagauaaggacaaaaaagacgccgcggagaaggagaaagaccuuuccucgagacaagcaguggccguacucgguauagcuuugaucaguaugggcgaagauauugguagcgaaauggccuuccgcaccuucgggcauuuguugcgcuacugcgaaccagugauuagaagagcaguaccguuagcuuuaggacuuauuucaguaucgaauccuaaauugagcauccucgauacuuugaguaaauucucgcacgacagugacgcggaaguagcccacaaugccauauuugccauggguuuaguuggagcggguacgaauaacgcaagauuggccgcgaugcugaggcaauuggcgcaguaucacgcuaaagauccgaacaaccuguuuaugguucgcauugcucagggucuaacacauuuagguaaaggaacguugacguugaguccuuaucacagcgaccgucaacucaugaguccuguagcaguugcaggauuaauggcuacacucguuggguuuuuggauguuaaaaauauuauuuugggaagaucgcauuaucuccuauacacuuuagcagcggcuaugcaaccuaggaugcuugugacauucgaugaagauuugaauccauugccgguaccugugagagugggauuggcuguugauguaguuggucaagcugguaa

SEQ ID NO: 4423 - RNA, 750 nt, Phyllotreta striolata
uuccuaauccgagcuuuacgcaggacauuaguuacgugaacauagaaggaacuguugugcccguuacaauaucggaaauggaacauccuggggacuaugccaaucuacaaacugcucaauacaacaacggcuauacggauggcacacaauauuuaaccaaucaucaguaccagaacauguauauagagagaaguacuguugauaauucuccuucugcuacaguucuauaccguggcgaugauccgaauuugggagcuucuagauuccaagcaaauuacgacauauccaguacucaaucgcaagugaaccuucuucccgcuuccggagaaaccuacuauacaucaacaucuaacuggacgccgaccagcagcgguucuuacccacaacaauauccaucagggaccauaaacguccuucaagcugauucgacccaagcuuucggaacuccuuacauaaacgcgaccuggucgucgaauucgauggaggacggacggcaaucuagucaagagacuggaaauagaagaaacggcguaacgugugcaaauugcaaaacuaacaacacaacacuuuggagaagaaacaaccaaggcgagccaguuuguaacgcuugcgggcuuuacuauaaauuacauaauguuaacaggccgaucaguaugaaaaaggaagguauccaaacgcgcaaaagaaggccaaaaaacucuucggucggaagcccugcgagugcugcaggucaaguaagaauggggcuuc

SEQ ID NO: 4424 - RNA, 762 nt, Phyllotreta striolata
gccuucuaguccaaauccaaauguugauacagacguuacuauagacauuccaacagacgacaguaugaagaauucagaaacuucuaauuuagaugauaguggggagaaagaaacggacgaaccuuuucaagacuaugucaaucaaagggguauucgguuuacgccucaauuccaacaggaaaccaaucuaucuccuuacgguuuagccugcguacgcgaacuauucagauuccuaaucagucucuguaauccuuuggacaagcaaaacacggacgucaugauacauuuaggacucgguuugcucacaguagcguucgaaauuagugcagacaacauaggcaaauacagcacccuguuggcucuagucgaagacgauuuaugcaggaaucuauucgcuuuaaugaacaccgaucgucugacgauauucgcagcgaacuugcaagugucguuucugcuguucgaaucgcuacgcgcccacuugaaguaccaauuggaaugcuacuugaagaaacucauggagaucaugcgcagcgaaucgaacaaagugagcuacgagcacaaggagaucgccuuggacaaucuguugcaauuguggcgggugcccggcuuccacgccgagcucuacgugaacuaugauugcgacauguauugcgcgaauuuguacgaagagcucaccgagcuacuggccgaacgaucaauuuccaccgucgugggaguguaccaccagcauuugcugucgcucgacgggcuucugaucauaau

SEQ ID NO: 4425 - RNA, 532 nt, Phyllotreta striolata
uagcaaugaaaggcgaaaacugcgucgcgauagccgccgaccgccgguucggcauccaagcccaaaccgucgccacgaacuucgagaaggucuucgaaaugggcccccaccuguucgucggccugcccggccuggccaccgacacgcaaaccgucauggagaagcuccgguuccgcaagaaccucuacgagcugaaggagaaccggcgcaucucgcccaagguguucgccgccaugauaucuaacaugcuguacgagaagagguucgggccguucuucguggaacccgugguggccggucuggcgcccgauacguucgaaccuuacauuugcaacauggauuugaucgguugccuuaacgaacccagcgauuucguuguaggggguaccgcuucggcgcaauuguauggaaugugcgaauccuuaugggagccuaauuuagcacccgaugaucuguucgaaaccauuucgcaggcucuaauaaacgccuucgauagggacgcuauauccgguuggggagcuacgguuuauau

SEQ ID NO: 4426 - RNA, 740 nt, Phyllotreta striolata
ggauaucagucggagcaauuggaccgagucaauuaagcgaggaucggguggugguugacauggcguucgacguguugaaaacggacauaaggccagaugaaaaagaaagcguaacaggccaacuucacgaagccgccacggauuguauuugcaccuuacuguuacgucucgaggauaauaacaaccacgucgcauuggaaacgcacuuauucgaaaauauaguaaauuuagaaguggccuaucaugcaucugucgcccucgaagaucaagcaaagucgacggacuauugucggcuauucaccgaauuggcggaaucauuuuuggggaagauuguagacgauggaggaggcgguggcggcggcgacggcggcggcggagccaagaggcguaccguguacgccguuaaaugucuagauuugguacugaugugcgucggccaucaugauuacgagguggccgaaauaacauuuaaccuuuggcauaugcuaagugaggaauuauaucagaaaaauaauaaggaauuaacugaauuauucaaaccauacguggaaagauugaucacggcccuauguaggcauugccagauggagccagacauggagggucuacucgaaaaaggagaugaauuuaaagauuuuaggaugaaagucucugaucuaauaaaggacguggucuuuauaguagguagcagcaguugcuucaggcaaauguucaucaauuuacaaaccucagguguuacg

SEQ ID NO: 4427 - RNA, 722 nt, Phyllotreta striolata
aagacucuaaaaacgaccccaacaagguaaagcgaaaauucuccucguucuucaagucccuggucaucgagcucgacaaagagcucuacggccccgacaaucaccuagucgaauggcaccgaacccucaccacccaagagaccgacggcuuccaagugaaacggcccggcgacaagaacgugcgcugcaccauucuguugcuccucgacuaccagccguugcaguucaagcucgacccgaggcuggcccgauugcucggcguccacacgcaaaccagaccggugaucauauccgcccuguggcaguacaucaagacgcaccggcugcaggacggccacgagcgcgaguacaucaucugcgacaaguauuuggagcagaucuucaacuguacucgcaugaaguucgccgagaucccgcaacgguugaauccccugcugcauccgcccgauccgaucgucauaaaccacguuauauccgucgaaggcggcgccgagagcaagcaaacggcuugcuacgauauagauguugagguugacgauacgcugaagacucaaaugaauaauuuccuguugaguacggccagucagcaggaaauucagggauuggacgcgaagauucacgagacuguugauacuauaaaucagcugaagacuaacagggaguuuuuccugaguuuugcuaaggauccucagcaguuuauacacaaauggaucgugucucaa

SEQ ID NO: 4428 - RNA, 286 nt, Phyllotreta striolata
caacauuggacgaauuagaacaaaaaaugcgagaagccgagaccgaaucccacgaaggaaaacgaaaaaaugaaucauuguggcccauauucaaaauucaccaucaaaaaucucgauacaucuucgacuuauuuuaccgaagaaaggcgauuagccgagaauuguacgaguauugcuuacuggaaaacaucgccgacaagaauuuaauugcaaaguggaagaaacagggcuacgaaagccuuuguugccugagaugcauccaagccagagacaccaauuucggaac

SEQ ID NO: 4429 - RNA, 760 nt, Phyllotreta striolata
ggcucacaauuuggaagaugaauuccgaacuauaagacaaauagugcagaaauaccaauaugucgcaauggacacugaauuucccggcgucguggcccgacccauaggagaauuucgaagcuccgccgauuaucaauaccaaauguugaggugcaacguagacuuacugagaauuauccaacuagguuuaacguucuuagacgauaauggcaaaacaccaggaggaguuuacacuaccuggcaguucaauuuuaaauucaaccuucaagaagacauguacgcacaagauagcaucgauuuacugcaaaauuccgggauacaauucaagaagcacgaagacgaagguaucgaaccguuagaauuugccgaacuacuaauguccuccgggaucguucuaauggaaaauaucaaauggcugucguuucauuccggcuacgauuuuggcuauuuaauaaaguuacucaccgacaacaaucuaccgcaagaugaaaaugaauuuuucgaucugcugaaauuguauuuucccaccauauacgacguaaaguauuuaaugaaaucguguaaaaauuuaaaagguggccuucaagaaguugcggaacaguuagaauuggagaggaucgggccccaacaucaagccggauccgacucgcuguugaccggaauggccuuuuucaaaaugaaagaaauguuuuuugaggauacuauugacgauucgaaguucucaggccaucuuuacgggcucggaacaucuuucacuguu

SEQ ID NO: 4430 - RNA, 681 nt, Phyllotreta striolata
cuguguuuauccccuacgagagaauuggcuguacaaauucagaaaguuauauuagcucuaggugauuucaugaauguacaaugucacgcuuguaucggggguacaaaucuuggagaagacaucaggaaguuagauuacggacagcacguuguuagugguacaccuggaaggguuuacgauaugauucguagaagagcuuugagaacuagauccgugaaaaugcuaguacuagaugaagccgacgaaaugcuaaacaaaggcuucaaagaacaaaucuacgauguguacagauuucuucccccauccacucaagugguguuaauaucugcuacauuaccacacgaaauccuggaaauaacauccaaauuuaugaccgaucccaucaggauuuuagucaaacgugaugaacugacgcuggagggaaucaaacaguuuuucgucgccguggagagggaagaauggaaauucgacacucuaugugaccuguacgacaccuuaaccaucacgcaagccguaauuuucugcaacaccaaaagaaaggucgauugguugaccgaaaagaugcgagaaaacaacuucaccgugagcucaaugcacggagacaugccucagaaagagcgcgacaacauuaugaaggaauuccggucgggccaaagcagaguuuugaucacuaccgacguu

SEQ ID NO: 4431 - RNA, 794 nt, Phyllotreta striolata
caacagucgagucucuuagggccuuuggcaguugaugcuguucuuaaaauugucgaaccaggacaggaacaagcguguaacuugguagaugugaaaguuauuaagcaauugggcgguaccguggaagauaccgaguugauugaggguaucguuuucucucagagauccgccaauguaucugguccgaagagaaucgaaaaagccaagauugguuuuauacaauucugcauuucuccuccgaaaaccgacauggaccacaauguuaucguauccgauuacgcugcgauggaucgaguguugaaggaggaaagagcguacauuuugaacauuguuaaacagauuaagaaagccggcuguaacguacuuuugguucagaaaucgauucucagagaugccguauccgauuuggcccuucacuuuuuggauaaaauaaagugcaugguuauuaaggaugucgaacgagaagacguggaguuugugugcaaaucguuggcuugcagaccgaucgcuucucucgaucacuucaccgcugagaauuuaguaacugcagauuuagucgaagaaguuggacuaggcgguaaccgaauggugaaagucacagguauucaaaauggcggacgcacggugacccuacuagugagaggcucgaauaaauuaguauuagaggaggcggaacggucucugcaugaugcucugugcgucauccguugucucguucguaagaaggcgcucaucgccggcgguggagcaccggaaaucgagguggcucuuaaacuggcugcuauggcuaauaa

SEQ ID NO: 4432 - RNA, 724 nt, Phyllotreta striolata
agggaauuacugaaaccguccgcuagcguagcccuacacaagcacagcaaugcuuugguggacgugcuaccgcccgaagcggacuccuccauuagcaugcuacaagccgaugagaaaccggacguacaauacagcgauaucggagguauggauaugcaaaagcaggagauucgagaggccguagaacuuccguugacccacuuugagcuguacaaacaaaucgguauagacccuccgagaggugugcugauguacggcccgcccgguugcgguaaaaccaugcucgcaaaagccguagcucaucacaccacagcggcuuucauucgaguggucgguucggaguucgugcaaaaauaccugggcgaggggcccaggauggugcgagacguguuccgccuggccaaggagaauuccccagccaucaucuucaucgacgagaucgacgccaucgcgacgaagcguuucgacgcccaaacgggcgccgaucgcgaggugcagaggauccuguuggagcuguugaaccagauggacggguucgaucagaccaccaacgugaaggugaucauggcgacgaaucgggcggauacguuggauccggcuuugcugcgacccggucguuuggauaggaagaucgaauuuccguugcccgauaggaggcagaagcgguugauauucagcacuaucacguccaaaaugaaucugucugaagagguugauuuggagg

SEQ ID NO: 4433 - RNA, 365 nt, Phyllotreta striolata
cggugaccauaaaaaccaugcuggaggaccugggcauggacgaggaagaggaggaggucgugcccuugcccaacguaaacucagcuauccuacggaaggucauccaaugggccacauaccacaaagacgacccgcccccgcccgaagacgacgacaacaaggagaagagaaccgacgacauauccucgugggacgcggacuuucucaaagucgaccaaggcacucuguucgaacugauccuagccgcgaacuaucucgauaucaaaggccugcucgacgucacuugcaagaccguggccaacaugauaaagggcaaagcgccggaggaaauacggaaaacguuuaacaucaagaacgauuucacg

SEQ ID NO: 4434 - RNA, 705 nt, Phyllotreta striolata
ugugugauaaggcgaaagaaauacuguccaaagaaucaaaugugcaggagguaaaauguccugucaccguuugcggagauguacacggacaguuucacgaucugauggaauuauuuaggauagguggucgaaguccagauacgaauuaccuuuuuaugggugacuaugucgaucguggguauuauuccgucgagacuguuacucuuuugguggcuuugaaagucagguauaaagaaagaauuacgauccugagaggaaaccaugaaucgagacaaaucacucaaguauauggauucuacgacgagugccugcgaaaauacgggaacgcgaacguuuggaaauucuucaccgauuuguuugauuacuugccgcuuacagcgcucgucgauagccagauauucuguuugcacggagggcucagucccagcauugauacuuuggaccauauuagagccuuggaucguuuacaagagguaccucacgaagguccgaugugcgaucuucucuggucggaucccgacgaucgcggagguuggggcauuucuccucgcggugcggguuauaccuuuggacaagauauaucggaaacguucaaccacagcaacggcuugacauuggucucucgggcccaucaacucgucauggagggguacaauuggugccaugacagaaacguuguaacgaucuucagugcuccaaacuacu

SEQ ID NO: 4435 - RNA, 510 nt, Phyllotreta striolata
agcuaaaauccaggacaaggaagguaucccaccagaccaacaacguuugaucuucgcuggaaagcaacuagaagauggucguacucuuucugauuacaacauacagaaagaauccacccuucacuugguacuuagacuucguggugguaugcaaaucuucguuaaaacauuaacuggaaaaacuaucacucuugaaguugaaccaucugauaccauugaaaaugucaaggcuaaaauccaggacaaggagggaauucccccagaccaacaaagauugaucuucgccggaaaacaacuggaagauggucgcacucuuucugauuacaacauccagaaagaaucuacucuucacuugguuuugagacuucgugguggaaugcagaucuuuguaaaaacuuuaacuggaaagaccaucaccuuggaagucgagccauccgacaccauugagaauguaaaagcuaaaauccaggacaaggaagguaucccaccagaccagcagagauugaucuu

SEQ ID NO: 4436 - RNA, 748 nt, Phyllotreta striolata
gaagcaacugaaguccuacaucgaagaaggcgugcauccgaggaucaucaucaaagccgugcggaaggcgacccagauuugccuggagaaaaucaacgcccucgccguuaaaaucaacaaagccaaccccgaggaguacaggucguugcuggagaaaugcgccgcgacggcgaugagcucgaaguugaucaacaaacagaaaucguucuucuccaaaaugguggucgaugccgugcuacugcucgacgaacuccugccguugaacaugaucggcaucaagaaggugcaaggcggcggucuggaggacuccauguuagucgccggaguggccuucaagaagaccuucucguacgccggguucgagaugcagcccaagauuuacaaagacugcaagaucgcccuguugaauauagaauuggaacugaaagcggagagagacaacgccgagauccgccugagcagcgucaaggaguaccaaaaagucgucgaugcggaguggaacauuuuguacaacaaacuccagaaaauuuacgaauccggagcgaacguuguucuaucgaaauuacccauuggugacgucgccacgcaauacuucgccgacagagacauguucugcgccggaaggguccaagaggaagacaugaagagaaccuugaaagccugcgguggcuccauaaugaccacagucaacgauuugaaagacgaagugcuagguaacugccagcuguucgaagagaagcaaauugga

SEQ ID NO: 4437 - RNA, 672 nt, Phyllotreta striolata
gucgcugaagauaucccauugcuguucagcuuguugaacgacguguuucccaacgugcaauacaccagagccgaaauggaaggucuuaaggacgaaauuagaaaagugugcacggaagaauaccucguuugcggagaaggcgaugaaagagguucggcuuggauggaaaaaguauuacaauuauaccaaauuucgaaccucaaccacggucuaaugauggucggcccgagugguucgggcaagaguucagcauggcgaguucugcuuaaagcccucgaacgauucgaagggauagaaggcguagcccauguaaucgauccgaaagcgaucagcaaagagacuuuauacgguguguuggaucccaauaccagagaauggaccgauggucuguucacccauauucuaagaaaaauuauagacaacgugagaggugaaauuaacaaacgccaauggauuaucuucgacggugacgucgauccagaauggguggaaaacuugaacucuguucucgacgauaacaaauuguugacucuucccaacggagaacgucuaucccuaccgccuaacauuagagucauguuugagguacaagaucuaaaauaugccacguuagcuacagugucgcguugugguauggugugguucucugaagacguacuauccaccgaaaug

SEQ ID NO: 4438 - RNA, 662 nt, Phyllotreta striolata
caaguuuucggaguucuucgacgacgcgccgguguaccaaaucccgggccggagguuucccguggauauuuacuacacgaaagcccccgaagccgauuacguggacgccugcgucgugucgauacugcaaauucacgucacccagccguugggcgacauuuugguguuccugacgggucaggacgaaaucgaaaccugccacgagcuccugcaggaucgcguacgacgauuggguucgaaagucaaagaacugauuauacucccguuguacgcuaacuuaccgagugauaugcaagcuaagauauucgagccgaccccgccgggagcgaggaaggugauucuagcuacaaacaucgcggagaccucgcuaacgaucgauaauauuaucuacguuaucgauccggguuucgccaagcagaaccacuucaauuccagaaccggcauggagagucugauggucgugccuauaucuaaagcuucggcuaaccagcgagcuggaagggccgguagaguggcggccgguaagugcuuuaggcuguacacggccugguccuauaagcacgaguuagaggaauguaccguucccgagauacagaggaucaauuugggaaacgcuguguugauguugaaggcguuggguauuaacgauuuggugcauuucg

SEQ ID NO: 4439 - RNA, 687 nt, Phyllotreta striolata
gcgagcuauuggucuuagaauuagagaaacaaaggaagucuacgaaggagaaguuagcgaacugacacccgucgaaacagaaaacccagcaggagguuaugguaaaacuguuagccauguuguaaucgguuugcgaacagccaagggcagcaagcaauugaaacuagaucccagcauauacgaagcccugcaaaaggagaagguggaagugggagaugucauuuacauugaagcuacaaguggagcuguuaaaagacagggaagguccgaugcuuaugccacggaauucgauuuggaagccgaggaauauguaccucuuccgaagggagaugugcacaagaagaaggaaguuguacaggacguuacuuugcacgauuuggaugcugcuaaugcgaaaccgcaggguggucaagacguguuauccaugauggggcaacuguugaaaccaaagaaaacugaaauuacggauaaacucaggaaagaaaucaauaaaaucguugacaaauacauugaucaagguaucgcggaauugguaccuggaguuuuauucaucgacgaaguucauauguuggauauagaaacauucacuuaucuccacagagcuuuggaaagcgcuauagcaccuauuguuauuuuugcuacuaauagaggucguugucucauuagaggaaccgaugauguguuuuc

SEQ ID NO: 4440 - RNA, 779 nt, Phyllotreta striolata
agggcgagagaugaaaaauuaaugacaaauauucuccagacuuuacgaaaccacgggaacguucugauagcuguagacacugcugguagagugcuggaauuggcucacauguuagaucaacuguggagaaacaaggaaucaggacuuuuggcuuauucauuggcuuuuuugaacaaugucaguuauaauguagucgaauuugccaagucacaaauagaauggaugagcgauaaucuaaugagaaguuuugaaggagccagaaauaauccauuccaguucaaauauuugcagcuaugccacaguuugggggaacuaagcaaaguacccaguccgaaaguggugcuggccaguucgccagauuuggagaguggauuuucaagggaauuguucuugcagugguguucuaauccaaauaacaguauuauauuaacuacaaggaccucaccuggaacuuuagccagggauuuaauugacaacggaggaggaagaaacauagacuugauaguagagcgaaggguuaaauuagaaggagcagaacuugaugauuaugaaaggcgucaacgaucuaaauaugacaaauuagaagaugaggaggccgauucugauucagauuccgauauugaaaugucagucaccucuaaaggcaaacaugacauuguuaucaaacaagaaggcaaaauaucaacaggauuuuuuaaagucaccaaaaagauguaccccauguauccuuucaaggaagauaaaauaaaguccgaugaauacggcgaaauuguaaaagc

SEQ ID NO: 4441 - RNA, 667 nt, Phyllotreta striolata
cuuggaggagcagauacaucagauacauaaagugaaaggucuccuucccgacgaagagaaggagaagaucgguccgaagaauaucgguucgaagaagauuaacauccaaagcguuaucacuacgaaaccgccgaaucccucuacgcagcaauccaaacagucgauuucgaugaugcaaacgagcgcccagccgaucaugccgguuccggcgcaaccgacgaugauggcgccgcaaccguccauuaugaugaugccggccccuccgaugcccgccauacgaccgccgccgcucaugauggccggugguguggcgaugggcggcuauccggugggaccgaugcccggcgggccgccgggucccggcaugaacauggcccccaugaagcaucccagcgacgggcccagcgaggacgagccgagcaacaagaaauugagaaacgaggauucguuggugccggagaacguguuuuuguccagaaauccgagucaagugucuaucaaaauuucggugccucugaugccggagaaaucggaauggaggcugaagggccaaaugguaucguggacguuggcguugacggagucgguggugaaucugaaggccaaaauccaggaggaaacgaacaugccgccggccaaacagaaguuauucuucgacgggauguuc

SEQ ID NO: 4442 - RNA, 757 nt, Phyllotreta striolata
aaaggagucuuggaugugucuaacaguuuugcagucccuuuugaugaggacgacaaagauaaaucuguaugguucuuggaccacgacuacuuggaaaacauguacggcauguuuaagaaagucaacgcuagagaacgcgucguugguugguaccacacugguccuaaauugcaccaaaaugacaucgcuauuaacgaauuaauucgaagauacugcccuaauuccguguuggugauuaucgaugcgaaaccuaaagaucuggggcuuccuacugaagcguaccaagcggucgaagaaguccacgaugauggcucucccacguccaaaacauuugaacacguuccgagcgaaauaggcgcagaagaagccgaggaagucggcguagaacauuuauuaagagauaucaaagacacuacagugggcacuuuaucucagaggaucaccaaucaguuauuaggccugaaaggguugcauuugcaauugagagacauaagagacuauuugaugcaagugggcgauaccaaacugcccauuaaucaucagaucaucuaucaauugcaagacauuuucaauuugcugcccgauauaaaccaagaugcauucaacaauucguuuuauguuaaaaacaacgaucaaaugcuuguaguuuauuuagcagcucucguucgaucuaucgucgcauugcacaaucuaaucaacaacaaacucaccaacagagacgcagaagaaggcaaaaaggaagagaagaaggacaagg

SEQ ID NO: 4443 - RNA, 652 nt, Phyllotreta striolata
aauaucgcuuuagaugcgguaaauaccguucuauuagaagaaaauggccgaacugagguggauaucaagagauacgccaaaguggaaaagauucccggugguucgguggaggaaucgaggauuuugagaggagucauguugaacaaagacguuacccauccuaaaaugaagcgacacauuaagaauccgagaaucauccuuuuggacugcgcuuuggaauacaagaagggagaaucucaaaccaacguugaaauuaguaccgaaacugauuuuaccaaacuccucgaauuggaagaagagcacgugaagcgccaaugcgacgagaucaucgcccucaagccggacgucguguucaccgaaaagggaguauccgauauagcccagcacuuccugcugaaggccggcaucaccgccaucaggcgugugagaaaguccgacaacaaccgaaucgccagagcuugcggcgccgucaucgucaacagaaccgaggaacuccaagaguccgacgugggcaccggggcugguguguucgaaaucaaaaaauucggcgacgaguacuucuguuucgucgacgaaugcaaaaauccaaaggccuguacgauccuccugcgaggagccagcaaggauauccugaacgaaaucgaaaggaacc

SEQ ID NO: 4444 - RNA, 563 nt, Phyllotreta striolata
cagauuaauccguacgcugauaauggagggagcguaguagcaauugcaggaaaagauuucgugguuauuggugccgacacgcgucucaguuccggcuuuuccauuuacacuagaaaccagaacaagcuguuuccucuuucugagacaaccguuuuaggauguucgggcuguuggugcgauacuuuaacguugacucgcauuuuaaagucucgcaugcaaauguaccaucaagagcacaacaagaacaugucuacaacggcggcugcucaaaugcuuuccaccauguuguacuacaagcgauuuuucccuuauuacauaucgaacauucucguuggauuggauaacgagggaaaagguugcguguacagcuacgauccuguaggacauugcgaaaaagccacuuacagagcaggcgguucugcaggggcuuugcuucaacccuuauuggacaaucaaaucgggcagaagaaucuacagaagccuucacaagaagaucuuacucaggaaaaagcccuuucuacacugaaagauguuuucauauccgccgcagaaagggauauuua

SEQ ID NO: 4445 - RNA, 656 nt, Phyllotreta striolata
aaauguuacucaguggccauguuuccggggaacgaaagacaggacgucgaacguggaggaaaaauaaucaugccacccucugcacuggaacagcucacucgauuaaacaucaacuaccccauguuauuuaaacuagucaauaagaagacgagucgcacgacucauugcggcguguuggaauucguggcggacgaaggaaaggucuaccuuccguuauggaugaugcacaauuugguacuaaccgaaggcgauuugguucaaauggaaagcgucucguugccggugggcaccuuuuccaaauuccaaccguuaaacccggacuuccucgacauaaccaacccgaaggccgugcuggagaauugccugcgguccuuugcuugucugacgaccggcgacgugauagccgugcgauacaaucaaaaggcguacgaauugugcgugcuggaaacgaaacccggcaacgccaucaguauaaucgaaugcgauaugaacguggaauucgccgcucccgugggcuacaaggaacccgagcaugcgaagaaagaagaggaaaugucgguggaucccgccgacuugaugccggaaccgucgggauucguggcuuuuagaggggccgguaaccgauuggacgggaaaaaacgcaaagauucuucguc

SEQ ID NO: 4446 - RNA, 707 nt, Phyllotreta striolata
accacuuuaggcucgaaaauaauuaacaagugucacaggcaaauggccgaaaucgccgucaauggcguauuagcuguggcggaucuugaacaaaaggaugucaacuuugaacucauuaaaguagaaggaaagguuggugguaaauuggaagacacgacauuagugaaaggugucguuauagauaaaacaaugucucauccucaaaugccgaaggaacuuaagaauguuaaauuggcaauccucaccugcccguuugaaccucccaaacccaagaccaagcauaaguuggaugucaccagcguagaagacuacaaagaacuaagauuguacgaacaagaaaaauucaaggaaauuguuggcuuagucaaaaaagcuggagcuaccuuggccauuugccaauggggauucgacgaugaagcuaaccauuugcuguugcagcaggaguugccugcuauacgauggguuggugguccagaaauagagcugauagccaucgcaaccggaggaagaauaguuccacgauucgaggaacuuagcccugaaaaacucggcucugccgguuuggugcgcgagauaucguuuggaacuaccaaagauaagaugauggugauugaagaaugcucgaauucccgugccguuaccauucuugucagaggcgguaaucaaauguugguugaugaagcuaagaggaguuuacacgaugcuuu

SEQ ID NO: 4447 - RNA, 202 nt, Phyllotreta striolata
aaaaguggaaugcuguagcucuuugggcuugggauauuguuguugauaacugcgcuauaugucgaaaccacauaauggacuugugcauugagugccaggcaaaucaggccucugcaacuagugaggaaugcacuguagcuuggggaguaugcaaccacgcauuucacuuucacuguauuucaagaugguuaaaaacuaggca

SEQ ID NO: 4448 - RNA, 771 nt, Phyllotreta striolata
gccaacuuagaaacguucagagaagaucugaugaacaucgcccgaaccacauugagcucgaaaauucuaucucaacacaaagagcacuuugcgaagcucgcagucgacgccgugcugagauugaagggauccggcgauuugcaagccauucaacugaucaaaaaaaccggcgguacguugcaggauucguuccucgacgaaggauuccugcuggacaagaaacccggcgugcaccagcccaagcgagucgagaacgcuaaaauccugaucgccaacaccccgauggacacagauaaaaucaaaguguuuggcucgcacaucaaagucgacucgauggccaaaaucgccgaauuggaguccgccgagaaggauaaaaugaaagacaaagucaacaagauccucaagcacaacgccaacguguucaucaaccggcaacucaucuacaacuacccggaacaguuguucgccgaugccggcgugauggccauugaacacgccgauuucgauggcaucgaaagacuggcgcuggucaccggaggagaaauagucucgacguucgaucacccggagcucgucaaacugggaacuugcgacgugauugaacaaaugaugauaggagaagauacgcugcugcguuucagcggaguagcuuugggggaggcuugcacgauagucauucgaggggccacccagcagaucaucgacgaagcggaucgcucccugcacgacgcucuuugcguacuagccgcaacggugaaagaaagcagaauc

SEQ ID NO: 4449 - RNA, 668 nt, Phyllotreta striolata
ccagucacgccguuauaauagcguugaaaagggccucguccgaacuguccgccuaucagaagaagaucauccagaucgacgaucacaucggcaucaccaucuccgguuugacggcggacgcgagaauacugagcagauauaugaggaacgaauguuugaauuacaaguacucgauggauucguacaugccuuugaacaggcugaucaacaucuuaggcauaaaaaugcaacauugcacccaacgcuacgaccguagaccguucggcgucggucuacucgucgccggcuacgacgacgacaccggcgcccacgucuaccagaccugucccucggcgaauuucuacgauugcaaggccaugucgaucggcgcgcgaucgcaaagcgcccgaaccuacuuggagaaaaagcucgacgagcugcccuccauggcuuuggaggaucucaucaagcacggcuugagagcuuugagagauacucucccacccgaaguggauuugaccacgaaaaacguuucgaucgguuacgugggaaaagggacgagcuucaagauauuggaggaggaggagacggcgccguuuuuggcguugaucgaaggggaggaacguagaggggguagcggugguggugggggugcuguggagggggcggcugauccuuugagggaaucg

SEQ ID NO: 4450 - RNA, 687 nt, Phyllotreta striolata
uuaccggguucguacaaauugugguacaauuaccugcggaccaggaggaaucaaauuaaaagcaaaugcaucaccgauccggguuucgaagagguaaacaacgccuucgagcguucguugguguucaugcacaagaugccccgaauuuggauggauuauugcaccuuccucaccgaccaguguaaaauaacgagaacccgaaaggucuucgacagggcccuucgagccuuacccguuacgcagcacaacagaauauggccuuuguauuugaaguucguacagaaacacgauauauccgaaacugccguucgaguuuucagaagguacaugaaauuguguccggaaaacgccgaagaguacaucgauuacuuagcgucgguggaacgauuagacgaagccgcuauaaucacggcuaaaauaguaaacgacgauaacuucgugucgcaacagggcaaaucgaagcaccaacuuuggaacgagcucugcgaguugaucuccaaaaauccggaaaaaguccgcucgcuaaacgucgacgccaucaucagaggcggccugcgccgguacaccgaccaauugggccaccuguggaacuccuuggccaauuacuacguucgcagcgguuuauucgagcgggcuagggacaucuacgaagaggccauucaaaccguuacgaccgucagagauuuc

SEQ ID NO: 4451 - RNA, 773 nt, Phyllotreta striolata
uaagagucaacaaggcuuccgcucaccaaaagaacuuggacgucggcgcgaacauuuucauagggaacuuggauccagaagucgaugagaaacucuuguacgauacguuuucggccuucgguguaauauuacaaacgcccaagauaaugagagauccggagacuggaaauuccaaagguuucgcguucauaaacuucgccaguuucgaagccuccgaugccuccaucgaggcgaugaacggccaguaccuuugcaaucgaccgauauccgucucuuacgcguucaagaaggauuccaagggcgagagacacggcucggcggccgagcgauuauuggccgcccagaauccauuaucgcaggccgacaggccccaucaguuguucgcagacgccccaccgauaggaaugaugccgaugagcauggcgccgccaccuccgccucuaaucaccggcaugaugccucccccaccgccuacgccgggcggaaugccgccgccuccuccgccgguuccgccgccgaguuccuuccccgcgggcaucccgccgccgccguuaccgcccucucaaccgccgcugccgccgggcgcgccgcccgcgauggcgccggugccgggcggcgccgccagaccgccgccgccgccuccgugggccggugcggcggccaacgugccgaugccgccgggaccgccugcggcgaacgcgggcggcggcuucgggggaaugcugccgccuccgccgccgcccggcgggaggccuuuaccgccuaauuggaga

SEQ ID NO: 4452 - RNA, 664 nt, Phyllotreta striolata
cacacuaagaggaggaaaggggcacccaagcuccguuacuuagauuucuccgaaaggcauggguacaucaagggugucgugaaagacaucauccacgaccccggucguggcgcccccuuggcucuggugcacuucagggaccccuacaaguuccaaacuaggaaggaaauauucauugcucccgagggaauguacacagggcaauuuuuguacuguggaaagaaagcuaaccuccaaauuggaaauguguugccuguaggaacuaugcccgaagguacaaucgucuguaauuuggaagaaaaaacuggugaccguggccgauuggcucgagcuuccgguaacuacgccaccgugauugcccacaaucacgacacaaagaaaacuaggguuaaauugccaucgggagccaagaaaguuaucccgagcaacaacagagcuauggucgguaucguugccggagguggucguaucgacaagcccauccugaaggccggucgcgccuaccacaaguacaaggugaagcguaacugcuggccgaaggugcgugguguugccaugaaccccgucgagcauccucacggaggugguaaccaucaacacauugguaaggccuccaccguuaagagaggaacguccgcuggucguaaggucggucuuauugcug

SEQ ID NO: 4453 - RNA, 262 nt, Phyllotreta striolata
uaaacaacuggccaccaaagccgcgaggaaauccgccccaucgaccggaggugugaaaaaaccccaucguuaccgucccgguacagucgcccugagagaaaucaggagauaccagaaauccaccgaauugcucaucagaaaacugccuuuccaacgauuagucagagaaaucgcccaggacuucaagacagaucuccguuuccagucugcggcuaucggugcucuacaagaagcgagcgaagcauacuuggugggucuguuc

SEQ ID NO: 4454 - RNA, 775 nt, Phyllotreta striolata
caacaaggaaucguuaaccgacguuugucgaacgagcuuaagaacgaaacugcaccaaaauuuggcugacuuacugaccgacgugugcgucgaggccauccucgccaucaagcaaucggacaagccggucgauuugcacaugguggagcugauggagaugcagcacaagaccgaaaccgauacgcaacuggucaaagggcuggugcucgaccacggcgcccgccaucccgacaugcccaagagccugcggaacugcuacauucucaccugcaacgucagcauggaguacgagaagagcgaagucaauucgggcuucuucuacaaaaccgccgaggaaagggagaagcucgugcuggccgagcgcgauuucaucgagcagcgcgucaagaaggugaucgaauugaagaagacccuuugcaagggcaacgacaagucguuugucgugauaaaccagaaggguaucgaucccaugagcuuggacaugcuggccaaagagggcaucguggcccugcgaagggccaagaggcguaacauggaacgauuggcucuggccugcgguggaauagccgugaacaguuucgaugauuuacaagaaucucaucucgguuacgccgggcacguguacgagcacguauugggcgagaacaaauacacguucgucgaggacugcaaagugccccaaucggugacgauucuaaugaagggccccaacaagcacacucuguugcagaucaaagacgccgucagagacgguuuaagggcuaucaauaacgcc

SEQ ID NO: 4455 - RNA, 781 nt, Phyllotreta striolata
ucaaaaucaaaguguugggcccguacacguucagcaucggcgacaccaccaaauucuccaaguacguccgaggcgguaucguaacgcaagugaagaugcccaaggaggugcacuucaagccgcugaaggagucgcugcagaaucccgaauucguggugaccgauuucgccaaguucgaucaccccauccaauugcaccucgccuucuccacgcugcacaaguucguggagaagaccggccgguugccgaagcccuggaacaaggacgacgccgccgaguuuaucgccuuggcgaaauccuuggcggugaacgguuccaccgacaacgaggucaacaccgauauacucaacguuuucuccaaguguugcucgggcgauuugaaucccaucaacgccacgaucggaggcaucguggcgcaggaggucaugaaagccugcucggggaaguucuaucccaucuaccaaugguuguauuucgaugccaucgaaugccugccccaagacaaggacgagaucacagaggaacuggccgcucccguugauagucgauacgacggacagaucgcuguguucgguaaagauuuccagaagcgauuaggugaauugaaauauuucauugugggcgccggagcgaucgguugcgaauuauugaagaacuucgccaugaugggauugggaacgcaaggcggucaaaucaccguaaccgauauggauuugaucgaaaagucgaauuuaaacaggcaauuuuuauucagaccccacaacguucaacaacccaaauc

SEQ ID NO: 4456 - RNA, 660 nt, Phyllotreta striolata
cguuucagcaaguacauguccaacaucaaggucggcguguucuucgggggccugcccauccaaaaagacgaagaaguauuaaaaaacagcuguccgcacaucgucgucggaacgcccggccgcaucuuggcccucgucagaucgaagaaacucaaucucaagcacaucaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaggcgaaauugacguuacacggucuacaacaacauuauguuaagcuuaaagagaacgaaaagaauaaaaaauuauuugaguuacuugauguguuggaguuuaaucagguggugauauuuguaaaauccgugcagagauguguagcguuggcgcaacuuuugacggaacaaaauuucccagcaauuggaauacaccgaggaauggagcaaaaagaacgauuauccagauacgaacaauucaaagauuuucaaaagagaauauugguagccacuaaucuuuucggucgugguauggauaucgag

SEQ ID NO: 4457 - RNA, 772 nt, Phyllotreta striolata
ccagaaggaaacuaaacggaacaguccucagaagccuuaucaaucaaauguaccccgucgccgaaagggacgugcuguucggccucagcgaggaaucuaccagugacguagacgcuacacagucgagggccagaucagccacuaaaacgccucuucccgaaguagaugcuuacauucacuuacuacuuuuaguucgacugaucgauaccaauaaacuagcugaagccgagcgguguucgaacauaaucaugaacaaaaucaccagccagaaccgacgaaccaucgaccacauagcagcuaaauguuacuucuaccauucgagaguggccgagcucaccgacaagcucgauucuauccggaguuuccuccacucccgucuacgaacagccacccugcgaaacgacuucgaaggccaagccgugcugauuaacugcuugcugaggaauuaccugcacuacucgcuguacgaucaagccgauaaauuggugaacaaaugcgucuaucccgaaacggccaguaacaacgaaugggcgagguauuuguacuacuugggccggaucaaagccgcccgguuggaguacagcguugcgcacaaacaccuaauucaagcgaugagaaaagcgccucaaaacgcugcgauggguuuucgucaaacggugcagaaacugaccaucguuguggaguuacugcugggggauauaccagaaaggcaggucuucaggcaggccaauaugaggcacucauuggcuccuuacuuccaauuaacccaggc

SEQ ID NO: 4458 - RNA, 712 nt, Phyllotreta striolata
caagacgguuaucgaggaauuccagaaaguggaggaagccaaacggcaacugaaaucggauaaauugaaugcgaacgaggaguccgacgacgaagaaaaagacgaggacaaauacguggaugaaguggacaugcccggaacgaaaguagacagcaaacaaagaauaacggucaggaauuugcguauacgagaagauacggcuaaauaccugagaaauuuggauccuaacucggcguacuacgaccccaaaaccagaucgaugagggaagauccgaaucccggaaacgacgccacauaccacggggagaauuuuguucgguuuuccggagacacuacgaaccacgcgagagcucagcuguuugcaugggaagcgcacgguaaaggaguagacguucauuugcucgcagaacccacgaaauuggaauuguugaagaaagaauacgagaaaaagaaagacgagguuaagucgaacauucagggaacgguuuuagagaaauauggaggugaggaguaccucgaagcgccuccgaagaguuuacuguuggcucaaaccgaaaacuacguugaauauucgagaucggguaaaguuauuaaaggcgcugaaaaagaaguuauuagaucgaaauacgaagaagauguguauauuaauaaucauacgucuguaugggguucuuauuggcgcggaggacaaugggguuaucgauguugcuau

SEQ ID NO: 4459 - RNA, 480 nt, Phyllotreta striolata
cguaagaagaggaaguucgaauuaggucgcccggcggcuaacaccaaacuaggaaccagaaggauccacuauguucguacaagggguggcaacuugaaguaccgcgcccuaagauuagacaccggaaacuucucuuggggaagcgaaggaacugcccgucaaacgcguauuaucgaugucguuuacaacgcuaguaauaacgaauugguccguaccaagacauugguaaagaaugcuauuguugucguugacgcuaccccguucaggcaaugguacgaaaaccacuacaucuuaccauugggacgcaagaagggugccaaaaugacgcccgaagaggaggagauauucaauaagaaacguagcaaaaaaguacagaagaaguacgaaacuaggcaaaaaaccgcuaaaguagagccugcgauugaagaacaguuccacacuggaagauuguuggcaugccuagcaucuagaccuggacaa

SEQ ID NO: 4460 - RNA, 651 nt, Phyllotreta striolata
cugugagagucauagacguguucgcuaugccccagacggguaccggagugagcguagaagcuguggaucccguauuccaagcgaaaauguuagauaugcuacgacagaccgggcgaccagaaaugguugucgguugguaccauucccauccggguuucggcuguugguugucgggcgucgacauaaacacccaacagagcuucgaggcgcucuccgagagggcgguagccguagucguagauccgauucaauccguuaaaggaaaggucgucaucgaugccuuuagguuaaucaaucccaauaugaugguauugggacaggaaccccgucagacgaccucgaauuuggggcauuugcagaaaccguccgugcaggcgcugauucacgguuuaaaucgccacuacuacuccauaagcaucaauuacaggaagaacgagcuggagcagaagaugcugcucaauuugcacaagaaaucguggauggacgguuugacucuggcggauuauucggagaauugcagcgugaacgagaagaccguggccgauaugcuggaacuggccaagaauuacaacaaggccuuggaggaagaggagaaaaugacuccggaacaacucgcuaucaagaacguggguaaacaagaucccaagaggc

SEQ ID NO: 4461 - RNA, 708 nt, Phyllotreta striolata
uuuggugucccuuaugauggucgaaaaaguaccggauuccacuuacgaaauggucggcggucuggauaagcaaaucaaagagaucaaagaggugauugaauugcccgugaagcaucccgagcuguucgaugccuugggcaucgcccagcccaagggcguguuguuguacgggccgccgggaaccgguaaaacucuucuggccagagccguggcucaccacacggaauguaccuuuaucagaguaucggguucggaguuggugcaaaaauucaucggugaagguucucgaauggucagagaacuguucgugauggccagagagcacgccccgucgaucauuuucauggaugaaaucgauucuaucggauccucgcgaaucgaaucagguuccgguggcgacucggagguucaaaggacuauguuggaguugcugaaccagcucgacggguucgaggccacgaagaacauuaaggugauaauggcaacgaacagaaucgacauuuuggauccggcuuugcugaggcccggcagaaucgacaggaaaaucgaguucccgccaccgaacgaggaagcucgauuggacauccugaagauucacucgaggaaaaugaauuugaccagagggauuaauuugaggaagaucgcggaauugaugccgggcgcuagcggugcagaagugaagggaguguguacugaggcugguaugua

SEQ ID NO: 4462 - RNA, 460 nt, Phyllotreta striolata
ugaaguccgcuuucgauuuacaaaguuucaguuuuuuccaaagagggucuguacaggaguuuaugucauucuuuuguaagacuauuguggaaaggaccauaccaucaucgagacaauccgucaaagaaggagaauacaugugucauguuuauguaagacaugauaacuuagcugguguuguaauaucagaccacgaauaucccuccaggguaucgcauacgcugauuacgaaaauuuuggacgaauucgcugcuaaaauacccgcugugaauuggccuaccuugcaggagagagaugucacguuuccacagcuaaacacuuaccuuaccaaauaccagaaccccaaggaagccgaugcaaugacuaaaauacaggaggaccuugacgaaaccaagauuauucugcauaacacgauucaagcaguccuggaaagaggcgagaaacuggacgacuugguaaa

SEQ ID NO: 4463 - RNA, 581 nt, Phyllotreta striolata
aauugggauccacagcuaucggaauaugcacgagcgaaggggucgugcuagcagucgaaaagcguauuacuucuccuuuaauggagccuacaacgauugaaaagaucguagaaguagacaaacacaucggcugugcuguuucggggcucauggcagauucacgcacgaugaucgauagggcaagaguagaaugccaaaaucauugguucguuuacaaugaaaacaucaccaucgaaucgugcgcucagggaguaucgaaccuagcuauucaauucggagauuccgaugaugauggugcugcuaugucgaggccauucgguguggcaaucuuguuugcuggcaucgacgaaaaagggccucaacuuuaccacauggauccuucagguacauuuguucaguucgaugcgaaagcuauaggauccgguucagagggggcgcagcagagcuugcaggaaguguaccaucguagcaugacucuagaggaggcuaccacagcggcauugaccauucucaagcaggucauggaggagaaauugaacucuuccaauguagaagucaugacaaugacgccaaaggauuug

SEQ ID NO: 4464 - RNA, 665 nt, Phyllotreta striolata
augauuugggaaagcuggauggauucguggagcagguuacccggaagguggcccaguaccucggagagguucucgaggaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggucaaaucgaugccgaucuuaagaccaaguccucggccuacaauaauuuaaaaggcagucuucaaaacuuggagaaaaaacaaacagggaguuugcuaacccguaacuuggcagaucuggucaagaaggaacacuuuauuuuagauuccgaguacuugcaaacgcugcucgucaucguucccaaggcucaguucaacgaguggaacgccacuuacgagaaaaucacggacaugaucgucccucgaucgucggagcugaucauccaagacggcgacuacggccuguucaccgugucgcucuucaagaaggucgucgaggaguucaagcugcacgccagagagaagaaguucaucgugcgagauuucacguacaacgaggaggaauuggcggccggcaaaaacgaaaucaccaagcucguuaccgacaagaagaagcaauacggu

SEQ ID NO: 4465 - RNA, 693 nt, Phyllotreta striolata
cuauacccguggaggaauugggcaaggaauccaucgugaacgucgccaagacaucgaugagcuccaaaaucauaggagcugacgcggauuucuucucgcaaaugguugucgacgcggcgaccgccgucaaagugacggacgccaaaggcaacucgauguaccccauuaaggcggugaacguguuaaaagcgcacggcaaaagcgcccgcgagagcuuccugguggccggauacgccuugaacugcaccgucgccagccaggccaugcccaagaggaucgucaacgccaaaaucgccugucuggauuucucgcugcaaaaggccaaaaugaagaugggcgugcaagugcugaucaccgauccgggucaauuggagggcgugcgcgcccgcgagcucgacaucaccaaggagcgcauccagaagauccucgccaccggcgucaacguggugcugcucuccggcggcaucgacgacgucugucugaaguacuucgucgaacgcggcgccauggccgugcgucgcgucaagaaggccgaucugaagcgcaucgccaaggcgacgggggcgucguucgugacgucguugagcaacauggagggcgacgagacguucgacgccaauauggugggcgaggcggcggagguggugcaggagaggauauccgacgaugaguugaucguuaucaaagguccga

SEQ ID NO: 4466 - RNA, 628 nt, Phyllotreta striolata
ggggcuuucuauaacuucccaggaacaguagcaccuguaacuaauccaauaacucauacucagucuccaguaacgacuucaacuucaauugugucuauaaccuacgauaaggggguacuaauugccggagacuugcuggccuccuacgggucauuagccagauauaaaaauugcccuagggugaucgaaauuaacccgaacaucaucaugggugcuggaggagauuacgcugauuuucaauacguaaaaagcuucauugagcagaaaauaaucgaugaggacugcuuagaugaugguuugaaaaugaaaccaaaaucucuuuauugcuggcugacuagaauuauguaccaacgaaggaguaaacucgaccccuucuggaacaaccuaguaguaggagggauacaggaugguguaccuuuccugggaacagucgauaaacucggcacugcuuacacagauaaaguaaucuguacuggguauggugcucauauugcccuucccgucuugagagaugcccucgacaagaaaccgaacuugaaucuaaacgaagcuaagcaacucauuaaaaagugcauggaaguuuuguucuacagagacgcgagaaguuacccgaaauaucaguugggaa

SEQ ID NO: 4467 - RNA, 734 nt, Phyllotreta striolata
aaauugaacccaccgaaaacaccgccuuaaaaauaguucacguuuauuuauuuacagauaguuuuaugauaacuacaagaaauucaaacagucgaggucucaugaaauacaucuaugaaaguauauaugaccuaagcagccuagcaguuguaaacguaagagauuugggaaacgucaaacacgccuuuaagcuucucauuuuccccgauaccagaguguuccaaugcucuucaaacuccaauaaaaaagaguggcuagacaaguucgaucaagccaagaagaccaggcuggcucaagaacagcaaaaaagagaauccauaucggaaaaaucucccacccguguauccuucgagucaccuagcuacaauccuuucgaugaaguggaagaagaaacgagcgccuugcauccggaaugguuccuggagauucccgaagagcuggacguuuguguagcccaaaggcauuucgaggaggcucugucucuauugcaaaaagccaaagaauacuugaaucaagcaucauccgcguccggugacaagcgggacaccguuuucacggauauucaaaggaaaguagagcaaagacagaacaauuuaacugagguguuaaugaaggaauuggaaguaaacccggacaaaucguugcaggggggauugagagcggcucgcagggcugugagacugcugaaucaauuaggaagagaaacacagucuuguacguuguuucugaagcug

SEQ ID NO: 4468 - RNA, 696 nt, Phyllotreta striolata
ucgauacagcuugcgaaauauuguacgaaagaaugaaaaguuuaggucccgauguacccgaacugaucauucuacccguauacuccgcucugccgucggagaugcaaacuagaauauucgaaccggcgccuccuggcagcaggaaaguuguaauugccacgaacaucgcagagacuucguuaacaaucgaugggauuuauuacguggucgauccgggauucgucaagcaaaaaguuuacaauuccaagaccggaauggauucauuagugguuacgccaauuucgcaggcgcaagcgaaacaacgagcaggccgagcgggcaggaccgguccugguaaauguuacagacuuuacacagagagagcguacagggacgaaaugcuuccgacgccggugcccgaaauccagcgaacuaauuuggcaacgacaguacuucaacugaaaacuauggguauaaaugauuugcugcauuucgauuuuauggacgccccuccgguggaaucgcucauaauggcacucgagcaguugcauucucuaucagcuuuagaugaugaagguuuauuaaccagacuaggaagaagaauggcugaauucccgcuggagccgaauuugugcaagauguugaucaugucgguagcccuccaaugcuccgacgaaauauugacuauagugagcauguugucuguucaaaacgugu

SEQ ID NO: 4469 - RNA, 702 nt, Phyllotreta striolata
aggaaccgaaccucuauguagaguaguuagaauuaaucacucaggaaaaauuuuagcuacugggggaacugauggggauguaagacuuuggaaauuucccacaaugcagccaaugucgauucuaaagggacauacaaaggaaauagacgauauagauuucaguaaauucgauaaccucaucauaacuuuagcuaaagacgguuuggcuauuuugugggacgcccaaacgggaaagcagaaaucgaaacugacauggaaaacuccagagggaucaaaauauuuguacaagagaugcagauuuggcguuauugaagaucaaaaaaacaagugcaugcuauacaugauagcgaaugcgacuaauucgaagcaagcaucguuucuucaacaauggauacccgaggagaauacuuuaaaaaaguucucggaauuuaaugaaacccugucugcacuugcagugagagacgaugggcgauuuguagcugucgggacaauguucagcgguuccguuuccauucacauagccuuuaguuuacagaaauuauuaguaguugucggugcucacucgauguuuguaacuggucuggaauuccuaucucacgaaaauacuaaucauuccauaaguaguguugcugagacugcuguguugucuauuucgguggauaaucagcuuuguauacauucagugccauacagacgaaguau

SEQ ID NO: 4470 - RNA, 754 nt, Phyllotreta striolata
uucgauaccggaauguacaccgaugcccuacaacuggaauccacccuguuaaaagagcugaagaaacuggacgacaaaaaucugcuggucgaagugcaacugcucgaaagcaaaacauaucacgcucucagcaauuuacccaaagcucgagccgcucuaacguccgcuagaacgaccgcuaacgcuauuuauugcccuccgaagaugcaggccgcccucgaucugcaaucgggcgugcugcacgcagccgacgaaaaggauuucaagacagcuuacuccuauuuuuacgaagccuucgaaggguucgauagcgucgaaucccccaaagcucugacugcucuuaaguacaugcuucuguccaaaauuaugauuaauagucccgaagacguacagcaaauugugaguggaaaauuagccauaaaguaugcagguaaagauaucgaggccaugaaagcagucgcacaagcagcccauaaaagaucucuugcagauuuucaacuugccguaaaacaauucaaacaugagcuggaagaugacguuaucguacgagcacauuuaggaacccucuacgacaauauguuagaacaaaauuugugcagaaucauugaaccuuacucgcguguccaaguagaauauauagcaaaaacgauuaagcuuccuguuuuacaaguagagaagaaacuaucgcagaugauuuuagaugccaaguuucauggaauuuuagaccagggugaugguguccugauaguguuug

SEQ ID NO: 4471 - RNA, 798 nt, Phyllotreta striolata
aguagaggucgagaaucacaaucagagucuuagggaagagcuaaccuucaaagaucagauucaccagcaagagcucaccgagacccguacgcgccgacaggucgagaucagcgaaaucgacggccgccuggcgcagaaguacgaggccaagcugcaggaggcgcuccaggaccugcgcgaccaguacgaaucgcagauggccaacaaucgacaggagaucgagcuguuguacgagcagaaaaucaaaaaccugcaggcggccgccgacaggcaccaaucgaccgccuccggcgcucucgacgagcugagacagguccggacgaggaucgacaccuucacgucgcgcauccaagaccuggagaaccagaacaacggccugucggcuaggacuagggauuuggagaaguugcucgagaacgagcgcauucgucaugccgaagaucuggcgauggucgagagggaauugcacaggaugcgagaggaaauggccacgcaacuacaggaauaccaagaccugauggauaucaaaguaucgcucgauuuggaaaucgccgccuacaggaaacuucucgaagcugaagaagcucgauugaacaucacaccaacaggcguugagcacgaggugcaccagaggaguuccucucaacgucggacgccggugagggugggagcgaagaggaaacgggcccugcucgaggagacgcaggagucgagcaugucggauuacagcgugaacaguucuucgaaaggggacaucgaaguggccgcagucgauccggagggucaguuugugagauu

SEQ ID NO: 4472 - RNA, 725 nt, Phyllotreta striolata
cugagaauccacaccaagaacaugaaguuggccgacgacgucgauuuggagcaaaucgcggccgagacucacggucacgugggcgccgauuuggcuucgcucuguucggaagcggcgcuucaacagaucagagaaaagauggaccuaaucgaucucgaagacgaucaaauagacgcggaggugcucaauucguuggccgugaccauggagaacuuccguuacgcuaugacgaagagcagcccgagcgcccugcgcgaaaccguggucgaggugccgaacgucacaugggaagauaucggcgguuuggcgaacgucaagaaggaauugcaggagcuggugcaauauccgguggagcaucccgauaaguuccucaaguucggcaugcagccgucuaggggugugcuguuuuacgggccgcccgguugcgguaaaacccuauuggccaaggccaucgcuaacgaaugucaggcaaacuucauuuccgucaaaggaccggaauuguuaacgaugugguucggugaaucugaagcuaauguuagagacauuuucgauaaggccaggucagcagcuccuuguguacuuuucuucgaugaguuagauucgaucgccaagucaagagguggaaaugugggagaugccggcggugccgccgauagggugauuaaucaaauuuuaaccgaaauggaugguaugggagcgaaaaagaacguuuucauaaucggugc

SEQ ID NO: 4473 - RNA, 650 nt, Phyllotreta striolata
auuuagugccaagucuuugugaggaucuucuuucgucugucgaucaaccuuuaaaaaucgcuaaagacaaggauucgggcaaggauuuucuuuuaugugauuacaauagagacggggauucuuacaggucaccauggucgaauaccuauuacccuccguuagaagacgguucgaugcccuccgagaggcuaaggaaauuagaauuagacgccaauuuagcguucgaucaauauagagaaauguauuucgaagguggcgugucuucuguuuauuuuugggacuuagaucacgguuuugcaggaguaauuuuaauuaaaaaaaccggcgaugguaguagaaaaauuaaagguuguugggauucccugcacguaguggagguacaagaaaaggguucaggaaggaauucccacuacaaaaugaccuccaccgcaaugcuguggcugcaaaccaauaaacaaggcucggguaccaugaauuugggcgguaguuuaacccgacagaucgagcuggaugcggccguaaacgacaucaacccccacaucgccaacaucggucgaaugguggaagacauggaaaacaaaauucggaacacguuaaacgaaaucuacuuuagcaaaaccaaggacauagucaauagcuugagaucggug

SEQ ID NO: 4474 - RNA, 767 nt, Phyllotreta striolata
cguugauaugccgaugaaaggcgccaaaggcaagaaagggcgaguuagcgucggcgguggaagcaccccaucgucgagcggaccgguaccgggggcggcggcuauaccaggagcugucagaggcagaccgcccgcgaccguuucuucuaccaguaccacgccaauugccaccacuacugguucgucgggccugccguuggguacccaagcgccggccacgcugccgggcaguaccgccacgacgacgauagcgccggccaacaacaacaacagcucucugacgccgcaacagcucgucggcacgcccgucgguucgaugcacggcacgcccggaggagcgccacuguccaauucccucgaucccggcggcgugaugcccggcaacgucaugccgccggcgcaaccggccaagguaaaaaaaggcgugaagagaaaggccgacacgacgacgccggcgacggccuacgacuauccgacgguguuggaaucgaaaucggcgaagauuucgacgcgccgagaaucgggcaggcagaucaagaaaccggcgcggcgggaaaucgaccuucauguaccucaaccggcgauccacaaacccaacgagaaguugucggaaucgcugaaggcuugcaaugaaauccucauggaauuguucuccaagaaacauucgaauuacgcauggccguucuaucaaccggucgaugcggaauuauugggccugcacgacuaccacgacaucaucaagagacccauggacuuugguacuguca

SEQ ID NO: 4475 - RNA, 751 nt, Phyllotreta striolata
caauuucguucaucagcaggucuccaugaaccaucgccagcccuacagcgucagcgacaaagcuggucaccaaaccuccgccgagucuuggggaaccggucgcgccguggcccguauaccucguguacgaggcggcgguacccaccgaucgggccagggagccuucgguaacaugugucgcggcggucgcauguucgccccgaccaagccguggcgccgcuggcaucgacgcgucaacaucaaccagcgucgcuacgcccuggcgucggccgucgccgccagcggcgugcccgcuuuggucaugagcaaggggcacguggucgaucagauacccgaguugccguuggucgucagcgacaaggugcaggagaugcacaagaccaaggaggcggugcaauuccugaggaggaucaaggccugggccgacauccagaaggucuacaagagccaacgguuccgugccgguaaaggaaaaaugcguaacaggagacguauccaacguaaagggccacuuaucguuuacuacaaagaucaaggucuucgucaagcuuuccguaacaucccgggcaucgaucucaucaguguccaaaaguugaacuuguugaaguuggcuccuggaggucacgugggucgauuugucaucuggaccgaaucggcguuccaacguuuagacaaauuauucgguacauggaagaacccaucgaccgagaagaaggguuacaauuuaccucaacccaagauguccaauacc

SEQ ID NO: 4476 - RNA, 690 nt, Phyllotreta striolata
caagaauguccacuggaagaacgccauacgauaugaguaccgaagcuauucaaagagucgcgcaaaaucuccccagcgacaugguccaagcccuaucagcugcaaccaaucaaacuccucacuacccgcacaccccuggcgguuacggugguaauuacaucaacacaccguauacaccuagcggucaaacgcccuacaugacuccauuccaaacgccucacgcucaacagacgccgcgguacggccaacagacgccuucgcagccgucucugagcaauccguuccuccauccgggcgccgugacgccgucgcaacggacgcccagcuacaggaaccugccgacgcagaguccgaugauaccgcagagcccggugccgagcccgggaucgcagagcucguacagcagccacaugagccaccauacgcgagcgaguuacggggauucguugagguuccagccgccggagucgccgaggaauuacccgagcagcaggggauccuaccccgaugggagguacggugguagcgagucgauggauuggcagaaggcagcugaagcuugggcuucuagguccaaaucgacaccacgaagcgaaggucgcgggacucccagaucgucuggucacagaacuccacguaauuaugauaauauguccgaaagugaccggucgaggaugaagcauaugagca

SEQ ID NO: 4477 - RNA, 656 nt, Phyllotreta striolata
uugucgagacuccuacugaugauuccguagagguggcgauuucuuuucugaaagagugcggacagaagcucacagaagucucgaguaaaggaauaacugccauauucgagauguugcguaacauccugcacgagggccagcucgagaaaagaauacaguacaugaucgaggugauguuccaaauuagaaaggacgguuuuaaagaccacgcugcuguaacagaggaauuggauuugguagaagaagaggaucaauucacccaucuaaucaugcucgaugauguuaaggagguuaaugcugaagauauucuaaauguguucaaguucgaugaacauuaugaagaaaacgaagggaaauacaaaacucugagcaaagaaaucuuggggagcgacagcgagucagauucgggaucggagggaucuggagaggaauccgaaggcgaagacgaggaagaagaggucaaagaugccggaaaaaucaucgacaauacugaaacaaaucuaauagcucucagaaggacaauauauuugacuauacaauccaguuuggauuucgaggaaugcgcucacaagcuuuugaaaauggaguugaaacccggccaagagaucgaauuaugccacauguuuuuagauugcugugcugagcaaagaacauac

SEQ ID NO: 4478 - RNA, 742 nt, Phyllotreta striolata
agaggagcacacguauuuuucacagaagcaugcccagacgaauuauuuaacaaauuaaguaagagucaugcagcaaaauauauaaaaacguuaaaagaaaucaacauagcauuuauuccgacagagucacagguauuuucuuuagauuccccugacacuuuccaauguaguuacgauccuuccuuugcugccgcacgaaacgcgaauauggaaagaauggccgaacagauugcaacguugugcgccacuuugggggaauacccgcacguccgauauaggagcgauugggaacguaacguagaguuggcgcaauugauucagcagaaauuggacgcuuacaaagccgacgagccgaccaugggcgaagggccggagaaagccagaucgcaauugcugaucuuagaucgaggcuucgauugcguuucaccgcuacugcacgaacugacguuucaagcgauggccuacgacuugcuuccgaucgaaaacgacguguacaaauacgaagcuuccgccggggugcagaaggaggugcucuuggacgaaaacgacgagcuguggguggaauugcgccaucaacacaucgccgucgugucucaaagcgucaccaagaauuugaaaaaguucaccgauuccaaacguaugacccaaagugauaaacaauccaugaaggauuuguccacuaugaucaaaaagaugccgcaauaccagaaggaauuaucgaaauacgccacucacuuacauc

SEQ ID NO: 4479 - RNA, 758 nt, Phyllotreta striolata
ucgaagagccaucaaaagaaacagauucaauccgggggcuuucaagaucuuaggagagauuuacaagcaguaauagguacgagggcaaauauuaacauagcacaaauugaaaauuacggaggugaaacuuucguaucggaggaauuggcuaucaugauucuucaggauacuaaacaagcuuuucaacguugcuuauuguugucgaaaggcagugaaagagccucuaacgccacucaaauuuuagacagacuuauuaauaguuugcuaauagagcauguagacuaugcaguugaauugggucuacaagccguaccaguugucgaaggcguuagaaaucccccuguuuuguauuuuuuuaaugucgugcaucaaagcaauaauauaacccaucucgucgagaaacaguuuauggauuuggugguucccuuaguagaaaauacuccaaaauauagcgauuguguucagaagaaaaaauuuguuuuggaggauauagaaagaaaaauuaauacgggauuagauaggugcuugagugcgauauuaaauugggugaaguuguauuugcaaucugagcaaaagaaauccgauuuuaagccggagucugaugauuuugauacaguggcaucaccugcaugcaagaacguacuuaacuauguuaauagcauuaucaaagaaauuaaaacaaauuuggauggcaauaauguaacggcuauccuucaagaauuaggaauuagacugcauagaguuguuuacgagcacau

SEQ ID NO: 4480 - RNA, 611 nt, Phyllotreta striolata
aaaaucaccuggggucuuacgaauguaagcuuugcuugacccuacacaacaacgaggggagcuacuuggcgcauacacaagguaaaaagcaccaggccaauuuggccaggagggcagccaaggaagccaaagaugcucccacgucgcugcaaccggagaagccccgaguggagcccaagaaguucgugaaaaucgguagacccgguuaucgggugacuaaacagagagauccagaaaccggucaacagaguuuacuguuccaaaucgauuauccagaaauaagcgaucugguuuugccccgacaccgcuucaugucugcguacgagcaaaaaaucgagcccccagaccguaaauggcaguacuuacuguuugcugcggaaccguaugaaaccauugcuuuuaaaguaccgagcagagaagucgagaaaacggauaauaaguucuggacacacuggaacagggacaccaaacaauuuuuccugcaauucgcuuucaagaacgagaacaaacgcuccguuaacucuguaauucaaaggcauucgauuguuggcggaguuccaccgccucccaugcugccgguaccgccgccgcccaggccuccuauguuuaau

SEQ ID NO: 4481 - RNA, 252 nt, Phyllotreta striolata
aaacuauaaccggcgaaguuuacagggguaaacuuauagaagccgaggauaacaugaauugccaaaugacucaaauaacgguaacguacagagaugggcggguggcgcaauuagaaaacguuuacauuagagguuccaaaauaagguuuuugauauuaccggauauguuaaagaacgcuccgauguuuaaaaaacaaaccaaagccgggacugcugguagagggaagucugcuauucuacgagcucaagcac

SEQ ID NO: 4482 - RNA, 655 nt, Phyllotreta striolata
caagucggagccaauuuaacggccacauccgauagagaaacuaucugcuacacgcuggaagguaccccugaggcuguggaaugcgcuuuaccauucuuaaccgaaguagccacccagcaagaauuuagaccuugggaaguuuccgauuuguccaguagauugcaguuggauauugcuacaagaccauugcaguugagagcuaucgauuuacugcacaaugcugcuuuuagaggacgcgguuuggguaauucucuguuuauuccgaaaacucaaauugguaaaauuucgucugaaacucugcaacauuacguuugcucgaacuucaaaagcggacguauggcggucguagguucaggaaucagucaaaaggaguugacgucuuuugcuaacucuuugaaaauagaaaauggugauggcgauaacaccccaucuccuuacaaaggaggcgaacuaagaucgaacaaagguggucaacuagcauuuauugcuguagcaggagaaggugcugcucucaaaaacagcaaggaagcucucgcuuuugcuguacuacaaggagcccuuggaggagguccccagguuaaacacggaauuacagacagcggugucuucaggaaggcucuuggaaauagcccugacguuaguuccguagccauaa

SEQ ID NO: 4483 - RNA, 206 nt, Phyllotreta striolata
acgaaaaugaucggaugacuaacgaauugcaagagaaaauuggagcgcugaagucccuaacuauugauaucggaaaugaaguuaaauaucaggauagaaugcucagggauguugacgacgauuuagaaaaaacuggaggguuucuaggaacaaccaugaacaaaguacugaggcugucgaaagggggccacaacuacaucauugug

SEQ ID NO: 4484 - RNA, 729 nt, Phyllotreta striolata
cguugguuauccucgaagaugucaaauuuccgaaauucaacgaaaucguccagcucaaacuggccgauggcagucuacgauccggucaaguacuggaaguaagcggcucgaaagccguaguacaaguguucgaagguacuucgggaaucgaugccaaaaacaccaugugcgaauucaccggcgacauccuccgaacgcccguauccgaagacauguugggcagaguguucaacggcucuggaaaaccgaucgauaaaggucccccaauuuuggccgaggacuucuuggacauccaaggucaaccgaucaauccguggucgcguaucuacccggaggagaugauccaaaccgguaucuccgccaucgaugugaugaacucgaucgcucguggucagaagauucccauuuucucggcggccggucugccccacaacgaaaucgccgcccagauuuguaggcaagccggucucgucaaggugcccggcaagucggcguuggacgaucacgaggacaacuucgccaucguguucgccgcuaugggugucaacauggaaaccgcucguuucuucaaacaagauuucgaagagaacgguucgauggagaacguauguuuguucuugaauuuggccaacgauccuaccaucgagagaaucaucacgccucguuuggcucuaacagcggccgaauucuuggccuaucaaugcgagaaacacguguuggucauauuga

SEQ ID NO: 4485 - RNA, 207 nt, Phyllotreta striolata
cguuucgggaucguacauauccuggucguagaucaacgcggugccucugcuuucuuuaaauuuagugaaguauuccugcgcguacgauacuacgucuucgggcuguucgagcaaguagcugcaagugaauucgagcaacauggcucgcaauucgucagggacucugauuccugcccuuucgcguucgcguauuucguucauuuucga

SEQ ID NO: 4486 - RNA, 729 nt, Phyllotreta striolata
acuacggcauacaagugaucgucaagcuguugaauccgccgucgcguuggccgcuggugaaggcggucaucggucugaucaggaaccuggcacuguguccggccaaucacgcuccguugagagagcacggcgccauucaucauuuggugcaguugcugaugagggccuuccaagacacucaaagacaacgggguagcguggcuagcggaggcagccaaccgccgggaacguacgcggacggggugcgcauggaggagauugucgaggguacggugggagcguugcauauauuggcgagagaaucgcacaaucgggccaucauuagacagcaaauggugauuccgaucuucgugcaauugcuguucaacgauaucgagaacauacaacgcgucgccgccggcguucuuugcgaauuggcggccgacaaagagggggcggaaaugauugaaaacgagggcgccacggccccauugacugaguuguugcauucgagaaacgaagguguugcuacguacgcagcugcgguuuuguuuagaaugagcgaagacaaaccacaagauuauaaaaaacggcugucgauggaguugacuaauucuuuguuuagagaagaaaaucuuuggaaucccgaucuaggcauggguccggauuugcaggauauuuuaagucccgaccaagcauaugacaacauguaugcucaggguccccccaguguucauaguagucauggcg

SEQ ID NO: 4487 - RNA, 667 nt, Phyllotreta striolata
gaaaucgacaagcacaagaagcgccguccguauuuggccuccgaaugcaagagccuguacgccugcgagaaauggcgcaugcagauaaucagagaaauagcgaaaaaagucgcucaaauccagaacgccggacugggcgaguuccgcauacgcgaucuaaacgacgaaauuaacaaacugcugcgcgagaagcgccauugggaggaccagaucaaggaauugggggggcccgauuaccagcgcgucgggccccggaugcucgaccacgagggcaaagaggugcccggcaacaggggcuacaaauacuucggagccgccaaggaauugccaggcguccgagagcuguucgaacaggaacccccgccuccgccucgaaagagccgagccgaauugaugaaggacaucgaugccgauuacuacgguuacauggacgacgacgacgggauuuugauaccguuggagaucaaagcugaaaaaaucgccguccaaaacgccaucaccgaaugggugaacaacaaagagaagaaccucgacucgagcaaaaccaucgaagagagcaucuacgcgguggaggauuccgacgaggaggagaccgucgaacgauucgacgguucccaacagcgguucgucgcccacguaccgguacccucucaacaggacaucgaac

SEQ ID NO: 4488 - RNA, 504 nt, Phyllotreta striolata
ggcgaauucgagaaaaaguacgucgccacauugggcgucgaagugcacccuuuaguguucacaacgaacagagguaaaaucuguuucaacgugugggauacggcgggccaggagaaauucggcggucucagagacgguuauuacauucagggacaaugugccauuauuauguucgacgucacguccaggguuaccuacaaaaacguccccaauuggcacagggacauugucagggugugcgaaaacauaccgaucguacugugcggaaacaaggucgacaucaaggauaggaagguuaaggcuaaaaguaucguguuccauagaaagaagaaucuucaguauuacgacauaucugcaaaaucgaacuacaacuucgagaagcccuucuuguggcuggcgaggaaacugaucggcgaucccaauuuagauuucguggcggaaucggcccuguugccuccggaagugcaaauggacccgcaguggcaacaacaguuggagaaggau

SEQ ID NO: 4489 - RNA, 340 nt, Phyllotreta striolata
uaccagggcuacuucuuaggaguaggaggaacauggaacuuaaacgaagaaaaaaauccugauucggaaauuguggcaucuggaaucuuugucggcuacaugaucuacacuaucguaucucuuauaagccuguguuucgccagcggugaucacaaaacaucuuucaccgauauuuuaaugaauauagucgguguauucauguggguggccguuggagcaacagcacuucacuacuggcucgguuauuugucagaauauaaauacucgagcguugauuccgagcgacaggugggcuuggcguuaggagccuugugcguuauaaacggugcagucuaucuag

SEQ ID NO: 4490 - RNA, 724 nt, Phyllotreta striolata
caaaugcgaaaugguuacgauguugcaauacgacaaucugaagaacccucugccggcgcaaaguaagcgaucgaacaugucgcaggcucagcaauuggccuuucucgagcaacauccguacgauucguucaaaacggaggauuuggacguggcuaaaucgcuguugaggagcgaaauggaugugguaaaaagcggcaugaaucacggagaauugccguuggacguguacaaucagguaugggaagagugccugggccaaguguuguaucuuccgaaucagacgagguacacccgcgcgcauuuggcgagcaaaaaagauagauuagaaucggcggaaaagcggcuggaacagaaccgaucgcacauggccaaggaggccaaacgcgccgccaagauggagaagaaauugaagauauuaacgggcgguuaccaauccagggcgcaggugcugauuaaacaguuacaggaucaauacgagagcaucgaucaaucgacguuggaguugaacacguucaaauuccuggccgagcaggagaagaacgcuuugccgaugcgaauacagucucuuacugaggacgugaauaggcagauggaaagagagaagguacuucaaaugaaauacgcugauuaccagaaucagauuaaagaguuacaagaggaguauuuaggucaaaugcaaaauguuccaaaugaagaaucaaauaaauaugacgaggucacuucg

SEQ ID NO: 4491 - RNA, 325 nt, Phyllotreta striolata
gcucauccugauaagcugaagaaaaaaauuacuagggaauuaauuaccacuauucuugccagaaaaccaaaaaugugcaguuucuuagaauggagagauuugaaaaucguuuauaaaagguaugcuagcuuguauuuuugcugcgcgauagaacaaugcgacaaugaacuguuaacauuggaaaucauucaucguuacguugaacuauuggauaaguacuucggaaguguaugcgaguuggauauaauuuucaacuuugagaaggccuauuucauucuggacgagcuaaugcuugguggagaggugcaggaaaccaguaagaaga

SEQ ID NO: 4492 - RNA, 776 nt, Phyllotreta striolata
aaaauuagagcaaagcgacgcuuugaaagcugcccggcagaaguucgaaaccguagagaaagaggccagcaaaggcggcgaaguguucaaagagaguuuagguucuaucaaagaucgagucaaaggcgucauagacgaggccaguaaaucggauuuagccaagaaggccgguaaguuuaccgaagaaguaggaaaaacuacgcacaaaaucagcgaaaccgcacaagaaaucagcaaaaccggagcguuucagagcauaucggaagccaccaaagccgucaaacaagaaaucgacaacaccagcauggaaggucgaguguaugucaguccuaaaaagcuacgaaaacgaaccgaaaccagcgccguaguccaacagaaauacuacgaacccaacacggacgccacaggcguggaacuccacaaagacuccaaauucuacgaauccuggcagaacuucaaaaacaacaaccccuacguacacaaagucauggacuggaaacucaaauucgacgaaagcgagaaccccaucauccgagccuccagggcgcucacggaaaaagucggagacaucaugggcggcuuauuccaaaaaaccgaacucuccgaaacccuaacggaaaucuguaaaaucgacccggacuucgauacaaaacgcuuccugaaacaaugcgaaaccgacaucaucccuaacguacucgaagcuaugacgcgaggagaccucgagguucugaaggacuggugucacgaaggacccuucaaucuauucgccauaccca

SEQ ID NO: 4493 - RNA, 685 nt, Phyllotreta striolata
cguaaacaacauaaguggccuaaaccagaaaauagaagaauucaaauugaaacugccauggaucgagagguuggacuguacaaacgcccaagccccccuggcgcccgaauuggcugcggaaauguuaguucacgaagaaaagaggaguaaucaacugagaaacaacaaaaaacuuccccaauuccaaccauccgaagacccgguucugaacgauuucaaacgagagcuaauauuccacaggcaagcacaagcuacaauucuagaagccaucccgaaaaucaaagaauuagggauauccacuaaaagaccagaagauuauuuugcugaaauggccaaauccgaugagcaaaugcacaaaaucagggagaaccugaagcagaagcaggagcaacagaagcggauugaacgggugaagcaauugaggcagcaaaggaaagaaggaaaaucgcugcaggugcagcugaaacugcaacgcucuaaggagaagaaagaaaugauggaucaaguaaagaaagcgaagaaaaauuucgauuuucucgacgauaaaaauaagcccauggguaagagggcggcggagaagcguaagaugaaggauaagaaauucgguuucggcgguaagaagaaagggaugaagaagaauacaaaggacagugcaggcgauauaagcgaguauagaaauccuggg

SEQ ID NO: 4494 - RNA, 514 nt, Phyllotreta striolata
agaugaacgaauuagagaagcuagaauaccuuucuuuggucucaaaaauuugcacagaauuggacaaucaucuuggaaugaacgauaaggauuuagcugaauuuauuauacaucucuccgagaaaaacaacacauuggagucuuucaagaaggugcucucagaaaauggcgccgaauucucggauucauuuguuucuaacuugcugcgaauuauccagcacaugaagccgaagaaauccuccaauaaggaagaguucgauaaaguggaaaaagagggacuagcuuuuaaauuucccggucuagcaauaccuaaugagaaacaaaaaccuuuacaauuagaagaauuugauaaugaaaaugaaaaugaugaaauagacguuguagcugauaugaugaaacagcucgaggccgaugcaccuucucaaaaacaaaccaaagaaagguccagaagccccagcaucgaaaagaaaccgagaguaagaucuggaaguagaucgaaggaacgaagaagauc

SEQ ID NO: 4495 - RNA, 792 nt, Phyllotreta striolata
ggaugauaccauagacgacgagcgccuccgcaaggaauucucgccguucggcaccaucacguccgccaaaguaaugauggaagaaggcaggagcaagggcuucggcuucgugugcuucuccucgccggaggaggccaccaaggccguaaccgaaaugaacggcagaaucgucggcacgaaaccgcuguacgucgcccuggcccaacgcaaggaggaccgcaaggcccaucugacgucccaauacaugcaacgcauggcgaacaugcgcaugcaccagaugggccaguucauccagccgggcggcucgagcggcuacuucgugcccaccauccaggcgacggcgccgcguuucuacgggccggcccagaugccgauucgcacgagcccgagauggccggcgcaaacgcccgugcggcccggcgcccaagggagcaccgccaccuacaccgguaugcagaacagcuacagggccgccgcccgaccgccgggccaauccacgaugcgcagcaacaucagcguuccgcgaccuaucaccggacaacaaccaccaaguaugcacggucguccacuuguuggacaagguguggcugcugcuggaaaucgugccaacuucaaauacaccgccaacaugcguaauccaccacaagcaauguuguccggagcucaagcucaaguacaacaagcaguccacauucaagggcaggaaccccuuacugcuaccauguuggccgccgcuccuccgcaggagcagaagcagauguugggagagagauuguucccucucauccaaag

SEQ ID NO: 4496 - RNA, 764 nt, Phyllotreta striolata
ccgguaucagaaaaacguugccggccaggcaagguuccgaugaaggcgucggugccggcgccgccgccgccgaaacgacggucaucccgaaccaagagagccucaucggagauuugcuuucuauggauaucaacgcgcccgcucccucggccgccgccgcucccgccgccccauuggcuagcaacgucgauuugcucggcgguggauuggacguuuugcucggaggcgguagugauaucggcggugguggcgccguuagcgccgccgcucccaccaccaccggucuucugggggauauauucggaauaccuuccgcuccuaccauguacacaccuccgaagguuaucugguugcccgccgaaaagggcaaggguauggaaaucuacgguacuuucuccagacgguccgggcagauggccauggaaaugacuauuaccaauaaggcuaugcaggccauguccgguuucgccauucaauucaacaagaacagcuucgggaucacgccgugcgcgcccaugaacgugccggcccugcagccgggccaaaaucucgaauacaguuuaccguugaacacgacggggccuguucaacggauggauccauugaugacgcuccagaucgccauuaaaaacaacguugacguguuuuacuacgccugccagauaccuauccagauauuguucggcgaggacgguacucuggauaagaggguguuccuuaccacuuggagggacauuccgggagcuaaugagguccaguacacg

SEQ ID NO: 4497 - RNA, 364 nt, Phyllotreta striolata
gaggagaaguaggagcuacaucaucuuuggcuccgaaaaucgguccccuuggucugucucccaaaaaaguuggugacgauauugccaaggguacugcugacuggaaagguuuaaaaauuacgguacaauugaaaauucaaaaccgucaagccaccaucuccguuguaccaucggcugcuuccuuaauuaucaaggcauugaaagaaccuccucgugacagaaagaagcagaaaaacauuaaacacaguggaaacauuacauucgaugaagugcuugccauugcgaagcaaaugaggccuagaucaauggccaagagccuuucuggaacuguuaaggaagugcuagguacagcucaaucuguagg

SEQ ID NO: 4498 - RNA, 697 nt, Phyllotreta striolata
gcaaauggaggaggaacuuacaguugaagcggccaaacugggcauuacuauaguauuuucgcaugagacugagccuaugggcaccgcaggaccaauagcauuagcgagagaacaccucucgaaaagcaccaagccguuuuucguauugaacuccgacauaauaugcgacuucccguucagggagcuggccaaguuccacgaaggccacggaaaagaaggcacgauagucgucacgaaggucgaggaacccuccaaauacggcguggugguguacgaucaaaacaacugcaucgagagcuucgucgagaaaccccaggaguucauuucgaauaaaaucaacgccgguuuguacauucugaauccgagcgugaucgaucggauagagcuccggccgacuuccaucgaaaaggaaguguucccuuacauggcgaccgacaagcagcucuacgccuucgaguugcaaggguucuggauggacgucgggcaacccaaggacuuccucaccgggaugugcuuguauuugaaccauuugcgggaaacuaacagccagaagcuguacaaaggucccgguguuguggggaauguacuggucgauccuacagccaaaauuggcaguaauugccagauugggccuaacguuacgaucgggccgggcguuguaauagaaaacgguguuuguauaaagcggucgacgaua

SEQ ID NO: 4499 - RNA, 676 nt, Phyllotreta striolata
aaaagaaggaguaacuggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauagucuugauacgacggcggagccuuggcgggccgcccuagauaacgaguuuauacaauacacaagaaaccauuauaaagacggcguuuguagcguauucggucgcagucaaaacggugcgaucacccuuacagcuugcaucgaagaccaccaauuucaacccaagaacuuuuggaacggucgauggagaucccaauggucuguuaguuuaaccgaugauucaaccgcagaaguacggggcguccucaaagugcaagugcauuauuaugaagaaggaaauguucaacuggugaguacuaaagagaucaaggaauccauucugguuucuaacgaagcucaaacggcuaaggaaaucauccauguaauagagaacgcugagaaucuguaucaaacggcuauuucggaaaauuaucagacgaugucggacacgacauuuaaggcucugcgaagacuccugcccgucaccaggacaaaaauggau

SEQ ID NO: 4500 - RNA, 709 nt, Phyllotreta striolata
ucucaaugguucaacgacauagugcccaaauaccucugcugucucuggcaggaagagcaagccgugggcugcgaaacccugcgauucgaacgaaggccuucgcaggauugcgucgccuaucaagcaccagguguagcaggaguguacggugacccgcacauagucaccuucgacgaugucgaauacacauucaacgguaaaggggaguacuccuuagugaaaucggucaagguggacgauaauuuagaaauacaggcgagauucgagcaaaugagccccaaugcuuauggagaggugagagcgacgcaacuaacggcgaucguggcuaaaggaaacaagacuauucccauugaaguuagaaguagaccgauagaauccagauggagguauagauuagauguuauagccgagaacaggagguuguacuuugauagaccuucguugaaauuccaacauuuccaaggcgugacuguuuauacaccaaccuacauucuaaaucaaucugaaguacugauaauguucgacaacggcgccgguguugaaguacuggacaaucaaggguacaugagcgccagaguauacuuaccuuggucguuuauaaauaaaacgguuggauuguucggaaauuggaguuucaacaaagaagacgacuucacccugccggacgguuccaaggcggccgucgugucaaacaucaacgacauggaga

SEQ ID NO: 4501 - RNA, 163 nt, Phyllotreta striolata
uucuuucuuuucuucugcggcagcaggagcagcggcaacugcagcagcagcuacgggugcugcaccaccuacuggcauggaacucaacuucucgcgaccuuuaguaaugagcucuucgauggauuugccguugaguucacccaagaccuucuugaccuuuucg

SEQ ID NO: 4502 - RNA, 789 nt, Phyllotreta striolata
agcgguacucaagaaacauuccacgaugcuucuaacggcuuccaaagucuacguccgucaccccgaacuagccgccgccaaagccaacagagacuacgucuugaagcaagucugcgaagccguuaauacgaucaacgacgucgcgcagggccggacgccccagcccgcuucgggccccuacgacggaccuggcgaacuggcggccgcuuuggacgauuucgaugaucacauggugauggagccucuggcuuacaacgagguccacacgagaccaucgcucgaggagcguuuggagagcaucaucagcggugccgcucuaauggcugauuccaguugcaccagggacgagagaagggaacguaucguugccgaaugcaacgcuguaaggcaggcguugcaggauuuguuguccgaguacaugacgaauauggguaagaaggauaagagcgacaaccucaacagggccaucgacaacaugggcaggaagacccgcgaccucagaaggcagcucagaaaggccgucgucgaucacguuucagacagcuucuuggagaccaacguaccccugcuggugcucauaaaagcggcucaaaacggcaacgaaaaagagguggaggaauacgccgucguauucaccgaacauuccaacaaacuggucgaaguagccaaucucgucugcagcaugucgaacaacgaagacggcgugaagaugguucgauacgccgccgcucaaaucgacaaucucugcccugaaguaauaaacgcagcuagaauauuagcggcgagauc

SEQ ID NO: 4503 - RNA, 699 nt, Phyllotreta striolata
uagccucauugaguacuccaacaucuucuucccaauuuggacuaaccuccagggccccuaaggacacaucaggguuauauggaucaaccacagcugcagcgccuacuccagcaucaaccggacuugguuuuggaccagcaguuucaacaacgucuucagcagccccagcuacuacaggaacuaccccccuuuuuggagucgcaucuaccccgagcaccacuacauuagccagugccccugcuuuagguuuaucgaccacaauuucuuccgcugcuucaacaacuccaucgacuucauuaaguacuacaacagcacccccggcuuacucaacaucgacacuuacuucuacugguucguuaacuuucagucaacuggaagauucuauuaacaaauggaccauugauuuggaagagcaaggaaaauuuuucauuaaucaagcgaagcagcuuaaugcuugggauucguugcuuauuucaaauggugaaaagauucucaaccugaacgguaguaucgagagagucaagcagcagcaacagcaauuggaucaagaacucgauuuugucuuagcacagcagaaggaauuggaagaguugauaacaccgcuggaaaaggaauuauuggaaauucccgugacggacauagaucgaaaucaaauguaucaauuuucggaaauaaucgauucgcaauugaagcaaaugu

SEQ ID NO: 4504 - RNA, 452 nt, Phyllotreta striolata
uugcuguuuuuaggacuggauaaugcugguaaaacgaccuuauugcacaugcuuaaagaugauagacuggcccagcacuugccuacauugcauccgacuucagaggaauuauccaucgguaacaugagauucaccacguucgaucucggagggcauucgcaggcuagaagaguguggaaggauuacuucccagcuguagacgccauuguauuccucauugaugcuaacgacagaucgagauucguagagagcaaacaggaauuggaugcuuuacuaacagacgaaacccuagcgaauugccccgugcugauucuaggcaauaaaaucgaucuaccggacgccgccucugaggaugaguugcgaaacguuuacucguuguauggccaaacgaccgguaaagguaaagucgcucgaucggauuugcccggaaggccuuucgagcuguuuaugug

SEQ ID NO: 4505 - RNA, 432 nt, Phyllotreta striolata
uauccaacaaaacgcaaaccauaacgaauuugcugguggaaacgcaaaccaugaucaauucggcguugaccugucgcgaaucgaucacgucgaugcugcaacaccuggucgucaucaacgacuaccugaaucccacgagcgaggcggacgagcucgagguggaagcgaaacgccaguauuuacucgaauuguaucccgaauugaaggauacgauacagacggugagcacguuggagucccuguugccauucaucgauuccauuaacauauccaaagugguggaguucucggggaaguuggaagagguggccgugggcaaucucaaauuguacggggaaugcagggacaucaccaagaaagugcuggucgcguuacagcaauacaacgacauauccaauuccauuaaguuauuguucucgcaauuggauaugg

SEQ ID NO: 4506 - RNA, 673 nt, Phyllotreta striolata
agaaggaaacguggcuaauuucguugaaaccgagcaaauagucgaauaccaaggcgaccgggcgaguuucgugcaaauacgagggagcauuccccuguuuuggcaacaagaucccgacuugagauacaaaccgccgccuacucuacucgaugucgauccgcaagaucagcacucgaugugucugaagcacaugaacgauuugaugacuuucuacggaaagaucgucugcgugaaucuaguggaucaaaaaggagcugaaggaaacauggaagucgcauuuaagaacgccauuaccaacguaucgucuccaucggugaaguacgaaucguucgauuuccacgccgagugcagcaaaaugcgaugggacagacugucgauucucaucgaucgauuggcgcacgaucaagacgaaaugaguuucuucuuauugcuaagagacggcucguugaguucguugcaggacgguguauucagaacgaacugcaucgauugcuuggaccgcacaaacgucgugcaaagcaugcuggcccaucggaaucucgaaagcgugcucagaaaauugcagauccuccaucagaaucaaacguuggaguuccaguauucguucgagguguuguucaagaacguuugggcggacaaugcggauauaaucaguacccaauauucggguacc

SEQ ID NO: 4507 - RNA, 737 nt, Phyllotreta striolata
gagaaaacguucgaagacaccaagacgaucaucgauaagcauuacagcaagcccaacgugguccccguggacguccugccgguuuauccagauuucaguuuguggaaauauccuugugcgcagguuaucuucgauucagauccggcuccagugggcaaacaaguacccgcccaaaucgaggagaugucucaagcuaugaucagagguguaauggacgaaagcggugagcaauucguggccuacuuccuucccaccgaggaaacacuccagaaacgcagggaagacgucgcgaaccaaguccaauaucaagacgaagaggaauacgaauacaaaauggccagagaguacaauuggaacguuaaaagcaaggcgagcaaaggcuacgaggagaauuauuucuuuguuguacgaucgagugguauuuauuacaacgaauuagaaacccggguuagguugagcaagcgaaggcagaaaguaggccaacccccgagcaauacgaggcuuaucguuaaacauaggccuauggaugcgaacgaauucagaaugcaaagguacagagaaaagcaacuggagccuacaggcgaggaugacgaagagauggaaauggacgagccucaagacgaggaaaacgugcuugagccggauaacgaaagucgcgacaaagaaaccgagagcgacaacgagaagaaacgauccagagcuuccucagugucuucccaaaggagaucgagauccag

SEQ ID NO: 4508 - RNA, 776 nt, Phyllotreta striolata
cugccucacuacaaguuucuccuaacgcucccggaauaccgcagcgaccggaauguccauucgaagaucacagaggccaucaagaaggaugauauggccccaugguaugagcuccuuugcaaagaaguaggcuggaaguuagacgcggccuugcugaagacccucaaagccaagaacgccgaaaaggucaagcuucuggacgaggccaucgaagaugcggagaagaacuugggagagauggaggugcgggaggcuuauuugcguaaagcggaguuuuacagcagaaucggcgacaaagagaacgccgugagcacuuucaggcagaccuacgauaaaacagugucuuugggccaccguuuggacaucauuuuccacuuaaucagaauaggcuuguucuucauggaccacgaccuuaucacgaggaacaucgacaaagcgaagacccuuaucgaagaaggaggcgauugggaccggaggaaccgauuaaaagucuaccaaggugcuuacugcaugucggugagagacuucaaaacugccgcuaaccuauuuuuggacaccgugagcaccuucaccuccuacgagcucauggacuacaaggcuuuugucagauacgccgucuacaccuccauaaucagccugccgcggaaccaacuuagagauaaaguaauaaagggcucggagauacuggagguccuucauuccgagccguucguuaaagacuaccuguucucguuguacaacugccaguacgccgaguucuucucgaauuuggcaga

SEQ ID NO: 4509 - RNA, 650 nt, Phyllotreta striolata
agcaggacaucaacaucaaucgccagcugagggagcuguugcagcggcagcaggucaagaagcuggacgaguuguugccgggcaaagcgccgccgccgccgccgcagagguuguggcacgcgaacgaucagcaggagggcggcggcgacgccucgaugacuucgggcggcgcccagggcgccgacgccaccuuucggcaaccucugccgccgggcguggucaaaccuagguuggccaucgcggccguuaacaggccgauauugaacgccguuagagugaaucaauuggaucccaggauucagaauuuggauccgaggaugagguugauuuugcaacaucagcaacaaagacuagcgacgggcauucaacagcaauucauccguuucacgucgaacgugcgaccgacgacgguggagcaguacgagcaacuguugcagcgucagggcaacaaucagaaucaaaugcacgccgaggaccagcagcagggcgucgcgcgaaugcccguagcccaaucgggcgucgugcaaagaccgcacgucgcccaggcgucggugacgggcgccgucgcgacggcuucuacggagagcaaucccagcgaggaagguauccccgauaacgugacugcggaauuggaaaaacuggaacaggaa

SEQ ID NO: 4510 - RNA, 770 nt, Phyllotreta striolata
aaagcuucaaaauagcgacggguuccgaagacgcugaaucuucuucagcaauuccgguugauacuccguuugugaaagucgacgggaaaaauguguuuagguucuucuggugggacgccuacguggauccgcaacaccaacaaggaaccgucuuccucuucggcaaaaccuacugcgaaaccuccaagaaauacgaaaguugcugcguagccguaaagaacauagaaagaacgcuauuuguuuuacccaggccuuuugaacuagaugagaacgguaaacccaccgauaaaccgguuacauucaaaacaguccacgaugaauucaacaaucguauauuaaagcgaacaggcauuacaucuuucaaaucgagauugaucacgaaaaaauacgccuucgacgcgaacauaccggccgaaucggaauauuuagaagucagauaccccgcgucauuuccgcggauccuuugcaacgaagaccgccaacacgacgacgacgaauccaccgacaacgacgaucucggcuacagcacuuucucgaagauauucggcaucaaaacgaacuucuuggagucccuuuuccucgaacguaagaucaaagggcccuguuggaucgacguguccgaucccgaaacggccgccaauccgaugaguuucugcaaguucgaagugaacugccugaagcccaacaaccugaaaaucaccccguucgagaaaccaguuccaccgccaccccucguagucgccaccauaaacaugaggaacugcaucaau

SEQ ID NO: 4511 - RNA, 685 nt, Phyllotreta striolata
ucacuaguauggcuggaucagagauauauucauuagagaugaguaaaacugaagcauugacgcaagcuauuagaaagaguauuggagucaggauaaaggaagagagugaaauuauugaaggugaaguugucgaucugagcauugaacguccagcaacaggaguugguacuaaaguggguaaauugauucucaaaacuacagauauggagacuguguaugauuugggcgggaaaaugaucgauaguauucugaaagagaaaguucagucuggugauguuauaaccauagauaaagcuacaggaaaaauuacgagauugggucgaucuuucgcuagagcuagagauuaugaugcuacuggucaacaaacgagguucguucaaugucccgaaggugaacugcaaaagcgcaaagaaguuguccacaccgugacuuugcaugaaauugauguaauuaacagucgcacccauggauucuuggcacuguuuucaggugauacgggagaaauuaaaccagaaguaagagagcagauuaauggcaaaguagcugaauggcgugaagaaggaaaggcugaaauuauuccugguguacuguuuauugaugagguucacauguuggauauagaaugcuucuccuuuuuaaacagagccuuagaaaaugaaaugucuccaauugucauaauggccac

SEQ ID NO: 4512 - RNA, 777 nt, Phyllotreta striolata
gggaaauuaucuucgccucuuuagaggaucccuguacaaaaaauauccuggaauguucaggagguccauaaccaaugaagaaagacgaagguugauugaacucgguuugagccagcauguucuagccaguagcguaucauugcuuagagcagaagaaguugaagauauaauugaaggaaaugaugaaaaguauaaagcuguaucuguacacacuuccgaaccuccuaugccaagagagggaaaauccaagaaaaacaugcaguggguaccuucguuacccaauuccagucacuuagaugccguuccacaagcuacaucuauuaauagaaacagaguagcugcuaaaaaggugagaacauuuccacuauguuuugaugacaccgauccccaaauaaacauagaaaaugcuugucaacaagaacugcuaguuccuauuagacucgacauggaaaucgaaggacagaagcucagagauacauuuacuuggaauaaaaacgagaguuuaauaacgccggaacaauuugcugaaguccucugcgacgaucuugauuuaaauccuuuaacauuuguaccagcgauugcucaagcgauuagacagcaacucgaugcauuccccacggaaccuccuaguauuauagaggaaaccugcgaucaaagagucauuauuaaguuaaacauucacgugggaaauacaucuuuagucgaucaagucgaaugggauaugagcgaaaagcaaaauaaucccgaagaauuugcguugaaacuuugcgcagaauu

SEQ ID NO: 4513 - RNA, 443 nt, Phyllotreta striolata
aucaauucccggaaguguacgugcccaccguauucgaaaauuauguggcggacaucgagguggaugguaagcaaguggaacucgccuuaugggauaccgcaggccaagaagacuacgaucgccugcguccccuuucauauccagacaccgacgugauuuuaauguguuucucggucgauucgccggauuccuuagaaaacaucccggaaaaguggacgccggagguaaaacauuuuuguccgaaugugccaauuauccugguaggcaauaaaaaggaucugcguaacgauccgacuaccauuaaugaacuuaaaaaaaugaagcaagagccugucaagccgcaagacggucgaucuauggcugaaaaaauaaacgccuuugcguauuuagaauguucggcuaaaaguaaggagggcgucagagaaguauucgagaaugccacc

SEQ ID NO: 4514 - RNA, 664 nt, Phyllotreta striolata
gcagcaaauugagagaagucuguccgcuguuuuauaaaaccgaagaugcggcauuuucaaaagccguggaaauauuaaagaugacgcgggcgauucaaaacaacgacgaaaaggaggagaugauccaaucggcccugcagauuugcaaaucaaucgggcccacuaucaauaucaccgauauaugcaaggaauucgcuaaucucaaagcguacaaagcuguuacggaauugugcgcgcauuucgguaagaaaauagaucccgauaaaauagcggagaguuacuauaacgccgaagauaacagcggugaccaagagggguacaauuauuaucaaagacgguuggaaauuuaccgucacauauugaacauguuggaucaauuauacaacgaacaaaaucaaacgcaagucauuaguagagauuccgcguacucgguuaaucagaccauauugcucgauggugucgaacaaucccaaguaggauacgugaugaagcaaguaauaaaagacgucauggaaacgcccgacgaaaucaugcauuucgcacuuuacgauuggcugguguucaaaaauaugacuggagauuugauaaacauccaaaaucccucgcuggaaacauauuugaagcgaacguccacccagaaucccaacaacaucgagaccaugaa

SEQ ID NO: 4515 - RNA, 706 nt, Phyllotreta striolata
cggaaauaaaugccaguuccauauuuuaaaacccuccauucgagaacaagaaaucucucugcauagauuggcugcucucgaaucgccauugaacgauuugauagacuucgcagcgcaauuagacugcuuguggucaguauggcgaucggacgugggcgaaacacugguguacaaggcaucguucaaauccaaccaauggacucaagucauacuggaacccgaaccgugcgaaaaacaguucccuaucaaauucaacgaugucaagaccauguacuuacagcacauuuuccacccgggcagguucccccugcacguuaucaacaaaacccuuucgauuuauaaaaugccuacgaucgccucggacucgcaucuuuccaucucggcgcuaaaacaaagaguaugcauggccguggaaaacgacauacaaaaucuguucaacagagacgggacugauauuaacagcguugaagucgaugaauacauagaaugcgccgaguggugcuggcagaaauucgacucccgcugcguacaauaccagauagccagcaggaaaccgcuggguuugaugcuccugccguccgucucgggcgccaugcuguugaagaaaucggcguuuucguuccugcggcccgucgauucgcucgaacacaugacguugugcaccgauuuguacagggagcaguucuucaauuuuuccauguuggcc

SEQ ID NO: 4516 - RNA, 658 nt, Phyllotreta striolata
uauuggcuccgauauugugggaacguccggcgaauaucagcccguuggugagauuguuggccgcguucgcuacgcaggcagccccucaaaucgugcuacaggacaaagugggcggauuuuuggggguguuccagaaguuguuggcaucgaaaucgaacgaucacgaagguuuccggcugaugcaaagccucauucagaaucuaccuaccgaagcucucacgcccuaucacaaacagauauucuuccuguuguuccaacgauugucguccaguaaaacgaccaaauacguuauuaauuugaucguguucuuuugcuuguauauggugaaguauucgcccaacgauuugguggcuuugaucgaugaaauccaagcucagauguuugguaugguucuggagaagcuucuaaucgcggaauugcagaaaaucgccggcgaugucgagaggaaaaucgucgcuuguggcguuacuaaauuacugugcgaaugcccggggauguauacggggucuuaccaaaaauauuggccgcaauuguugcaggcguuauuggcguucuucgagaugcccagagacgagacgacguuccccgaugaucauuucaucgaaguggacgauacgccggccuaucaagcgaccagcgcuaaauugaauuucgccga

SEQ ID NO: 4517 - RNA, 451 nt, Phyllotreta striolata
guucgagugcauagaggaauuaaaagaagauuuagaauggaagaugauuuacguuggcuccgcugaaacugaagaacacgaucaaauuuuagacuccguauucgucggacccauuccagaagguaaacacauguucgucuuccaggcagauccuccgaacgucucccgcauaccugaaaacgaugccaucggugucacagucguucuacucacuugcuccuauaaaagccaagaguuuauucguguagguuauuuuauaaacaacgaauacagcgauccggagaugagagaaaacuugcccaguccaccucaguucgauaagguaauuagaaauauauuggcguccgaaccgagggugacgagguuuaaaaucaacugggaagaaucgagugguacgcaggaaaacgguacuacaaucgcagaagcacccgccaaccaaacauccgagacu

SEQ ID NO: 4518 - RNA, 700 nt, Phyllotreta striolata
aacgcuuggucuagguuuaggccaugcuaugucuaugccacauacaaaguauguaacuggauuuucacugccuaucaguucuauggcuccucaaacaccacaacauacaaugaugaguccuaugguaaacguugguggaacugguaccacuaguucugguguaaccccuacauugggucccucuacaccuucaccaaugacuccuaugacaccgcauucagcagaucccggaaucguuccacaauuacaaaacaucgucucaacuguaaacuugagcuguaaauuagauuuaaagaaaauugccuugcacgcgagaaaugccgaauacaauccuaagcgauuugcugccgugauuaugaggauaagagaaccgaggacgacggcuuugauauuuucgucggggaaaaugguguguacaggugcgaaaagugaagaagacucgagacuagcggcgagaaaguacgcucgaauuauacaaaaguugggguucccugcgaaguuuuuagauuuuaaaauacagaauauggugggaaguugugauguuaaauuuccgauacgauuggaagguuugguuuuaacucacaguucuuucaguaguuacgagccggaauuguuuccuggucuuauauaucguauggugaaaccaagaauuguucuguuaauauuuguuuccggcaagguuguucugacuggugcuaaa

SEQ ID NO: 4519 - RNA, 454 nt, Phyllotreta striolata
uccaacaaaauccccuuucaaagcucagaaaauggcugcaaugcguuccaugucucgccuguuauucuccagaucauuucaaacuacuguaaaaagggguuaugcugaucaaaugagcuucacuuuugcuucuggaaaccaggucuucuacgaugcgaaaucaauaaaacaaguagacguuccuucuuucucugguagcuucgguauccuaccagcccacguucccacucuugcuguccucaaaccuggaguaguuacuguuuaugaagacggcgguucaguccagaaaauuuuuguauccagugguacagucacuguuaaugacgauucaucuguucaaaucuuagcugaagaggcccauccaguagaaaauuuagauauuagugcagccagggaucuucuuaccaaagcacaaagucaauugucaucggccacuacagaucaggcuagagcu

SEQ ID NO: 4520 - RNA, 688 nt, Phyllotreta striolata
agaaauacgagaaguccagcagggagcagcacgcggccgaauugaaggagaaacucgaacaagaagcgcgccggaaggcgaaaaaagaggccgaacgggcccgaauaaccgagcuaacggacgagcaagcggagaaacuccaagccgagcucgacgccaagaaggccccuucgagcgcccccgacgccccuucgagcaccuccggcgccccuucgacuuccaccgcuaagaucgaagaggacgaggacgaguccgagaaggguaaauuguuaccgaacaaaggcaacgggugcgauuuggacaaguacaguuggacucaaacccuuagugauauagagcugcgcgugccgcucgaaugcgauuuccgagccaagcaaaaggaucucacggugaacaucaccaaaaagcggcucguuugcggccucaaaaaccaccggcccaucaucgacgacgauuuccagcacgagaucaagcuggaggagaccaauugggugaucgaggacgggaaaucguugcuauucuccaucgaaaaagugaacaagaugaauugguggagcaaauuggugaaauccgauccggagaucagcaccaagaagaucaauccggagccgucgaagcugagcgaucuggacggcgagacccgaggcauggucgagaagaugauguacgaucagcgacagaaagagau

SEQ ID NO: 4521 - RNA, 339 nt, Phyllotreta striolata
aguacagcgauagagagagguggauuugcguuuauccagcguacauuaacugcaaaaaaaccauagcccaaggcaggaaauuaaacaaggaaaaaugcguggagaaucccacucaucaagagaucagagacguauuagucgcagcagguuugaaggucggcguggaaaacaaauuauacagcagggaacgaagcaaagaauuguuguaucgaggacgaauuagaguucaauugaaaaacgacgacgguacgcugugcaauccaaguuuucccacuagagacagcuuaaugcuccaucugggagacaugauuccuaaauugaagagcaggcaaaauaagg

SEQ ID NO: 4522 - RNA, 660 nt, Phyllotreta striolata
aguaaaucacgccagaaacuuaugggacagagccacaguucuuuuacccagaguaaaucaguuuugguacaaguacaccuauauggaggaaaugcuggaaaauguagccggagcaagagcaguauucgaaagauggauggauuggcaacccgaugagcaagcuuggcaaacuuacauuaauuuugaacugagauacaaagaaauugacagagccaggcaaauauacgaaagauuuguuauaacgcauccggaagugaaacauuggauuaaauacgcccgguuugaagaaaaucacgguuuuauccauuccgcuaggcagauuuaugaaagagcuguccaguuuuauggagacgaucacuuggaugagaagcuuuacauagcuuuugccagauucgaagaaaaccaaaaggaacacgauagagcuagaguuaucuacaaauacgcuuuagaucacauuccuaaggaugaaacgaaggaacucuauaaagcauauaccauccacgagaagaaauauggagacagaagcgguaucgaggaaguuauaaugucuaaaagaaaacugcaguacgaacaagaaauacuccaaaaucccaccaauuaugaugcuugguucgauuaccugagacucguagaaggagaggcugauuuggaaauaacccg

SEQ ID NO: 4523 - RNA, 791 nt, Phyllotreta striolata
ggagauccagcugaaauaggagccggagucugccuucugaucaucauccaacuguucguggcgggucucaucgugcuccugcucgaugaauuguugcagaaaggauacgguuuggguucggguauuucucuuuucaucgcuacaaacaucugcgagacgaucaucuggaaggcuuucucgccggcuacugucaacacuggaagaggaacggaguucgaaggagccgucaucgccuuguuccacuugcucaccaccagacaggacaagauucgaggauugcgcgaggcuuucuaccgccagaaccuuccuaauuugaugaaucuacuagcuacaguucuaguguuugcuauaguaauauacuuccaagguuucagagucgauuugcccauaaagagcgccagauaccguggccagcauucgagcuaucccauuaaacuuuucuacacuuccaacauuccgaucauuuugcaauccgcuuuggugucgaauuuguacguuauaucccagauguuggccguuaaauuccaaggcaacuucuucauuaaucucuuggggguuugggccgauguuggaggcggcggcccggcuaggucuuacccgaucggcgguuugugcuauuacuuaucgccgcccgagagcgugagccacaucuuggaagaucccguccacgccguuauguacauuauauucauguuggguuccugcgcuuucuucucgaaaacguggaucgaaguguccggcaguucggcuaaagaugucgcgaaacagcuuaaagagcaacagauggucau

SEQ ID NO: 4524 - RNA, 344 nt, Phyllotreta striolata
caggacaaguuauuacggcuuucuacgacguuguacguaggaaaccuaucauuuuacacuacagaagaacaaauuuacgaauuauuuucgaaaugcggcgacauuaggcgaaucgugaugggucuggacaaguauaagaaaacaccguguggauuuuguuucaucgaguauuacaaccgcgaagaugcagaaaauugcuuaagguauaucaaugggacaagauuggacgauagaauaguaagaacagacugggaugcggguuuuauagaaggcagacaauacggaagggggaaaaccgguggacagguuagggaugaguauagaacugauuaugauuccggucg

SEQ ID NO: 4525 - RNA, 657 nt, Phyllotreta striolata
aaauggaacuucauccucccagauuuccuugggccuacaaaggcauaauuacagcacuagaccaugcgaguuuacgacgugguuacgaagucuaccggcaaguuugcgccuccugccauucgcuuaaacacguaaccuuucgagaacugguuggaguuacgcacacugaagcagaggcgaaagccgaagcugagcagcaaauggucgaagacgggcccaaugaagaaggcaauauguuccagcguccugggaaauuauccgauaaauuuccgccuccauaucccaacgaagaagcugcucguuucgccaacgguggauccuacccacucgacuuaacuuacauaauauuagccagagaagguggcgauaauuauauuuucucgcuauugacuggcuacugugaaccaccugcagguguaacauuaaaagaaggauuguacuauaauccuuauuuucuuggagguucuauagcuauggccccaccgcuauuuucagaaucugcuacauauucugaugguacucaagcucaugccagucaacuggccaaggaugucguuacuuuucucaaaugggcuggagagccggaauuugacgauaggaaagugaugauggucaaaugcuuagguugguuuauagucgguucaguaauaucguggu

SEQ ID NO: 4526 - RNA, 663 nt, Phyllotreta striolata
ugcgugagaaccuauuauggacaccgacaggccguuagagauaucaauuucaacaauuccggaaagcauuucuuaucugcggguuacgacagguauauaaaauugugggauacggaaacgggucagguuuugucgcguuucaccagcaggaaaauacccuacugcguuaaauucaauccggauaggaacaaacagcauuuguucguggccgguacaucggauaagaagaucaucuguugggauacgagaucgggggauaucgugcaagaguacgacaggcauuugggcgcugugaauaguauuacauucgucgacgaaaaccgacgguucgugacgacuucggacgauaaaucguugagagugugggaaugggacauuccggucgauaugaaauacauugcagaucccacgaugcacagcaugccuucgguaacaccggcaccgaacgguaaaugguuggcuugccaaagcauggacaacaaagucgucauauucucuuccaugaaucgguuuaagauuaaucguaagaagacguucagcggucacaugguggccgguuacgccugcuccuuggacuuuucuccugacaugagcuaccugacgucaggggaugccgaugguaaaguguauauuugggacuggaaguccacuaagcuguucaag

SEQ ID NO: 4527 - RNA, 691 nt, Phyllotreta striolata
cuuuggcagugaaaaaggucgagcagaaaaaagaagugaauccccuauucgaaaagcgacccaggaacuucggaauaggccaagacauccaaaucccccgggaucuaucgagguucgugaaauggcccaaauacauccgcauccaaaggcagaaggccgucuugcagaagcgccugaaagucccgccgcccaucaaccaauucucccagaccaucgacaaacaaacagccacccaauuguucaaaguauuggagaaauaccggccggaaaccgcucuccagaaaaggaaccgauugaaggccaaagcugaagcuaaaguggccaagaaggaagagaccccuucgaaaagacccaauacuuuaagggcugguacuaacaccgucaccaaauugguugaacagaaaaaggcccaauugguggugaucgcccacgauguagacccuauugagcuuguacuauuccuccccgcgcucugcaggaaaaugggagucccuuacugcauaguaaagggcaaagcaagguuagggcugcucguuaggcguaaaacuugcgcggcugucgcccuuacgcaagucgauucaggugacaggucuaacuucaacaagcuuuuggagguuaucaagacgaacuucaacgaucgcgccgaugagaucaggaggcacuggggaggcgguauccucggaucgaaauc

SEQ ID NO: 4528 - RNA, 737 nt, Phyllotreta striolata
cauaaaggaauacggccagaaggaaaacaacuuugaauaugcaaugaccgauuauuugaggauauccggcauguauuggggccuuacggcccucgaauugaugaacgccucgcccccgcacacgauagaagagauuucagauuacauuaaacauugucaagaccccgaaagcggcggaauaagcucgugccucaaucacgacccucacauacugcacacacugagcgccgugcagauacucugcauguacgacaauuuaaaagccaucgauguggagggcgucgugaaguacgugaaaaaccuacaguuacccaacgguagcuucacgggggacaaauggggcgaaguggacacgagguucuccuucugcgccgucgccacguugucucuuuuaaacagaauggacgcuauugacgugaauaaagcagucgacuuuguagcuucguguaaaaacuucgauggcggguucggcucgaggccucuuuccgaaagccacgccgguuuaauauacugcugcuuaggauuuuuaucuguuaccaauagguuggauauaguggaucgagacaagcucgcuugguggcugugcgaacgacaacuaccuucgggggguuugaacggacgcccggagaagcugcccgacgugugcuacuccuggugggugcuguccucuuuaacgauacuaggcaaguugcauugcaucgaugccaacgcuuugaagaaauucauauuggccugcc

SEQ ID NO: 4529 - RNA, 697 nt, Phyllotreta striolata
cuuacauagccguaaccgaauuaccgcaaggacaauggccggaucucauaucgacgcucguaagcaacauuugccaagggaauuccaccgaaaugcaaaaggaggccacgcuggaggccaucgguuacaucugccaagaaaucgaguccgacguguuggugucccaaucgaacgauauauugacggccaucgugcacggcaugagauccuccgaaccgagcaaucacguacgauuagccgccacgcaggcuuuacugaacucauuggaauucaccaaggcuaacuucgaucucaccaccgaaagaaacuacauuauggaggugguuugcgaagccacgcagucgccggugucgcaaaucaagguggccgcuuugcaaugucuagugaagauaaugucgcuguauuaccaacacauggagcccuacauggcgcccgcgcuguuucccaucacguuggaggccaugaaauccgagaacgacgccgucgcccugcaggguauagaauuuuggucgaacgucagcgacgaagaagucgauuuggccaucgaggauacggaagcggccgaagcgggacggccuccuacaagaguaucgaggcauuaugcaaaaggagcucugcaguauauaauaccaaucauucuucaaaaacucacgaaacaagaggaguuagaugaugaggacgauuggaauccgaguaa

SEQ ID NO: 4530 - RNA, 690 nt, Phyllotreta striolata
gaccaacucuacgacauaccgaaagaacgaaagaccggcgaauacaggaaauaccugcucuaccucaucgaauaccucacgugguucgugcaacgcaucagaccgcugauggaccucgacagcgaucuccaggaccaggucgaacagguguuggccaauugggauaacgggauggugcccggguggccgaaagaaaccgguucggcuuuggccaacgucggcgcccauuuggaccugucggccuucuccagcugggaggaauuggccucguugggucuggaucguuugaaauccgcccucauggcguugggauugaaaugcggaggaacguuggaggaacgagcccagagauuguucucgacgaaaggaaaaggcucuuuagaucccucucucaugacgaaaaacagcaagaaccgcgugacgaaggagaaggaggcgcucaggcaacgggaacuggccacguuagaggcccaaauuuacagauuggccgaucuggugucagcccaacgggcggcgaccaaagagaacgugcaaaggaaacaggcccguacugacggcgaacgggacgacagcgagaacgaagagagcgaggaggagagccccgacgaggccgacgacgauguacccuacaaucccaaaaaccuaccgcucgguugggacggaaaacccauuccguauuggcuguacaaa

SEQ ID NO: 4531 - RNA, 507 nt, Phyllotreta striolata
uaucggcaccuuuaaagcuuucgacaagcauaugaacaugauacucggcgacugcgaagaauuccguaaaauuaaacccaaaaacucgaaagucgaacgagaagagaaacggguauuaggauuuguacugcugagaggcgagagcauagucucacuaacuguagaagggccuccaccaccagaagagggacuuccucgggugccuauucccggagcagcccaaggaccagguaucggaagagcagcagguaggggaaugccaccggguauggcuggagucccaguaggucugcaaggucccgugagaggagucggaggaccaucccagcaaguaaugacgccuacggguagaggacagguuucggcgccgccacaaaugaaccaagcgccuccgaggauggguggcccuccgccugguaugauggggccuccgcccggaaugaugggcaugccgccgcaaaugggcauggggcgcgguggaccgccuccgauggguaugaggggucc

SEQ ID NO: 4532 - RNA, 774 nt, Phyllotreta striolata
ucggauguccaucucuacuuuucacgaucuucuacaaagacugcaagauaaauugagaaaacaggauacaaacaugagaaaagccgucagcccugaagagaaauuagcgauauguauaagguauuuggccucaggauguuccuucagagacauacauuauaguuaccgaauagguauaucgaccaucagcaacauaauagaagaagugacagaaugcauuuggaauaauuuacaccaugaauuuaugccuauaaucgauaaaguguccgaaugggaaaaaauaucggaugcauuugaugaaaaagccaauuuuccccacugucuuggcgcaguugacggaaagcauaucaggcuuaaaaagccaucaaauagugguucaauguauaugaacuauaaagacuuuuuuucgauaguauuauuagcagugguagaugccgauuaucguuuuauuuacguuaguguaggcuccuauggaaaagagugcgauucgucgauauuuaaggaauccaauuuuuggaaaaaauuaacggaaggcagcuuaaauauuccucaaccaagaccucuaaccaccgacucaacaacugcgguuccuuauguaauaauaggcgaugagggauuuggauuacaugacaauuuauugagaccuuuugguggaacacacuuagauaaagaaaaaagaauauuuaacuacagguuaaccagagcccgacgguauguagagugugcuuuugggauuuuugcaaauaaguggaggauuuuucaucgacccuugga

SEQ ID NO: 4533 - RNA, 793 nt, Phyllotreta striolata
auaacgaggaggcggauauaauuauuucggaucagacuagcggcguggccgaagacucgauuucgacuaaagaggacuucgaggagcucaucgaugagggaucgaggaagaacaacguagggaaacaggaggugaccgcaaagcacauacaggacuuccaccgguacaccgaacuguucgauuacgguaaacccgauguuaagaaaccggccgcuaaaaaauuccaaccgaagguaucacucguuagaggagugacuuugcccagcaaacccaacgccgagaagauuauuaucacgcaaaauucgaacacuucgcaagcuuccaaaguuaccagcaucauucucacgcacaacgcuaacgugaggaggaacauuauaggcguaccgaagauagucaguaccguuucgccggcuauaacuauagugagcgcuaguaccucgcaaauggccucgauauuacccucuaaauucacggugccugucauaagcgcgagcgccguucgccagcuauccaacguaaaagucaucgauaaaccgucgucaucgucgcuaucgauuucgacgagagacaacguccugcccaagaagauauucgaggacgauucggugucucccgacagcaguucgaauugcgacgacgagaaaucgaaggauucguucgacgacaaggcgaaaugcgagucgccgccgcgcgaucucaaacagcccaacucgcagaucgucucguugaaaucgaaaaccuacgcggagcaaucgaagaagaucgaacaccuccaaaucgugaacguaucguc

SEQ ID NO: 4534 - RNA, 663 nt, Phyllotreta atra
uagagagggaauuggagaggcaaaagagagaggaagaaacgcaaaugaugcaacgaacuaaagaagcagcccaauucgaggaaugggagaggcaagaagauaaauuccacuuggaacaagcucgauugagaucucacauaagaauacaagacggacgagccaagccgauugaucugcuagcgaaguacauaagcgccgaagaagaagucgaugccgucgaaaugcacgagccuuacacuuaccugaauggcuugcaaaucaaagaccuagaagacuuagucgaagacaucaaagucuacaaagaacuagaaagaggaaaaaaccuagauuacuggaacgauauaacagucauagucgaagacgagcuucaaaaguugcgaaaaauagaaaaacaaaacgauuucgacuugggauugaaccgaagggaaggaauacaucaaucugucgccaccgaugugacaucaguauuuaaaggcaaaacagccgcacaauuagcagcuuuagaaaaacaaaucggaaguaaaaucagcagcaaagccgauggaauagacauaggcuauugggaaucuuugcuaucgcaacuuaaggcccacauggcgagggcgagacuacgcgacagacaccaagauagcuuaagaaggaagcugcaaguacuaaaagcag

SEQ ID NO: 4535 - RNA, 687 nt, Phyllotreta atra
cuuaaacggcuacgaaaucggcggcaggaacuugcgaguagacaacgcuuguacggaaaaaucccgcauggaaaugcaaaaccugcucaaccaaccgcccaucgagaaccccuacggcgagcccauccaagccgaaaaggccccggaggccaucagcaaggccguggccucccugccgcccgaacagauguucgagcucaugaagcaaaugaagacuaccauacaaaauaaccccacagaagcgagacaaaugcuauugcagaauccccaauuggcguacgcuuuacuacaagcccaagugguuaugaagauuaucgauccccauacggccgccagccuacugcacccgguuaaccaaguaccagccacuuugcugccgggggacaagaacguggcaguacaaguaccgaucaacaaccaguaccgggaacccccugcgcccguacaaccgcccaggcaggaguaccaacccguaccgccgccccugguacaucccaaucacguucaacagcccguuuuuaccggucaagauguggacuugcgaucgauggggaaugugaccgauccgagaaucaggcccaugauuguggaucaggauaugagacaaaugccggccguuauccagaauccccuaccgccuacuauuagcgaaagucuugccaaagcgggagauucgaaaccggauaa

SEQ ID NO: 4536 - RNA, 642 nt, Phyllotreta atra
cagacugaaagaaaugcgagaacaacucaaagauuuaaccaagcaguacgauaaaucagaaaacgauuugaaagcccuccaaaguaugggccaaaucguaggugaaguucugaagcaacugacagaagagaaauucauuguaaaggcaacaaacgguccccguuacguaguaggcugccgucgucagcuggauaaagccaaguuaaaggccggcacaagaguagcccucgacaugaccaccuuaaccauaaugcgguacuugccgagagaagucgauccguuaguuuacaacaugagccacgaagauccaggagacgucacuuacucagccauuggaggacuuuccgaacagauuagggaauugagagaagucaucgaauugccucucaugaaucccgaguuguuuaugcgagugggcauuacaccaccaaaagguugucuauuguacggaccgccuggaacugguaaaacucuguuagccagagcuguggcaucccaacuggacgcgaauuucuugaaggucguauccagugcuaucguagauaaauacaucggcgaaucugccaggcuuauuagagaaauguuuaacuacgccaagaccaccaaccgugcaucaucuucauggaugaaaucgacgcuauu

SEQ ID NO: 4537 - RNA, 637 nt, Phyllotreta atra
ccauggaagccauaucucacgcgggcacaugucugggcauccuggcgaacgauggaauccuucucgcugcagaaagacgcaacaccaacaagcuacuagaugagguuuucgucucggagaaaaucuacaaacucaacgacgauauggugugcagcguagcuggaauuacgucugacgcuaacguauugacaaacgaauugcguuugauuggacaaagauauuuauaccaguauggggaaucgaucccuugcgaacagcugguuucguggcugugcgauguuaaacaagcguauacucaauacggagguaagaggccguuuggcguauccaucuuguacaugggcugggacaagcauuacgguuaccaauuguaccaaucggauccgagcgggaauuauuccgguuggaaggcgacuugcauaggaaauaacaguuccgccgccauuucgaguuugaaacaggaauauaaagaaggcgauauggcuuugaaggaugccaaagguuuggccgugaagguuuuggcuaaaacguuagauauggcuaaauugacuucagaaaaaguggaaauggcuacucuuacacguagaaacgacaagaccaugauaaauauauuaaauagcaaagaaguggaagaacu

SEQ ID NO: 4538 - RNA, 785 nt, Phyllotreta atra
aggucuuacgccuaucgauaaauacuuguacucuucugaagaucacauuaaauccggagcucuauuagccugugguauugucaauugcggagucagaaaugagugugauccugccuuggcucuauugagcgacuauguccuacauaacacgaauauaaugaggauaggcgcuaucgugggccucgguuuagcuuacguuggauccaacagagaagcaguuuuaaguuuacugacucccgucuuuuccgauccgaaauccaacauggaagugaucgguaugucggcgcuagcuugcggaaugaucgcagugggaucuggaaaucuccaaguuaccaccacaaucaugcagacgcuaauggaaaaaucagaaaccgaacugaaagauacguacgcuagauuuuugccucuaggucucggcuugugcauguuaggcaaacaagaaggcaucgauuccauaauagccgcauuggaagucauaccggagccuuuuaaauccauggcaacuacgauggucgacauuugcgcuuacgcugguaccggcaacguacuuaaaguccaacauuuacugcacauuugcuccgagcauuacgacggcagcgacagcucagacaagaguuccaaagauaaggacaagaaagaugcuacggagaaggagaaggaccuuuccucgagacaagcaguggcuguacucgguauagcuuugaucagcaugggugaagacauuggcagugaaauggccuuccguaccuucgggcauuuguugcgcuacugcgaaccgguaauua

SEQ ID NO: 4539 - RNA, 742 nt, Phyllotreta atra
caaccaucaguaccagaacauguacauagagagaacuacaguugauaauucuccuucugcuacuguuuuguaucgggacgaucccaauuugggagcuucuagauuccaaggaaauuacgacauauccaguucccaaucgcaagugaaccuucuuccagcugcgucaggagaaaccuacuauacaucgaccccuaacuggacgccgacgagcagcgguacuuaccaacaacaauacccauccgggaccauaaacguccuucaggcggauucgacucaagccuucgggaguccauacauaaacgcgacauggucgucgaauucgauggaggacggacggccgucuagucaagagguacuagugaaagagugcguuaauuguggugcuagcgucacaccacuuuggcguagagacgguacggggcauuaucuauguaacgcgugugguuuauaccacaaaauuaauggggugcacagaccgccgacaaagccaaccaaaaaaccacaggcgacuggaaauagaagaaacggcguaacgugcgcaaauugcaaaacuaacaacacaacucuuuggagaagaaacaaccaaggcgagccaguuuguaacgcuuguggacucuacuacaaauuacauaauguuaacaggccuaucaguaugaaaaaggaagguauccagacucgcaaaagaaggcccaaaaacuccucugugggaaaccccgccagugcugcaggucaaguaagacuu

SEQ ID NO: 4540 - RNA, 762 nt, Phyllotreta atra
ccauuuccaccauuguaggaguguaccaugcgcauuuacugucgcucgauggacuucuaaucauaaucgaugguauagggaagagauucgacgaagcgaaagaucguacugauaccgaugagauuaguaguuauauaggagagaauacgagaauuaaagguuguguuaaaguucccgauaagaagguguuggcugcgaagaaagggaucaaaaagugguuaccgcaagguacagaguauuucaaucagaagccgaagaaagguauacaguuccugcaggaacacggcguuuugaagcaggagcucgacguggaagagaucgcuagauucuugcgggagaaucccgcauugaacaaagcgaugauuggugaguacaucagcaaucgggggaauuugaagauccucgaggcuuucgugagcacguucgauuucacugggauccgaaucgacgaagcgcuuagagcguuuuuggagacguuucgauuaccaggcgaggcuccuacgauuucguugauucucgaacauuucgccgagcauuggcacaaaagcaacggagaaccauucgcugauguggacucggcuuuuacauuagccuaugcuguuauuaugcuaaacgucgaccagcacaacgaaaacgccaaaaaacaaacaauuccgaugucaccuaacgcguuuaagaagaaucugaaaggcguaaauggaggcgacgacuucgaggaggacaugcucgacgaaauauacacuucaaucaaaagcgaggaga

SEQ ID NO: 4541 - RNA, 480 nt, Phyllotreta atra
auacaagcccaaacgguggccacgaauuucgagaaagucuucgaaaugggcccccaccuguucguggggcuccccggccucgccaccgacacgcaaacggucauggagaagcucagauuccgcaagaacuuguacgaauugaaagaaaacaggcgaaucucccccaaaguguucgcggcgaugauaucgaacauguuguacgagaagagguucggaccguucuucgucgaaccggucguggccgguuuagcucccgauacauucgagccuuacauaugcaacauggauuugaucgguugcaucaacgaaccuagugauuuugucguagggggcacagccucugcgcaauuguauggaaugugcgaaucuuuaugggaaccuaaucuagcccccgaugauuuauucgaaaccauaucgcaggcuuugauuaaugcuuucgauagagacgcuauauccgguuggggugcuacgguuuauauu

SEQ ID NO: 4542 - RNA, 754 nt, Phyllotreta atra
ggaauuguguucgaugcaauugucgccgcugugcaguuugauggagaacgacguucggccggugaaagggacccugacggauccggugcugugguuggaucgauugaguucgguuuugcgauacguuaacgucaauauagucgaaggcgaaauccauccuugcaagccgguaauauuggagauauggccgauacugucccgagcauucgacaccuaccacagcgacgugcgaauaauggaaaggugcugucguucggugcguuucauguugcgcugcguggcccgccagcugcaggauuugcugcccucuuuggucgggcaaaucgugcacauuuacugucgcuacgggcauucguguugcuuguacgugggcagcaucuugguggacgaguacgccggcgacgcgacuugcgugcaaggucugcucgacauguugaacgccuuuuuggagccgacguuucgcuuguugcaagaggagaacggcuugaagaaccauccggauaccguggacgauuucuuuagguuaugcgcucgauucguacagagggcgccuaaggcguuucuaagcggcggggcccaucuggcgcccauuaugcaaugugcucuucucgccgccaccuuagaucacaaggaggccaacgugucgguuaugaaguuuuucuacgauuugauaaaccagggauugagcgguagaggugagcccgacuucgacgagagaaaagccuuaguuagaagccuacuaaacgaauacggu

SEQ ID NO: 4543 - RNA, 744 nt, Phyllotreta atra
guuacaacagaagaacagcgacuauagucauggcacuaguaagaaaaaaaagaaacucgccgauaaaauucuaccccaaaaaguaagagauuuggugccagaaagccaagccuacauggaccuguuagcuuucgaacguaaacuggauuccaccauuaugcgaaagcgauuagacauccaagaagcccuaaagcgccccaugaagcaaaaaagaaaacugcgaaucuucauuucuaacaccuucuacccagcgaaagaaccccaacccgaaggccccgacggcccuugccaagaaggcacaguagccucaugggaacugagagucgaaggcagacuucuggaagauuccaagaacgauccgaacaaaguaaaacgcaaauucuccucguucuucaagucuuuggucaucgagcucgacaaagaacuauacggacccgacaaccacuuggucgaguggcacagaaccuuaaccacccaagaaaccgauggguuccaggugaagagacccggagacaagaacgugagaugcacgauucuccuacuccucgacuaccaaccucugcaauucaagcucgauccgagacuggcccgauugcuuggcguacacacgcaaacaaggccagugauuauaucggcucuguggcaguauauuaaaacccaccggcuacaagacggccaugaacgcgaguacaucauuugcgacaaguauuuagagcagauuuuuaacuguacucgcaugaaguu

SEQ ID NO: 4544 - RNA, 288 nt, Phyllotreta atra
agcccacauuggaugaauuagaacaaaaaaugagagaggccgagaccgaaucccacgaaggaaaacgaaagaacgaaucucuguggcccauauucaaaauucaccaccaaaaaucccgauacaucuucgaccucuuuuacagaagaaaggcaaucagccgcgaacuguacgaauauugcuuacuggaaaacaucgcugacaagaauuuaaucgcaaaauggaagaaacaaggcuacgagagccuuuguugccugagaugcauccaagcaagagacaccaauuucggaa

SEQ ID NO: 4545 - RNA, 678 nt, Phyllotreta atra
gggcccacaauuuagaagaugaauuucgaacuauaaggcaaauagugcagaaauaccaauaugucgccauggacacugaauuucccggagucguggccaggcccauaggugaauuccgaaguucggccgauuaccaauaccaaauguuaaggugcaacguagacuuacugagaaucauucaacuagguuuaacguucuuagaugauaaugguaaaacaccaggagguguuuauaccaccuggcaguucaauuuuaaauucaaccuucaagaagacauguaugcacaagauagcaucgauuuacugcaaaauucaggaauccaauucaagaagcacgaagaugaagguaucgagccguuggaguucgccgaauugcuaaugucgucuggaaucguucucauggaaaauaucaaaugguuaucguuucauuccggcuacgauuucggcuauuuaauaaaguuacuaaccgacaacaaucucccacaagaugaaacugaauucuucgaucuguugaaauuguauuuuccuacgauauacgacgugaaguauuuaaugaaaucguguaaaaauuuaaaagguggucuucaagaaguugccgaacaguuagaauuggaaaggauugggccucaacaucaagcuggaucggacucgcuuuugaccggaauggccuuuuucaaaa

SEQ ID NO: 4546 - RNA, 756 nt, Phyllotreta atra
caucuucgcauaugguuucgagaagccuucggcuauucagcaaagagcuauuauuccugugaugaaaggccgagauguuauagcccaagcacagucagguaccgguaaaaccgcuacauucuccauagcuauucuacaagcccuggauuuaacgaugagagaaacgcagguguuguguuuauccccaacgagagaauuggcuguacagauucaaaaaguuauauuagcucugggcgauuucaugaacguacaaugucaugcuugcaucggggguaccaaccuuggagaagacauuagaaaguuggauuauggacagcacguuguuagugguacaccuggaagaguuuacgacaugauucguagacgagcucugagaaccagaucagugagaaugcuaguccuggaugaagccgacgaaaugcuaaacaaaggcuucaaagaacaaaucuacgauguguacagauuccuuccaccguccacucaagugguucucauaucugcuacguuaccccacgaaaucuuggagauaacguccaaauucaugaccgaucccaucaggauucuagucaaacgugaugaacugacgcuggagggaaucaagcaguuuuucguggccguggagagggaagaauggaaauucgacacccuaugcgaucuguacgacaccuuaaccaucacgcaagccguaauauucugcaacacgaagagaaagguggauugguuaaccgaaaagaugcgagagaauaacuucaccgu

SEQ ID NO: 4547 - RNA, 794 nt, Phyllotreta atra
caacagucgagucucuuagguccuuuggcagucgaugcuguucuuaaaauuguugaaccagggcaagaacaagcauguaacuuauuggacgucaaagugauuaaacaauugggugguacuguagaagauaccgaguugauugaggguaucguuuucucgcagaaaucugcuaacguaucuggccccaagagaaucgaaaaggcuaagauugguuuaauccaauucugcauuucuccuccgaaaaccgacauggaccacaauguuauuguaucagauuaugcugccauggaucgaguuuugaaggaagaaagagcuuacauuuugaacauuguuaaacagaucaagaaagccgguuguaacguacuuuugguucagaaaucgauucucagagaugcugucuccgaucuggcccuucacuuuuuggauaaaauaaagugcaugguugucaaggauauugagcgagaagauguagaauucguaugcaaaucguuggguugucggccaaucgcaucacucgaucauuucaccgcagagaaucuaguaacugcugauuuggucgaagaaguuggaguaggcgguaaccgaauggugaaaauaacagguauucaaaacgccgggcguacuguuacccugcuugugagaggcucgaauaaacuaguauuagaggaggcugagaggucucugcacgacgcucuuugcgucauucguugucuuguucgcaagaaggcgcugaucgcagguggcggggcaccggaaauugaagucgcucuuaagcuggcugcuauggcuaauaa

SEQ ID NO: 4548 - RNA, 738 nt, Phyllotreta atra
agagcuagacauggaggauuuguacacgaaauacaagaaacuacaacaaacccuggaauuccuagaaguccaggaggaguacaucaaagacgagcagaggaacuugaaaaaggaguaccugcacgcacaagaagaagucaaacguauccaaucaguaccgcuggucaucggccaauuuuuagaagcgguagaucagaauaccggcaucguuggcucaacuaccggcucgaauuacuacguucgcauucucuccaccaucgacagggagcuacugaaacccucugccagcguagcccugcacaagcacagcaacgcuuugguggacguguuaccccccgaagccgauuccuccauuagcaugcuccaagccgacgagaaaccggacgugcaauacagcgacaucggagguauggauaugcaaaagcaggagauucgcgaggccguggagcugccguugacccacuucgagcuguacaaacaaaucgguauagacccgccgaggggcgugcugauguacgggccccccggcugcggcaaaaccaugcuggcuaaagcuguagcucaucacaccacagccgcuuucauucgagugguggguucggaguucgugcagaaguaccugggcgaggggccuaggaugguuagagauguguuucguuuagcuaaggagaauucgccggcuauuauauucaucgaugaaaucgaugcgauagcuacuaagagauucgaugcucagac

SEQ ID NO: 4549 - RNA, 362 nt, Phyllotreta atra
gacgauaaaaaccaugcuggaggaccucggcauggacgaggaagaggaggaaguggugccguugcccaacguaaacucagccauucuacggaaggucauccaaugggccaccuaccacaaagacgacccacccccgcccgaagacgacgacaacaaggagaagcgaacggacgacauauccucgugggacgcggauuucuugaaagucgaucaaggaacgcuguucgaacugauccuagccgcgaacuaucucgauauaaaaggcuugcucgauguuacuuguaagacuguggccaacaugauaaagggcaaagcgccggaggagauacguaaaacguuuaacaucaaaaacgauuucacgc

SEQ ID NO: 4550 - RNA, 754 nt, Phyllotreta atra
ugugugauaaggcgaaagaaauacuguccaaagaaucaaaugugcaggagguaaaauguccugucaccgucugcggagaugugcacgggcaauuucacgaucugauggaauuauuuaggauagguggccgaaguccagauacgaauuaccuuuuuaugggugacuaugucgaccguggguauuauuccgucgagacuguuacucuuuugguggcuuugaaagucagguauaaagaaagaaucacgauccugaggggaaaccaugaaucaagacaaaucacucaaguauauggauucuacgacgagugccugcgaaaauacggaaacgcgaacguuuggaaauucuucaccgaucuguucgauuacuugccgcuuacggcgcucgucgauagucaaauauucuguuugcacggagggcucaguccuagcaucgauaccuuggaccauauuagagccuuagaucguuuacaagagguuccucacgaaggcccgaugugcgaucugcucuggucggaucccgacgaucgcggagguuggggcauuucuccucgcggcgcaggauauaccuuuggacaggauauaucggaaacguucaaccacagcaacgguuugacgcuggucucucgggcccaucagcucgucauggagggguacaauuggugccacgacagaaacguuguaacaaucuucagugcuccgaacuacugcuauagaugugguaaucaagcugccauuauggaauuagaugaugcgcu

SEQ ID NO: 4551 - RNA, 792 nt, Phyllotreta atra
acuaucgagaacguuaaggcuaaaauccaagacaaagaggggauuccuccagaucagcaacgucuaaucuucgccggaaagcaacuggaagacggaagaaccuuguccgacuacaacauucagaaagaguccacacugcauuuaguucuucgucuacguggaggaaugcaaauauucgucaaaacucuuacugguaaaacuauaacccucgaaguugaaccaucugauacuaucgagaacguuaaggcgaaaauccaagacaaagaggggauuccuccagaucagcaacguuuaaucuucgccgguaaacaacuggaagauggaagaaccuuauccgacuacaauauucaaaaagaaucuacucuacauuuaguacuucgucuccguggagggaugcaaauauucguuaaaacucuuacugguaaaacuauaacccucgaaguugaaccaucugauacuauugagaacgugaaggccaaaauccaagacaaagaggggaucccaccagaucagcaacgucuaaucuucgccgguaaacaacuggaagauggaagaacauugucugacuacaacauucagaaagaguccacauugcauuuaguucuucgucuacguggaggaaugcaaauauucguuaaaacucuuacugguaaaacuauaacccucgaaguugaaccaucugauucuauugagaacguuaaggccaaaauccaagacaaagagggaaucccgccagaucagcaacgucuaaucuucgccgguaaacaacuggaagauggcagaacauugucu

SEQ ID NO: 4552 - RNA, 748 nt, Phyllotreta atra
gaggaauacagaucguugcuggacaaaugcgccgccaccgcgaugagcucgaagcugaucaacaaacagaaaucguucuucuccaaaaugguagucgacgccguguugcuccucgaugagcuccugccguugaacaugaucgguauaaagaagguccaaggcggcgguuuggaggaauccaugcugguggcuggaguggccuucaagaaaaccuucucguacgccggguucgaaaugcagcccaagaucuacaaagacugcaagaucgcccuguugaacaucgaauuagaacugaaagcggagagggacaacgccgagauccguuugagcagcgucaaggaauaccaaaaaguagucgaugccgaguggaacauccuguacaacaaacucgagaaaaucuacgaauccggugcuaacgucguacuauccaaacuacccaucggcgacguugccacgcaguacuucgccgacagggacauguucugcgcuggcagaguccaagaagaagacaugaagaggacuuugaaagccugcgguggcuccgugaugaccacagccaacgauuugaaagaugaagugcuagguaaaugccagcuguucgaagagaaacaaauaggaggcgaacgguacaacuucuucaaaggcugucccaacgccaaaaccugcaccaucauccuacgagguggagccgagcaauucuuagaagaaaccgaaagaucccuacacgaugcuaucaugauuguacgca

SEQ ID NO: 4553 - RNA, 681 nt, Phyllotreta atra
ggcgagcaauuagaaguagacgucagaucguuggaaacguguccuuacuccgccaacaccuucgccgacauauuaucgaagauccaacacgcugucgacgaucuaucccugaagcaguucucgaaccugcacauuuggguguugcgauuggacgaggaagucgagaagaaccucgccaggcgacuccaagcgggcgucgaagccuggacggaagccuuaagcggccagaagaaagaaaucgaucauagcauggacacggacgccccggcccaacccacccacaaacccggaggcgauccccaaauccaaaccaugauacacgaagugcgaaucaccaaucaaaccauguacuuguuuccgagcaucgaagaggcccgguuccugauuaugcagcaauuguucgcuuggcaggcgaucgugacgugccagcaacgucuucaaagcagccgcuaccaagugggcguggauaagccggucguugaaacuuacaggaauauuuugacuagauuaccggccggcgcucaaccguugaucaacgcuuacagugcuauuucuucuaaaauuaaagagguucaaaauuauguaaaugaaugguuaacuuaccagucucugugggaucugcaagcugauaaucuuuacgggaaacugggagaagauauuagcaaauggauggaaugucug

SEQ ID NO: 4554 - RNA, 699 nt, Phyllotreta atra
acccuuucagagacgaucuaauccaagccguuaaagaguaccaagugcugauuauaaaaggugaaaccgguucgggaaaaaccacacaaauaccgcaguaccuccacgaagccgguuucacugcugaugguaaaaaaaucgguugcacccagccuagaagagucgcugcuaugucaguagcagccagaguagcccaagaaauggacguaaagcuaggcaacgaagucggauacgccaucagauucgaagauugcacauccgaacgaaccguuauaaaauacaugaccgaugguacuuuacacagagaguuucuaucagaaccggacuugcaauccuacagugugaugauuauagacgaagcucacgaacgaacgcuucacacugauauauuauucgguuuggugaaagacauagcuagauuuagaccagauuugaagcuguuaauauccagugcuacguuagauguuaccaaguuuucggaauucuucgacgaugcuccgguguaccaaaucccaggcaggagauucccaguggauauuuacuacacgaaagcccccgaagcagauuacguagacgcuugcguuguuucaauacuacaaauacauguaacucaaccauugggcgauauuuuaguauucuugacgggucaagaugaaaucgaaacuugccaugaacuccugcaggaucgaguaagauguu

SEQ ID NO: 4555 - RNA, 651 nt, Phyllotreta atra
aagaauugggcaacaaagugccauuuugccccauggugggcucugaagucuacagcacggaaauaaagaaaaccgaaguacucauggaaaauuucagacgagccaucgggcuuagaauuagagaaacgaaggaagucuacgaaggagaagucagcgaacuaacuccugucgaaacagaaaacccagcaggagguuacgguaaaaccgucagucacguuguaaucgguuugcggacggccaagggcagcaagcaauugaagcuggaucccagcauauacgaggcccugcaaaaggagaaggucgaggugggagaugucauuuacaucgaggccaccagcggggcugugaaacgacagggaagguccgaugcuuaugccacggaauucgauuuggaagccgaggaauacgugccccuuccgaagggggaugugcacaagaagaaggaaguuguacaggauguuacuuuacaugauuuggacgcugcuaaugcgaaaccgcaggguggucaagacguguuguccaugauggggcaacuguuaaaaccaaagaaaaccgaaauaacagauaaacucagaaaggaaaucaauaaaauuguugacaaauacauugaucaagguauugcugaauugguaccggguguauuauucaucg

SEQ ID NO: 4556 - RNA, 653 nt, Phyllotreta atra
auccggacuuuuggcuuauucguuggcuuuuuugaacaacguuaguuacaaugucgucgaauuugccaaaucacaaauagaauggaugagcgauaaucuaaugaggaguuucgaaggagccagaaacaaucccuuccaguucaaauauuugcagcuaugccacaguuuaggggaguugagcaaagugcccaguccgaaggucguacuggcuaguucgccugauuuggaaaguggauuuucuagggaacuguuuuuacaaugguguucuaauccuaauaacaguauuauauuaacuacaaggaccucaccaggaacuuuagccagggauuuaauagacaauggaggaggaagaaccauagacuugauaguagagcgaagaguuaaauuggaaggccaagaacucgacgauuaugaaaggcgacaaaggucuaaauaugacaaauuagaagaagaugaagccgauuccgauucggauuccgauauugaaaugucagucaccucuaaaggcaaacaugacauuguuaucaaacaagaaggcaaaauauccacaggguuuuuuaaagucaccaaaaaaauguaccccauguauccuuucaaggaagauaaaauaaaguccgacgaauacggcgaaauugugaaagcggaagauuaca

SEQ ID NO: 4557 - RNA, 753 nt, Phyllotreta atra
gaacaacgggacaaacaaauguccgauaaaaugaaccaagacacgguguacgcggccgguagcgccaucgacgcuucgcugaaguugcuagccgaaagacguacggauauuuucggcgugggcgacgaagaaacggcuaucggcaagaaaaucggcgaagaggacgugaggaaggacgaaaaggugacgugggacgggcacacgagcagcguggaggcggccacgagggcggccagggccaacaucacgcuggaggagcagauccaucagauacauaaagugaaggggcuguugccugaugaggagaaggagaagaucgggccgaagaauaucgguucgaagaagauuaauauacagagcguuauuacuacgaagccggcgaaucaagcugcgcagcaacccaaaccgccggucucgaugauccaaaccggcgcccaaccaauaauuccaacgcaacccgcgaugcuggccccgcaaccguccaucaugaugaugccagcgccgccuaugcccaccauucgaccgccgccauugaugaugcccggaggcguggcgaugggcgguuaucccguaggccccaugcccccggggcccggcaugaacauggcccccaugaagcaccccaacgaggggcccagcgaggacgagccgagcaacaagaaguugcgaaacgaggauucguuggugcccgagaacguguuccuguccaggaauccgagucaagugucuaucaagauuucgauaccggugaug

SEQ ID NO: 4558 - RNA, 703 nt, Phyllotreta atra
ugaggacgacaaagacaaaucuguaugguucuuggaccacgacuaccuggaaaacauguacggcauguuuaagaaagucaacgcuagagaacgagucguugguugguaccacaccgguccuaaauuacaccaaaacgacaucgcuaucaacgaauuaguucgaagauacugccccaauucagucuuggugauuauagaugcgaaaccuaaagaucuggggcuuccuacugaagcauaccaagcgguagaagaaguccacgaugauggcucacccacaucuaaaacguuugaacacgucccgagcgaaauaggcgcagaagaagcugaagaagucggaguagaacauuuacuaagagauaucaaagacacuacagugggaacuuuaucucagaggauuacuaaucaguuauuaggccuuaaaggguugcauuugcaauugaaagauauaagagacuauuugaugcaagugugcgauaacaaacugcccaucaaccaucagaucaucuaucaauugcaggauauuuucaauuuguugcccgauauaaaucaggaugcguucaacaauucguuuuacguuaaaaauaacgaucaaaugcuuguaguuuauuuaggggcucucguucgaucuaucgucgcauugcacaaccuaaucaacaacaaacucaccaacagagacgcagaagaaggcaaaaaggaggagaaa

SEQ ID NO: 4559 - RNA, 746 nt, Phyllotreta atra
agggaguauccgauauagcccagcacuuccugcucaaggccggcaucaccgccaucaggcgcgucagaaaaucugacaacaaccgaaucgccagagccuguggcgccgucaucgucaacagaaccgaggaacuccaggaguccgacgucggcaccggagccggcguauucgaaaucaagaaauucggcgacgaguacuucuguuucaucgacgaaugcaaaaauccuaaggccuguacgauccuucugcgaggagccagcaaggauauucugaacgaaaucgagcgaaaccuccaagaugcccugcaagucgccaggaacaucgugcugucgccgcguuuggugcccggcggcggggccauugaaauggccguggcccaacgguugaugcaaaaggccacgcacgggcccuaccgggcgcucgcccacgcguuggaaaucauuccgagaacguuggcgcaaaauugcggcgccaauaccaucagaacguugacggcgcugagggccaagcacgccaaccacgcugaagccgacaaaccgugcacuugggguaucgauggcgaaagcggggaauuggucgauaugaaaaucaaaggcuugugggagccguugucugugaaacugcaaaccuacaaaacagccguugagaccgccauucuccuguuacguaucgacgauauuguaucgggauccaaaaagaagggcgacaaggaggucccgacgcccagucaaaugcaacaacaggaa

SEQ ID NO: 4560 - RNA, 562 nt, Phyllotreta atra
cagauuaauccguacgcugauaauggaggaagcguaguagcaauugcaggaaaagauuuugugguuauuggcgcagauacgcgucuuaguuccggcuuuuccauuuacacgaggaaccagaacaagcuguuuccucugucugagacaacuguuuuaggauguucagguuguuggugcgauacuuuaacguugacucguauuauaaagucucguaugcaaauguacuaucaagagcacaacaagaacaugucuacaacagcggcugcucaaauguugucgaccauguuguacuauaagcgauuuuucccuuauuacauaucaaacauucuuguuggauuggauaaugagggaaaagguugcgucuacagcuacgaucccguugggcauugugaaaaagcuaccuaccgagcaggugguucugcaggagcuuugcuucagcccuuauuggacaaucaaauugggcagaaaaauccacagaagccuucgcaagaagaucuuacucaggaaaaagccaucucuacacugaaggaugucuucauuucggcugcagaaagggauauuu

SEQ ID NO: 4561 - RNA, 704 nt, Phyllotreta atra
caugaccuacaagugcuacucgguggccauguucccgggaaacgaaagacaggacgucgaacgugguggaaaaauaaucaugccaccuucggcacuggaacagcuuacucgauuaaacauuaacuaccccauguuguuuaaacuaguuaauaagaaaacaaaucguacgacucauuguggcguauuggaguucguagcggacgaaggaaaggucuaccuaccauuauggaugaugcacaauuugguacuaaccgaaggcgauuuggugcaaauggaaagcgucucguugccagugggaacguuuuccaaauuccaaccguugaauccggauuuccucgacauaaccaacccgaaagccguacuggagaauugcuugcggucuuuugcuugucugaccaccggcgacguaauagcugugagguacaaucaaaaggccuacgaauugugcguauuggaaaccaagccugguaacgccaucaguauaaucgaaugcgauaugaacguggaauucgccgcuccuguuggcuacaaggaacccgaacaagcuaaaaaagaagaagaaaugucuguggaucccgcagacuugaugcccgaaccgucgggauucguggcuuuuaggggggcugguguucgauuggaugggaaaaaacgcaaagauucuucaucuaaugacacuccuucgguuaaaccgguuuacguuaggg

SEQ ID NO: 4562 - RNA, 709 nt, Phyllotreta atra
aaaguugcgaugacuacacuggguucgaaaauaauuaacaagugucacaggcaaauggccgaaauugccguaaauggcguguuagcaguugcggaucuccaacaaaaggaugucaacuuugaacucauuaaaguagaaggaaagguuggcgguaaauuggaggacacgacauuagugaaaggugucgucauagauaaaacaaugucucauccacaaaugccgaaggaacuuaagaauguuaaauuggccauccucaccuguccguuugaaccucccaaacccaagaccaagcauaaguuggacgucaccagcgucgaagacuacaaagaacuaagauuguacgagcaagaaaaauucaaggaaauuguuggcuuagucaaaaaagcuggagcuaccuuggcuauuugccaauggggauuugacgaugaggccaaccauuugcuguugcagcaggaguuaccugcuauaagauggguuggcgguccagaaauagaacuaauagcuauugcgaccgguggaagaauaguaccaagauucgaggaacucagcccugagaaacuugguucugccgguuugguacgugaaauaucguuuggaacuaccaaagauaagaugauggugauugaagaaugcucgaauucccgugccguuaccauucucgucagaggcgguaaucaaauguugguugaugaagccaagaggaguuuac

SEQ ID NO: 4563 - RNA, 202 nt, Phyllotreta atra
aaaggugagaagaaacgguucgaggugaagaaguggaacgcuguugccuugugggcgugggacauugucgucgacaacugugccaucugucguaaccacaucauggaucuuugcaucgaaugccaagccaaucaagcugccgccaccagugaagaaugcacagucgccugggguguguguaaccacgcuuuucauuuucacu

SEQ ID NO: 4564 - RNA, 657 nt, Phyllotreta atra
cucgaaaauucuaucgcagcacaaagaacacuucgcgaagcucgccguggacgccgugcugagauugaagggcucuggugauuugcaagccauucaauugaucaaaaaaaccggaggaacuuugcaagaaucguuccuugaugaugguuuccugcucgauaagagaccuggcguacaccagcccaagcgagucgagaacgcuaagauccugaucgccaacacuccgauggacaccgauaaaaucaagguauucggcucgcacaucaaagucgacucgauggcuaaaaucgccgaauuggaauccgccgagaaagauaaaaugaaggacaaagucaacaaaauccucaagcacaacgccaacguauucaucaaccggcaacucaucuacaacuaucccgaacaauuguucgcagaugccgguguaauggccauugaacacgccgauuucgaugggaucgaaagacuggcgcuggucaccggaggagaaauagucucaacuuucgaucacccggagcucgugaaacugggaacuugcgaucugaucgaacaaaucaugauaggagaagauacucuccugcguuucagcgguguggccuuaggugaagccugcacgauagucauucgaggagccacccagcaaaucauagacgaggcaga

SEQ ID NO: 4565 - RNA, 656 nt, Phyllotreta atra
gccgucauaauagcccuaaaacgggccucguccgaacuauccgcuuaccaaaagaagaucauucaaaucgacgaucacaucggcaucaccaucucgggccuaacggcggacgcgagaaucuugagcagauauaugcgcaacgaauguuugaacuacaaguacucuuuagacgcuuacaugccuuugaauagauuaauuaacaucuuagguaucaaaaugcagcacuguacucaacgauacgaucgcagaccguucggcgugggucugcuaguagccggcugcgacgacaacggggcccacauauaccaaacgugccccucggcgaauuucuacaauugcaaggccaugucgaucggggcgcggucccaaagcgcucgcaccuaucuggagaagaagcucgacgaguugccgucguguucgcuggaagauuugaucaagcacggcuugagggcucuaagagacacucugccgccggagguggauuugaauacgaagaacgugucgaucgguuacgugggcaaagggauuacguuuaagauauuggaggaggaggagacggcucccuauuuggcuuugaucgagggcgaggagcguagaggaggcgcuggugguggcggcgguaguuccgaaggacaggccgauccuuugagggaauc

SEQ ID NO: 4566 - RNA, 658 nt, Phyllotreta atra
guaaauaaugccuucgagcguucguugguguucaugcacaagaugccucgaauuuggauggacuauugcacguuucucacagaucaaugcaaaauaacgagaacacgaaagguguuugacagggcucugcgagcccugccuguuacgcagcacaacaggauauggccuuuguaucugaaguucgugcagaaacacgauauaucagaaacugcuguucgaguauucagaagguacaugaaauugugucccgaaaacgccgaagaauacauagauuacuuaacaaaaguagaaagauuagacgaagccgcuauaauuacagcuaaaauaguaaacgacgauaacuucguaucgcaacagggcaaaucgaagcaucaacuauggaacgaacugugcgaauugauuuccaaaaaccccgaaaaaguucgcucucuaaacgucgacgccaucaucagaggcggccugcgcagauacaccgaccaauugggccacuuguggaacucuuuggccaauuacuacguucgcagcggcuuguucgaacgggcuagagacaucuacgaagaggccauacaaaccguuacaaccguuagagauuucacacaaguguuugaugcuuaugcgcaauucgaagaguuaaguuugagcaaacgaauggaagaag

SEQ ID NO: 4567 - RNA, 656 nt, Phyllotreta atra
gcgguuuagacgacaaaguaucggaaucucugcuaugggaacucuucgugcaagcggggccguuagugaacguacauaugcccaaagaucgcgucacgaugaugcaccagggcuacggcuucgucgaauucaugggcgaagaggacgccgauuacgccauaaaaauaaugaacaugauaaaauuguacgggaaacccauacgggucaacaaggcguccgcucaccagaagaauuuggacgucggagcgaacauuuucauaggcaauuuggacccggaagucgacgagaaacucuuguacgacacguuuucggccuuuggcgucauauuacaaacgcccaagauaaugagagaucccgagacugguaauuccaaaggcuucgcguucauaaacuucgccagcuucgaggccucggacgcuuccaucgaggcgaugaacggccaauaucucugcaaucgacccauauccguaucguacgcguucaaaaaggauuccaaaggcgaacgacacggcucggcggccgagcgauuguuggccgcacagaauccgcuaucgcaggccgacaggccccaucaauuguucgcagacgccccuccgauuggaaugaugccgaugagcauggcgccgccaccgccgccucuaaucaccggcaugaug

SEQ ID NO: 4568 - RNA, 639 nt, Phyllotreta atra
ccaagcuccguuacuuagauuucuccgaaaggcauggcuacaucaaggguguugugaaagacaucauccacgaccccggucgcggcgcccccuuggcucuagugcacuucagggaccccuacaaguuccaaacuaggaaggaaauauucaucgcucccgagggcauguacacagggcaauucuuguacuguggaaagaaagcuaaccuccaaauuggaaauguguugccuguaggaacgaugccugaagguacaaucgucuguaauuuggaagaaaagacuggugaccguggccgauuggcucgagcauccgguaacuacgcaaccgugauugcccacaaucacgauacaaagaaaacuagaguuaaauugccaucaggagcuaagaaaguuauccccagcaacaacagagcuaugguugguaucguugcuggugguggucguaucgacaagcccauccugaaagccggucgugccuaccacaaguacaaggugaagcguaacugcuggccgaaggugcgugguguugccaugaaccccgucgagcauccucacggaggugguaaccaccagcacauugguaaagcguccacgguuaagaggggaacguccgcuggucguaaggugggucuuauugcug

SEQ ID NO: 4569 - RNA, 285 nt, Phyllotreta atra
aacuugcuacgaaggcugcgcguaaguccgcaccggcgaccggcggugugaagaagccucaucgcuaccguccugguaccguggcuuuacgcgagauucgucgcuaccaaaagucgacugaacugcuuauucguaaggcuccguuccagcgccuuguucgagagaucgcucaggacuucaagacggauuugcguuuccagucgucggccgugucugccuugcaggaggcaucggaagcauacuuggucggucuuuuugaagacacgaacuugugcgcuauacaug

SEQ ID NO: 4570 - RNA, 733 nt, Phyllotreta atra
ggcugaucuccuuacugaugucugcgucgaggccauucucgcuaucaaacaguccgacaaaccggucgauuugcacaugguggagcucauggagaugcagcacaagaccgagacggacacucaacuggucaaagggauagugauggaucauggugcucgacacccugauaugccgaagagcuugaagaauugcuacauccuuacaugcaacgugagcauggaguaugaaaagagcgaaguuaauuccgguuucuucuacaaaaccgccgaagaaagggagaaauugguguuggccgagagagauuucaucgaacagcgagucaagaagguggucgaguugaagaaggcccuuugcaacggcacaaacaaaucguuugucguuauaaaccaaaaagguauugacccgaugagcuuggacaugcuggccaaagagggaaucguggcucugcgaagggccaagagacguaacauggaacguuuggcuuuggcaugcgguggaauagccgugaacaguuucgacgauuuacaggaaucucaccucgguuacgccgggcauguauacgagcacguccugggcgaaagcaaauauacguuuguugaagauugcaaaguuccccaaucugugacgaucuuaauaaaaggacccaacaagcacacuuugaugcagaucaaagacgccguuagagauggcuugagagcuaucaauaacgcaaucgaugacaaagcgcuuaua

SEQ ID NO: 4571 - RNA, 652 nt, Phyllotreta atra
uucgaucaccccauucaauugcaucucgcuuucuccacccuacacaaguucguggagaagaccggucgauugccgaaacccuggaacaaagacgacgccaccgaguucaucgcuuuggcgaaaucguuggccguaaacggaucuacggauaccgaagucaacaccgauauccucaacauuuucuccaaguguugcucaggcgaucuuaaccccaucaaugcuacgaucggagguaucguggcgcaagaggucaugaaagccuguucggggaaauucuaccccaucuaccaaugguuguacuucgaugccaucgaaugccugccccaggacaaggaggagaucacugaggaacucgcugcccccguugauaguagauacgauggacagaucgcuguguucggaaaagacuuccaaaagcgauuaggugaacugaaauauuucaucguuggugccggagcgaucgguugcgaguugcugaagaacuucgccaugaugggaauaggcacgcaaggcggucaagucaccguuaccgacauggauuugaucgaaaagucgaauuugaauaggcaauuuuuguucaggccccacaacguccagcaacccaaauccgcuaccgcugcuaagguaauuaagaagaugaaucccgacguua

SEQ ID NO: 4572 - RNA, 695 nt, Phyllotreta atra
uagcugauugugguuucgaacacccuucagaagugcaacacgaaugcauuccccaagcaguaaucggcauggacauccucugccaagcgaaaagcgguauggguaaaacggcggucuucguccuagccacacuacagcaacucgaacccaccgaaaacgucgucuacgugcuggugaugugccauacgcgcgaacuggccuuccaaaucagcaaagaauacgagcgguucagcaaguacauguccaacaucaaagucggcguguucuucggcgggcugcccauccaaaaagacgaagaaguauuaaaaaacagcuguccgcacaucgucgucggaacgcccggccgcaucuuggcccucgucagaucgaagaaacucaaucucaagcacaucaaacacuuuauucucgacgaaugcgauaaaauguuggagcuacuugacaugagacgcgacguucaagaaauauacagaaauacgccgcacgagaaacaaguaaugauguucagugcgacgcucagcaaagaaauucggccaguuugcaagaaauucaugcaagaucccauggaaguguauguugacgaugaagcgaaauugacguuacacggucuacaacaacauuacguuaagcuuaaagagaacgaaaagaauaaaaaauuauuugaguuacuugauguguuggaguuuaaucagguggug

SEQ ID NO: 4573 - RNA, 654 nt, Phyllotreta atra
guucuuguacuacuugggcaggaucaaagcggcgcgauuggaguacagcguggcgcauaagcaucugauacaagcgaugcgcaaagcgccccagaacacggcgaucggcuuccggcaaaccguacaaaaacuaacggucgugguggaguugcuguugggggauauuccggagaggcagauauuccggcaggcgagcaugcggcauucgcucgccccguauuuccaguuaacgcaggccgugagaauggggaacuugcaacgguucggggagguguuggagaauuucgggccgcaauuuaggcuggaucauacguuuacucuaauccugcggcuucggcauaauguuauaaagacagcuaucagaucgauugggcugucguauuccaggauauccccacaggauauagcuaagaagcuggggcuggauucagccgaggaugcggaauucaucguagcgaaggcuauucgagaugggguuaucgaagcuacuuuggacccacaagggggguacaugaggaguaaagagaguacugauaucuacuguacuaaagagccccaacuggcuuuucaucagaggauaucauuuuguuuggauuugcauaaucagagcguuaaggcuaugagauacccgccgaaugcguauggaaaggaacu

SEQ ID NO: 4574 - RNA, 723 nt, Phyllotreta atra
guauacgagaagauacggccaaauauuugagaaauuuggaucccaacucggcguacuacgaccccaaaaccagaucgaugagagaagauccgaacgcuggaauggacgcuacauaccauggggaaaacuucguucguuucuccggagauacuacgaaucacgccagagcccagcuguucgcuugggaagcgcacgguaaaggagucgacguucaucuacuagcagaaccuacgaaauuggaauuacugaagaaggaauacgagaagaagaaggacgaagugaagucgaauauucaggguacaguauuagagaaauacggaggugaagaauaccucgaagcgccgccgaagaguuuguuguuagcucaaacugaaaacuacguggaauauucgagaucggguaaaguuaucaaaggugccgaaaaagaaguuauuagaucgaaauacgaagaagauguuuacauuaauaaucacacgucaguuugggguucuuauuggagugggggacauugggguuaucgcuguugccauucuuucauuaagaauucuuauuguuugggagaaucgggaaaauuagugaacgcucaaccuacggcagaauuaauaacuaaugaugagccuaaagaggaacagagucaagaagaugauaagguugaagcauuagaaaaagaaagcgaagaaucugaaucuagcaguucaucggacgaugaaaaauccaaagcga

SEQ ID NO: 4575 - RNA, 472 nt, Phyllotreta atra
aggaaguucgaauuaggucguccggcggccaacacgaaacuaggaaccagaaggauccacuauguucguacaagggguggcaacuugaaguaccgugcgcuaagauuagacacuggaaacuucucuuggggaagcgaaggaacugcccgucaaacacguauuaucgaugucguuuacaacgcuaguaauaacgaauuggugcguaccaagacguugguaaagaacgcuauugucgucgucgacgcuaccccguucagacaaugguacgagagccacuacaucuuaccguugggacgcaagaagggugcuaagaugacgccugaggaggaggagauuuucaauaagaaacguagcaaaaaaguacagaagaaguacgaaacuaggcaaaaaaccgcuaaaguagagccugcgauugaagaacaauuccacacuggaagauuguuggcaugccuagcaucaagaccuggacaau

SEQ ID NO: 4576 - RNA, 710 nt, Phyllotreta atra
gucaugggucuuaugcuaggugaauucgucgacgauuacacagugagggucauagacguguucgccaugccccagacggguacuggagugagcguagaagccguggaucccguuuuccaagcgaaaauguuagauaugcuacggcaaaccggccggccggagaugguggucgguugguaccauucccauccggguuucggcugcugguugucgggagucgauaucaacacucagcagagcuucgaggcccucuccgagagggcgguggcuguagucgucgauccgauucaauccguuaaaggaaaagucgucaucgaugccuuuagguuaaucaauccuaauaugaugguguuggggcaggaaccccgacaaacgacuucgaauuuggggcauuugcagaaaccguccguacaggcucugauccacgguuuaaaucgccacuacuacuccauaaguauuaacuacaggaagaacgagcuggagcagaagauguugcucaauuugcacaagaaauccuggauggauggguuaacguuggcugauuauucggagaauugcagcguuaacgagaaaaccgucgccgauauguuggaauuggcuaagaauuacaacaaagcguuggaggaagaggagaaaaugacaccggaacaacucgcuauuaagaacgugggcaaacaggcuaccaagaggcauuuggaggagaaagugga

SEQ ID NO: 4577 - RNA, 691 nt, Phyllotreta atra
uggucaaacccauggauaagaagaaaguacuggugaaaguucacccggagggaaaauuuguuguugauaucgacaaaaauaucgacauuaaugacguuacgccaaauuguagagucgcucugcgaaaugaaucguacacuuugcauaagauuuuaccgaauaagguggacccguuagugucucuuaugaugguagaaaaaguaccagauucgacuuacgaaauggugggugguuuggauaagcaaaucaaagagaucaaagagguuaucgaauugccggugaaacauccugagcucuuugaugcuuuagguauugcucagcccaaggguguguuguuguauggaccuccaggaacuggaaaaacucuucuggcuagagcuguagcucaccacacagaauguacguuuauuagaguaucaggaucggaguuggugcaaaaauucaucggggaagguuccaggaugguaagggaacuguucguaauggcuagggagcaugccccuucgaucauuuucauggaugaaaucgauucuauuggauccucucguaucgaaucagguucugguggcgauuccgaaguucaaagaacuaugcuggaguugcugaaucaacucgauggauuugaagcuacgaagaacauuaaaguuauaauggcuacgaacagaaucgacauuuuggaucccgcuuuacu

SEQ ID NO: 4578 - RNA, 450 nt, Phyllotreta atra
guugaagucugcuuucgauuuacaaaguuucaguuuuuuccaaaggggaucuguacaggaguuuaugucauucuuuuguaagacuaucguggaaaggacuauaccaucguccaggcaauccgucaaagaaggagaauacaugugucauguuuauguaagacaugauaacuuggccgguguuguaauaucagaucacgaauacccgucuagggugucgcauacgcugaucacaaaaauuuuggacgaauuugccgcuaaaauaccagcugugaauuggccuaccuugcaagagagagacguggcguuuccacaguugaacacauaccuggccaaauaccaaaacccuaaggaagccgaugcgaugacuaaaauacaagaggaccuugacgaaaccaagauuauucugcauaauacgauucaagcuguccuggaaagaggggaaaaguugga

SEQ ID NO: 4579 - RNA, 604 nt, Phyllotreta atra
uggaauaugccauugaagcuauuaaauugggaucuacagcuaucggaauaugcacuagcgaagggguugugcuagcagucgaaaagcguauuacuucuccauuaauggaacccacuacgauugaaaagaucguagaaguugauaaacacaucggcugugcuguuucggggcucauggcagauucacguacaaugaucgauagagcaagaguugagugccaaaaucauugguucguuuacaacgaaaacaucaccaucgaaucgugugcucagggaguaucgaaccuagccauucaguucggagauucggaugaugauggugcugcuaugucgaggccauucgguguggccaucuuguuugcuggcauagacgaaaaagggccucaacucuaccacauggacccaucagguacauuuguucaguucgaugcgaaagccauaggaucugguucagagggcgcacaacaaagcuuacaagaaguauaucaucguagcaugacuuuagaggaagcuaccacagcagcguugacuauucucaagcaggucauggaggagaaauugaacucuucuaauguagaagucaugacaaugacgccaaaggauau

SEQ ID NO: 4580 - RNA, 737 nt, Phyllotreta atra
gagguucuugaagaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggacaaaucgaugccgaucuuaagaccaagucgucagcguacaauaacuuaaaaggcagucuucagaauuuggagaaaaaacaaacagggaguuuguuaacccguaacuuggcagaucuggucaagaaggaacacuuuauuuuagauucugaguacuugcaaacgcugcucgucaucguucccaaagcucaguucaaugaguggaacgccacuuacgaaaagaucacggacaugaucgucccucguucgucggaguugaucauucaagaccacgacuacggccuguucaccgugucgcucuucaagaagguggucgaggaguucaagcugcacgccagagagaagaaguuuaucgugcgagauuucacguacaacgaggaggaacuggcggccggcaaaaacgaaaucaccaagcucguuaccgacaagaagaagcaauacgguccguuggugagaugguugaaagucaacuucagcgaaugcuuuugcgcuuggauacacguuaaagcgcugagaguguucguggaguccguguugagauacggguuaccagucaauuuucaggcuauucugauccaucc

SEQ ID NO: 4581 - RNA, 719 nt, Phyllotreta atra
cucgauguaccccauuaaggcggugaacguguuaaaggcucacgggaaaagcgccagggagaguuuccuaguggccggcuacgccuugaacugcacugucgccagccaagccaugcccaagaagaucgucaacgccaaaaucgccugucuggauuucucauugcaaaaggccaaaaugaagaugggcgugcaagugcugaucacggaccccaaucaacuggagggcgucagagccagggagcuggacaucaccaaggagcgcauccagaagauccuggccaccggcgucaacguggugcugcuguccggcggcaucgacgacgucuguuugaaguacuucguggagcgcggcgccauggccgugcgccgcgucaagaaggccgauuugaagcgcaucgccaaggcgacgggggcggcguucgucacauccuugagcaacauggagggcgacgagaccuucgauuccaauaugguuggugaagccgccgagguagugcaagagaggauuuccgaugaugaauugaucgucauuaaaggccccaaggcucgcacggccgccucgaucauccugcgaggccccaacgauuucuacugcgacgagauggagcgcuccguccacgacgcccucuccguggugaaacgcguacuggaaucgaagagcgugguggcgggaggcgguagcguggaggcggcgcucuccaucuaccuggagaacuucg

SEQ ID NO: 4582 - RNA, 684 nt, Phyllotreta atra
gccuucuauaacuucccaggaacagaauggaaaccuguaucacauccaauaacucauacccaaucuccaguaacaacuucaaccucaauuguaucuauaaccuacgauaagggaguacuaauagccggagacuugcuggccucuuacgggucuuuagccagauacaaaaacugcccuaggguaaucgaaauuaacccaaacaucauccuaggcgcuggaggagacuacgcugauuuccaauacgucaaaagcuuuaucgagcagaaaauaaucgaugaagauugccuagaugauggcuggaaaaugaaaccgaaaucucuuuauugcuggcuaacuaggauuagguaccaacgaaggaguaaacucgacccguucuggaacaaucuaguagucggaggaauccaagauggaguaccuuuccuaggaacagucgauaaacuuggcacugcguacacagauaaaguaaucuguacugguuacggggcucauauugcccuuccugucuugcgggaugcccucgacaagaagccgaauuuacaucuaaaugaggcuaaggcucuaauuaaaaagugcauggaaguuuuguucuacagagacgcgagaaguuacccgacauaucaguuggguauaaucgauauggaugaugguguuaagaucgagggaccgauuucugucgaggagaau

SEQ ID NO: 4583 - RNA, 760 nt, Phyllotreta atra
uccgaauugcaaaaucuucgcagaaaaauccaagggcucuccgaagaaacuagcucuaauuugaagaaaaauguuuacgaaaacuacauucaauuuaucgaaaccgcgaaagagauuucacaucucgaaagugaaauguaccagcuuucccacuuacuuucagagcaaaaggccuuacuuaauugucuaucagccaccucgauacuagaagauguccaaccuguuaacaucgagagagauaauaaaguaaacgaaaaggauauugaagaagaaaauaaacaaaaaauagcugcuauauuagaaaaaguagaagguugucaggaauuguuaaaagugccagggagaauuuuuuuguacgaaggagauuuauuagaaaucgaacccaccgaaaacacugcuuuaaaaauaguucauguuuauuuauucaccgauagcuuuaugauaaccacuagaaauucaaacagucgaggccucaugaaauacaucuacgaaagcauauacgaccuaagcagccuagcagucgugaacguaagagauuugggaaacguuaaacacgccuuuaaacuucucauuuuccccgauaccagaguuuuccaaugcucuuccaacuccaauaaaaaagaaugguuagacaaguucgaucaagccaagaagacccggcuagcccaagaacaacaaaaaagggaauccauaucggaaaaaucccccacccgcguuuccuucgagucccccagcuacaaucccuuugaugaaguggaag

SEQ ID NO: 4584 - RNA, 789 nt, Phyllotreta atra
cccaaagaugaagauggugaagcugauauugaaauugaauuggucgaagaugagccaccauuuuuacagggucaugguagagcucuucaugauuuaagcccagugagaauaguuaaaaacccggacgguucgcuagcccaagcugccaugaugcaaucggccuuggccaaagagagacgcgagcaaaaaaugcugcaaagagaacaggaaguggauucccagccgucuggaaagaacaaaaacuggauagauccccuuccggaagaggaaucuaaaucgauggcaagaggaaucggucugcaaagucaagauuuacccgaauggaaaaaacacguuaucgguaauuauuucucgaucacacaauuaauuucgaaguuuguacuaaacaacauuuuaggugguaaaaagucuucuuuugguaaaaaaaccaacuuaacgaucaucgaacaaaggcagucucuuccuauauacaaacucaaagaggaguuacgaaaagccguaacggauaaucaaauacugaucguuaucggugaaaccgguucaggaaaaaccacacaaaucacccaguacuuagccgaagccgguuucacagccagagggaaaauuggcuguacacaacccagaagaguugcagccaugucgguugcuaaaagaguggccgaagaguuugguuguagauuaggccaagaaguuggauauaccauucgauucgaagauugcaccagucccgaaacgaugaucaaauacaugacagacgguauguugcuucgugaaugccugauggauuug

SEQ ID NO: 4585 - RNA, 715 nt, Phyllotreta atra
aaaccgacuuuaagggauccgaaccccuaugcagaguaguucgaauuaaucacucgggaaaaauauuagcuacuggaggaacugacggcgacguaagacuuuggaaauucccuacgaugcagccauuguccauucucaagggacauacgaaggaaauagacgauauagauuucaguaaauucgauaaucucaucauaacuuuagcgaaggacgguuuggcuauuuugugggacgcccaaacggguaaauugaaaucgaaacugacauggaacacuccagagggaucgaaauauuuguacaagagaugcagguuuggcguuaucgaagaucaaaagaauaagugcaugcuauacaugauagcgaaugcgacuaauucgaagcaaaaaucguuucuacaacaauggauaccugaggagaauacuuuaaaaaaguucucggaauuuaaugaaacacuguccgcacuugcaguuagagacgauggacgauuuguugcugucgggacaauguucagcgguucuguuucgauucacauugcauuuaguuuacagaaaauauuaguaguugucggugcucauucgauguuuguaacuggucuggaauuccuaucucaugaaaauacuaaucauuccauaaguagugucgcagaggccgcuguauugucuauuucgguggauaaucagcuuuguauacacucggugccauacagacgaaguau

SEQ ID NO: 4586 - RNA, 711 nt, Phyllotreta atra
ccuuguuaaaagagcugcagaaacuggacgacaaaaaccugcuggucgaagugcagcugcucgaaagcaaaacauaucacgcuuuaagcaauuuaccgaaagcccgggccgcucugacguccgccagaacgaccgccaaugccaucuauugcccuccgaagaugcaggccgcccucgaccugcagucgggcgugcugcaugcagccgacgaaaaggauuucaagaccgcuuacuccuauuucuacgaggccuucgaggguuucgacagcgucgagucccccaaagcucggaccgcucugaaguacaugcuuuuguccaaaauuaugaucaauaguccugaagauguacagcaaauuguuaguggaaaauuagccauaaaguaugcagguaaagauaucgaggccaugaaagcagucgcacaagcagcccacaaaagaucucuugcagauuuucaacuggcuguaaaacaauucaaacacgagcuggaagacgacguuauuguaagagcacauuuaggaacacucuacgacaauauguuagaacaaaauuuaugcaggaucauggaaccuuacucacguguccaaguagaauauaucgcaaagacgauuaagcuucccguguuacaaguagagaagaaacugucgcagaugauuuuagaugccaaguuucauggaauuuuagaccagggugaugguguccugauaguguuug

SEQ ID NO: 4587 - RNA, 752 nt, Phyllotreta atra
cgagcagaaaaucaagaaccugcaggccgccgccgaccggcaucaauccaccgccuccggcgcucucgacgagcugagacagguucgaacgaggaucgacaccuucucgucgaggauccaggaccuggagaaccagaaccagggucuggcagcuagaacuagggauuuggagaaguugcucgagaacgagcgcauucgucacgccgaagaccuagcguuaguagagagggaauugcacaggaugcgcgaggaaauggcgacucaacugcaagaguaccaagacuugauggacaucaaagugucccucgauuuggagaucgccgccuaccguaaacugcucgaagcggaagaagcucgauugaacaucacgccaacaggcggugaccacgaggugcaccaaaggagcuccucucaacgccggacgccggugcgacugggggccaagaggaaacgggcccugcucgaggagacgcaggagucgagcaugucggacuacagcgugaauaguucgucuaaaggggacauugaaguggccgcagucgauccggacgggcaguuugugagauugcacaacaaaaguaaccaggaggugccgcucagcggauggcaggucauaaggcgggcgggcgaugaggagacuuucuacaaauuccacagaaccguuaaaguagagggaaaugguaccguaaccauuuggaguucugauuuaaauaaggaucacgaacccccuaguaaccugguuaugaaagggc

SEQ ID NO: 4588 - RNA, 767 nt, Phyllotreta atra
cugagaauccacaccaagaacaugaaguuggccgacgacgucgauuuggagcaaaucgcggccgagacucacggucacgugggcgccgauuuggccucgcucuguucggaagcggcgcuucaacagauuagggagaagauggaccugaucgaucucgaagacgaucaaaucgacgccgagguucucaauucgcuggccgugaccauggagaacuuccgcuacgccaugacgaagagcagcccgagcgcucugcgcgaaaccguggucgagguuccgaacgucacuugggacgauaucggcggcuuggcgaacgucaagaaggaguugcaggaguuggugcaauauccggucgagcaucccgauaaguuccugaaauucggcaugcagccguccaggggagugcuguuuuacgggccgcccgguugcgguaaaacccuguuggccaaggccaucgcuaacgaaugucaggccaacuucauauccgucaagggaccggaauuguuaaccaugugguucggugaaucugaagcuaauguuagagacauuuucgauaaggccaggucagcagcuccuuguguacuguucuuugaugaguuagauucgaucgcuaagucgagagguggaaaugugggagaugccggcggcgcagccgauagggugauuaaucaaauuuuaacugaaauggaugguaugggagcuaaaaagaacguuuucauaauuggugcuacaaauagaccagauauuauugaucccgcuauauuacgucc

SEQ ID NO: 4589 - RNA, 659 nt, Phyllotreta atra
gcgacuugauagauuuagugccaagucucugcgaggaucuccuuucguccguggaucaaccuuuaaaaaucgcuaaagacaaggauucgggcaaggauuuucuuuuaugugauuacaauagagacggggauucuuacaggucaccauggucgaauaccuacuauccuccauuagaagacgguucgaugcccuccgagaggcuaaggaaauuagaauuagacgccaauuuagcguucgaucaauauagagaaauguauuucgaaggcggcguaucuucuguuuauuuuugggacuuggaucacgguuucgcagguguaauuuuaauuaaaaaaaccggcgaugguaguaggaaaauuaaagguuguugggauucccugcacgugguggagguacaagagaagaguuccggaaggaauucccacuacaaaaugacguccaccgccaugcuguggcugcaaaccaauaaacaaggcucggggaccaugaauuugggcggcaguuuaacccgacagaucgagaaugaugcggccgugaacgacaucaauccccacaucgccaacaucggucgaaugguggaagacauggaaaacaaaauucggaacacguuaaacgaaaucuacuuuagcaaaaccaaggacauagucaauagcuugaggucg

SEQ ID NO: 4590 - RNA, 792 nt, Phyllotreta atra
ucaggauuucaacacgauguucacgaauugcuacgucuacaaccagcccggcgaagaugugguggucauggcccaaacauuagaaaaaguauuuuuaaccaaaguggccgacaugccuaaacaagaauuugucguugauaugccgaugaaaggcgccaaaggcaagaaagggcgaguuagcgucgguggcgucgguggcggcggcggcggcggcagcacgccauccuccagcggcccgguaccagcagcuauaguaccaggaggugucagaggcaggccgcccgcgaccguauccucuaccaguaccacaccgauugcgaccacuaccgguucguccggcuugccguugggcacccaagcgcccgcgacgcugccgggcaguaccgccaccacgacgauagcgccggccaacaacaacaacagcucucugacgccgcagcagcucggcacgcccgucagcucgaugcacggcacgccgggggcgccgcugucgaauucccucgaucccaccggaggagugcuacccucuaacgucaugccgccggcgcaaccagccaagguaaaaaagggcgugaagagaaaggccgacacgacgacgccggcgacggccuacgauuauccgacgguguuggaaucgaagucggcgaagauuucgacgcgccgagaaucgggcaggcagaucaagaagccggcgcggcgggaaaucgaccuucacguaccucagccggcgauccacaagcccaacgacaaguugucggagucgcucaaggccugcaaugaaauccucaugga

SEQ ID NO: 4591 - RNA, 681 nt, Phyllotreta atra
uuuaaggccccaauuagaccagaugucgucaauuucguucaucagcaggucucaaugaaccaucgccagccuuacagcguuagcgacaaagcuggacaccagaccuccgccgagucguggggaaccggucgcgccguggcccguauaccucguguacgcgguggcgguacccaccgauccggucagggagccuucggcaacaugugucgcggcggucgcauguucgcgcccaccaagccguggcgccgcuggcacagacgcgucaacaucaaccagcgucgcuacgcccuggcgucggccgucgccgccagcggcgucccagcucuggucaugagcaaggggcacguggucgaucagauucccgagcugccguuggucgucagcgacaaggugcaggagaugcacaagaccaaggaggccgugcaguuucugaggaggaucaaggcuugggcugacauccagaagguuuacaagagccagcgguuccgugccgguaaaggaaagaugcguaauaggagacguauccaacguaaaggaccacucaucgucuacuacaaggaucaaggucuucgucaagcuuuccguaacaucccaggcauugaccuuaucaguguccaaaaguugaacuuguugaagcucgcuccuggcggucacguaggucgauucgugaucuggacugaa

SEQ ID NO: 4592 - RNA, 650 nt, Phyllotreta atra
cgaggaagaggaagaagaugacgaagaaaaaauuagagaagaauuaaaagaucuaaucgacgauaauccaaucgaagaaagugaugcugaauccgaugcuucaggucgugagaaaagaaaaaaaucugaugacgaagaccucgaugaucgauuggaagacgaagauuacgaucuguuggaagaaaauuugggucauaaaguagaacgaaggaaauucaaacguuuacgccgguuugaagaugaagaaagcgaaggggaagaagaacaugaucccgaccaggaucgcgaacaaaucgcuauggacauauuuuccgacgaugacgaagaaagaaggucggaaagaagccaaagaccggucgucgagcaagaaucuuucgguguaggcgaagaagaagaagaaggcgauuauucggacgccgaugauuuuauuguagacgacgacggcagaccguuaaucgagaagaagagaaagaagaaaccgauuuucaccgacgccgcgcugcaagaggcccaagaaacguucggcguugauuucgauuacgacgaguucaccaaauacgaucaagacgaauacgaggacgaggaggacgaagaagaggacgaauacgaagaagaugacaacgaacgaaggaaacauccgaagaaagcug

SEQ ID NO: 4593 - RNA, 724 nt, Phyllotreta atra
guagcucacuugguaaaccaacggguggcucaugagauacuggcgcucgaaauacugacuuugcucgucgaaacuccuacugaugauuccguggaaguggcuauuucuuuucucaaagagugcggacagaagcucacggaagucucgaguaaaggaauuacugccauauucgagaugcuuagaaacauccugcacgaaggccagcucgagaaaagaauacaguacaugaucgaggugauguuccaaauuagaaaggacggcuuuaaagaucacgccgcuguaaccgaggaauuagauuuaguagaagaagaggaucaauucacccaccuaaucaugcuugaugacguaaaggagguuaacgcugaagauauucuaaauguauucaaguucgaugaacauuacgaagaaaacgaaggcaaauacaaaacucugaguaaggaaaucuugggaagcgauagcgaaucggaaucgggaucggagggauccgaagaggaaucggagggcgagggcgaggacgaagaagucaaagaugccgggaaaaucaucgacaauaccgaaacgaaucuaauagcccuuagaaggacgauauauuugacuauacaauccaguuuggauuucgaggaaugcgcucauaagcuuuugaaaauggaguuaaaaccuggacaagaaaucgaauuaugccauauguuuuuagauuguugugccgagcaaaggacauaugaga

SEQ ID NO: 4594 - RNA, 712 nt, Phyllotreta atra
cccagacacuuuccaauguaguuacgauccuuccuuugcugccgcacgaaaugcgaauauggaaagaauggccgaacagauugcaacauugugcgccacuuugggggaauacccgcacguccgauauaggagcgacugggaacguaacguagaguuggcgcaauugauucagcagaaauuggaugcuuacaaagcggacgagccgaccaugggagaagggccggagaaggcccgaucgcaauugcugaucuuagaccgaggcuucgauugcgugucaccuuuacuccacgaacugacguuccaagcuauggccuacgauuuacuuccaaucgaaaaugacguguacaaauacgaggcuuccgcugggguacaaaaggagguucucuuggaugaaaaugacgagcuguggguggaguugcgccaucaacacaucgccgugguaucccaaagcguuacuaagaauuugaaaaaguucaccgauucgaagcgcaugacucaaagcgauaaacaauccaugaaggauuuguccacuaugauuaaaaagaugccgcaauaucagaaagaauuaucgaaauacgcuacucacuugcaucuugccgaggacugcaugaaggccuaccaaggguauaucgauaaguuaugcaaaguugaacaggauuuggcaaugggaacugacgccgaaggggagaaaauuaaagaucacaugcgcaac

SEQ ID NO: 4595 - RNA, 697 nt, Phyllotreta atra
acaagcaguaauaggcacaagggcaaacauuaacauagcacaaauagaaaauuauggcggcgagacuuucuuaucugaggaauuggcaaucaugauccuucaagauacuaaacaagcuuuucaacguugcuuauuguuaucaaaagguagugaaagggcuuccaacgccacucaaauuuuagacaggcuuauuaauaguuugcugauagaacauguagacuaugcaguugaauugggucuacacgcuguacccguugucgaaggcguuagaaaucccccuguuuuguauuuuuuuaacaucguucaucagaguaauaauauaacccaucucgucgagaaacaguucauggauuuggugguuccauuaguagaaaauacuucgaaauauagcgauugcguacagaagaaaaaauuuguuuuggaggauauagaaagaaaaauuaauacgggauuggauagaugcuugagugcgauauuaaauugggugaaguuguauuuacaaucugaacaaaagaaaucggauuuuaagccagagucugaugauuuugauacaguggccucaccagccugcaagaacguacuuaauuauguuaauaguauugucaaagaaauuaaaacuaauuuggauggcaauaauguaacagcuauccuucaggaguuagggauuagacugcauagaguuguuuacgagcacuug

SEQ ID NO: 4596 - RNA, 653 nt, Phyllotreta atra
uagaaaccaucgaucugcagaaagaccccuauuucaugaaaaaccaccuggggucuuacgaauguaagcuuuguuugacgcuacacaacaacgagggcagcuacuuggcccauacgcaaggcaaaaagcaccaagccaauuuggccaggagggcggccaaggaagcuaaagacgcccccacguuacuccaaccggagaagccucgaguggagcccaagaaguucgugaaaaucgguagacccgguuaucggguaaccaaacaaagagaccccgaaacuggucaacagaguuuacuguuccaaaucgauuauccagaaauaagcgacuugguucugccccgacaccgcuucaugucugcguacgaacaaaaaaucgaaccccccgaccguaaauggcaauaccuacucuucgcugccgaaccguacgagaccaucggcuucaaagugccgagcagagaaguggaaaaaacugacacuaaauuuuggacgcacuggaacagggacaccaagcaguuuuuccugcaauucgccuuuaagaacgagaacaaacgcaacguuaacucgguaguucaaaggcauucgaucguuggcggcguuccaccgccucccaugcugccgguaccgccgccacccaggccuccuauguuuaauccc

SEQ ID NO: 4597 - RNA, 253 nt, Phyllotreta atra
uaaccugcgaaacgauaaccggcgaaguuuacagggguaaacuuauagaagccgaggauaauaugaauugccaaaugacccaaauaacuguaacuuacagagacggacgaguggcgcaauuagaaaacguuuacauuagagguuccaagauaagguucuugauauuaccggauauguuaaagaacgcuccgauguuuaaaaaacaaaccaaagcuggcacugcuggcagagggaagucugcaauucuacgagc

SEQ ID NO: 4598 - RNA, 794 nt, Phyllotreta atra
uauucgcaacauucagcaacuaggggccaauuuaacggccacuuccgauagagaaacuaucugcuacacguuggaaggcaccccggaagcuguggaaugcgcuauaccauucuuaaccgaaguagccacccaacaggaauucagaccgugggagauuuccgaauuguccgguagauugcaguuggacauugcuacaagaccguugcaguugagagcuaucgauuugcugcacaacgcugccuuuagaggacgcggcuuggguaauucucuauuuauuccgaaaacucaaaucgguaaaauuucguccgaaacccuacaacacuacguugccucgaacuucgugagcggccgcauggccguaguaggcucagguaucugucaaaaggaacugacaucuuucgcaaacuccuugaaaauugaaaauggcgaaggcaacaacgcuccuucaccuuacguaggaggugaacuaagaucgaacaaaggcggucaacuagcauucauugcuguagcaggagagggugcugcuaucacgaacaccaaggaggcucuggcuuucgcugugcugcaaggagccuuaggaggaggcccgcagguuacacauggaguuugugacaacggugucuucaggaaggcucugggaagcaaccccaaugucaguucaguggccauaaacgccaguuacucagacacaggucucuuugggcuucugcuggcuguaccaacgaagucugcaggaggugcucuggaagcagcuguuaaagugcucaagaguggaucggugucugaugaagaug

SEQ ID NO: 4599 - RNA, 197 nt, Phyllotreta atra
ugaucggaugacuaacgaacuacaagagaaaaucggagcccuaaaaucccucacuauugauauaggaaaugagguuaaauaccaggacagaaugcucagggaugucgaugacgauuuggagaaaaccggaggcuuccugggaaccaccaugaacaaaguguugaggcugucgaaagggggccacaauuacaucauug

SEQ ID NO: 4600 - RNA, 705 nt, Phyllotreta atra
cguugguaauccucgaagaugucaaauuuccgaaauucaacgaaaucguccagcucaaacuggccgauggcagucuacgauccggucaaguauuggaggugagcggcuccaaagccguaguacaaguguucgaagguacuucgggaaucgacgccaaaaacaccgugugcgaauucaccggcgacauucucagaaccccaguguccgaagacaugcugggcaggguguucaacggcucaggaaaaccaaucgauaaaggacccccgauuuuggccgaggacuucuuggacauccaaggucaaccgaucaauccuuggucgcguaucuacccggaggagaugauccaaaccgguaucuccgccaucgaugugaugaacucgaucgcucguggccagaagauccccaucuucucggcggccggucugccccacaacgaaaucgccgcccaaauuuguagacaagccggucuugucaaggugcccggcaagucggcuuuggacgaucacgaagacaacuucgccaucguguucgccgcuaugggagucaacauggaaacggcucguuucuucaaacaagauuucgaagagaacgguucgauggagaacguauguuuguucuugaauuuggccaacgauccuacuauugagagaaucaucacgccccguuuggcucuaacggcugccgaauuuuuggccuaucaaugcg

SEQ ID NO: 4601 - RNA, 345 nt, Phyllotreta atra
ucgaauucacuugcagcuauuugcuagaacagcccgaagauguaguaucguaugcacaagaauacuucacuaaauuuaaagaaaguagaggcacugcguugauauaugaucaggacauguacgaagaggaaacgauggguaucaaaacagucuuggcucgccaaaucuucgacuccagaggcaacccgaccgucgaagucgacaucaccaccgaguuggggcucuucagagcagccguaccaucaggagccaguacugguaucuacgaagcccucgagcuccgcgacaacaucaaaaccgaauaccauggcaaaggcgugagucaggccaucaaaaacaucaaca

SEQ ID NO: 4602 - RNA, 664 nt, Phyllotreta atra
aucagacgcagcuacuaaagucgacggauuggagagcuuguugcagucguuggugcaagugcugcaaucguccgacgugaacguggugaccugcgccgccggcauccugucgaaucugacgugcaacaaucaacgcaacaaagugacggugugccaggugggcggcgucgacgcccuggugcgcaccaucgucagcgccggcgaucgcgaggagaucaccgagccggcggugugcgcccuacggcaccucaccucccgccacguggaguccgagauggcccagaacgccgugcggcugaacuacggcauacaagugauugucaagcuguugaacccgccgucgcguuggccgcuggugaaggccgucaucgguuugauuaggaaccuugcucuguguccggccaaucacgccccgcugcgcgagcacggcgccauucaucacuuggugcaguugcugaugagggcuuuccaagacacucaaagacaacggaguagcgucgcuagugguggcagccaaccgcccggaacguacgcggacgguguucgcauggaggagauuguagagggaacggugggagcguugcauauauuggcgagagaaucgcauaaucgggccaucauuagacagcaaauggugauuccgauauucgugcaauugcuguuc

SEQ ID NO: 4603 - RNA, 654 nt, Phyllotreta atra
ggcccuauuuagcuucagaaugcaaaagucuguacgccugcgagaaguggcgcaugcagauaaucagggaaauagcgaaaaaaguggcccaaauacagaacgcaggacucggggaauuccgcauucgcgaccuaaacgacgaaaucaacaaacuccugcgcgagaaacgccauugggaggaccaaaucaaggagcuaggcggccccgauuaccaacgagucggccccaggaugcuggaucacgaaggcaaagaaguccccgggaacagaggcuacaaguacuucggagccgcuaaggaauuaccuggcguucgagagcuguucgaacaggaaccgccgcccccgccgaggaagagucgcgcggaacugaugaaggacaucgaugccgauuacuacggcuacauggacgacgacgacgggauacugauaccuuuggaaaucaaagcugaaaaaacagccguacaaaaugcgauagccgaaugggugaacaacaaggaaaagaaccuagacucuaccaaaggaaucgaagagaguaucuacgugguggaggauucggaugaagaagaugucguucaacaguucgaugguucgcaacagagauucguagcccacguaccggugccaucgcaacaggauaucgaacaggcuuuguuga

SEQ ID NO: 4604 - RNA, 509 nt, Phyllotreta atra
uacaggcaaaacaacuuucgucaaacggcacuuaacuggugaauuugaaaagaaguauguugcaacacuaggaguugaaguucauccacugguuuuucacacuaacagaggcccaauccgauucaauguuugggauacagcaggacaagagaaauuuggcggucuucgugaugguuauuacauucagggucagugcgcuaucgucauguuugacgucacaucacgaguaacguacaaaaauguuccaaacuggcauagagaucuuguucguguuugugaaaauaucccaauuguucucugcggaaacaaaguugauauaaaagaccgcaaagucaaggccaaaaguauaguuuuucaucggaagaaaaaucuucaguacuacgacaucagcgccaagagcaauuacaacuuugagaaaccauuuuuauggcuggccagaaaauugaucggggaugcuaaccuugaauuuguagcgaugccugcucuuguaccuccugaaguuguaaugg

SEQ ID NO: 4605 - RNA, 125 nt, Phyllotreta atra
auaagucucuguuucgccagcggugaucacaaaacaucuuucaccgauauuuuaaugaacauagucgguguguucauguggguggccguuggagcaacagcacuucacuacuggcucgguuauuu

SEQ ID NO: 4606 - RNA, 747 nt, Phyllotreta atra
agaaacgaggcguagauuacaacgcggaaauuccguucgaaaaacaaccggcuaucgguuucuacgacacuuccaacgaagcccucgacuugauggccccggauuucuccaaaaugagacaacagcauuuggacggcgaacucagaagcgaaagggaagagagggaacggaagaaggauaagcaaaaguugaagcaacgcaaggaaaacgacauuccucaagccaugcugcaaaacgaggaacccgcuaagaaacgauccaaacugguauugccggaaccgcagauauccgaucaagagaugcaccaggugguuaaguuaggcaaagcgagcgaaacggccagagaaaucgcaacagaaagcggagucgaaaccacugacacucuacuuaacgauuacauguucacaccgcaagcugccgcuacuccaagaacucccgcgccccaaacugacaggauacuucaagaagcucagaacaugauggcucuuacgcacgucgauacgccucuuaaaggggguuugaacacgccccugcauaacucggauuucagcgggguucugccgcaaucgcaagcgauuaccacuccuaauacgguacucgcuaccccguucagaucuacuagaagcgaugggggagcuacaccgggaaguacugccggauucaugacuccuaaaagcggagcccugacuccuguuggcaaaaacgcgacgccuucuaucagagauaagcugaauauuaacgccgaag

SEQ ID NO: 4607 - RNA, 339 nt, Phyllotreta atra
gcucauccugauaagcugaagaaaaaaauuacaagggaauuaauuacuaccauucuugccagaaaaccaaaaaugugcaguuuuuuggaauggagggauuugaaaaucguuuauaaaagguaugccagcuuguauuuuugcugcgcgauagaacaaugcgacaaugaacugcuaacuuuggaaaucauucaucguuacguugaacuuuuggauaaguacuucggaagcguaugcgaauuggauauaauuuucaacuuugaaaaagcguauuucauucuggacgagcugaugcuugguggcgaggugcaggaaaccaguaagaaaaauguccugaaggca

SEQ ID NO: 4608 - RNA, 782 nt, Phyllotreta atra
aagagaucgucguuucucagccgccuguacgacaauuucaaagacgaaaugaacaaaaacaaagaaaugaaagaaucccuaaaaaaauuccgcgaagaagcccaaaaacucgagcaaagcgacgcucuaaaagccgcccgacagaaguucgaaaccguagagaaagaggccaguaaaagcggcgaagucuucaaagagaguuuagguuccauuaaagaaagagucaaaggaguaauagacgaggccaguaagucagauuuagccaaaaaggcugggaaguuuaccgaagaaguggggaaaaccacgcacaaaaucagcgaaaccgcacaggaaaucagcaaaaccggagccuuucaaagcauaucggaagccaccaaagccguuaaacaagaaaucgacaacaccagcauggaaggucgaguguacgucagcccuaagaagcuucgaaaacgaaccgaaaccagcgcagugguccaacaaaaguacuacgaaccgaacacagacgccaccggcguagagcuacacaaagacuccaaauucuacgaguccuggcaaaacuucaaaaacaacaaccccuacgugcacaaagucauggacuggaaacucaaauucgacgaaagcgagaaccccaucauccgagccuccagggcgcucacagaaaaaguaggagacauaauggggggacuguuucagaaaaccgaacucuccgaaacccuuacggaaaucugcaaaaucgaccccgacuucgacacgaaacgguuccuaaaacaaugcgaaaccga

SEQ ID NO: 4609 - RNA, 752 nt, Phyllotreta atra
agaugguaagcugaaaccuggauuaaauaaaaucgaacaggccccaaagcaauucguaaacaacguaagugguuuaaaucagaaaaucgaagaguucaaauugaaucugccauggaucgaaaggcuggauuguacgaacgcccaagcccccuuagcgcccgaauuagcggaagagauguuagcucacgaagaaaaaagaaguaaucaacugcgaaacaacaaaaagcuuccccaauuccaaccgucggaagauccaguucuaaacgauuuuaaacgagaacuaauauuccacaggcaagcucaagccacaauucuagacgcaauuccgaaaaucaaagaauuagggauaucuacuaaaagaccagacgauuauuuugcugaaauggcgaaauccgaugagcaaaugcacaaaaucagagagaaucugaagcagaagcaggagcagcagaagcggagugaaagggugaagcaauugaggcagcaaaggaaagagggcaaaucgcugcaggugcagcugaagcugcaacgcucuaaggagaagaaggaaaugauggaucaagugaagaaagcgaaaaaaaauuucgauuuucuggaugagaaaaacaagcccaugggaaagaauaagguggcggaaaggcgcaagaugaaggacaagaaauucgguuuuggugguaagaaaaagggaaugaagaaaaauacaaaggacagugcgggcgauauuagugaguauagaaauccuggaaaagccaaga

SEQ ID NO: 4610 - RNA, 789 nt, Phyllotreta atra; identical to SEQ ID NO: 4584

SEQ ID NO: 4611 - RNA, 783 nt, Phyllotreta atra
uuaacuuccaacaaccugcugacgccgaacgugcccuggacacuaugaauuucgacuugaucaaaggcaggcccauucgcaucauguggucccaacgcgacccuucucugcgaaaaucuggaguuggcaacguguucaucaagaacuuggaccgauccaucgauaacaaggccauguacgauacuuuuucugcguucggcaacauccucagcugcaaaguggcucaagacgagagcggagucagcaagggauacgguuucguucacuucgaaaccgaagaagccgccaacaaguccauugaaaagguaaacgguaugcuguugaacggcaaaaaggucuacguuggucgcuucaucccgcgcaaagaaagggaaaaggaauugggcgagaaagccaagcucuucacgaacguuuaugugaaaaauuucggagaggacuuguccgaggaacagcugagaacgauguucgagaaauacggcaagauaaccagcuacaaaauaaugagcaaggacgaugggaagucgaaaggauucggauucgucgcauucgagagucccgaggcagccgaaucagcuguugaagcccuaaacggcaaagaaauauuggaaggcaaaccucuguacgucgggcgggcccagaagaaggccgaacgccagcaggaauugaagcgucgcuucgaggcucuaaaaauggaaaggcucaaccguuaccaaggcguaaaucuauacgucaaaaacuuggaugauaccauagacgacgaacgccuucgcaaagaauucucac

SEQ ID NO: 4612 - RNA, 772 nt, Phyllotreta atra
gcgaaaauuuggauacccuggacgagccggaagcccgagccaguauggucuggauuauaggagaauacgccgagagaaucgauaacgcagaugaguuacuggauaguuucuuggaagguuucggugacgagaacgcucaaguacaacuacaauugcuaacagccguugugaagcuauucuuaaaacguccucaacauacgcaaggcuuaguccaacacguacugaguuuggccacucaagacuccgacaaucccgauuugagagacagagguuucauauauuggagauuguugaguaccgauccggccgcugccaaggaggugguucucgcugauaaaccucuuauuucggaagaaacggaccucuuagagccgacucuucucgacgagcucaucugccacauaucaucccuggccagcguuuaucacaagccacccacagcguucguagaaggccgaagugcagguaucagaaagacauugccggcuagacaaggcuccgaugacacagccgccgcucccgaaacaacgguuauuccgaaccaagaaagccucauuggugauuugcuuucuauggauauuaacgcgcccgccccgucugcugcugcugcuccugccgccccucagacuaguaacguugauuuacucggcgguggauuggauguuuuguugggaggagguaaugauauugcggcggcuccugcuagugcugcugcucccaccaccacuggucuucucggggacauauucggcauaccuacugcaccuaccau

SEQ ID NO: 4613 - RNA, 348 nt, Phyllotreta atra
auugguccacuagguuugucccccaaaaagguuggagaugauaucgccaaggcuacaucugacuggaaaggacuuaaaauaacuguacaguugacaauucaaaacaggguggccacaaucucaguagucccaucugccgcaucuuuaguaauuaaagcccucaaggaacccccuagggaccgaaagaaggucaagaacaucaaacacagugguaauaucacauucgaugauguacucaacauagcaaggaccaugcgaucaagaucaauggccaaagaauucaaaggaaccgucaaagaaauauuaggaaccugccagucugucggaugugucauugauggcaaacaa

SEQ ID NO: 4614 - RNA, 660 nt, Phyllotreta atra
cuagagaaguuccacgaaggccacggcaaagaaggcaccauagucgucacaaaggucgaagaacccuccaaauacggggugguaguguacgaucaaaacaacugcaucgagagcuucguggagaaaccccaggaguucauuucgaauaaaaucaacgccggccuguacauccugaaucccagcgugaucaaccgaauagaacuccggccgacuuccaucgaaaaggaaguguucccuuacauggccuccgaccagcagcuguacgccuucgaguugaagggauucuggauggacgucgggcaaccgaaggauuuccugaccggaaugugccuguaucugaaccauuugcgggagaccaacagccagaaguuguacaaagguccuggaguggucgggagcgugcuggucgaucccacggccaaaauuggcaguaauugccaaauuggacccaacguuacaaucgggccagguguuguaauagaaaaugguguuuguauaaaacgcucgacgauacuaaggggugcaacgguuuguuccaacucuugguuagaaaguugcauugugggguggaagugucacauagguaaaugggugagaauggaaggaaguacuguacuuggagaggauguuauugugaaagaugagacguacauaaacggg

SEQ ID NO: 4615 - RNA, 675 nt, Phyllotreta atra
cgauguaaggaagcuucugaauaacgaugaccuucugaaagaagggguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauaguguugauaccgcggcggagcccuggcgggccgcucuagauaacgaguuuauacaguacacgagaaaccauuauaaagacggcguuuguagcguguucggucgcagccaaaacggcgccaucgcccucaccgcuugcaucgaagaccaccaauuccagcccaagaacuucuggaacggucgauggagaucccaguggucuguuaguuuaaccgaugaagccaccgcagaaguacggggaguccucaaagugcaaguucauuauuacgaagaaggaaacguucaacuggugaguacuaaggaaaucaaggaaucgauuccgguuucgaacgaagcgcaaacggccaaggaaaucauccauguaauagagcaggcggagaaucuguaccaaacggcgauuucugaaaacuaccagacgaugucugauacgacguuuaaggcucu

SEQ ID NO: 4616 - RNA, 714 nt, Phyllotreta atra
guuguuggauacgucguagacaggaaucgugcuauuugcauccaaccucgccuuuacuccgaagguugggugagguugcaaaucgccaucaauucggacgccuucaaguggaaaggaaaauacuacgucgaaucgccggccagcgccucgcagaagaucuucuucaaagacaugaaguaccacgagaagucgcccagcgagauucgcaucacguggcagaagcagaacuugaccaccaacgaaaaugccaacaucagaauuuccuugugggguuacagggaaacuaccaugagacccacguucguuuacaucacagaaauagccgauaauguccagaacaccggggaguacaccaucguaccgucgcaguacaggggcaaaaucaaccaguuccucacugacauuaaguuuggauuccuccaaauaaauuugaccgaaucgauaaaggucaacauuuacucuaccaacaaccagaacaucgauaucacaccgauaauauggagcaggccgauuccucuagguugguauuuccaauuccaaugggagaaccaauacggcaaaaauuggccuaaacaccucugcgacgauuggcucaggaccgacagauaucugaaaaacuucgcucacgaauuaccccaauguccuugcacgguccaacaggcucuggcugauaaggggaaauucaugcccgacuuugauugcgacaaagauucg

SEQ ID NO: 4617 - RNA, 171 nt, Phyllotreta atra
cugaagcugaaaaggucaagaaaguccuaggcgaacucaaaggcaaauccaucgaagagcucaucacuaaaggucgugauaaauugaguuccaugccaguagguggcgcagcccccguagcuguugcugcaguugccgcugcaccagcugccgccgagcaaaagaaaggua

SEQ ID NO: 4618 - RNA, 796 nt, Phyllotreta atra
cagaucgaacagaguaugcaacgugguaacggccgaaauggacaauuacgagccgugcauuuacaccaagcgcgugcuggaggcggugaaaguuuugaacgaucaagugaugcccaaguuuacccagagaguccagguggcugugcaggcuuugggcaacagcccgcccaaggaggucgacgagaacgauuucaucgaugcgucgagauugguuuacgacgguguuagagaaauaagaagagcuguacugaugaacagagccgacgaagauuuggaucccgaagauguagaacucgaugagaauuauuugaucgagaccagaagcaaaucgagugcucauacuggugaacauggcguugaugaguauccugacaucaguggaauuacaacagcucgggaagcuauggguaagaugccggaagaggauaagcagaaaauauugcagcagguggaguuuuucaagagcgagaagcucaaguucgaucgcgaggucgccaaaugggacgauaccggcaacgauaucaucguguuggcuaaacacaugugcaugauuaugauggaaaugacagauuuuacuaggggaaaagguccccugaaaacuaccauggacgucauaaacgcggccaagaaaauaucagaagcgggcacuaaauuggacaaguugaccagacaaauugccgaacaguguccggaaaguucaacgaagaaagacuuacucgccuaucuacagcguaucgcucuuuacugccaucagaugaauaucacuucuaagguuaaagcugacguccagaauauc

SEQ ID NO: 4619 - RNA, 770 nt, Phyllotreta atra
cagcuucaacuggacuuaguuuuggaacagcggugucuacaacaucuucagccaccgcagcugcuacaggaaccccccuuuuuggaguugcuccuaccucgagcacuacuacaauagccaguguaccugcuuuagguuuaucgacuacaguuucugucgcugcuucgacaacuccaucgacuucguuaaguacuacaacagcacccccggcuuacucgacaucgacgcuuccuucuagugguucguuaacuuuuagucaacuagaagauucuauuaacaaauggaccauugauuuggaagaacagggcaaguuuuucauuaaucaagcgaaacagcucaaugcuugggauucguugcuuauuucaaauggcgagaaaauucucaaucugaaugguaguaucgagagaguuaagcagcagcagcagcaauuggaucaagaacucgauuuugucuuggcgcaacagaaggaauuggaagaguuaauaacgccgcuggaaaaggaauuauuggaaauucccguaacagacauagaucgaaaucaaauguaucaauuuucggaaauaaucgauucgcaauuaaagcaaaugucugaugauuugaaagaaauuauugagcacauuaaugaaucuaauaaaagcgaagaaauuucgaauccuuugacccaaauuagccgcauaaugaaugcccacaugaauucccuccagugguuagacagaaauacggcgcaaauuguuucucaucuggaacaaaucaguaaaaugcaggacucc

SEQ ID NO: 4620 - RNA, 468 nt, Phyllotreta atra
ccgggaaauugcuguuuuuagggcuggacaacgcugguaaaaccaccuuauuacacaugcuuaaagacgacagauuagcccagcauuuaccuacauuacaucccacaucugaggaauuaucaaucgggaauaugagguuuaccacguucgaucuaggaggccauucgcaggcucgaagaguauggaaagacuacuucccagcuguagacgcuaucguauuccuuguagaugcuaacgacagaucucgauucggcgaaagcaaacgggagcucgaugcgcuguugacggacgaaacccuggccaacugccccgugcugauucuaggcaauaaaaucgaucugcccgacgcggcgucugaggaugaguugcgaaacguuuacucguuguacggccaaacgaccgguaaagguaaagucgcucgaucggaucugccuggcagaccguuggagcuguuuaugugcucgauuc

SEQ ID NO: 4621 - RNA, 767 nt, Phyllotreta atra
caaccuguuguacuccuucaagggauucuccauacaccgauucugcuugccgcucaugcacggauucguuucgauaaacuucugcguggugaacggccacaguuugaacuggucgauuguaaguagaagaagcgugcaaagagcgggcacccgauugcaccgaagaggguuggacaaggaaggaaacgucgccaauuucguggaaaccgagcagaucaucgaauaccaaggggaccgggcgagcuucgugcaaauacgaggcagcauuccacuguucuggcaacaagaccccgauuuacgauacaaaccaccgcccacucugcucgacgucgauccgcaggaucagcacucgaugugccugaagcacaugaacgaucuaaugacuuucuacgggaagaucguuugcguuaaucugguggaucagaaaggagccgaagggaacauggaaauggcaaugaagaaugcgauaaacaacguaucaucaccaucgguuaaguacgaaucguucgauuuccaugccgagugcagcaaaaugagaugggacagacugucgauacucaucgaucgauuggcucacgaucaagacgagaugaguuucuuucuguuguugagagacggcucguugaguucguuacaagacggcguauucagaacgaauugcaucgauugcuuggaccgcacgaacguggugcagagcaugcuggcccaucggaaucuggaaagcgugcucagaaaauugcagauccuccaucagaaucaaacguugg

SEQ ID NO: 4622 - RNA, 776 nt, Phyllotreta atra
caucaagaagucccugaacaacgaaacccucuacauggacagggacucgcaaaucaaggccaucgagaagacguucgacgauaccaaaacuacaaucgacaagcauuacagcaagccuaacguagucccuguggauguacugccgguguauccagauuucaguuuguggaaauacccuugugcgcagguuauuuucgauucggauccggcuccggugggcaagcaaguaccggcucaaaucgaggagaugucucaagcuaugauucgggguguaauggacgaaagcggugaacaauucguagccuacuuccuccccacggaggaaacucugcaaaaacgcagggaagacguggccaaucaaguccaauaccaagacgaagaagaauacgaauacaaaauggccagagaguacaauuggaacgucaagagcaaggcuaguaaaggcuacgaggagaauuacuucuucgucguacgaucgagugguauuuuuuacaacgaauuggagacuagaguuagguugagcaagcguagacagaagguugggcagccgccgaguaauacuaggcucaucguuaaacacaggccgauggaugcuaaugaauuuaggaugcaacgguacagggaaaagcagcuggagccuacaggugaagaugaugaagagauggaaaucgacgagccccaggaagaggauaacgugcuugagccggauaacgaaagucgggauaaagaaaccgaaagcgacaacgaaaagaaacgauccagagcuuccucaguau

SEQ ID NO: 4623 - RNA, 659 nt, Phyllotreta atra
cgauaaaacggugucuuugggccaccguuuggacaucauuuuccacuuaauuagaauaggcuuguucuucauggaccacgaccuuaucacuagaaauaucgacaaagcgaagacccuaaucgaagagggaggcgauugggacaggaggaaccgauuaaaagucuaccaaggcgcuuauuguauguccgugagggacuucaaaaccgccgcuaaccuguuuuuggacaccgugagcaccuucacauccuacgagcucauggacuacaaggcuuucgucagguacaccgucuacacuuccauaaucagccugccgagaaaccaacuuagagauaaaguaauaaaaggcuccgagauacuggaggugcuucauuccgagccguucguuaaagauuaccuguuuucuuuguacaacugccaguacgcggaguucuucucgaauuuggccgaggucgagacgaucuugaggaaagauuacuuccugaauccccauuaccgguauuacguuagggaaaugaagauuucggccuacacgcaacugcuggaguccuaucgaucucuuacguugcaauauauggccgaagcuuucgggguuaccaucgaguacaucgaugaggaguugucgacuuucaucgccgcuggaaggcugcauuguaaaaucg

SEQ ID NO: 4624 - RNA, 799 nt, Phyllotreta atra
uucgucgaaaguugaagaguaaauuagcagaaacguuuccagccuaucuucaagaggcuuuuuucgggaaagaucuuauggauacggucgauuguaaaaaggaagaagucgauugcuauagcagcgaugaugagaaaacugacaagcauuuuaaaucgauuaauuuaucacaagacgaaauaauagcaauaguggcaucagguaaaaccgagaaauuggaaaacaauaacaaagauucgaccaaagaagucaaaccgacuguguugaaggaggaagaagaagauaauccggaggauuugaaagauguucuugcccuaccgggcgacuuacucgauaccgauuugguuaauagcauuauggaagaugaggaggaacugagcaaaacuacagcgucucuuguugcuuuagauucgaauuuacagcacgaugcggaacugacggacacuuugaguaguucaggaaauucgaaagaaaccaaagaugaauugagcgacauuuuaggcccucauuucaaccucgauuccauaucgaacauaaacagcaaggacgucgaagacauauuuaagggcguauuaacagacgagucgcaggaaucccaagaaagcaguagcuucucccuacaaggaaauaauauguuuucgaauaauaaugcgcaacaaaacguugcccaacaccccauuauuaaucaagcggugagaccgaaaacauugccuacuguuaaucacaauuugaauuccccuguuaguuucccaccccccucaccguaccacucggaauacagcaacaguccucaguuuag

SEQ ID NO: 4625 - RNA, 733 nt, Phyllotreta atra
cggcuaucgagaaaccuaaaauuagcaaguacucuacacuggccauuaacuugucagcuaaggauuacaugaggaauuuuucccaaccgguuaaaaaacgcgcuaucgaaaaaaauguacaacccagugugcccaaaccaguaaucaaguuaaacaaaaaacuaacuaaaucaauucaaccaauuaaaauugaagauaccaaaaacgaaacgauugagccugaugagcauaucgauaaagaaaaggcugauccagauacaucacacuuugaugaugauuuggaugaaacuuuacuagaagaaaucagcgaagaucugaauaaaaccgccacugaaucccaaauaaccgaaucagaaaugaacgaagacgauuuuccaggggauuuugauacaacaguaauagaugaaaucgaagaacgaauuaacauugccagcgaacaacuaaucaacgauauucaagcggaagucgagacggaauggcaguauuucaacgaugcuaauaaaagcuuuaaaauagcaacaguagauucuggagauacugauucuauugcuucggaagauaccgauucuauugccgauucuccugcugucacuacugccgauacuccauuuguagaagucgaagggaacaguguguuuagguucuuuuggugggaugcuuacguggauccacuacaucaacaagggacuguuuuucucuuugguaaaacguacugcgaaaccuccaagaaaua

SEQ ID NO: 4626 - RNA, 744 nt, Phyllotreta atra
gacgcaggcuauuagaaagaguauuggaguaaggauaaaggaagagagugaaauuaucgaaggugaagucgucgaucugagcauugaacguccagcuacaggaguugguacuaaagucgguaaauugauucucaaaacuacagacauggaaacuguauacgauuugggcgguaaaaugauugauaguauucuaaaagaaaaaguucagucuggugauguuaucacuauagauaaagcuacaggaaaaauuacgagauuggguagaucuuuugcuagagcuagagauuacgaugcuacuggccaacaaacgagguucguucaauguccagaaggugaacugcaaaaacguaaagaaguuguccacacagugacuuugcaugaaauugauguaaucaacagucgcacccacggauucuuggcacuauuuuccggugacacuggagaaauuaaaucagaaguaagagagcagauuaacggcaaaguagcugaauggcgugaagaaggcaaggcugaaauuauaccuggcguacuguucauugaugagguucauauguuggauauagaaugcuucucauuuuuaaacagagcuuuagaaaaugaaaugucuccaaucgucauaauggccaccaauagagguauaacaaaaauucgagguaccacuuacaaaucuccgcacggcauuccguuagauuuacuggaucgaacaauuauuguuccuacucagccauacgacgagaaggaauu

SEQ ID NO: 4627 - RNA, 771 nt, Phyllotreta atra
uuaucugcgacuguucagaggaucccuguacaaaaaauauccugggauguucaggaggucuauaaccaacgaagaaagacgaagguugauugaacucgguuugagccagcacguuuuagcgagcaguguaucacugcuuagagcagaagaaguugaagauauaauugaaggaaaugaugagaaguauaaagcuguaucuguacacacuucggagccuccuaugccaagagaggguaaauccaagaaaaacaugcaauggguaccaucguuaccuaauuccagucacuuagaugccguuccacaagcuacccccauuaauaggaacagaguagcugcuaaaaaggugaggacauucccacuauguuuugaugacacagauccccaaauaaacauagaaaaugcuugucaacaagaauugcuaguuccuauuagacuggacauggaaaucgaaggacagaagcucagagauacauucacuuggaauaaaaaugagaguuuaauaacgccugaacaauuugcugaaguucucugcgacgaucuugauuuaaauccuuuaacauuuguaccagcgauugcucaagcgauuagacaacaacucgaugcauucccaacagaaccuccugcuauuauagaggaaaccugcgaucaaagagucauuauuaaguuaaacauucacgugggaaacacuucuuuagucgaucaaguugaaugggauaugagugaaaaacagaauaaucccgaagaauuugcguugaaacuuugcgcagaauu

SEQ ID NO: 4628 - RNA, 560 nt, Phyllotreta atra
ucaucagcuacaccacuaacgccuuuccgggcgaauacauucccaccguauucgacaauuauucggccaacgugauggucgauggacgacccauuaauuuggggcuuugggauaccgcuggucaagaggauuacgaucggcuucgaccgcucagcuauccgcaaacggauuguuuccuucuuuguuucagccuagugaauccggcaucguuugaaaauguaagagcgaaaugguacccugaaguauugcaucauuguccuagaacgccgaucaucuuaguugguacgaaacuugaucuccgcgacgacccggcaucguuugaaaauguaagagcgaaaugguacccugaaguauugcaucauuguccuagaacgccgaucaucuuaguugguacgaaacuugaucuccgcgacgacccgaaauccauugaaaagcuaaaagagcgaagauuauuuccgaucacguauacacaggguuugcaaauggccaaagaaaucaaagccgucaaauacuuggaauguucagcguugacgcaagucggcuugaagcagguguucgau

SEQ ID NO: 4629 - RNA, 749 nt, Phyllotreta atra
uucauauugccuaccgaugguuccacuguuacgauaaucaacaguacugaugaugggaggauuuucuauggcacaaaagaagggaauuuauuugaaauugcauaucaagcugagagugguugguucggcaaaagaugcaaaaaaauuaaucuaucgaccagcacuuugucguuccugguucccucguuuauuaaugcagcguuaagugaagaggauggaauaacgcaaauuucaauugacgauagccgacauauucucuacauucuuacggaaaaaggauccauugaaguuugcgaccuaggagacaaagggaauucguuuuccagaauuaguaaaauaucucaaaacacguugguuaaccaagcaaugaauacuguuaaaacucuugacagucagaauuuucgaccaauagugagcauauccgccaucgaagcguccgaaucgguuaauuuaaauuuaguagcuguaucucaaacuggaguaagauuuuauaugaguguuacgaguuugucaaaccaaaauccuaaucaaagaccauacacgcuaacccuggcucauguaaggcuuccaccgggcuauucagcgaacauuaccguaagacccagggcggugcaugugucccaauauagggacagaaacuugauauugauauccacaguuaaugagaaagauguguugugguguaugagcucagacuuauuuccauucggccgaggacugacagaagcuuacacggccauuaauuugga

SEQ ID NO: 4630 - RNA, 679 nt, Phyllotreta atra
caguauggcgaucagaagaaggcgaaacggugguguacaaugcaucguucaaauccaaccgauggacucaaguuauacuggaaaccgaaccgugcgaauuuaaauauaucccuauaaaacacaacgaugucaagacgcuuuacuuacagcacauuuuccauccaggcagauucccuuugcacguuauuaacaaaacucuuucgauauauaaaaugccuacgauugccucagacucccaucuuuccguuucugcucuaaagcaaagagugugcuuggcugucgagaacgacauacaaaaucucuuuaauaaugguagcgauaucgauagcguugaaguugaugaguauguagagugugcugaauggaguuggcaaaaauucuacaccuauuguguccaauaccauacagcuagcagaaaaccguuggguuugaugcuauuaccauccguaucaggagcuauguucuugaaaaaaucuguguuuucguuucuacgcccuguggauucguuggaacauaugacguuguguacagauuuguacagagagcaguuuuacaauuuuuccauguuguccgaagauuuggauacaguagacgacguaaucaacguguuuaaagugauuguuuacaucgaacaacaacuaaaggauguuuucaugcaaucguucgaaacagaacuucu

SEQ ID NO: 4631 - RNA, 775 nt, Phyllotreta atra
acaaccgaaauacgauuugcugguuucgaacgccuuacaguuccuuucgucuguggccgaacgcucccaauacagaaaccucuucgaggacgacaacguguugagcagcaucugcgagaaagucaucauacccaacauggaauucagaaccuccgaugaggaauuguucgaagacaaucccgaagaguacacgagaagggacauagaaggcuccgacauugacacgcgcagacgagccgccugcgauuuggucaacacuuugagccagaacuucgagcaacggaucgucgagauauucggcagauaucuacaagugaugcucgcgaaguacgcggagaacccgaaggaguucuggcgcagcaaggacgcggccuuguacuugguaacgucgcugguuagcaggggauccacucagaagcacggcguuacgcagaccagccaauugguggacauuacccaguucugucggcagcacauuuugcccgaauuagagcgaccggacguuaacgauuugccgguguugaaagccgaugcuauaaaguacgugaugacguucagaucgguacugcccagcgauuuggucguaucuacuuuaccgcaacugauaaggcauaugccgagcgaaaguugcgugguucacacguacgccgcgugcacuuuggagaagauucuuauguugaaauccaacaaucaagcuauaguaaccggggcucaguuggagccguuggccuccgaguuguugaccaauuuguucgccguauuacaaaaacccgug

SEQ ID NO: 4632 - RNA, 458 nt, Phyllotreta atra
aucacguucgaaugcauagaggaauuaaaagaagacuuagaauggaagaugauuuacguugguucggccgaaacugaagaacacgaucaaaucuuagacuccguauuuguaggaccuaucccagaaggcaaacacauguucgucuuucaggcagauccuccgaacgucucucguauaccugaaaaugaugccaucgguguaacaguugugcuucucacuugcuccuacaagagccaagaauucauucguguagguuauuuuauaaauaaugaauacagcgauccggaaaugagggaaaauuugccuaguccaccucaauucgauaagguaauuagaaauauauuggcuuccgaaccgagggugacgagguuuaaaaucaauugggaagaaucgagcgguacucaggaaaacggaacuacaauugccgaggcccccgcuaaccaaacaaccgaaacuuc

SEQ ID NO: 4633 - RNA, 702 nt, Phyllotreta atra
uuuaccaaacgccauucaacaacaacaaagucuaccuacuacuaacucacaagugccuccucuagcuccaaugggagguucuacuccaacgcuuggucuagguuuaggccaugcuauguccaugccacauacuaaguauguaaccggauuuucacugccuaucagcucuauggcaccucaaacaccacaacauacaaugaugagucccaugguaaauguugguggaacugguaccacuaguucugguguaacgccuacguuaggucccucuacaccuucaccaaugacuccuaugacaccacauucagcagauccuggaaucguuccacaauuacaaaacauugugucaacuguaaacuugagcuguaaauuagauuuaaagaaaauugccuugcaugcgagaaaugccgaauauaauccuaaacguuuugccgcugugauuaugaggauacgagagccaaggacgacagcuuugauauuuucgucggguaaaaugguguguacaggugcgaaaagugaagaagacucgagacuagcugcaagaaaguaugcucgaauuauacaaaaacuggguuucccugcgaaauuuuuggauuucaaaauacagaauauggugggaaguugugauguuaaauuuccaauacgauuagagggauugguucuaacucacaguucuuucaguaguuaugagcccgaauuguu

SEQ ID NO: 4634 - RNA, 305 nt, Phyllotreta atra
uacgcagaucaaaugagcuucacuuuugcugcuggaaaccaggucuucuacaacgcaacaucaauaaaacaaguagauguuccuucuuucucagguagcuuugguauccuaccagcccacguucccacucuugcuguucuaaagccuggaguaguuacuguuuaugaagacgcugguaaugucaagaaaaucuucguauccagcgguacagugacuguuaaugacgauucaucuguucaaaucuuagcugaagaggcccauccaguagaaaauuuagacguuagugcagccagagaucuucuuaa

SEQ ID NO: 4635 - RNA, 719 nt, Phyllotreta atra
gcgaaugggaaaaguuaguguugaauacguucaagaaguacgagaaguccagcagggagcagcacgcggccgaauugaaggagaaacaggaacaggaggcccgcaggaaggccaagaaagaggccgaaucggccaagcaggcucaaauuaccgaacuaacggaagagcaggcugagaaauugcaagccgaacucgaugcuaaaaaguccccagcuucggcagccacuucgaauagcucgaguggcccuucgacuuccacugcgaagaucgaagaagacgaagacgagucggagaaggguaaauuguuacccaauaaaggcaacggaugugauuuagacaaguauaauuggacccagacucuuagugauauagagcugcgagugccgcuccggugcaauuuccgagccaagcaaaaggaucucacggugaauuuaaccaaaaaacaucucacgugcggccucaaaggccauccccccaucaucgacgacgauuuccagcacgagaucaaacuggaagagaccaauugggugauugaggaugggaaaucguugcuguuuuccauagaaaaagugaauaagaugaauugguggaguaaaaucgugaagaaugauccggagauuagcacuaagaaaauaaauccggagccuucgaaguugagcgaucuggauggugagacgagggguaugguggagaagaugauguacgaucaaaggcagaaa

SEQ ID NO: 4636 - RNA, 359 nt, Phyllotreta atra
gcaauggagcccugauaaaaaauacagcgauagagaaagguggauuugcguuuauccagcauacaucaauugcaaaaaaaccauagcccaaggcaggaaaauaaacaaagaaaaaugcguggagaaucccacucaucaagagaucagagacguuuugcucgcugcagguuugaagguuggcguagaaaacaaauuguacagcagggaacgaagcaaagaauuguuguaucgagggcgaauuagaguccaauugaaaaacgacgacgguacgcugugcaauccaaacuucccaaccagagacagccuaaugcuccauuugggagacaugauucccaaauugaagagcagacaaaacaagg

SEQ ID NO: 4637 - RNA, 685 nt, Phyllotreta atra
gaccacaggaacauuaccauuugguugaaauacaccgaaauggaaaugcggaacagacaaguaaaucaugccaggaacuuaugggacagagcuacaguucuuuuaccaaggguaaaccaguuuugguacaaguacaccuauauggaagaaaugcuggaaaacguagccggagcaagagcgguauucgaaagauggauggauuggcaaccugacgaacaagcuuggcaaacuuacauaaauuucgaacugagauacaaggaaauugacagagccaggcaaauauacgaaagauuuguuauaacgcauccggaggugaagcauuggaucaaauaugcccguuucgaagaaaaucacgguuucauucauucagcuagacagauuuacgaaagagcuguccaguuuuacggagacgaucauuuggaugagaagcucuacauagcuuucgccaaauucgaagaaaaccaaaaggagcacgauagagccaggguuaucuacaaguacgccuuagaccacaucccuaaggaugaaacgaaagaacuguauaaggcguacaccauccaugaaaagaaauauggagacagaagcgguaucgaggaaguuauaaugucuaaacgaaagcugcaguacgaacaagaaauacuccaaaaucccaccaauuacgaugcuugguucgauuaucuccgac

SEQ ID NO: 4638 - RNA, 787 nt, Phyllotreta atra
ucugccugcuuaucaucauccaacuguucguggcaggucuuaucgugcuccuucucgaugaauuguugcagaaaggauacgguuuggguucugguauuucgcuuuucaucgcuacaaacaucugcgagacgaucauauggaaggcuuucucuccggcuacugucaacacuggaagaggcaccgaauucgaaggagcuguaaucgcucuguuccacuugcucaccaccagacaagacaagauuagaggauuacgagaggcuuucuaccgccagaaucuuccuaacuugaugaaccuccuagccacaguuuuaguguuugcuauaguaauauacuuccaagguuuuagagucgauuuaccgauaaagagcgccagguaccguggccagcacucgagcuaccccaucaaacuuuucuacacuuccaacauuccgaucauuuugcaaucugcuuugguguccaauuuguacguuauaucccagauguuggcgguuaaauuucaagggaacuucuucaucaaucuguuggggguuugggccgauguugggggcggcggcccggcuaggucuuaccccaucggcgguuugugcuauuacuuaucgccgccugagagcguuagccacauucuggaagaucccguccacgcuguuauguacauuauuuucaugcuggguuccugcgcuuucuucucgaaaacguggaucgagguauccggcaguucggcuaaggaugucgccaagcagcugaaggaacagcagauggucaugagaggucacagagacaauuccau

SEQ ID NO: 4639 - RNA, 318 nt, Phyllotreta atra
gguuucaucuucagcuguugaauuaaguucauacagggaucagcauuuuaagggcagucgagcugagcaggacaaguuauuaaggcuuucuacgaccuuauacguaggaaaccuaucauuuuacacaacagaagaacaaauuuaugaauuauuuucgaaaugcggcgacauuaggcgaaucgugaugggccuggacaaguauaagaaaacaccuuguggauuuuguuucaucgaguauuacaaucgcgaagaugcagaaaauugcuuaagguacaucaacgguacaagauuggacgauaggauaguucgaacggauug

SEQ ID NO: 4640 - RNA, 712 nt, Phyllotreta atra
aauuuaaccaccaucggucagaucaacuccuauucgaccgccaaagaauggaguagagguaaaaaggcacuuuuaggaacauuaggguuauuagccggaggcacuggggccguacuaguggcccucgaccaaucgguuaaagcgucggaucuagaacugcacccgccgaagaacaucuggagccacagcgggauauucagcucacuugaucacgccagcguccggagggguuacgaagucuacaaacaaguaugcgccgcaugucacuccuugcguuucguggccuaccgcaaucuaauaggcguuacucacaccgaagccgaagccaaagccgaagccgaagaccagaugaucgaagacggccccaacgaggagggcaacauguucaaacgccccgggaaauuguccgacuacuuccccagcccuuaccccaacgaggaggcggccagggccgccaacaacggggccuacccgcccgauuugagcuacauuacgucugcuagacacggagccgaggauuauauuuuugcgcuguugacugguuacugcgaggccccagccggggugguuguuagagaagggcaguacuacaauccguacuuccccggcggggcuauuucgauggcucaggcuuuguauaacgagacgauugaguacggugacgguacuccggcuacggcuagucaauuagcuaaggaugugucgacguuuu

SEQ ID NO: 4641 - RNA, 713 nt, Phyllotreta atra
cgacgggaaaauuaaagugguuggaucuucggaagccgaugauaauagcauuaagacuguguucgaagccucuaagacgagaccuuuagauaagcgaaaaaggaagaagaaugaugaccccagcgauguggaagguuucuuagguccuugggguggauucauagacgaacaaaaaguauccaaaccgaccgaggaagaacaaaucgaauuggaugagauauccuccaagaagaauaaaaaggguaaacccaacgaagauaaaccccucgaagaaaaaucagucuugcacaucaaagacgccguggauuaccaagggcgcucauuccuccaugcgccacaagaugucgggguuaaucucagaucggacacuccuccagagaaauguuuccuacccaaagcucauauucacacuuggacuggccauucgaagggcaucgcugcuauccgauuguuccccaggacugcucaucuucuauuaucagccggaauggacugucguauuaaaauuugggagguuuacaacgaaagacggugcguuaggaccuacuauggacaucgacaagccguuagggauauuaauuucaacaauuccggaaagcauuuucuuucggccgguuacgacagguauauaaaauugugggauacggaaacaggacagguuuugucgcguuucaccagcaggaagauacccuauugcguaaaauucaauccgg

SEQ ID NO: 4642 - RNA, 591 nt, Phyllotreta atra
cgagcaaaagaaagaagucaaucccuuauucgaaaagagaccuaggaauuucggaauaggccaagacauccaacccccgagggaucuauccagguucgugaaauggcccaaauacauccgcauccagaggcagaaggccgucuuacagaaacgcuugaaagugccgccgccaaucaaccaauucucccaaaccaucgacaaacaaacggccacccaauuguucaaaguuuuggagaaguaccgaccggaaaccgccuugcagaaaaagaaccgacugaaggcuaaggccgaggccaagguggccaaaaaggaagaggcccccgccaagagacccaauacuuugagagccgguacuaacaccguuaccaaauuggucgagcaaaagaaagcccaauugguggucaucgcacacgauguagacccuaucgaauugguacuauuccuucccgcccucugcaggaaaaugggaguccccuacugcauagugaaggguaaagcuagguuagggcuacucguuaggcguaaaacuugugcgacuguggcacuaacacaagucgauuccggagacagguccaacuucaacaagcucuu

SEQ ID NO: 4643 - RNA, 766 nt, Phyllotreta atra
cuucgaauaugcaaugaccgacuauuugaggauauccggcauguacuggggccucacggcucucgaauuaaugaacgccucaccaccacacucaauagacgagauuucagauuacaucaaacagugccaagaccccgaaagcggugggaucagcucuugccugaaccacgauccucacauacuccacaccuuaagcgccguucagauacugugcauguacgauaacuuaaaagcuauagauguagagggcguugugaaguacguaaaaaaccuacaauuacccgacgguagcuucacaggagacaaauggggcgaaguggacaccagguucucauucugugccgucgcgacgcucucgcuauuggacagaauggacgucaucgacguuaauaaagcaguagacuucguagauucuuguaaaaacuucgauggcgguuucggcucgaggccccucuccgaaagccacgccggcuuaauauacugcugcuuaggauuccugucuguuaccaaucgauuggauguuguggaucgagauaugcuggcuugguggcucugcgaaaggcaauuaccuucaggcgguuugaacgggcguccggagaagcugcccgacguuugcuacuccuggugggugcugucuucuuuaacuauauuaggaaaacugcauuguaucgacgccaaugcguugaagaaauuuauauuagcaugccaggauaccgagagcgggggcuucgcugauaggccuggagacauuccagauccuuuccac

SEQ ID NO: 4644 - RNA, 703 nt, Phyllotreta atra
uacagcugaagaaccaacucacuucgaaagacgcgaccaucaaagccaccuaccaacagcgcuggcuggucuucuccgaagaagucagagacuacaucaagaagaacguggucggcgcccucgggaccgagaccaacaggccgucgucggccgcccaaugcgucgccuacauagcggugaccgaauuaccgcaaggacaauggccggaucucauaucgacgcuggugagcaacauuugccaggggaauuccaccgaaaugcagaaggaggccacgcucgaagccaucggcuacaucugccaggaaaucgaauccgauguccuagugacccaauccaacgauauacuaacagccaucgugcacggcaugagaucuucagaacccagcaaucacguucgauuggccgccacgcaggcuuugcuaaacucguuggaauucaccaaagccaacuucgauuuacccaccgaaaggaauuacaucauggaggucguuugcgaagccacgcagucgccggugucgcaaaucaagguggccgcuuugcaaugucuagugaaaaucaugucgcuguauuaccaacacauggagcccuacauggcgcccgcgcuguuucccauaacguuagaggccaugaagucggagaacgaugccguggcucugcaggguaucgaauuuuggucgaacgugagcgaugaagaaguggauuu

SEQ ID NO: 4645 - RNA, 793 nt, Phyllotreta atra
cggcaaaaguaccuucuagacagauacaugacguccaccgaaagacugauagauuuguacgaagacaaagacggacaacguaaggccgagguggccgcccugacgggccccaaugaauucaacgaguucuacagcagacugaagcaaaucaaagauuucuacagaaggcacccgaacgagauaaguguaccgaugucgguggaguucgaugaauucgccaaagccagggagaaucccaacgaagauauggccaauuucguggaauuuaccgacgaagaaggcuacgggaaauauuuagauuuacacgagugcuacgagaaguacauaaaucuaaaaggcaucgagaaagucgauuauaucaccuacuuggccauguucgaucaacuguacgacauaccgaaagaacgaaagaccggcgaguacaggaaauauuugcuguaccucaucgaguaccucacgugguucgugcaacgcaucagaccgcugauggaucucgauagcgauuugcaggagcaggccgaucaggcgucgggcggcugggagaacggaacggugcccggguggccgaaagaaaccgguucggcuuuggcgaacgugggcgcccauuuggaccugucggccuucuccaguugggaggaauuggcuucguugggcuuggaucgcuugaaauccgcccuuauggcguugggauugaaaugcggaggaaccuuggaggagcgcgcccaacgguuguucucgacgaaaggcaagggcuccuuggacccgucgcugaugacgaagaacagcaagaauc

SEQ ID NO: 4646 - RNA, 507 nt, Phyllotreta atra
uaucggcaccuuuaaagcuuucgacaagcauaugaacaugauacucggcgauugcgaagaauuccguaaaauuaaacccaaaaacucgaaagucgaacgagaagagaagcggguauuaggauuuguacugcugagaggcgagagcauagucucacuaacuguagaagggccuccaccaccagaagaaggacuucccaggguaccuauacccggagcagcucaagggccagguauaggaagagcagcagguaggggaaugccucccgguauggcuggaguaccgguuggucuccaaggucccguuagaggagucggaggaccgucucagcaaguaaugacuccuacggguagaggacaggucucagcgccaccacaaaugaaccaagcgccuccgaggauggguggcccuccgccugguaugauggggccgccgccgggaaugaugggcaugccgccgcaaauggguauggggcgcggaggaccgccuccgauggguaugaggggucc

SEQ ID NO: 4647 - RNA, 667 nt, Phyllotreta atra
acuuguuuggccauauggaauguuauucaaccucaagaaauuccauuuccuacgaaggagcugugguuagagaaguccaaggaauuuuaugagauuacacaguuucccaauuguauuggaaguaucgacgggaaacauaucaggauaauuugucccccuaacucuggcucagaguauuucaauuacaagaaauacuucucgauuguccuuuuggcgguugcugacgcaaauuauuacuucacagcugucgauauuggaucuuuuggacgcgaaggagacucuacgaucuucaaaaagucaaauuuuggacuaagacucaaaaauaacgaacuagaccugccugcagauaauccccuaccaguaccugacaauguggagcaagguuccgagguacccuauguuuugcucggggaugaggcuuuuggguugucaaagcaugugaugcggccauacccguccaagggauuaucgcaagaaaagaggaucuacaacuacagacacugccgagcucggcgugucguagaaugcucuuucggaauucucucuaacaaauggcgugugcuacauucuucuauguuaauacauccugaauuugcugucaucguagugcaggcuuguuguguuuugcauaauuuugugcgaagaagagauggcuaccuuuuugagg

SEQ ID NO: 4648 - RNA, 799 nt, Phyllotreta atra
uucgucgaaaguugaagaguaaauuagcagaaacguuuccagccuaucuucaagaggcuuuuuucgggaaagaucuuauggauacggucgauuguaaaaaggaagaagucgauuguuauagcagcgaugaugagaaaacugacaagcauuuuaaaucgauuaauuuaucacaagacgaaauaauagcaaucguggcaucagguaaaaccgagaaauuggaaaacaauaacaaagauucgaccaaagaagucaaaccgacuguguugaaggaggaagaagaagauaauccggaggauuugaaagauguucuugcccuaccgggcgacuuacucgauaccgauuugguuaauagcauuauggaagacgaggaggaacugagcaaaacuacagcgucucuuguugcuuuagauucgaauuuacagcaugaugcggaacugacggacacuuugaguaguucaggaaauucgaaagaaaccaaagaugaauugagcgacauuuuaggcccucauuucaaccucgauuccauaucgaacauaaacagcaaggacgucgaagacauauuuaagggcguauuaacagacgagucgcaggaaucccaagaaagcaguagcuucuccuuacaaggaaauaauauguuuucgaauaauaaugcgcaacaaaacguugcccaacaccccauuauuaaucaagcggugagaccgaaaacauugccuacuguuaaucacaauuugaauuccccuguuaguuucccaccccccucaccuuaccacucggaguacagcaacaguccucaguuuag

SEQ ID NO: 4649 - RNA, 713 nt, Psylliodes chrysocephala
aagaacgucagucaacaagacauagaggcuagaaacagguuaaaacaggaagaaaauaagagagaacuugaaaaagugaagaaaaggagguuggaacgagaauuagaaagacaaaagagagaagaagaaacacaaauguuacaaaggaguaaagaagcugcacaauuugaagaaugggaaaggcaggaagacaaguuucauuuggaacaagcuagauuaaggucucauauaaggauacaagauggucgagcuaaaccuauagauuugcuggcaaaguauauaagugcugaagaagagguagaugcaguggagaugcaugagccauauacauaccucaauggguuacaaauuaaagaccuagaagaucuaguugaggauauuaaaguguacaaagaauuagaaagggguaaaaauuuggauuauuggaaugauauaacagucauaguugaagaugagcuacaaaaauugagaaaaauagagaagcaaaacgauuuugauuuaggauuaaauagaagagaagguauacaucagucaguugcuacugauguuacaucaguguucaaaggaaaaacugcugcucaacuagcagcuuuagaaaagcacauugaaaguaaaauuaguggcaaagcugauggaauagauauaggcuacugggaaucuuuauugucccaacuaaaagcccacauggcgagagcaagauuacgagauaggca

SEQ ID NO: 4650 - RNA, 694 nt, Psylliodes chrysocephala
auagagaucaagaaaccgccuugagugcgaugagaaaucuaaauggcuacgaaauuggcggcagaaaccuaagaguagauaaugcuuguacagaaaaaucucgaauggaaaugcaaaauuugcuuaaucaaccuccaguagaaaacccuuauggagagccuauucaagcugagaaagcuccugaagcuauuagcaaggcuguagcuucucugccaccagaacaaauguuugaguugaugaagcaaaugaaaacuacaauacagaacaacccaacagaagcaaggcaaauguuacuucaaaauccacaauuagcuuaugcucuuuugcaggcucaaguaguuaugaaaauaauugauccccauacagcagcuacauuauuacauccuguaaaucaaguuccugcaacuuuaaugccuggugauaagaauguuccagugcaaguaccaauuaauaaccaauauagggaacccccagcaccuguucaaccaccuagacaagaauuccagccugugccuccaccuauuaugauucccaaccauguucaaccaccuguuuuuacugggcaagauguugacuuaaggucccugggaaccgccccagauccaagacucgggccuguggugagggaccaagauaugagacaaauuccaggcccuauucaaaaucccuuaccgccuaccauuggagaaagcuu

SEQ ID NO: 4651 - RNA, 693 nt, Psylliodes chrysocephala
acaacaugagccaugaagauccuggugauguaacuuauucugcuauugguggucuuucugaacaaauuagagaacuccgagaaguuauugaauuaccauuaaugaacccggaguuauuuaugagaguuggaauuacaccuccaaaagguuguuugcuuuauggaccaccagguacaggaaaaacuuuguuggcaagagcuguggcuucacaacuugaugcaaauuucuugaaaguuguaucuagugcuauuguugacaaauauauuggagagucugccagacuuaucagagaaauguucaacuaugcuaaagaucaucaaccuugcauuauuuuuauggaugaaauugaugcuauagguggucgcagguuuucagaagguacaucagcagacagagaaauucagagaacucucauggaauugcuuaaucaaauggauggauuugacucuuuaggacaaguaaaaaugauaauggccaccaacagaccugacacauuagauccugcuuuacuccguccaggccguuuggauagaaaaauugaaaucccucuaccaaaugaacaggcccgucuugaaauucucaaaauccaugccuucccuauugccaaacauggggaaauugauuaugaggcaauuguuaaacuaucugauacuuucaauggugcagauuuaaggaauguuuguaccgaagcag

SEQ ID NO: 4652 - RNA, 257 nt, Psylliodes chrysocephala
ucgcuacgauucaagaacaaccaucuucucgccugagggccgacucuaccagguugaauaugcgcucgaggcuauuucccaugccgguaccgccauugguauccuugccaaggacggcaucguccuugcugccgaacgcaaggucacauccaagcuccucgagcaagacaccucugccgaaaagcucuacguccucaacgauaacaugaucugcgccgucgcugguaugacagccgaugccaacauccucaucaacu

SEQ ID NO: 4653 - RNA, 655 nt, Psylliodes chrysocephala
agcucuuagauuagccaugcaacuaaaugaucacagucuuauagaagaaauauuugugaauuguccagacacugauauucaaaagcaguuggcauucauguuagggaggcaacaaauuuauauugaaauuccagaaagcacuccagaauaugaagaccucauagaaauaauggccaacugucaucugaacaaccacuuccuaaaucucgcccgugaauuggauaucauggauccaaaaacuccugaagauguguacaagucacauuuagaaaacagccgucccccauuuggggguagucaaguugacucugccagacaaaacuuagcugcaagcuuuguaaaugguuuugugaaugcugcuuuuggccaggauaagcucuugauggaagaugguaauaaaugguuguacaaaaacaaagaacauggaaugcucagcgcaacugcuucauugggauugguauuacugugggauguagaugguggucuuacccccauugauaaauauuuguacucuucugaagaucacaucaaaucuggagcucuguuagcaugugguaucguaaauugugguguuaggaaugaaugugacccagcacuagcucuguugagugauuaugugcuacauaauacaaacaucaugaggauaggcgcuaua

SEQ ID NO: 4654 - RNA, 723 nt, Psylliodes chrysocephala
guuguaccgguaacucucucagaaaucgaacauccuggagauuaugccaaccuucagacugcgcaauauaauaacgguuacgcugaugguucucaauaccuagcucaacaucaguaucaaaauuuguucauaaacagaaacgauguugauaauucuucucccacggcgguuuuauacagaggcgaucccaauuuagcagauucuagauaccaaguaaacuuugaaguauccaguacucaaccccaagugaacauccucccuucuuccggagauuccuacaccuacaccaccccaggaaguuggaaugcuaguagcagugguucuuaucaacaacaauaucccggaaacauaaauguucuucaucaagccgacaguacucagucguacucugcuggacaauacgcaaacuccacuuggucaucuaacacgauggaggauggacggccaucuagucaagagguacuagugaaagagugcguuaauuguggcgcuagcguuacaccucuuuggcguagagacgguaccgggcauuaucuauguaacgcgugugguuuauaccacaaaauuaaugggguucacagaccgccgauuagaccaaccaaaaaaccacaggcgacuggaaauaggcgaaacggaguaucgugugcuaacugcaaaacuaauaauacuacccuuuggagaagaaauaaccaaggugaaccuguuuguaacgcuuguggacua

SEQ ID NO: 4655 - RNA, 791 nt, Psylliodes chrysocephala
ucucuugaaaagaaccucggcagccacgauccgcgaagcaugaugaaaugcugcgagagccucgcguuccuuguacgcgacguggcccacaucacuccauacaauuucgacgugugcguucacugcauacgaaccuucgucgaggccagucugcacggcaccagccucagacgaaccagaucgagaaaaaaguccucggacaggcaccggacgagaaagagcccugccagcaguccugaugaggacgacagugaugacgacgacauuccaagcggcuaccaucaaauauccauacaauuauuagauuugaugcacacgcugcauacacgaacggcgcagauuuuuaaauggugggccgaagagggcggcgaaauaucgcaagagacgucgcuguggacucaaggcuggugcccgcuguuacaagggaucgcgcgauugugcugugauaccagaagacccgugcggaugagcgcuauaacguaccugcagagagcguugcuggugcacgaucuucaaacauugagcgggcccgaaugggagcaauguuuccagagaguuuuauucccgcuuuuaaguuaccuacuacaaucgaucaguccuaaagacgccaucgccauggaggaaacuagaauaagagcggcaacggugcuaucgaaaguauuuuuacaucaccucaccccacugcuagcguugccgaguuuuuucaaucuuugguuggucguucuggacuuuauggacaaauauaugcaugcggauaggagcgaacucuuauacgaagcuauuccggaaag

SEQ ID NO: 4656 - RNA, 470 nt, Psylliodes chrysocephala
cucaaaccguagcaacaaauuucgaaaaaguauucgaaaugggcccacaucuauucgucggccuacccgguuuagcuacagacacccaaaccguaauggaaaaguuacgauuucguaaaaaucuuuacgaacucaaagaaaacagacguauuucaccaaaaguauuugcugcaaugauuucaaauauguuauacgaaaagagguuuggccccuuuuucgucgaaccgguaguugcaggauuaaugccuggaacuuuugagccuuauauauguaauauggaucuuauugguuguauuaaucaaccuacugauuuuguuguuggugguacugcuuccgcacaauuguaugguaugugcgaagcacuaugggaaccuaauuugggaccugacgauuuguuugagacuauaucgcaagcgcugaugaaugcuuucgauagagaugcuauuucugguuggggagcuacaguuuau

SEQ ID NO: 4657 - RNA, 675 nt, Psylliodes chrysocephala
cuggcagaaagcuacucuagauuuaauaaauagguuuucucagacuaauauuuggccuuuauuagaaauucugacuguuuuaccagaggaauuggaaaguagaucuguaaggcuaggugaaaauaggcgaauugagguauuagaagacaugaaauuuugcgcccccacugucaacgaauucuugaaacauugcuccaaucuuuacggcacaaauuggcaagagcacguucaggucaauguaaaaauauugcguuguuucacaucuuggguauccguaggugccauaagucugaacgaucuugcaaauaacguaguaaucaauagggcauuugaaauacugaacuuuaagccucaaaaugacaaacauaccauaucaggugccuuccacgaggcugcuacagacuguauaugcaccuuauuguuauguuuagaagauaacaauaaucaacuagguuuagaaaguuaucuuuuuaauaauauaauuaauuuggauguaccuuaucacuugucagucgccaacgaagaucaaggaaaaucuauggacuauuguagguuauucacagaauuagcagaaucauuuuuggaaaagauuaucaacaauaguaacacggaacagaugcauuaugcuacuaaaauuuuggauuucguuuuaauguguguugggcaucaugauua

SEQ ID NO: 4658 - RNA, 709 nt, Psylliodes chrysocephala
uuaguuccagaaagucaggcauauauggauuuguuggcauuugaaagaaaacuugauucaacaauuaugagaaaaagacuagauauucaagaagcauuaaaacguccaaugaaacaaaaacgaaagcuaagaauuuuuauuucuaauacauucuauccugcuaaagaaccucaacccgaggggccagaagggccuugucaggaagguucuguagcaucuugggaacuuagaguagaagguagacuuuuagaagauucuaaaaaugauccaaauaaaguuaaacguaaauuuucaucuuucuuuaagucuuugguaauugaacuugauaaggaacucuauggaccugauaaucauuuaguagaauggcauagaacauugacuacacaagaaacagauggcuuucagguaaagagaccuggugauaaaaauguccgcuguacaauccuguuacuacuugauuaucaaccacuacaguuuaaacuugauccuagacuggcucgucuucuuggugugcauacacagacuaggccagucaucauuucagcuuuauggcaguauauuaaaacacaucgccuucaggauucucaugaacgugaauauauuguaugugauaaauauuuagaacaaauuuucaauuguacucguaugaaauuugcugaaauuccacaacguuugaauccauuauuacacccaccagauccaauuguua

SEQ ID NO: 4659 - RNA, 312 nt, Psylliodes chrysocephala
aaccaacuuuagacgagcuugagcaaaaaaugagagaagcugaaacagaaucucaugaagguaaaagaaaaaaugaaucguuguggcccaucuuuaaaauucaccaccaaaaaucaagauauauuuuugaucuguuuuauagaagaaaagcaauuagucgugaacucuaugaauauuguuuaguggaaaauauugcugacaaaaauuugauagccaaguggaagaagcaaggcuaugaaagccuuuguugcuuaagguguauucaaacaagagauacuaauuuuggaacaaauugcauuugucguguaccua

SEQ ID NO: 4660 - RNA, 652 nt, Psylliodes chrysocephala
aaggcccauaggagaguuuagaaguucugcugauuaccaauaccaaaugcuaaggugcaauguagacuuauugaggauaauucaacuaggccuuacauuuuuggaugacaacggaaagacaccugguggggcuuauacuacauggcaguucaauuuuaaauuuaaucuccaggaagacauguaugcacaagacaguauugacuugcugcaaaauucaggaauucaauucaagaagcaugaggaugaggguauagaaccucuagaauuugcggaauugcugaugucuucugguauuguucuuauggaaaauauaaaaugguugucuuuucauucuggcuacgauuuuggauaucuuauaaaacuauugacugacaacaaccuuccacaagaugaaacugaguuuuucgauuuauuaaaauuauauuuucccacaauauaugauguuaaauaucuaaugaaaucauguaaaaauuuaaaagguggucuucaagaaguagcugaacaacucgaauuagaaaggauuggaccacagcaucaggcaggaucugauucacuuuuaacaggaauggcauuuuuuaaaaugaaagagauguuuuuugaagauacgaucgaugauuccaaauuuuccggccaccuauauggacucggaaca

SEQ ID NO: 4661 - RNA, 653 nt, Psylliodes chrysocephala
uucgaaaccagugaagauguggaaguuauugaaaaguucaaaaacaugaaucugaaggaagaauugcuucguggaauuuuugcauaugguuuugaaaagccuucagcuauucaacaaagggcuauuaagccuauuaugaagggcagagauguuaucgcccaagcacagucgggaacugguaaaacugcuacuuuuucaauaucaauuuugcaagcccuugauuugacgaugagagaaacacaaguauugugcuuaucuccaacaagagaauuggcuguucagauucagaaaguuauacuagcuuuaggugacuuuaugaauguacaaugucaugcauguauugguggaacaaaucuuggagaggauauaaggaaacuugauuauggacaacauguuguuaguggaacaccaggaagaguauaugacaugauucgaagaagagcccuuaggacaagaucaguaaaaaugcugguucuagaugaagcugaugaaauguuaaauaaggguuucaaagaacaaaucuaugauguauacagauuucuuccuccuuccacacaagucguucuuauaucagcuacuuugccccaugaaauuuuggaaauuacaucaaaguuuaugacugaucccaucagaaucuuggucaaacgugauga

SEQ ID NO: 4662 - RNA, 680 nt, Psylliodes chrysocephala
ucgaacuuucaagagcucaagacauugaagcuggugacgguaccaccucagucguaguaauugccggugcccuuuuggacgcugcugaaaaauuguugcacagaggaauccacccaacugccauuucagaaucuuuccaaagagcagcucuuuuagcaguagaaauauugaaugguauuucuacaccaauagaaauuacaaauagggaauuguuaaucaaaagugcuucuacuuccuuaaauucuaaaguuguaucacagcauucuagucuauugggaccguuggcuguugaugcaguacucaaaauuguugaaccaggccacgaagaagcuugcaacuuagaagacauaaaaguaaucaaacaauuaggaggaacggucgaagacaccgaauuaguugaaggaaucgucuucucgcaaagauccgcaaacguaucuggcccaaaaagaaucgaaaaggccaaaaucgguuugauacaauucugcauuucaccaccaaaaaccgacauggaccauaacgucauaauauccgauuacgccgcgauggauagaguuuugaaagaggagagagcuuacauuuugaauauagucaagcagauuaagaaagcuggauguaauguucuuuugguucaaaagucaauucucagagacgccguuucagaucuagcccuccacuuuuug

SEQ ID NO: 4663 - RNA, 729 nt, Psylliodes chrysocephala
uuaguagauguuuugcccccugaagcugauucuucaauaaguaugcuacaagcagaugaaaaaccugauguacaauauugcgauauaggagguauggacaugcaaaaacaggaaaucagagaagcuguugaauuaccuuugacucauuuugaguuguauaaacaaauugguauugaucccccacgagguguguugauguauggaccgccugguugugggaaaacuauguuagcaaaggcaguggcacaucauacuacagccgcuuucauucguguagucgguucggaauucguccaaaaauauuuaggagaaggaccgcguauggugcgagacguauuccguuuggccaaagaaaauucgcccgccauuaucuuuauugacgaaaucgacgcuauagcuacgaaacguuucgacgcccaaaccggcgccgaccgcgaaguccaacgaauuuugcucgaacugcuuaaucaaauggacggauuugaucaaacuacaaacguuaagguuauaauggcuacuaacagagcagauacauuggauccugcucuucuaagacccggucguuuggauagaaaaauugaauuuccuuugcccgauagaaggcaaaaacgguugauauucaguacuaucacuucuaaaaugaaccuuucugaagaaguugauuuggaagacuauguggcaagaccugacagaauuucgggggcugauauaaacgccaucugucaagaa

SEQ ID NO: 4664 - RNA, 510 nt, Psylliodes chrysocephala
accaucgcacucuucuuaucccauuucugacuacuauucaucucacaaaauggccgacgcuaagccuauguccaagaucuggcugaucuccaacgauucggccaccaucgaaguugaccgugccguugucgagcgcuccaugcucaucaagaacaugcucgaggaugucggcgacgacaccaucagccagaccaaccccauucccauucccaacgugaaugaggccguuuugcgcaaggucaucgaguggugcaaccaccaccgcgacgaccccgcccaggccgccgacgacgagucggaugcucgaaagaagacgacugauaucgacgagugggaccagaaguucaugcaggucgaucaggagaugcucuucgagauuauccucgccuccaacuaccucgauaucaagccccuucucgaugucggcugcaagacugucgccaacaugaucaagggcaagucgcccgaggagauucgcaagacguucaacauuaccaacgacuucacucc

SEQ ID NO: 4665 - RNA, 697 nt, Psylliodes chrysocephala
ggacaguuccaugacuugauggaguuauucaggauaggcggucguaguccagauacaaauuaucuuuuuaugggugacuaugucgaucgugguuauuacucaguugaaacugucacccucuugguagcacugaaagucagguauaaagaaagaaucacaaucuugagagggaaucacgaaucaaggcaaaucacacaagucuacgguuucuacgaugaaugucuaagaaaauauggaaaugccaauguauggaaauuuuucacugauuuguucgauuacuugccucuaacggcgcucguugauagucaaauauucugucugcaugguggguugaguccuagcauugauacuuuggaccauauuagggcgcuagaucguuuacaagagguaccucacgaaggcccaaugugcgaccuccuuuggucagacccggacgaccgcggagguuggggcaucucuccccguggugccgguuauaccuuuggacaagacaucucagaaacuuucaaucacagcaauggucugacgcugguaucgagggcgcaucaauuggucauggaaggguauaacuggugucacgauagaaacguuguaaccauauucagcgcccccaacuauugcuauagauguggcaaucaagcugccauuauggaauuagacgaugcucuuaaauauucauucuuacaguucgauccgg

SEQ ID NO: 4666 - RNA, 763 nt, Psylliodes chrysocephala
auuuggugcuuagacuucguggugguaugcaaaucuucgucaaaacuuugacugguaaaacaaucaccuuagaaguugaggcaucagacaccauugaaaacgucaaagccaagauccaggauaaggaaggcaucccaccagaccaacagagguugaucuuugccgguaaacaauuagaagaugguagaacauuaucugacuacaauauccagaaagagucgacucuccauuugguacuuagacuucguggugguaugcagaucuuugucaaaacacuaacuggaaagaccaucacucuugaaguagagccaucugauacuauugaaaacguuaaagcuaaaauucaagauaaagaagguaucccaccagaccagcaaagauugaucuucgcaggaaaacagcuagaagacgggcguacucuaucugauuacaacauacagaaagagucuacccugcauuuggugcuuagacuucguggugguaugcaaaucuucgucaaaacuuugacugguaaaacaaucacauuagaaguugaggcaucagacaccauugaaaaugucaaagccaagauccaggauaaggaaggcaucccaccagaccaacagagguugaucuuugcugguaaacaguuagaagacggcagaacauuaucugacuauaauauccaaaaagagucuacucuccauuugguacuuagacuucgcggugguaugcaaaucuucgucaaaacucugacuggaaagaccaucacucuagaagucga

SEQ ID NO: 4667 - RNA, 725 nt, Psylliodes chrysocephala
aaauccaugaaucuggugcuaaugcuguuuuauccaaacuucccauuggugauguagccacucaauauuuugcugaucgagauauguucugugcugguaggguaggagaagaugauaugaaaagaacccuaaaagcaugugguggugcuguaaugaccacuguuaaugaucuaaaugauucaguacuagguaaaugucagcuuuuugaagaaaaacaaauaggaggugagagauacaauuucuuuaaaggauguccuaaugcuaaaacuuguacauuacucuuaagaggaggaucugaacaauuucucgaagaaacugaaagaucuuuacaugaugccaucaugauuguccguagaacuaucaagaaugacucaguuguagcaggaggaggagcaauugaaauggaauuaucaaaauuauuaagagaucauucaagaacuauagcaggaaaagaacaacuccuuauuggggcuauugcuaaagcuuuggagauaaucccaagacaguuaugugauaaugcagguuuugaugcuacaaacauacuaaauaaguuaagacagaagcaugcccagaauaacccuugguaugguguugauauugccaaagaagacauuauugacaacuuugaagcuuguguuugggaaccagccauugucaagguuaaugcuuuaacggcagcugcagaagcuaccugucuaauacuuucuguggacgagacuaucaag

SEQ ID NO: 4668 - RNA, 740 nt, Psylliodes chrysocephala
ucuuggguuuccuuagaacgcauucaauuuguaggugcuugcaauccuccuacagacccuggaagaaaaccucuuucucaucguuuccucagacauguaccagucauuuauguggauuauccuggagaaaccucuuuaaagcaaauuuaugguacuuucacuagagccauguugagguuggcuccagguuuaaaagguuaugcgaauccuuugacaaaugcuaugguugaauuuuaccuagcgucucaagacagauuuacucaagauaugcaaccccauuauguuuauuccccucgagagaugacaagauggguaagaggaauaugcgaggcuaucagaccauuagauaaucucucuguagagggauuaguaaggcuuugggcgcaugaagcucuacgucuauuccaagauagacuuguugaagacacagaaagacguuggaccaacgaaaauaucgacgcugucgccuuaaaacauuucccaucagcgaauugugaacgugcauuggaacgaccuauuuuauacaguaauugguugucuaaagauuacguuccuguuggaagagagcaguuaagggaauacguuaaagcaaggcugaaaguauuuuaugaagaagagcuugaugugcccuuaguacuauuugaugaaguauuagaucauguauuaagaauagacagaauuuucagacagccucaagggcauuuacuucugauuggugucucuggagcuggaaaaacuac

SEQ ID NO: 4669 - RNA, 713 nt, Psylliodes chrysocephala
gaggcugauauugcugaugaugaauaucuguuugaagaaaaaguauuaacagaaagagaaaagaaagaacgccagcauaaaaaggaacuauuacaacuugcucaggaacaugaaaaagcaagagaacuugaacgaauucagagguaucacaugcccagagauuuggguaaagacucuacagcagauuauauugaaguugaugaacuugaaaaaguaccucaauccgaacagaaaaaaugggaaaaagaccagauggcuucugcuguuuuuaaguuuggugcuaaagaugucaagaaaaaggaugauuaugaguugcuguuggaagaucagauugauuuuauucaagccuugcaaaugccaggggucauugaaaaaaaggaaaaagaguuaacugaaguagagaagaaaaaguugaguauugaagaaacuaagaagaguuuaccaauauuuccauuuaaagaugaucugauucaggcaauuagagaacaucagguauuaaucauugagggagaaacaggaucuggaaaaacuacacaaauuccucaguaucuacaugaagcuggauucacugaagauggaaaaaagauuggcuguacacaaccacgucgaguagcagccaugucuguagcaucaagaguagcacaagaaauggguguaaaauugggcaaugaaguuggauaugccauuagauuugaagauugcacuuccgaaag

SEQ ID NO: 4670 - RNA, 765 nt, Psylliodes chrysocephala
agagacagaaaauccagcaggaggguaugguaaaacuguuagucauguuguaauugguuugagaacugcuaaggguaguaaacaauugaagcuggauccuagcaucuaugaagcucuacaaaaagagaaaguugagguuggagauguuauuuacauugaagcuacaaguggagcugucaaaagacaaggaagaucugaugcauaugccacugaauuugacuuggaagcugaagaauauguuccccuuccaaaaggagauguacauaagaagaaagaaguaguucaggauguuacuuuacaugauuuggaugcugcuaaugcuaaaccacaaggaggucaagauguauuauccaugaugggacaacuauuaaaaccaaagaagacugaaauuacagacaaauuaaggaaagaaauuaacaaaauuguugacaaauauauugaucaggguauagcggaauugguaccugguguacuuuuuauugaugaaguucauauguuagaucuagaaacauuuacuuaucuucauagagcuuuagaaagugccauagcaccuauuguaauuuuugcaacaaauagagggcguugucuuauuagaggaacagaugacauuuucucuucacaugguauaccauuagaucuuuuggauagauugcugauuauucgaacaauuccuuaugguagaucugauauggaacaaauuuugaaacuaagggccaccacagaagguuuagaaauugaaucagaugccaucgcaauauuaggaga

SEQ ID NO: 4671 - RNA, 732 nt, Psylliodes chrysocephala
cuaauagacaacggagguggaagaaacaucgauuuaacaguagaaagacgggugagauuagaaggacaagaacucgacgauuacgaaagaagacaaaggucuagaagugauaaaauugacaaugaggacgcggauucagauucggacucugacaucgagaugucgguaaucucgaaggggaagcacgacaucgugaucaagcaggaagguaaaauaucgacgggauuuuucaagguuaccaaaaaaauguacccgauguauccguuccacgaggaaaagauuaagugcgacgaauacggcgagaucgucaaacccgaggauuacaaauuggccgaaguaauacccgaaggcgaagacaauaaggaaaauaucgugauaaagaaagaagaggaggaaauuacugaaauuacggaacaaccgacgaaaugcaucgugcugcaaaggacgguucaaguuaacugucaaguccaguacaucgauuucgaggguagaucagacggugaaucgcugaugaagauuuugacgcaacugaaacccaggagagugauuguggugcgcggcacggaagaaaauacggccgucaucgagaagcauugcuuggagaacaugcaggggcgaguguuuacgcccucuaggggcgaaauagucgacgcuacgagcgaaacgcacaucuaccaaguuagguugacugacgcucuagugucgcaguugaguuuccaaaaggcgaaagaa

SEQ ID NO: 4672 - RNA, 749 nt, Psylliodes chrysocephala
aaggaggugaugauaaucgcguucaggauauggaggaagaaaguucugaugaagaugaaaaugaaggcaagacaccuagagcaccucccccgccgucaauucaacccccucuaccaccugcuccagauaaagugcuugugaagaaauaugauccuaaacaagccguuaaagucgcaagaccuacaguaggagacgauuaucuagucucucccaucacuggugagaaaauuccagcuagcaagguccaggaacacaugcgcaucgggcuuuuggauccccguuggguggaacagcgggacaaacaaauuacagacaagaugaaccaagauacgguuuaugcagccgguagcgccaucgaugcaucucuuaaacuccucgccgaaagacguaccgauauuuucggugucggagaugaagaaacugcuauugguaaaaagauuggagaagaggaugucagaaaagacgagaaagugacaugggaugggcauacgagcagcguggaagcagcgacaagagccgcgagggcuaauauuacuuuagaggaacaaauucaucaaauacacaaaguaaaaggucuacuuccugacgaagagaaagaaaaaauuggucccaaaaauauuggaucuaagaagauaaacauucagaguauuauuacuacaaaaccuccuaauccaccuguucagcccccaaagccgccaguaucucuuauacaaaccccugcuccacaaaugauuccaguuccaacucag

SEQ ID NO: 4673 - RNA, 740 nt, Psylliodes chrysocephala
augggaaaaaucgguaaccaaaaacgcgucgucggugucuuacucgguuguuggagggcuaaaggagucuuggauguuucgaauaguuucgcaguuccuuuugaugaggaugacaaagaucaaucugugugguuuuuggaccaugauuacuuagaaaauauguacggcauguuuaaaaaagucaaugcuagagaacguguagugggcugguaccacaccggacccaaauuacaccaaaacgacauugcuauuaaugaacuaguaagaagauacuguccaaauucaguauugguaauuauugaugccaaaccaaaagacuuaggccuucccacagaagcguaucaagccguugaggaaguacaugaugaugguucaccaacauccaaaacuuuugaacacguaccaagcgaaauuggagcagaagaggcugaagaaguggguguagaacauuuauuacgugauaucaaagauacuacuguuggcacacuuucucaaagaauuacaaaucaauuguugggucugaagggacugcauucacaguugaaagacauuagagacuauuuguuaaauguuugugacaauacgcuaccuauuaaucaucaaauuaucuaucaguuacaagauauuuucaauuuguugccugauauaaaccaagaugcuuuuaacaauucauuuuauguuaaaaacaaugaucagaugcuuguagucuacuuagcagcucugguuagauccauaguggc

SEQ ID NO: 4674 - RNA, 793 nt, Psylliodes chrysocephala
aacuccuugagcuugaagaggaacauguuaagcgccaaugugaugaaaucauagcuuuuaagccagacguugucuuuacagaaaaggguguuucagaucuagcccaacacuuuuuauuaaaagcuggaaucagugcugugagacguguuaggaaaucugacaauaacagaauugccagagcauguggugguacaauugugaaucgaacagaagaauuacaagagacagauguugguaccggagcuggucucuuugaaauuaaaaaaauaggcgaugaguacuucuguuuugucgaugaauguaaaaauccaaaggcuugcacuauuuugcuccgaggagcuaguaaagacauccuuaaugaaauugaaagaaaucuccaagaugcccuucaaguugcaagaaacauaguucucucaccccgucuagugccaggagguggugcuauugaaauggccauagcucaacgucuaaugcaaaaagcaacacauggaccuuacagagcucuugcacaugcacuagaaauuauuccuagaacuuuagcucagaacuguggagcuaacacaaucagaaccuugacagcuuugagggcaaaacaugcuaaccauacugaugcugagaaaccuuguacuugggguauagauggagaaacuggcgagauuguugacauggagacuaaaggauugugggaaccacuuucagugaaacuacaaacuuacaaaacggcuauugaaacugcuauucuucuauugcguaucgacgguauugugucuggauccaaaaagaagggugacaa

SEQ ID NO: 4675 - RNA, 555 nt, Psylliodes chrysocephala
ccaacgacaaauuaaccccuaugcugauaauggagggaguguuguagcgauagcaggaaaugauuucguaguugugggagcugauacucgucucaguucagguuuuucaauuuacacaagaaaccaaaauaaauuauuuccuauguccgauacaacuguauuagguugugcaggauguuggugcgacacuuuaacuuuaacccgaauuuugaaaucucguaugcagauguaccagcaggaacauaacaaacaaaugucuacaacagcaugugcacagauguuauccaccaugcuguauuauaagagauuuuucccuuacuauauauccaauauacuuguuggauuggauaaugaaggaaaagguuguguuuauagcuaugauccaauugggcauugugaaaaggccaccuacagagcagguggcucugcaggugcauuacuucaaccucuuuuggacaaccagauuggacaaaaaaaucuggugaaaccaucaucugaagaucuuucucaagagaaagcucuugcuauauugaaagauguauucauugcugcugc

SEQ ID NO: 4676 - RNA, 660 nt, Psylliodes chrysocephala
ucuagagcaauuaacgaggcuaaacaucaacuauccuauguuauuuaagcuuguaaauaaaaaaacaaaucguacuacacacugugguguguuagaauucgucgcugaugaaggaaaaguauaucuucccuuauggaugaugcauaauuugguccuuucugagggcgauuugguucaaauggaaagcauuucgcuuccaguuggaacuuuuuccaaauuucaaccuuugaauccugauuuuuuggauauuacuaauccgaaagcuguuuuggagaauuguuuaagaucuuaugcuugucuuacgacuggggacguuauagcuguuaaauauaaucaaaaggcuuaugagcuguguguuuuggaaacaaagccugggaaugcuauaaguaucauagaaugcgacaugaauguggaauucgcagccccagugggcuacaaggaaccggaaagauuuaaaaaagaagaagaggaaaugucuaucgauccugcugacuuaaugccagaaccaucagguuuuguagcauucagaggcgccgggaaucgucuggauggcaaaaaacguaaagauucuucuucgagcgacagucacguaucuaaaccaacuuacguuaagggaauccccgauuacgauuacgagaucggcaccuugaauuucaucag

SEQ ID NO: 4677 - RNA, 783 nt, Psylliodes chrysocephala
auugccgaaguauuuccaguuucugcugaaaauacugagccucuaguuaaaguugcaaugaccacauuaggaucuaaaaucauuaauaaaugucacagacaaauggcagaaaucgcaguuaaugcuguuuuagcuguggcugauuuagaacaaaaagauguuaauuuugaauuaaucaaaguugaaggaaaggucggugguaaauuagaagacacaacaaugguccguggcguagucauagacaaaacaaugucucauccccaaaugccaaaagagcuuagaaaugucaaacuggccauucucaccugccccuuugaaccaccaaagcccaaaaccaaacauaaguuggauguugccaguguagaggauuacaaagaauugaggcaguaugaacaagacaaguucaaagaaaucguuagucugguuaagaacgccggcgccacauuggccaucugucaaugggguuuugaugaugaagccaaccauuugcuuuugcaacaggaguugccggccgucagaugggugggcggucccgaaauagaacuuaucgcuaucgcgaccggcgguaggauugugccgcgauuugaggaacuuaguccugaaaaacuugguuaugcagguuugguaagggaaauauccuuugguaccaccaaagauaagaugauggugauagaagaaugcaagaauucccgugccgugacuauucuaguuagaggcgguaaucaaaugcugguagcugaggcuaagaggagucuacacgaugcguuaugugucguuaggagu

SEQ ID NO: 4678 - RNA, 208 nt, Psylliodes chrysocephala
cucgaagggagagaagaaacgauuugaaguuaaaaaguggaaugccguugcacuuugggcuugggauauuguuguggacaacugugcuauuugccgcaaucauauaauggauuuauguauugaaugucaagcuaaucaagcuucugccacuagcgaagaauguacaguagccuggggaguauguaaucaugccuuucacuuucauugc

SEQ ID NO: 4679 - RNA, 782 nt, Psylliodes chrysocephala
gaggcagaaagguuaguugaacagaaaauucauccucagacuauaauugcuggauggagaaaagcaguugaugcugcaagaaaggccuuauuagaugcuuccaaagacaauagugcuaaccuggaagcauucaaagaagaucugaugaauauagcaaggaccacauuaaguucaaaaauccucucacaacacaaggaacacuuugccaaacuuacuguagaugcaguauugagauuaaaggguucugcugaacugcaauccauccagcugauuaaaaaaacuggagguacuuugcaagauucuuuuuuggaugaggguuuccuuuuagauaaacggccugguguucaucagcccaagagaguagaaaaugcaagaauuuugauugccaauacacccauggacacugacaaaauuaaaguauuugggucacacauuaaagucgacucuauggcaaaaguagcagagcuggaaucugcagagaaggacaaaaugaaagauaaaguuaacaaaaucuugaaacacaaugcaaauguauucauuaauagacaacuuauuuacaacuauccugaacagcuguuugcugaugcuggaguaauggcuauugagcaugcagauuuugaugguauugaaagauuagcacuuguuacaggaggagaaauagucucaacuuuugaccacccagagcuugucaaauuaggcacuugcaacuuaaucgaacaaauuaugauuggagaagauacucuucuacguuuuaguggaguugcucuaggagaagcuuguac

SEQ ID NO: 4680 - RNA, 667 nt, Psylliodes chrysocephala
ccaccaaguagaauaugccauggaagcuguuaaccuagguucagcaacaguaggucucaaaagugauaauuaugccguuauaauugcuuuaaaaagagcuucuucggaacucucggcguaccagaagaaaauuaucaauaucgacgaucauaucgguauaacuauaucuggacuuacagccgaugcuagaauuuugaguagauacaugaggaacgaauguuuaaauuauaaguacucauuggaugcuuauaugccccucaacaggcugauuaguaucuuagguaauaaaaugcaacauugcacccaacgguacgaccguagaccauucggcgucggccuacucgucgcagguuucgaugauacuggugcucauauuuaccaaaccugucccucagcuaacuucuacaacugcaaagccaugucuaucggggcuagaucucaaagugcuaggacuuacuuggagaagaagcucgaugaauuaucuucagccucuuuggaagaguugauuaaacaugguuugagggcuuugagggauacuuuaccuccagagguagaccuaaccaccaaaaacgucucaauaggcuauguaggcaaaggucaaaacuucaagaucuuagaagaggaagaaacugcucccuaccucucgcucauugaaggugaagaacgu

SEQ ID NO: 4681 - RNA, 688 nt, Psylliodes chrysocephala
acaguguuuagauggguguccgccgcaauuugcuaaacaucuguacuugcuguacgccaaauuagaagaggaacacggaauggcccggcacgccauggcuguuuacgaaagaucuacaacagcgguuccggaaaacgagauguucgauauuuucaacauuuauaucaaaagagccgccgaaauuuacgguauaccuaagacgcgacaaauuuaugaaaaggccaucgaaguacugccggaggauaaaacaagagaaaugugccuucgauucgccgauauggaaaccaaauugggcgaaaucgauagagcgcgagcgauauacgcucauugcagucaaauuugcgauccgcgaauaacggcggaguuuuggcagaucuggaaagaauucgaggugaggcacggcaacgaggauaccaugcgagaaauguugaggaucaagcgcagcguccaagcugucuacaauacacaggugaacaugaugucggcacaaauguugagcuccgcgggcagcaugagcggcaccauugccgauuuagcgcccgguguaaaagacgguaugcgauuguuagaggccaaagcugcagaaauggcggggauuccgcagagcucgaccaaacccgggaauauuauguucgucagaggggaaacccagggcgcuaauaaggauagagucguuaaucccgaugaa

SEQ ID NO: 4682 - RNA, 692 nt, Psylliodes chrysocephala
auuaugggagcucuuuguccaagcagggccuuuaguaaauguacauaugcccaaggaucguguaaccaugaugcaccaggguuacggcuuuguagaauucaugggcgaagaagaugcggauuacgcuauaaaaauaaugaacaugauaaaguuauauggaaagccaauaaggguuaauaaggcaucugcacaucaaaaaaauuuagaugugggagcuaauaucuucauaggaaauuuagacccugaaguagaugaaaaguugcuauaugauacauuuucagccuuugggguaauauugcagacaccaaagauaaugagagauccugagacuggcaacuccaaaggguuugcuuucauaaacuuugcaaguuuugaagcaucugaugcuucaauugaggccaugaauggucaguaucucuguaacagaccaauuucuguaucauaugcauuuaagaaagacucaaaaggugaaagacauggaucugcagcagaacgucuucuagcagcacaaaauccauugucucaagcugacagaccucaucaauuguuugccgaugcaccacccauaggaaugaugccaaugaccauagcaccuccaccaccaccuuuaaucacaggaaugaugccaccuccuccaccuacuccuggaggcaugccaccaccuccucccccaguuccaccaccaaauucuu

SEQ ID NO: 4683 - RNA, 628 nt, Psylliodes chrysocephala
aaaaaggaggaaaggagcaccaaaacugcguuauuuagauuucucagaacgacaugguuacaucaaggggguaguuaaagauauccuucaugacccaggucgcggugccccguuggcuguuguacauuucagagacccuuacaaguuccaaacuagaaaggagcuguucauugcucccgaaggaauguacacaggacaauuuuuauacuguggaaagaaagcuaaccuccaaauuggaaauguacuaccuguaggaacuaugccugaagguaccauuguguguaauuuggaagaaaaaacuggugaccguggucgauuggcccgugcaucaggcaacuaugcaacaguaauugcacacaaccaugauacaagaaaaacuaggguuaaguugccaucaggagccaagaaggucauuccauccaacaacagggcuaugguugguaucguugcuggaggcggucguaucgacaaacccauauugaaagccggucgugcuuaccacaaauacaaggugaagcguaacugcuggcccaagguucgugguguugcuaugaaccccgucgagcauccucacggaggugguaaccaucaacacaucgguaaggcuucuacugucaagagaggaacg

SEQ ID NO: 4684 - RNA, 310 nt, Psylliodes chrysocephala
cgaaaacaauuggccacuaaggcggcucguaagagcgcaccggcuaccggugguguuaaaaaaccacaucguuacaggccugguacgguggcucuucgagaaauucgucguuaccaaaagaguaccgaauuguugauuagaaaauuaccuuuccaacgguuaguacgugaaauugcccaagauuuuaaaacugauuuaagauuucagaguucugcagugauggcgcuucaagaagccagcgaagccuacuugguagguuuauucgaagacacuaacuugugugccauucacgccaaacgaguaacaauua

SEQ ID NO: 4685 - RNA, 661 nt, Psylliodes chrysocephala
uguuacauacugacgugcaacguuagcauggaauacgaaaaaagcgaagucaauucggguuucuucuacaaaaccgcagaagagagagaaaaguugguuucggccgaacgagaauuuaucgaacaaaggguuaagaaaguugucgaauugaagaaaucucuuugcaacgguacagauaagacguucguugucauuaaucaaaaaggcauugaccccaugagcuuggacaugcucgccaaggaaggaauaaucgcucuuagaagagcuaaaagacguaacauggggcgcuuggcuuuggcgugcggcgguauagccaugaacaguuucgaugauuuacaggaaucucaucucggacgugccggacacguuuaugaacacguuuugggcgagaacaacuacacguucgucgaggauugcaaagugccccagucgguuacuauuuugaugaaaggacccaacaagcacacacugcugcagaucaaggacgccguuagggacggauugagugccaucaacaauacuaucgaagauaaagcgguuauuccaggugguggugccuucgaagugacugccaacaaggaacuguuggccuacaaagacgagaucaaaggcaaagcucgucugggcguggcagcuuaugccgaagcucuuuuggugauuc

SEQ ID NO: 4686 - RNA, 782 nt, Psylliodes chrysocephala
ggugucaaaucagugacucugcaugacgaugcucuuugcaccgugcaggauuuaucgucccaauuuuaucuaacggaauccgauguaggcaaaaaccgcgcugaagcuugcugcaagcagcuuucagaacuuaacacuuacgucccgaccaaagcuuacacggggcccuuagaugagaaaaucauaaagaaauucaggguugugguuuuaacuacgaguacucgugccgaacagauacguaucagcgaaauaacucacgcuaaugauauugcuuuaaucaucgcugauacgaaaggucuuuuugcucagguuuucugcgauuuugguaaaucuuucuccgugguggacguaaacggugaaacaccgguaucuacgaugauagcagacaucuccagugauaaagacagcguuguaacuugcauagacgacacgagacacgguauggaagaaggagacuauguaacuuucucugaaauacaagguaugacugaauuaaaccacuguaaaccaauaaaaaucaaaguauuaggcccuuacacguucagcauuggugauaccacuaauuucacaaaauacguacguggcgguaucguuucucaagucaagaugccgaaagaauugaauuucaaaccuuuaaaagaauccuuacagaauccugaauucguuauaaccgauuaugcuaaguuugaucacccugugcaguuacacuuggcuuauacaacucugcacaaguauguagaaaagacaggcagauugccuaaaccuuggaacaaugaugaugc

SEQ ID NO: 4687 - RNA, 759 nt, Psylliodes chrysocephala
aaaccgccguauucguauuagccacucuccaacaacuagacccgaccgaaaaugccgucuacguccucgucaugugccauacgcgugaguuggcuuuccaaauuagcaaagaauacgaacguuucaguaaauacaugcucaacaucaaggucgguguauuuuucggaggucugcccauucaaaaagacgaggaaguauuaaaagccagcuguccccauauugucguuggcacgccuggacguauuuuggcucuugucagaucuaagaaacucaaucucaagcauuuaaagcauuuuauucuugaugagugcgauaaaauguuggaacuauuagauaugagacgcgacguccaagaaauauaccguaacacuccgcacggcaaacaaguaaugauguucagugcgacccucagcaaagaaauccggccaguuugcaagaaauucaugcaagaucccauggaaguguacguugaugacgaagccaaauugacccuucacgguuuacagcagcauuauguaaaacuaaaagagaacgaaaagaauaaaaaguuguuugaguuacuagaugucuuggaauuuaaccaggucguuauauuuguaaagucggugcaaagguguguagccuuagcgcaauuguuaacagagcaaaacuuuccagcaauuggaauucacagaggcauggaccagaaagagagauugucucgguaugagcaguuuaaagauuuccaaaagagaauuuugguagcaaccaaucuuuucg

SEQ ID NO: 4688 - RNA, 787 nt, Psylliodes chrysocephala
ggauuggaagcuggagauagcaaaaaagacacugacaugcaaaguguaauagaaauucgagaacaugcaagacagauugaaaaagccguaagcagcaaggaaaaucgauuuauuuuaagaguuuugcguuguuugcccaacacuagacgaaagcuuaauggaguaguucucagaagucuuauaaaccaaauauauccuguagccgagagagacguccuacuugguuuuacugaagaggcugcaacugaacuugacacuacgcaaucuagagcuagaucagcuucaaaaacuccuguuccagaaguugaugcuuauauuaacuuguuaauuuugguucguuugauugacacuaauaaacuaccagaagcagaacguuguucucaagcacucaugaauaaaauuacuagucaaaaucgccguuccauagaucuuguagcagcuaagugcuacuuuuaucacucaaggguuucugaacuuacugauaaacuugauucaauuagagguuuucuacauucucgucuucguacugcuacucuuagaaaugauuuugaaggacaagcuguacuuauaaauugcuuauugagaaacuauuugcauuauucauuauaugaucaagcugacaaguuaguaaguaaaugugucuuuccugaaacggcuaguaauaaugaaugggccagauuuuuguauuauuugggucgaauuaaagcugcuagauuagaauacaguguagcccauaagcaccuuguucaagccaugagaaaagcaccucagaaugcugcaauagguu

SEQ ID NO: 4689 - RNA, 786 nt, Psylliodes chrysocephala
gccugguacaaaaguagacaguaaacaaagaauuacugucagaaauuuaagaauaagagaagacacugcgaaauauuuaagaaauuuagacccugcuucagcuuauuaugauccaaaaacaagaucaaugagagagaauccgaauccugaaagagaugaaacauaucauggugaaaacuuugugcguuucucuggugacacaacgaaucacgcaagagcucaacuauuugcuugggaagcucacgaaaaagguguagauguucaucuacuagcagagcccacuaaauuggaguuacugcaaaaagaauacgaaaagaaaaaagaugaaguuaaaucuaauauucagaguacgguuuuggagaaauaugggggccaggagcauuuggaagcuccaccuaaaaguuuauuguuagcucagacugaacaguauguggaauauucaagggcuggaagagucauuaaaggagccgaaaaagaaguuauucuaucuaaauaugaagaagauguuuauauaaauaaccacacuucaguuugggguucucauuggagaggaggacaguggggauaucgguguugccauucuuucauuaaaaauucguacuguuugggagaagcaggaaaauccguuaauguacaacccauaguggaaucgauuuccaaugaagaggaaauuggaaaaccuguuggagaugugcaagaaaaggaaaagagcaaagaaaaggacgaggaaagugaagaaagcgauucgagcaguucgucagaagauaauucaaaagugaaagcgca

SEQ ID NO: 4690 - RNA, 471 nt, Psylliodes chrysocephala
cacgaaacuaggaaccagaaggauccauuauguucguacgaggggaggcaacuugaaguaccgcgcccuaagauuagacaccggaaacuuuucuugggguagcgaagguacugcccgucaaacacguauuaucgaugucguuuacaacgcuaguaauaacgaauugguccguaccaagacguugguaaagaaugcuauuguugucauugacgccaccccguucaggcaaugguacgaaaaucacuacaucuuaccauugggacgcaagaagggugccaaaaugacgccugaagaggaggagauuuucaauaaaaagcguagcaaaaaaguacagaagaaguacgagacuaggcaaaaaaccgcuaaaguagaacccgcgaucgaagaacaguuccacaccggaagauuguuggcaugccuugcaucuaggcccggacaaugcggcagggccgaugguuauguccucgaagg

SEQ ID NO: 4691 - RNA, 662 nt, Psylliodes chrysocephala
accaauggaaguaaugggacuuauguuaggugaauuuguggaugacuacacaguccguguaauagauguuuuugcaaugccucagacugguacuggggucaguguagaagcaguugauccaguauuucaagcuaaaauguuggauauguugaggcaaacugguaggccagaaaugguagugggaugguaucacucucauccagguuuuggaugcugguugucaggaguugauauuaacacacaacagaguuuugaagcacuuucugagagggcuguugcagugguaguagacccaauacaaucaguuaaaggaaaagucgucauugaugcauuuagguugaucaaucccaacaugaugguuuugggacaagaaccucgccaaacaacaucuaauuuaggacaccugcagaaaccuucagugcaagcacugauccaugguuuaaaucgccauuauuauucuauaaguauuaauuacaggaaaaacgaacuugagcaaaaaaugcugcuuaaucuacauaaaaaguccuggauggacggucuaacuuuagcugacuauucagagaacugcaguguuaaugaaaaaacuguugcugacauguuggaauuagcuaagaacuacaauaaggcauuagaagaugaagaaaaaaugacaccagagcaac

SEQ ID NO: 4692 - RNA, 658 nt, Psylliodes chrysocephala
agaacagggaagcuauguuggugaaguuguaaaacccauggacaagaaaaaaguacuugucaaaguacacccugaaggaaaauuuguuguugauaucgauaaaaacauugacauuaaugaugucacaccaaauuguagaguagcccuuagaaaugaaucauacacauugcauaagauuuuacccaauaagguugacccauuaguaucacuuaugaugguagaaaaaguaccugauucuacauacgaaaugguuggagguuuagauaaacaaauuaaagaaaucaaagagguuauugagcugccaguaaagcauccagagcuuuuugaugcuuuggguauugcccaacccaaggguguauuguuguauggcccuccaggaacuggaaaaacucuguuggccagagcaguagcucaucauacagaauguacauucauucgaguaucugguucagaauugguucaaaaauucauuggagagggcuccagaauggucagggagcucuucguuauggccagagagcaugcaccuuccaucauuuucauggacgaaauugauucuauaggaucuucucguauugaaucuggcucugguggugauucugaaguccaaagaaccauguuggaguuguuaaaucagcuugaugguuuugaagcaacc

SEQ ID NO: 4693 - RNA, 532 nt, Psylliodes chrysocephala
gcuggaaauuuuggugaaguuacagaacaaauuauagcaaaaauuccgccucacaaugauaaacuuaccuauucucauggaaacuaucuuuuucacuacguuuuagaaaaucguauucuguacaugugcauaacagaugaugaauuugagagaagucgagcauuuuuauuucucaaugaaauuaaaagacgguuucaagcuacuuauggagcuagugcugauacagcuauugcuuaugcaaugaauucagaauuuuccacaauauuggcuacagaaaugaaacauuauuccgaaucucacgaucuugauacaauauccaggguccacagugaauuagaugaauugaagaauauuaugguuaaaaauauugauaauauugcaaugagaggugaaagacuagaacuucuggucaacaaagcagauaaucuaaauaauggaucgaugacauuuaggaccacaaguagaaaccuagcucguucguuauuuuggaaaaacaucaaacucuacguuauuauuggugucgucguaacug

SEQ ID NO: 4694 - RNA, 586 nt, Psylliodes chrysocephala
gucgaauaugccauugaagcgauuaaacugggaucaaccgcuauuggaauaugcacaagcgagggugucguuuuagcaguugaaaaacguauaacuuccccucugauggaacccacuacuaucgagaagauuguagaagucgacaaacauauuggaugugcuguuucaggucuuauggcagauucacguaccaugaucgacagagcuagaauagaaugccaaaaccacugguucguuuacaaugaaaauauuagcauugaaucaugugcacaggguguuucaaauuuagcaauccaguuuggcgauucagaugaugacggugcugcaauguccagaccuuuuggaguggcuauuuuguuugcugguauugacgagaaaggaccucagcuauaccauauggauccaucggguacuuuuguucaguuugaugcaaaagccaucggguccgguucagaaggagcgcaacagagucuacaagaaguauaccaucgcaguaugacuuuggaggaagcgacgacugcagcguugaccauucucaagcagguuauggaagaaaaauugaauucugcgaauguagaagucauga

SEQ ID NO: 4695 - RNA, 760 nt, Psylliodes chrysocephala
acucgaagaucagagagacaaguugcaggagaacuugauggcuaauaacaccgauuugccaaguuauuuaaccagauuucaaugggacaucgccaaauacccgaucaagcaaucccugcgaaacauugccgauauaauaaguaaacaaguuggccaaaucgacgcugaucucaagaccaagucgucagcguacaauaauuuaaagggaagucuucagaauuuggagaagaaacaaacuggaaguuugcuaacacguaacuuggcagaccuagucaagaaagaacauuuuauuuuagauucggauuauuugcagacuuugcuggucaucguuccaaagucucaauucaaugaauggaacgcuacuuacgaaaaaauuacagauaugauuguaccgcgcucgucagagcucauuacucaagaucacgaauacggucuauucaccguuucgcucuucaaaaaggucguugaagaauuuaaguugcacgcaagagaaaagaaguuuauugucagagauuucacuuauaacgaggaggaacuggcagcugguaaaaaugaaauuaccaaacucguuacugauaaaaaaaagcaauuuggaccguuggugaggugguugaaagucaacuucagcgaaugcuuuugugcuuggauacauguaaaggcguuaaggguguuuguugaguccguauuaagauaugggcuaccagucaauuuucaagcuauccuaauccauccaaauaagaagacacugaaacguuuacga

SEQ ID NO: 4696 - RNA, 774 nt, Psylliodes chrysocephala
ugcccaagaagauccuuaacgccaaaaucgccuguuuagauuuuucuuugcagaaggcuaagaugaagauggguguacaagucuugaucaccgaucccaaucaccuggaagggauccgcuccagggagcuggacaucaccaaggagcgcauccagaagauccuggcgacgggagugaacgucauccuauguuccggggguauugacgaucugugucucaaguauuuuguagaaaacggcgccaugggggugcguaggguuaaaaaagcugauuugaaacguaucgcuaaagcuacgggcgccgcuuuugucacuucacucagcaacauggaaggggacgaaacauucgaugccaauauggucggcgaggcagcugaggucguacaagaaagaauauccgaugacgaacuuaucauuauuaaaggccccaaagcccgcacagccgcuucaaucauccuucgcggacccaacgacuuuuacugugacgaaauggagcgcucagugcacgacgcacucugcgucgucaaacgcguccucgaaucaaaaagcgucgucgugggaggcgguagcgucgaagcggcauugucaaucuaucuggagaacuuugcaacaacgcucagcuccagggagcaacuugccaucgcugaauucgccagaagcuugcugguaauucccaagacguuggccguuaacgcugcccaagacgcgacugaucuaguggccaaguugagggcauaccagaacuccagccagaccaaaaaggaccaugcacauu

SEQ ID NO: 4697 - RNA, 642 nt, Psylliodes chrysocephala
uuccaggcacucaaagaauuccugcugccaacccgauaacccauacucaaucuccuguaacuacaucaacuucuauaauagcuauuacuuaugauaaagguguauuaauugcuggagauuuagucgccucuuauggaucuuuagccagguacagaaauugucccaggguaauugaaguuaauccuaauauaauauuaggagcugguggagauuaugcagauuuucaguacgugaaaagcuuuauugagcagaaaauaauugaugaagacuguuuagaugaugguuuaaaaaugaaaccaaaaucucuguauuguuggcuuacaagaaucauguaucaacguagaaguaaacuugaccccuucuggaauaaucuuguaguaggaggacugcaggaugguguaccuuucuugggaaccauagauaaacuuggcacagcuuacacagauaaaguuauuuguacuggguauggagcucacauugcucucccuauucuucgggaugcucuugauaagaaaaccaacuugaaucugaaugacgccaaagcucuuauaaagcggugcauggaagugcuuuuuuacagagaugcaagaaguuuuccaaaauaucaguuagguauuauugauaaggaugauggcgugaaaa

SEQ ID NO: 4698 - RNA, 799 nt, Psylliodes chrysocephala
uugggaaaugucaaacaugccuuuaaacuucuaauuuuuccugacacuagaguguuucaguguucuuccaacucuaauaaaaaagaaugguuggauaaauucgaucaagcuaagaaaacaaggcuagcucaggaacagcaaaaacgagaaucaauuacugaaaaauccccaucucgcucagcaucuauugagucgcccacuuauaacccauuugaagaagauauggguaccauucacccggaaugguuuuuagauauuccugaagaacuugacguuuguguagcccaaagacauuuugaagaagccuugucuuuauuacagaaagccaaagauuauauaaaucagacugcuucuuccagugagaaacaugaucacguucucauugauauucaaagaaagguggaacaaagacagaacagucuaacugaagugcuaaugaaagaacuagaaguuaauccugacaaaucucugcaaggugguuugagagcagcacguagagcuguuagguugcugaaucaauuaggaagggaaacucaaucaugcaaccuguuucugaaauugugcaguaguauguugagaacucaauguaaacgaguaaaacgagaagguucgaccacaacuuauauaagacauuuaucuaguguaguuuuuacuaauaugugucacaugucugaugaguuuuuacgagccuuucccgauucgccagcuugugcuucagcuuauguugugugggccagcaaugaacuguuacaauuuacaacccauuugauuaaacaaguuuuuaugccucagacuuccc

SEQ ID NO: 4699 - RNA, 750 nt, Psylliodes chrysocephala
gacgcagaucacucaguauuuggcugaagccgguuucacagccaggggaaaaauaggauguacucagccaagaagaguggccgccaugucgguggcuaagcgaguagcggaggaguuuggauguagauugggacaggaagucggauauaccaucagauucgaagauuguacuagcccugagacgaugaucaaguacaugacagacgguauguugcuuagagaaugccuuauggacuuagaucucaaaaauuacucggugauuauguuggacgaggcucacgaacguaccauccacaccgacguccuauucggucuucugaaacaagcugucuugaaacgcgaagaacucaaauugaucgucaccucggcaacgcuggacgccgucaaauucucgcaguacuucuucaaggcgccgauauucacgauacccggcagaacguuuccggucgaaguuuuguacaccaaagaaccggaaacugauuauuuggacgccagcuugaucaccgugaugcagauacaccugagggaaccgccuggcgauauuuuacuguuuuugaccgggcaggaggagaucgauacagccugcgagauucuguaugaaagaaugaagagucuaggucccgauguaccugaacuaaucauccuacccguguauuccgcguuaccaucagaaaugcaaacuaggauauuugaaccggcaccgccggguagccgaaaggucguuauagcuacaaauauugccgaaacguc

SEQ ID NO: 4700 - RNA, 799 nt, Psylliodes chrysocephala
uagcuggucaagaaagucacugucaauuauauaaaguuaacacaaaauuaguagaacaaguuaaaguggagaacauuggaaaugauauacauauuaaacaaagaaauacaaauuuaaaaccuaaagaacaaguagauaauaauaaaaauguuaaaaaagaauuauacuauacucuuaauccuauggacaguguacagacagauuuuaaugguucugaaccauuaucuagaguaguuagaauuaauuaugauggaaaaguauuagcaacuggaggcacugauggcgauguaagacuguggaaguuucccaguuuacaaccccucuucauucuaaaaggccauaagaaagaaauagaugauguagacuuuaguagacaugacaauuauguuauuucaauugcuaaagaugguuuaggaauauugugggauuguaaaacgggaaaugaaagaucaaaacugacauggaaacauccagaaggaucaaaguaucuguauaaaagauguagguuugguguuauugaagaacaaaaaaauaaaucagcauuauauaugauugcuaacgcagucaauccuaaacacaagucuuuccuucaacaauggauaccugaggagaaugacuugaaaaaauauucagaauuugaugaaacucuugcaaccuuggcagugcgagaugauggcagauuuguugcaguugguaccauguuuaguggaucuauuucuauccauguugccuuuaguuuacagaaaauauuaacuguugcuggugcucauuccauguuugugacuggucuugaauuccu

SEQ ID NO: 4701 - RNA, 784 nt, Psylliodes chrysocephala
aaguacaaaaaggagggcaaggcuaaggaacuagcggagcucauaaaggcuacuaggccuuuuuugagucuaauuaguaaagcgaaggcugcuaaauuaguuagaucguuaguugacuacuuuuuggaucuagaagcugguauugguaucgagguccaacuuuguaaagaaugcauagaaugggcaaaagaagaaagaagaacguucuugcgccaaucccuggaagcccgacuuauugcccuuuauuucgauacuggaauguacgccgaagcccuacauuuagaauccacauuguuaaaggaauuaaaaaagcuugaugacaaaaauuuguugguggaaguucagcuucucgaaagcaaaacauaucaugcuuugaguaauuuaccgaaagcccgagccgcuuuaaccucggcacgaacaacagccaaugcuauauauugcccuccaaaaaugcaggcugcuuuggacuugcaaucugguguccuacaugcagccgaugagaaagacuucaaaacugcauacucauauuucuaugaggcauucgaagguuucgauagugucgagucccccaaggcucuaacugcucuuaaguacaugcuucuguccaaaauuaugauuaacaguccugaagauguccagcaaauuguuaguggaaaauuggcuauuaaauaugcuggacaagauauugaugcaaugaaagcaguugcacaagcugcccacaaaaggucccucgcagauuuucaacuugccguaaaacaauucaaacacgaacuagaagacgaug

SEQ ID NO: 4702 - RNA, 793 nt, Psylliodes chrysocephala
aaaacuccuagacgaaacccaucgugaaaaagcgcguuuggaaauugauguuaagcgacuuuuagaagaaaaugaugaacugaaagcugauuuagguaagaggaacaaggaguugcaauuagccgaaaguucuguuagaaucuaugaaacuagauguaacgaaucgcagcucaaagcuaaucaggcaauugcugaugcuaagaaagcuaucgccgaugcuaaagaacucgaaaaagaacgggacaaguuaaggaaacuucuugaagcaacacguaaacaguuggaacaggaaucuuuggcuagaguagaugucgagaauaaaaaucaaagucuuagggaagaacuauccuucaaugaucaggugcaccagcaagagcugacagaaacccgcacccgccgucaagucgaaaucagcgaaaucgauggcagacucgccgaaaaguacgaagccaagcuccaagaagcccuacaagaucucagggaucaauacgaaucucagauggccaacaaucgccacgaaaucgaguugcucuaugagcagaagaucaaaaacuugcaggcggccaacgauagaaaccagaauuccgcuuccgcugcucucgacgaguugagacaaaccaggacgagaaucgacacgauaucgucgaggaugcaggauuuggagaaccaaaacgccggccuggccgccagagcaagggacuuggagaaguugcuggagaaugaacgaaugcgucaugcugaagaucuagcucuauuggaaagagagcuccaaagacuuagggaagaaacagca

SEQ ID NO: 4703 - RNA, 665 nt, Psylliodes chrysocephala
gaagaugaucaaaucgacgccgagguccuaaacucgcucgcuguaacaauggagaacuuccguuacgccaugaccaagagcagcccgagugcuuugcgcgaaacugucgucgaaguaccaaacauuacuugggacgauaucggcgggcuggccaacguuaaaaaggaguuacaggaauuggugcaguacccugucgaacaucccgacaaguuccucaaguucgguaugcagccgucuagaggcgugcuguucuauggcccaccggguugcgguaaaacucuuuuggccaaggccauagcgaacgagugccaggccaauuucauauccguaaagggaccggaauuguugacgaugugguuuggagagucagaagccaaugucagagauauuuucgauaaagcuagaucugcggcgccuugugugcuguucuucgacgaguuggauuccaucgcuaagaguagaggugggaacguuggagaugcaggcggugcugcggauagggugauuaaccaaauuuugacggaaauggacggcaugggagccaaaaagaacguguucauaaucggugcuacuaacagaccagauauuaucgaucccgcaauauuacgucccggccguuuggaucaacugaucuacaucccauugccagaugaaaaauccaggga

SEQ ID NO: 4704 - RNA, 650 nt, Psylliodes chrysocephala
ugugaagaucuccuuucgucuguagaucaaccuuuaaaaauugcuaaagacaaggauucugggaaagauuuccucuuaugcgauuauaauagagauggagauucuuacaggucaccuuggucuaacaccuauuaucccccauuggaggaugguucuaugccauccgaaagguuaagaaaauuagaauuagaugcaaaucaugcauuugaucaauauagagaaauguauuuugaaggugguguaucuucaguuuauuuuugggacuuagaccaugguuuugcagguguaauucuaauaaagaaaacuggggaugguaguaaaaaaauaaaaggauguugggacuccuuacauguaguagaaguucaagaaaaaaguucuggaagaaauucacacuacaaaaugacuucaacugccauguuguggcuacagaccaacaaacaaggaucuggaacaaugaauuuggguggcagucuaaccagacaaauugagcaagaugcagcugucaacgaaaucaauccucacaucgccaacauuggucgcaugguagaagauauggaaaacaaaauucggaacacacuuaacgaaauuuacuuuagcaaaacuaaggauaucgugaacagcuugaggucaguccaaccucugacagaaag

SEQ ID NO: 4705 - RNA, 739 nt, Psylliodes chrysocephala
caauggaccugggaacaauaaagaagcgcuuagagaacaacuauuauuggucgggcaaagagugcauacaggacuucaacacaauguucacaaauuguuauguguacaacaaaccuggagaagaugugguuguaauggcccaaacauuggagaaaguguuuuugaccaaaguggcugauaugccaaaggaggaauuuguagucgaaaguccuaucaaagggacaaaaggaaagaagggccgaggaaguuccggcggcccagguacccccucgacaccggugguggcggcgguuccgccaccaacaccaacggcaacugguagaggcaggccgccugcuacuguuucaucuacaagugcgacuccaguugccacuaccacaggaucaucagguuuaccauuggguacccaagcuccagcuacaguaccaggcagcacagcaacaaccacgauagcaccugcaacuaccaauaauagcucucuggcuucccagcagcuuacuacuucaguuggauccacacacggagcuggagcuccuuuggccaauuccuuagacucuaguggagugcuaccuggaaauguaauaccuccggcacaaccagcaaagguaaaaaaaggcgugaagagaaaggccgacacaacaacuccugcgaccgccuaugauuauccgaccgcauuagaaucgaaaucugcgaaaauuucaacgcgcagggaaucaggaaggcaaauuaaaaagcccac

SEQ ID NO: 4706 - RNA, 762 nt, Psylliodes chrysocephala
caauuucguucaucagcaggucucaaugaaccaucgccagcccuacagcgucagcgacaaagcuggucaccaaaccucggccgaguccugggggaccggucgcgccguggcccguauaccccguguacgcggcggcgguacccaccgaucgggccagggagccuucggcaacaugugucgcggcggucgcauguucgcgcccaccaagccguggcgccgcuggcacagacgcgucaacgucaaccagcgucgcuacgcgcuggcgucggccgucgccgccagcggcgugcccgcccuggucaugagcaagggccacguggucgaucagauacccgagcugccguuggucgucagcgauaaggugcaggagaugcgcaagaccaaggaggccgugcaguuccugaggaggaucaaggcuugggcugacauccaaaagguuuacaagagccagcgguuccgugcugguaaaggaaaaaugcguaacaggagacguauccaacguaaaggaccucuaaucguuuacuacaaagaucaaggucuucgucaagcuuuccguaacaucccuggcauugaucuaaucaguguucaaaaguugaacuugcugaaacuggcuccugguggucacguaggucgguuuaucaucuggaccgaauccgcuuuccagcguuuagacaaauuguucgguacauggaagaacccgucgaccgaaaagaaggguuacaauuugccccagcccaagauguccaacaccgauuugucuag

SEQ ID NO: 4707 - RNA, 678 nt, Psylliodes chrysocephala
uugucaccagaacaauuugcugaaaauaugagagacaacuaccaaagacaugaaguugaucaggaacauguugaaccugcggagguagcaaaagauuuuauuucaccuaaguuugcuaauggugaugaagucuugcaagcugccaaauauaugguugccuugcaaauagcuagagaacccuuagugagaaaaugugugagggaaguuuuuuuugaaagagccagaauuaacguuuauccaaccaaaaaaggucaaaaaguaauugacgaaucucacaauuguuauaguaugaaauauguaaaaaauaagccuguaagagaucuagcgggcgaucaguuuuuaaaauugugccuugcugaagaagaaaaccuucuuacuauuacaauuaaugaccacaucgaagguaacacaacuaauucguauauugacgaaguuaaacaacuuuacauaaaagacgaguuuaguaaaaacguacaagacuggaaugcuuugaggauggaauguguggagagagccuuaacgaaaaguguuuuaccugauuuaagaacugaauuaaaaaggacuuuguugacugaagccaaagaauuuguacuuaaagcauguuguaggaaacuuuauaauuggauaaagauugcaccuuacucuaucacguuucccgaugaugacgaggaugauugg

SEQ ID NO: 4708 - RNA, 678 nt, Psylliodes chrysocephala
uuuugggaagcgauagugaaucaggaucuggcucugaaggaucagaugaugaaucagacgaagagggggaagaggaaguaaaagauucuggaacuauuauugacaacacagaaacuaaucuaauagcucuuagaaggacgauauauuugacaauacaaucuaguuuagauuuugaggagugugcacauaagcuauugaaaauggaauugaagccuggacaggaaauugaguugugucauauguuccuggauugcugugcagaacaaagaacauacgaaaaauucuauggacuguuagcccaaagauucugucaaaucaacaaaauauacauugaacccuuucaacaaauauuuagagacacauaugcaaccacacacagauuagaugcuaauagguugagaaaugugagcaaauuuuuugcacauuugcuguuuacggaugcuauaaauuggcaaguucuugacauaaugaaauuaaacgaagaagauaccaauaguucuaguaggauuuuuaucaaaaucuuguuucaagaguuggcugaauauaugggauugggaaaauuaaacgcaagacugaaagaugagacucuucaagaacauuuuucugguuuguuuccuagagacaauccuaaaaacaccagauuuuccauuaacuucuuuacauccauugguuugggag

SEQ ID NO: 4709 - RNA, 783 nt, Psylliodes chrysocephala
ccaaagcguuaccaaaaacuugaagaaguuuacagauucaaaacgcaugacgcaaagcgacaaacaaucgaugaaggauuugucgaccaugaucaagaaaaugccccaauaucagaaggagcuguccaaauacgcgacccaccuccauuuggccgaagacugcaugaaggcuuaccagggguacaucgacaaguugugcaaaguugaacaggauuuggccaugggcaccgacgcagaaggugaaaaaaucaaagaccacaugcgcaauaucguccccauucuucuagauccaaaaauaacuaaugaauaugacaaaaugcgcaucauugccuuguacgcuaugaccaagaacggaauuacugaagaaaauuuaucgaaacuugcgacucacgcacagauaaaggacaaacaaaccauugccaaccuccaacuguugggcgucaacgucauuaacgauggagggccgagaaagaagcaguacaaugugccgcguaaagaaaggaucacagaacagacuuaucaaaugucaagauggacgccuguuauuaaagacauuauggaagauuguaucgacgauaaguuggaucaaaagcacuacccauacuugagcggccgggcgcagacuacuggauaucacgcagcgcccucuagcgcgcgcuauggacaguggcacaaagauagaggccagcaagccguuaagaacguuccgcgcauuuuggucuuugugguaggaggcaucaguuucucggaaauacgaugcgccuaugaagugacaaacgcuca

SEQ ID NO: 4710 - RNA, 772 nt, Psylliodes chrysocephala
acucucaauguguugaugcuuauauagaucacagucaaaugggcuguuuguccagcaaagacguuuuuauuaguuuucugaaucuguguaaauacaacaaugaaauuauccagaaaguuuuuaauaauccagaacaaguuauggcuaaauuuguauuaaacauauaucaauuaaaauugguggaauacauugaugacaaacugaauucuaaauuaggaacuuauaauuacuuacagacauuauaugaauuguauucaaagacuaaucaguuaucaaaugauuuaaguguguuuaauaugggaaaugauaaaaauuauuugagaaaguuaacaacuaauauuuuuaauaaauauauaaaugacuauauuacaauggaacucaaaugccugaaagacagauguucggcaaauuuacaaaaguacuaugagucaaaaaaucaucaaaagaagcagauucaaucuggcgguuuccaagaccuuagaagagauuuacaagcagugauagguacaagagcaaauauuaauauagcccaaauagaaaauuaugguggcgaaacuuucuugucugaggaauuggcuauaacaauuuuccaagacacuaaacaggcuuuucaacguugucaguuguuaucgaaaaacaaugacagagcaucaaaugcaacucaaaucuuagacagacugauaaauaguuuacuuauagagcaugucgauuaugccguagaacuagguuugcaagcuguaccuguuggggaaggauccaaaaauccuccugu

SEQ ID NO: 4711 - RNA, 659 nt, Psylliodes chrysocephala
ucgcuuuagaaaccaucgauuuacaaaaagaucccuauuuuaugaaaaaccacuuagguucuuaugaaugcaagcuuuguuuaaccuuacacaacaacgaagguaguuauuuagcucauacgcaaggaaaaaagcaucaagcuaauuuagcuagacgagcggccaaagaagcuaaagacgcacccucccuauugcaaccagagaagccucgagucgaaccuaagaaauucgugaaaaucgguagaccugguuauagaguuacgaagcagagggacccagaaaauggccaccagaguuuacuguuucaaauugauuauccagaaaucagugauguaguccuuccucgacaucgcuuuaugucagcuuaugaacaaaaaauagaaccuccagaccgcaaauggcaguaccuuuuguuugcagcugagccauaugaaaccauugccuuuaaaguaccaucaagggaaguggaaaaaacugacaauaaguuuuggacucauuggaauaaggauacaaagcaguuuuuccugcaguuugcguucaaaaaugagaacaaacguacugcuaauacuguugugacaagacaucaguuggucaguggagugccaccuccuccgauguugccagugccuccaccuccuaggccuccuauguuuaaucca

SEQ ID NO: 4712 - RNA, 252 nt, Psylliodes chrysocephala
accugugaaacuauuaccggcgaaguuuacagaggaaaacuuauagaagcugaagauaauaugaauugccaaaugacucaaauuacuguaacuuacagagacggaagaguagcacaauuagagaauguuuacauuagaggaucuaaaauuagguuucuaauauuaccagauauguugaagaaugcuccuauguucaaaaagcaaacuaaagcugggacugcagguagagggaaaucagcaauucuucgagcu

SEQ ID NO: 4713 - RNA, 661 nt, Psylliodes chrysocephala
aagaaacugacaacuuggguguaacgcauguuuugagaacugcagcagguuuaagcacuaaaaaugcuucacaauuugccauuauucguaauauucaacaaguuggugcuaauuuaacagcuacuucugaucgugaaacuauuucuuauacuuuagaagguacuaaagaagcuguugaacgagcuuugccauuuuuaacagaaguagccacucaacaagaauuuaggccaugggaaguuucugaauuaucaaacagacuauuguuggauauugcaaccaggccacuucagcuaagggcaguugauuugcugcacaaugcugcuuucagaggucguggauuaggcaauucccucuuuauuccuaagccacaaauuggaaaaauaucuucugaaaccuugcagcacuauguugccagcaauuuuuugaguggucgcacugcuguuauaggaucaggaaucagugaaagagaguuggcacaguaugcaaacuccuugaaaauuggaaauggugaagguaauacuagucccagcccuuacaaagguggcgaacuuagaucaaacaaagguggaccacuugccuuuguugcuguagcaggagaaggaacugcucuuaaaaacacccaagaagcucuugcuuuugcuguccuacaaagagccauagg

SEQ ID NO: 4714 - RNA, 202 nt, Psylliodes chrysocephala
gacgaaaaugaucgaaugacuaaugaacuccaagaaaaaauugggguucuaaaaucuuugacuauagacauuggaaaugaaguuaaauaucaagauaaacuuuugagagauguggacgaugauuuagauaaaacuggaggcuuuuuaggaacaacgaugaauaaaguauuaaaauuauccaaagguggucagcauuauauca

SEQ ID NO: 4715 - RNA, 663 nt, Psylliodes chrysocephala
caauugauaaaggucccccaauuuuggcagaagauuacuuagauauccaaggucaaccuaucaacccauggucacguauuuauccugaagaaaugauccaaacugguaucuccgccaucgacguaaugaacuccauugcccguggccaaaaaauucccauuuucucggccgcuggucugccucacaacgaaauugcugcucaaauuugucgacaagccggucuugucaaaauucccggcaaaucuguauuggaugaccaugaagauaacuuugcuauuguguuugcugcuaugggaguuaacauggaaacugcuagguuuuucaaacaagauuucgaagaaaaugguuccauggaaaauguaugucuguuuuugaacuuggcuaaugaucccacuauugaaagaauuauuacaccacguuuggcucuuacagcagcugaauuuuuggccuaccaaugcgaaaaacacguccuggucauauugacugauaugucuucauaugcugaagcuuugcgugagguauccgccgccagagaagaagugcccggucgucgugguuucccagguuacauguacaccgauuuggccaccauuuacgaacgugccggucgugucgaaggucguaacgguuccauuacgcagauucccaucuugacuaugccua

SEQ ID NO: 4716 - RNA, 752 nt, Psylliodes chrysocephala
gaacuuuuaucuccggacgagucugucauaucccgggacgaagaaccuuccauaacccgcuuuuccggucgacgcaaaucgguguucgccgaaacguacgaucccgaagaagaugacgacgaggacgccaacaaaaucgucuauccgaaaucggacgagcaacgccaaagacugucguccgccgucggcaauauuuugcucuucagaucgcuggacagcgaacaaaugaacgaaguauuggacgccauguucgagaggaucgucaagaaggacgaauuggucauacggcaaggagacgacggggauaauuuuuacguuauucaaaauggaacuuaccacguuuuggucagcaccgauaacucgccggagccgaaacacauccacaccuacgaagacagcggcagcuucggcgaauuggcguugcuguacaacaugccgcgcgcggcuaccguaaaggccguuucggaaggcucccucugggcgauggacagacacacguuuaggcguaucguucucaaaucggcguucaaaaagaggaagauguacgaaacguugauagagagcguaccgaugcucaagacuuugcagccguacgaacguaugaaucuugccgaugcgcuuguucccagaguguucaaagacggggacagaaucauaaaacagggcgacgcggcggacggaauguauuucguggagcaaggccagaucaucaucagcguuuuagacgauagcggcaaagagguggagauaaa

SEQ ID NO: 4717 - RNA, 698 nt, Psylliodes chrysocephala
aucuguuguugcaucaggauggaucaaaaauggcagugagacuugcugguggucuccaaaaaaugguagcacuguugcaaaggaacaaugucaaauuuuuggcuaucgugacugauugcuugcaaauuuuggcuuaugguaaucaagaaaguaaacugaucauuuuggcuucacaaggacccaucgaauuggucagaauuaugagaucuuaugauuaugagaaguugcuauggaccacuucaagaguuuugaagguuuuaucaguuuguuccaguaauaaaccagcaauuguagaagcugguggaaugcaagcucuugcuaugcauuugggcaacccaagcaccagacuggugcaaaauugccuuuggacucuaagaaacuuaucagaugcugcuacuaagguugauggucuagaaagcuuguugcaguccuuggugcagguaaauguacuggcuucaucugaugucaauguuguaacaugugcagcugguauucuuucuaacuugaccugcaauaaccaacguaacaaagugacaguuugucaaguaggaggggucgacgcuuugguacgcacuauagucacagcuggagaucgugaagagaucacagaaccggcuguaugugcuuuacgucauuuaacauccagacauguugaaucugaaauggcacagaaugccgucaggcucaacuaugggaua

SEQ ID NO: 4718 - RNA, 665 nt, Psylliodes chrysocephala
uaaacauaaaaagcgccgaccauauuuggcuucugaaugcaaaagcuuacacgccugugaaaaauggagaaugcaaaucauaagggagauagcaaaaaaaguggcacaaauacaaaaugcugguuuaggagaauucagaauuagggauuuaaaugaugaaauuaauaaauugcuuagggaaaagagacauugggaagaucaaaucaaagaacugggagguccagauuaucaaagaguuggaccuaggauguuggaucaugaaggaaaagaggugccaggaaauagagguuauaaauauuuuggagcugcuaaagaauugccagguguaagagagcuuuuugagcaagaaccacccccuccucccagaaagagcagagcugaacugaugaaagacauagacgccgauuacuauggguacauggacgaugaugacggcauucuuauuccgcuggaaguaaaagcugaaaaaauagcuauucaaacuucuaucacugaauggguaaauaauaaagagaagaauuugggagauaaugaggaaguggaagaaaauauuuaugcuguagaagguucggaggaugaagaggaaacaguucaacaaauugacggaucccaacaaagauucgucgcgcacguaccggucccaucgcagcaagacauagaacaag

SEQ ID NO: 4719 - RNA, 532 nt, Psylliodes chrysocephala
guaccggcaaaacuacuuucguuaaacgucauaugacuggagaauuugaaaaaaaauauguagccacuuugggcguggagguucauccccuaguguuccacacaaaccgaggcaaaauccguuuuaacguaugggauaccgcuggucaagaaaaauucggaggccuacgagauggauacuacauucagggacagugugccaucauaauguuugaugugacuuccagaguaacauauaaaaauguaccaaauuggcauagagaccuuguaagagugugcgaaaacauuccuauuguuuuguguggaaacaaaguugacaucaaggauagaaaaguuaaagcaaaaaguaucguuuuccauaggaagaagaauuugcaguauuaugacaucucugcuaaaucaaauuacaauuucgaaaaacccuucuugugguuggcaaggaaacucauuggagaucccaacuuagauuucgucgccgcuccagcucuacugcccccagaaguccagauggauccucaauggcaacaacaaau

SEQ ID NO: 4720 - RNA, 727 nt, Psylliodes chrysocephala
caguugacgauccuaggaagcuuaaaccuggggaaauugaucccaacccugaaacuaaaccagcuaggccagauccuaaggauauggaugaggaugaguuagaaaugcugucugaagcuagagcuagauuagcuaacacucaaggcaagaaagccaaacgcaaggcccgcgagaagcagcuggaagaagcccgacguuuggcagccuugcaaaaacguagagaauugagagccgcugguaucgaaguaacaucaagacgcaagaaaaagcggggagucgauuacaacgcggagauuccguucgaaaaacguccggcgaucggauucuaugacacaucgaacgaggcucuagacccgauggcuccggauuucuccaaaaugagacagcaacauuuggacggggagcuccgaagcgaacaagaagagagggagcgcaaaaaagacaagcagaaguugaagcaaaggaaggagaacgauauaccgcaagcgaugcuucaaaaccaggaaccggcgaagaagcggucgaaauugguuuugccugaaccgcaaauuuccgaucaagagaugcaucagguugucaaauuggguaaagcuagugaaacugccagagaaauagccacagaaaguggaauagaaacuacggauacgcuuuugaaugauuacauguuuaccccgcaagcugccgccacuccuaggacuccggcaccccaaacugacaggauucucca

SEQ ID NO: 4721 - RNA, 429 nt, Psylliodes chrysocephala
ccagaagauaugcaacaacagauuauuaaagaaacguuucaguuaguuucaaaaagagaugauaacguauguaauuucuuagaagguggaaguuuaaucggaggcagcgauuauaaauuaauauacagacacuacgccacauuauacuuuguauucugcguggauuccucugaaagcgaauuaggcauuuuagaucuaauucaaguuuuuguugaaacauuagacaaauguuucgaaaauguaugugaacucgauuugauuuuccacgucgauaaaguucauuacauacuuaacgaacucguuaugggugggaugguauuagaaacgaauaugaccgaaauuuuaacaaggauagaggaucaaaauaaaauggaaaaacaagaagccgguauagcugcagcuccagcucgagcgguuucagcuguaaaa

SEQ ID NO: 4722 - RNA, 718 nt, Psylliodes chrysocephala
aaggaagauuaaagccuggguuaaauaaaguagagaaggugccaaaaaaauucauaaauaauguaaguggucuuaaacaaaaaguugaagaauuaaaacuuaaucugccuuggauugaaagacuugacuguacaaguucacaagccccauuagcaccagaauucgcagcucaaauguuaauucaugaagaaaaaaggaguaaccaauugaaaaauaauaagaaacuuccccaauuuaguccaucugaagacccaguacuuaacgauuuuaaaagagaaauuauguuucaaaggcaggcacaggcuacgauucuagaagcuauaccuaaacuaaaagcaaugggaauuucuacgaaacgaccagaugacuacuuugcagaaauggcaaaaacagaugcacauaugcauaaaauucgagaacaacuacagaaaaaacaagaacaacaaaaaagaauugaaagaguaaaacagcuaaggcaacaaagaaaagauggaaagauguuacaaauucaaacaaaauuacaaaggucucaagaaaagaaagaaaugcuugcacaggugaagaaaguccggaaaggcgugagcaaaaaucucgauuuucuugaugguaagaauaaaccuuccaaaaagauuauugaaaaacgcaaaaugaaagauaaaaaauuugguuuuggggguaaaaaaagagguaugaagaaaaauacuagagaaagcgcagg

SEQ ID NO: 4723 - RNA, 750 nt, Psylliodes chrysocephala
gacgcagaucacucaguauuuggcugaagccgguuucacagccaggggaaaaauaggauguacucagccaagaagaguggccgccaugucgguggcuaagcgaguagcggaggaguuuggauguagauugggacaggaaguuggauauaccaucagauucgaggauuguacuagcccugagacgaugaucaaguacaugacagaugguauguugcuuagagaaugucuuauggacuuagaucucaaaaauuacucggugauuauguuggacgaggcucacgaacguaccauccacaccgacguccuauucggucuucugaaacaagcugucuugaaacgcgaagaacucaaauugaucgucaccucggcaacgcuggacgccgucaaauucucgcaguacuucuucaaggcgccgauauucacgauacccggcagaacguuuccggucgaaguuuuguacaccaaagaaccggaaacugauuauuuggacgccagcuugaucaccgugaugcagauacaccugagggaaccgcccggcgauauuuuacuguuuuugaccgggcaggaggagaucgauacagccugcgagauucuguaugaaagaaugaagagucuaggucccgauguaccugaacuaaucauccuacccguguauuccgcguuaccaucagaaaugcaaacuaggauauuugaaccggcaccgccggguagccgaaaggucguuauagcuacaaauauugccgaaacguc

SEQ ID NO: 4724 - RNA, 727 nt, Psylliodes chrysocephala
cgacccuucucuacgaaaauccggagucggcaacguuuucaucaagaacuuggaccgauccaucgacaacaaggccauguacgacaccuucucggccuucgggaacauucucagcugcaaaguggcucaagacgagagcggagucagcaagggcuacgguuucguccacuuugaaaccgaagaggcugccaauaaauccaucgaaaagguaaaugguaugcuguugaacggcaagaaggucuacguuggucgauucaucccgcgcaaagaaagggaaaaggaacugggcgaaaaggccaagcucuucacgaacguuuacgugaagaauuucggagaggacuuguccgaggagcagcugcgaacgauguucgagaaguacggcaagauaaccagcuacaaaauaaugagcaaggaugacggcaaauccaaaggguucggauucgucgcuuucgagagccccgaggcagccgaaucagcugucgaggcccuaaauggcaaagaguuacuggaaggcaagccuuuguacgugggaagagcccagaagaaggccgagcgccaacaggagcugaagcggcgcuucgaagcccugaaaauggaacggcugaaccgcuaccaaggcguaaaucucuacgugaaaaacuuggaugacaccauagacgacgaacgccugcgcaaagaauuuuccccguucggcaccaucaccucggccaaggugaugauggaagaa

SEQ ID NO: 4725 - RNA, 717 nt, Psylliodes chrysocephala
ugugcaaucaaaguugaaccuucugcagaaagguguguugccacauuauuggaccuuauucagacaaaagucaacuaugucguucaggaagccauuguggugauuaaggauauuuucaggaaauauccaaacaaauaugaaaguauuaucaguacauuaugcgaaaauuuggauacucuugaugaaccagaagccagggcuagcaugguguggauuauaggagaguacgcagagagaaucgauaaugcugacgaacuuuuggauaguuuucuggaagguuuuggcgaugagaaugcucaaguacaacuucaauuguugacugcuguagugaaauuauucuugaaacgaccucaacacacucagggcuuaguucagcacguacuaaguuuagcaacucaagauucugauaaucccgauuugagagacagagguuuuaucuauuggagauuauuaaguaccgaucccgcugcagcuaaggaaguggugcuugcagacaagccccucauuuccgaagaaacugaucucuuagaaccgacccuucuugaugaacugauuugucacauaucaucacuggcuagcguuuaucacaaaccacccacagcauuuguagaggguagaagugcuggaauacgaaaaacauugccagcuagacaagguucugcagaugauagugcuagcgcuccggagaccacugucauaccgaaccaagaaagucug

SEQ ID NO: 4726 - RNA, 355 nt, Psylliodes chrysocephala
uucaucuuuggccccuaaaauugguccacuaggguugucuccaaagaaaguuggugacgauaucgcuaaaggaaccgccgacuggaaagguuugaaaauaaccguucaauugaaaauccaaaaucgucaggcuacaauuucugucguaccaucagccgccucucuuauuauuaaggcuguaaaagaaccaccacgugauagaaagaagcaaaagaacauuaaacacaguggcaacauuaccuucgaugaaauaaucacaauugcaaagcaaaugaggccccggucuauggccaaacaacuuucugguugugucaaggaaguauuggguaccgcacaaucuguagguugcaccauc

SEQ ID NO: 4727 - RNA, 652 nt, Psylliodes chrysocephala
gcaaaagagcacugauucucguuggaggauaugguacaagacugagaccucucaccuugaguagaccaaaaccucuuguagaauuugccaauaaaccaaucuuguugcaucagauugaagcauuaguagaugcuggagucacagaaguaauucuagcaguaucauaucgugccaaacaaauggaagaagaacuaaccauagaagcuacaaaacuagguguuaacauaaucuauucucaugagacugagccucuagguacugcaggaccaauagccuuagccaaagagcaucuuuccaaaagcacaaagccauuuuuuguacuuaauucagauauaaucugugacuuuccauuuagagaacuagccaaguuccaugaagaucaugguaaagaagguacaauagugguuacaaaggucgaagagccuucuaaauaugguguagugguuuaugauaaaacuaauuguauacaaagcuuuauugaaaagccccaggaauuuaucucgaacaaaauaaaugcuggcuuguacauucuaaaccccaguguaaucaacagaauugaccuuaaaccaacuucuauugaaaaggaaguuuucccaaauauggcuucugacaaacaguuguaugcauuugaauugaaaggguuuuggaugga

SEQ ID NO: 4728 - RNA, 651 nt, Psylliodes chrysocephala
gcccaguacaauaaagaccaacucaccccaguuaggauagaaaaugccgaucacuuggugcugauuacagaauacaacgauuuagguaacaacagauucuucgauccccguaguaaacaaaguuucaaauacgaacauuuaagaaaagaggcuuccgauuaccagcccuauaccccagauucugcuacggagccuuggcgggcugcccuagaugcggaguuuguccaauacacgaggaaccauuacaaggacggcguuugcagcgucguggggcgcaaccaagguggugcuauuacacuuacagcuugcauagaagaucaccaguuucaaccuaagaauuuuuggaacgguagguggaggucucaguggucuguuagcuuaacggaugagucuacggccgaaguaagagguguguugaagguucaaguccauuauuaugaagaaggaaauguccagcugguaagcacuaaagaaauaaaagaaacuauuccgguuuccaaugaaacucaaacagcaaaagaaaucauccaagugauugagaaugccgaaaaccuguaccagacggccaucucugagaauuaucaaaccaugucugacaccacauucaaggcgcucaggagacuccugccugucaccaggacaaaaaucgau

SEQ ID NO: 4729 - RNA, 730 nt, Psylliodes chrysocephala
gaguuuauggugacccacaugucguuacuuucgaugacguagaguauacuuuuaauggcaaaggagaauuuucuuugguaaaaucaguuacuaaauuagauaauuuagaaguacaagguagauuugaacaaauggacccuaaugcuuacggugaagucagagcuacacaguugacaucaauuguugcuaaaggaaacaacacuaucucuguggagauuagaagaaggccuuuggauucuagguggagauaccgauuggauguaauagcugauaauagaagguuauauuuugacaggccuuccuugaaguuccaacauuuucaagguguaacuauuuauaccccaacuuauauacugaaucagucugaaguguugauuauguuugauaacggagccgguguugaaguauuagauaaucaagguuacaugagugcaagagucuuuuuaccauggucauuuauaaacaaaacaguugguuuauuuggaaacuggaguuucaacaaagaagaugacuuugcuuuaccagacggcacuaaggcugcuguaguaaguaauauuaacgauauggaaagaguguacaaugacuucgguucaaaauggauguuggaugacguauuagauccacaaaaaggacgcgcauuguucuauagagaguucggacgaaguucuucuacauauaauaauaaaacuuucaaaccacaguuuuuaaugaugccggaagacauuauacc

SEQ ID NO: 4730 - RNA, 188 nt, Psylliodes chrysocephala
ugguucaguaggaguugaagccgagggugaaaaacuuaaaaaagucaucggcgaacguaauggaaugugcguugaagaacuuaucacucaaggucgugaaaaauugaguucccugcccguugguggaggugcaccugcagcugcuguugcuucagcugccccagcugcugccgcagagcagaagaaag

SEQ ID NO: 4731 - RNA, 793 nt, Psylliodes chrysocephala
auuguagcugaaugcaaugcuguuaggcaagcucuucaagauuuacuuucagaauacauaacaaauauuggcaauaaagacaaaagugagagucuuaacagggcuauugacaauaugggcagaaagacccgugaccucagaagacagcucagaaaagccguaguugaucauguuucugacaguuucuuggaaaccaacguaccucuauugguucuaauaaaagcagcucaaaacggcaaugaaaaagaaguagaggaauaugcggucgucuuuacugaacauuccaauaaacuuguagaaguagcuaaccucgucugcagcaugucaaacaaugaagauggugucaaaaugguucgauaugcagcugcucagauagacaaucuuugcccggaaguaauaaacgcagcuagaaucuuagcugccagaccucgcaguaaaguugcucaagagaauauggaagcuuuuaaacaaucuugggaacaccaaguacgaauuuugacagaagcuguugaugauaucacuacuauugaugacuuuuuggcuguuuccgagaaccauauucuugaagauguuaauaaaugcguccuagcacuucaagaaggugaggcugauacauuagaucgcacugcuagcggaaucaaggguagaucuaacaggguaugcaauguuguaacagccgaaauggauaacuaugaaccuugcauuuauaccaaacguguucuggaagcaguuaaagugcugaacgaucaaguaaugcccaaguuuacucaaagaguacagguugcaguacaag

SEQ ID NO: 4732 - RNA, 672 nt, Psylliodes chrysocephala
ugcuucucucuucgguaguacgucuacaaguguugcuacaauugcuccagguuuggguuugucaacagcagcaccuacagcuuuuucuacagcagcauccaccgcuuuaaguacuaccacaguagcuccaacuuauucaacuacuacacuuccaucuacugguuccuugacuuucggucaauuggaagacucuauaaacaaauggacgaucgauuuagaagaacaaggcaaauucuucaucaaccaagcaaagcaacuuaaugcaugggacucucugcuuauuaccaacggagagaagauucuuaauuugaauggcaguauugagcggguuaagcaacaacaacagcaguuggaucaagaacuagauuucguauuggcacaacagaaagaauuggaagagcuaauuacaccuuuggaaaaggaauuguuggaaauuccugucacugauauagauaggaaucaaauguaucaauucucagaaauuauugacucucaguugaaacaaaugucagaugauuugaaggaaauuaucgaaaauauuaaugaaucuaacaagaaugaagaaauaucaaauccuauuacccaaaucagucgaauacugaaugcccauaugaauucucuacaaugguuagauagaaauacaucccaaauuagcucacaucucgaacaaau

SEQ ID NO: 4733 - RNA, 446 nt, Psylliodes chrysocephala
uuccucggucucgacaaugccggaaagacgacccuccugcacaugcuaaagaacgaccgcguugccguuuugcagcccacgcuccacccuaccucugaggagcuugccauuggcaacguccgcuucaccacauucgaucucgguggccauccccaagcccgccgcaucuggagagacuacuuccccgaggucaauggugucguguuccucgucgacgccaaggacgaggagcgauucgccgaggccaaagccgagcucgacgcccugcucgccauggaggagcucgccaagguccccuuugucauccucggaaacaagaucgaucaccccagcgcgguccccgaggacagacuucgucacgagcucggccuuuaccagacgacuggcaagggcaaggugccucuggagggcauccgcccgaucgagguauucaugugcucgguagu

SEQ ID NO: 4734 - RNA, 417 nt, Psylliodes chrysocephala
aguuuuuccauuaggagaccauucucaaauuucaaauaaaacccaaacuauuaccgacuuauugucggaaacucaaacaaugaucaaaucagcccuacauugucgggaaucgaucacuucaauguugcaacauuuaguaaucauuaaugauuauuugaacccugccggcgaugcugacgaguuagaaguggaagcaaaacgacaauguuugcuugaauuguauccugaauugaaagacacuguacaaaccauuaguacucuagagucucuguugcccuuuauugauucuauuaacaucucuaaaguagucgaauuuucuggaaaauuggaagaaauagcuuuaaguaaccuuaaacuuuauggagaaugucgagauauaacuaaaaaaguacugguagcucuacaaaauuauaauga

SEQ ID NO: 4735 - RNA, 737 nt, Psylliodes chrysocephala
ggagacugguuaaagcugaauuaauuccauuuagaagugcauugcauuuaccuccagaaaaacaagcugauaaugaaauauauuuagcuaugguagagucuguauuaucuaccccuuuccuauauuuuuguuaugauuaugaucuuacacauuccuuacaacgauuacauggaauaaguccugauuucuggaaccaaucaauaugggauagagcugaucaaagauuuguuuggaauggaaacuuauuaacuccauuuaagggcuuguauauucaaaaauuuugcuuaccuuuaauucaugguuuuauuuccauaaacuucuguguuauaaauggccacaguuugaacuggucaauuguaucucguagaaguguucagcgugcugguaccagauuacauagaagaggcauagacaaagauggaaauguugcuaauuuuguugaaacugaacagauuguugaauaucaaggggaccaugcaaguuuuguacaaauaagagguucaauuccacuauuuuggcaucaaaauccugauuuacguuacaagccuccucccacccuauuagaaguugauccacaagaucaucauuccacuuguuuaagacauaugaaugauuugaugaccauguauggaaaaguuguuugugugaaucuuguugaucaaaaaggagcugaagggaauauggaaauagcuuuccaaaaugcuauaaacaauaugucgucuccuuccauucguuau

SEQ ID NO: 4736 - RNA, 700 nt, Psylliodes chrysocephala
cagaccagauuucaaccucaaaccauggacaaaguggaagcaaaaguugguuacaguauuaaaaagucacuuaacaaugaaacuuuguauauggacagagauucucaaauuaaagccauugaaaaaacauucgaugauacuaaauugguuaucgauaagcauuauagcaaaccgaauguuguaccaguugauauuuugccuguauaugcagauuuuagcuuauggaaauauccuugugcucaaguuauuuucgacucugauccauccccgaguggcaaacaaacgccugcccagauugaggagaugucucaagcuaugaucagaggugugauggacgaaaguggagaacaauucguggcauauuuccuaccuacagaagaaacucuucaaaaacgucgagaagauuucaucaaacaaaucccguaucaagacgacgaggaauacgaauauaaaauggcgagagaauacaauuggaaugucaaaaguaaagccagcaagggauacgaagaaaauuacuucuucgucguucgucccgacggaaucuacuauaacgaauuggagaccagagucagacuuaguaagagaagacagaaaaucggucaagcucccagcaacacuaggcuuaucguuaaacauaggguuauggaugcaaacgaguucaggaugcaaagauacagggagaaacaacuugaaccaccag

SEQ ID NO: 4737 - RNA, 757 nt, Psylliodes chrysocephala
guugaagacccugaaagcuaaaaaugacgaaaagaucaagcuuuuggaugaagcuaucgaagaugcugaaaagaauuugggagaaauggaaguaagggaagccuacuugaggaaauccgaauauuauaguagaauuggagauaaagacaacgcuguaauuacauuuagacaaacuuaugauaaaacugugucucucgggcaucgcuuagauaucaucuuucaucucauuagaauugguuuguucuuuauggaucacgaccuuauaacaagaaauaucgauaaagcaaagacuuuaauagaagaggguggagauugggauagaagaaaucguuugaaaguauaucaaggugcuuacugcaugucagugcgagauuuuaaaacugcugccaacuuauucuuggacacugucaguacuuuuaccucauaugagcuuauggauuacaaagcuuuugucagauauaccguuuauacuucaauaauaagccuaccaaggaaucaacuuagagauaaaguggugaaagggucugaaauucuagaagugcuacauucugaaccauuuguuaaagauuacuuauuuucuuuauauaacugccaguaugcugaauuuuucacaaaucucgcugaaguugagaguauauugagaaaagauuauuucuugaauccacauuaccgcuacuaugucagagaaaugaaaauaucagccuacacucaacucuuagaaucauacagaucucuuacuuugcaauacauggcugag

SEQ ID NO: 4738 - RNA, 664 nt, Psylliodes chrysocephala
gaagcccguuugauacuuugcgaugacugugacgucucguuucauauuuauugcauggacccuccuuuagauuacguuccgcacggaaauuggaaauguaaauggugugccauaugccuguccuguggaucuaccgauccagguuuuaacuguacguggaugaauaguaccacucaauguggaccuugcgcuucgcauauuaauugcccgaguugcaaugacccuuacagugaaggugaccucaucauucaguguguucaaugcgaacgauggcuacacgguucgugcgauuacauaaagagcgaagaagaugccgaaaaaugcgcugaagaagguuauaauuguauuuugugucggccaagagacguaccgccuccgcauuuaauaccgccaccaauuacgccuaagccuccgacgccaacgaaaaguccugaaguuggaaggaguacaaguuuuuauauggacggaguuuaucucagcgaauucggaaauaaucuaauaaaaucuuuggcuuuagaauaucauggaucuaggaaaaagcggaagaaaauuccuaccguucaggauaaagaagcugguaucauggcuacaauugagucgguuguugcagguggaaauauugguccuaccaauuuggacgacagugcgaaacucgaguuaguag

SEQ ID NO: 4739 - RNA, 710 nt, Psylliodes chrysocephala
uccgaaagaaacgaauuccuauugcugcacgcuuucuccgaaaaaggauucauauugcccgauaaggaguacaagaagaaaauuccgggucagaaggguuccaagaagaaaccuacuuacgccggagguuugguccuggaucccaagguagguuucuacgacaagcucauccuccucauggacuucaauuccuuauaucccaguauaauucaggaauacaauauaugcuuuaccacauuaccugucacagaggaagacgauaaucuguacuuaccggacagcagucugccgccuggcauuuuaccgacagaaaucagaaaacuaguagagagucgacgucaagucaaaggucugaugaagagaccggaucuaucuaaugaucugcgagugcaguacgauaucaggcagauggcucugaaguugacagcuaacuccauguacgguuguuuggguuucgcgaauuccagguucuacgccaaaaauuuggccgcuuuggucacgcagaaaggucgagaaaucuugaccaacaccagggauaugaucgagaaaaugagcuacaaugucguguacggagauaccgacaguauuaugauuaauacuaauauuuuggaguaugaacagguauucaaaaucggcgugaaaaucaaacaggaagucaacaaacuguacaaacaagucgaguuggacauagacggcguguucaaauauuu

SEQ ID NO: 4740 - RNA, 714 nt, Psylliodes chrysocephala
gaaaaauuacgcgauuggguagaucuuucgccagagccagagauuacgacgcgacaggucaacagaccagguucguucaaugccccgaaggggaauugcaaaaaaggaaggaagucgugcauacggugacgcuucacgagaucgacgucaucaauagucguacgcacggauuucucgcccuauuuucaggcgacaccggcgaaauuaaaccggaaguaagagaacaaauuaacggaaaaguggcggaauggcgggaagagggcaaagcggaaauaauaccggguguccuuuuuaucgaugagguucacauguuggauaucgaaugcuucucguuucuaaauagagcgcucgaaaaugaaaugucuccgaucgucauaauggcuaccaaucgaggcaucaccaaaaucagagguaccacuuauaaaucuccgcacgguauuccccuagauuuguuggacagaaccaucaucguaccgacucaacccuacgacgagaaggaauugagggaaauuuugagcauccgaugcgaagaagaagacugucaaaugucggacaacgcuuuggccguuuuaacgaggaucugcaaggagacuucguugcgauacgguaugcaauugauuaugacaucuagcuugauagcuagaaaacguaaagcucacgaagucgauguugaagacauaaagagagcuuacacacuguuuuacgacgaaggaa

SEQ ID NO: 4741 - RNA, 653 nt, Psylliodes chrysocephala
gcgacuauucagaggaucucuauauaaaaaauacccuggaauguuuagaagaucuauaacuaaugaagaaagaagaagauuaaucgaacuugguuugagccagcacguauuggccagcaguguaucucuacuuagagcuggugaaguugaagauaucauugauggaaaugaugauaaguguuccagauacaaagcgguaucugugcacacuucagaaccuccgaugccaagagagagcaaaucgaagaagaacaugcaauggguaccgucucuacccaacuccagucaucuggaugccguuccucaagccacgccuaucaacagaaacagaguggccgccaaaaagguuagaacguuuccucuauguuuggacgauacggauccacaauugaacaucgaaaacgcgugccaggcagagguauugguaccuauaaggcucgauauggaaaucgagggacagaaacucagagauacuuuuacuuggaacaaaaaugagaguuugauuacaccugaacaauucgcugaaguacuuugcgaugaucucgauuugaauccauugacguucgugccggcuaucgcccaagcgaucagacaacaacucgaggcuuuucccgccgauccgccgagcauuaucgaagagucuagcgaucaaa

SEQ ID NO: 4742 - RNA, 162 nt, Psylliodes chrysocephala
cggacgugauuuuaauguguuucucggucgacucgcccgacucccuagaaaacaucccggaaaaguggacgccggaggugaaacauuuuuguccgaacgugccaauuauccugguaggcaauaagaaggaucugcguaacgaucccacuaccauuaacgaac

SEQ ID NO: 4743 - RNA, 779 nt, Psylliodes chrysocephala
gcaugugucccacuauagagacaggaauuugguguugauaucuacaguaaaugaaaaagauguucugugguguaugaguucugauuuauuuccguuuagucagacauugauggaagcguacucggcuguaaauuuagaugguccagcuuuggcuauaucagaggugcgaaauaucaauccccuacaaauacacgauuuacaugaagccccuccauuggucgucagacaacaugcagaaccuccgaagaaauauguaguacuaacuucgcauaguguucaaauuuucauaaaauugagaccaguugauuugcuuaaacaaauuuuaaaagauagccacggucaagauacuggagcauugaaagcuuucuucaccauucaaaaggaagaucaagcuugugcuaccaguuugauacuggcuucuuuggaaaaugaggacaacauggaaguagcagaauaugcaacgagagcuuucuuuuuguuuggaggcgaaccuaagcuggcacacggaaauauuuauucuggucaaucuguauuugcaccgcccauaauuucuacuccagcuccacaucaauaucagcaacaacaguuucaaucucagcaauaucauaguuuuucacaaacuaugucuccuacaggcucugcauaugauuuauccaguccauuuauuuuuucgccuaaacacaauggucuuuacuuguacuuaagcagaauauugagaccgauuuggaauagaagaacaguugauaaacuuuguuuagauggcaaaacuauaacgacca

SEQ ID NO: 4744 - RNA, 656 nt, Psylliodes chrysocephala
gguugucaauuccacguuuuaaaucccguuauuaaaggacaagaaauuacaaucgaccgaguggcgacuguuuauucacccgagaacgaccuuauagauuuugcucuucaaaccaaucguuuguggucuuuauggagauccgaagauggcgauagugucguauauacggcuucgcuaccguugugcaagcaaucggguacuuuuaagucgaccaguuggacgccggugauuuuggaaacuaucccugacgccaaucaagcucccgcuaaugauggcgauuccgauucaagacagauuuauuugcaacauauuuuccauccuggaagguuucccuugcauauuaucaguaaagcguuaucgauuuacaaaagaucaacaauuuugucagaugcccaaauaucagcaucggcguuaaaacaaagaauauguuuagcgguugauaacgaaauacagaauaugcugaacggagaaaacgucaacgaugaugaauauaucgauugcgcugauuggugcuggcaaaaauuuuauucuuguugcguucaauaccacaucgcgagucuaaagccguugggauugaugcucuuaccguccguaucuggcgcgguauuuuugaaaaaaucugcuuuuucguuuuuaagaccucuugacggauuaga

SEQ ID NO: 4745 - RNA, 791 nt, Psylliodes chrysocephala
ugcuguuguugaauuugguccacaaaccggaagcagacaugacuauuagaguagccggagcuguggcuuuuaaaaauuauauaaaaagaaauugguuuguggaggaagaucaaacggaucguauacaugcaacugaucguuuagcaaucaagaaucugauuguuacguuaauguugaguucuccagaaucuauucagaagcaguuaagugaugcuauaagcauaaucggaaaaacugauuuuccauuaaaauggccugaacucauaacucaaaugguagaaaaauuuuccacaggugauuuuaauguuauaaacggaguuuuaagaacagcacauucucuguuuaaaaaauauagauacgaauucaagucaaacgaguuauggacggaaauaaaguacguuuugcaaaaaauagcucaaccuuuaacggaucuauuaguggccacuauaaauuuaucgcaaacccacacaaacgaugugaaugcuuugaaaguaaucuauagcucuuugguguugauuugcaaaguauucuauucguugaauuuccaagaucucccggaauuuuucgaggauaauauucagauuuggaugacgaauuuccacacucuucucacugucgaagugccaaguuuacaaaagaaugauagugaugaagcugguguaauagaacaacuaaaaucacaaguuugugauaauguggcucuauacgcucaaaaauaugacgaagaguuccaaccguauuugccgcaguucguuacagacguuuggagccuuuuaguugcaacuggcuug

SEQ ID NO: 4746 - RNA, 655 nt, Psylliodes chrysocephala
caucaaccagaagaagaccaauuaauuuuaccaaaugcucuucaacaacagcaacaacaaaaccaacucccuacuagcaguucgcaagucccuccauuagccccuaugggugguacaacaccuacucucggucuugguaugggccaugcuaugucuaugccucauaccaaauacguaacaggcuuuacuuugccuaugaguucuaugacaccucaaacaccacaacacaccaugaugaguccuaugguuaauuugggugguucuggaccaacagguucuggugugacacccaccaugggacccucgacaccuucgccaaugacucccaugaccccucauucagcagauccaggcauaauuccacaauuacaaaacaucgugucaacuguaaaccucagcugcaaauuggacuugaaaaaaauugcccuacacgcaagaaaugcggaauauaaucccaaacguuucgcugccgucaucaugaggauucgagagccgcguacaacagcucugauuuuuucuucggguaaaauggugugcacgggagcaaaaagugaagaagauuccaggcuggcugcuagaaaauacgcccggaucauccaaaaacugggauuccccgccaaauucuuggauuucaagauacagaacauggucggaa

SEQ ID NO: 4747 - RNA, 329 nt, Psylliodes chrysocephala
acugcaagaagaggauaugcagaccaaaugaauuuuaccuuugcugcuggaaaccaggucuuuuacaaugcaaugucuguuaaacaaguagauguuccauccuucucagguaguuuugguaucuuaccugcgcauguuccuacucuugcuguucucaaaccuggaguaguuaccguuuaugaagacaguggcaaaguuaauaaaauauuuguauccaguggaacagucacaaucaaugaugacucaucaguucagauuuuagcagaagaagcucauccuguagaaaauuuagauguuaaugcagccagagauauccgcacuaaagcuca

SEQ ID NO: 4748 - RNA, 733 nt, Psylliodes chrysocephala
uacgaaaaauugagcagggaaaaucacgaggcggaacuaaaagaaaaacgggaacaagaagcccguaaaaaagcggcggcugccaaaaaagcacaagccgaaaccguuaaaccugcucaaauuacagaacugacagaggaagaggcugcuaagcuucaagcugagcuugaugcuaagaauaacgucucuucugcuaguucuucgagcacgccuguaccaacuccuccggccccccaaaagauugaggaagacgaggacgaaucugaaaagggcaaauugcugccuaacaaaggaaauggaugcgaucuagagaaguauaccuggacucaaaauuuaggcgacauugaguuacggguaccuuuaaaugcgagcuucagaguaaaacagaaggaucugauugugaauaugacgaagaaacacuugacuugcggcauuaagggucaaccgccgaucauagacgaugauuuucuacacgaaaucaaguuggaggaguccaguugggugauagaggaugggaaaauguugcuauucacuuuugaaaaggugaacaagaugaacugguggagcaaaauagugaaguccgauccugagauuagcacgaaaaaaaucaacccggaaccgucgaaguugagcgauuuggacggagaaaccagaggcaugguggaaaaaaugauguacgaucaaagacagaaggagcugggucuccccacuagcgacgaacagaagaaacaag

SEQ ID NO: 4749 - RNA, 356 nt, Psylliodes chrysocephala
uaagaagcacagugaucgagagagauggauuugcauuuauccugcuuauauuaacaguaaaaaaaccauagcccaaggaaggaaaauuaacaaagaaaaguguguggaaaaucccacccaucaagaaauaagggacguauuagucgcagcugguuuaaagguugguguagaaaauaaauuguacagcagagaaaaaagcaaggagcuguuguaucgcgguagaauacggguucaguugaaaaacgaugauaacaguuugugcaaucccaauuucccuacuagagacagucuuauguuacauuuaggggacaugauucccaaacuuaaaaguagacugaauaagggaaguggagacc

SEQ ID NO: 4750 - RNA, 672 nt, Psylliodes chrysocephala
acuuacacgauccacgaaaagaaauauggagacaggaguggcauugaagaggucauaauguccaagaggaaauugcaauaugaacaggaaauuuuacagaauccuacaaacuaugaugccugguuugauuaucuaagauuaguagaaggcgaaggugacauugauguuacuagggagacauaugaaagagccauagcuaauauuccuccaucaaaaaacaaacaauuuuggaggagauacaucuauuuguggaucaacuaugcuuuauuugaagaacuugaagcuaaagauuaugaaagaacacgacagguuuacaaagcuugucuggaaguucuaccucacaaaauauucacuuucucaaagauuuggcugcuuuuugcucaauucgaaauacgccagaaaaauuuaaccuccgccagaaagauccugggcaugucuauaggaaugugucccagagacaagcuauuucgagguuacauagauauagaaauacaacuuagggaauuugacagaugcagaaagcucuaugaaaaauucuuagaauucgguccggaaaauugcgucacuuggaugaaauuugcggaauuagaaacguuguuaggcgaugcagacagagcuagagguauauacgagcuagcuauuaaccaaaccagauuggacaugccagaauug

SEQ ID NO: 4751 - RNA, 744 nt, Psylliodes chrysocephala
ucaucgcuacaaacauuugcgaaaccaucaucuggaaagccuucucgccggcuacggucaacaccggaagaggaacugaauucgaaggagccgucaucgcguuauuccacuuacucacuacuagacaagacaaaaucagaggauuacgugaagcuuucuacagacaaaaucuaccuaaucuuaugaaccucuuauccacuguucucguuuuugcuauagugauauacuuccaaggauuuagaguggauuuaccaaucaagagugcaagauaucguggacagcauuccaguuauccaauuaaacuuuuuuacaccucaaacauuccuauuauccugcagucggcuuuagugucgaauuuguacguuauaucucagauguuggcagugaaauuccaugggaacuuuuugauuaaucuguuaggaguuugggcugauguagguggcggcgguccagcuagauccuaccccauuggcggguuguguuacuauuuaucuccaccagaaaguguuagucacauucucgaagaucccguucacgcaugccuuuauaucguuuucauguugggaucaugugcuuucuucucgaagacguggauugaaguaucuggaaguuccgcuaaagacguagcuaagcaacuuaaggaacaacagauggugaugagaggucacagggauaacucgaugauucacgaguugaaucguuacauucccacugccgccgcguuugguggauuguguauuggag

SEQ ID NO: 4752 - RNA, 361 nt, Psylliodes chrysocephala
agccgaacaagacaaacuauuaagacuuucaacaacuuuauacguaggaaauuuaucuuuuuauacaacugaagaacagauuuaugaacuguuuaccaaauguggugauauuagacguauugugaugggccuggauaaauacaagaaaacuccauguggauucuguuuuguagaauacuauaauagagaggaugcagaaaauuguuuaagauauauaaaugguaccagacuugaugacagaauuguaaggacagauugggaugcagguuuucuagaggggagacaguauggaagaggcaaaacugggggacaggugagagaugaauacagaacugauuaugauucuggucgaggaggauau

SEQ ID NO: 4753 - RNA, 790 nt, Psylliodes chrysocephala
ugacgacaauuagccagaaaaguucauauuccacggccaaagacuggacauggggcaaaaaagcgcuuuuagggagcuuagguuugguggcaggugguacaggagccauacuauuugcucucgaccaaucuguuaaggcuucggaucuagaauuacauccaccaaagaauauuuggagucauacagggcuuuucagcgccuuugaucaugccagcauaagacgaggauaugaaguauauaaacaggugugcgcagcaugccacucgaugcguuucaucgccuaccguaauuugguaggcguaucgcacacagaguuggaagcgaaggcugaagccgaggagcaaaugguagaagacggaccagacgaccaaggcaacauguucaaacguccuggaaagcuaucggacuauuucccuaguccuuaucccaacgaggaagccgcccgugcagccaacaauggugcuuacccuccggauuugaguuacaucgucucugcuagacauggaggagaagauuauauuuucgcucuucuaacuggguacugcgacgccccugcuggugucguucuucgagaaggucaauacuacaacccguacuuccccggcggcgccauuuccauggcgcaagcgcuguacaaugaggucauugaguaucaagauggcaccccacccacugccagccaaauagccaaggacguguccacguucuugaaauggaccgccgagcccgagcacgacgacaggaagaaaaugcugaucaaagcuaucggcaucuucaccuuccuuaucgc

SEQ ID NO: 4754 - RNA, 731 nt, Psylliodes chrysocephala
gaauggauugccgcauuaaaauuugggagguuuauaaugaaaggcgauguauuagaacuuauuauggacauagacaggcuguuagagauauuaauuuuaauaauucugggaaacaguuucuuucugcuggauaugauagauauaucaaauuaugggacacagaaacuggccagguuguaucacguuuuacaaguagaaaaaucccuuauuguguuaaguuuaauccugacaaaaauaaacaacauuuauuugucgcugguacuucugauaagaaaauuauuugcugggauacaagaucuggugauauuguacaagaguaugauaggcauuuaggagcugugaauaguauuacuuuuguugaugaaaauagaagguuugugacgaccucugaugauaagucauugagagugugggaaugggauauuccuguugacaugaaguauauugcugauccaacuaugcacaguaugccuucaguuacaccugcaccaaauggaaaaugguuggccugucaaaguauggauaacaaaauagugauauuuucggccaugaauagguuuaaaauaaaccgaaaaaaaaccuucacagggcauaugguugcugguuaugcauguucuuuagauuuuucuccugauaugaguuacauaacaucgggagaugcagaugguaaaguguacauaugggacuggaaaucaacuaagcuguuuaaaaaauggaaggcucaugacaau

SEQ ID NO: 4755 - RNA, 651 nt, Psylliodes chrysocephala
ucccuuauucgaaaagagacccaggaauuuuggaauaggucaagacauccaacccccuagggacuuaucgagguucgugaaauggcccaaauacauccgcauccaaaggcagaaagccgucuugcagaaacguuugaaagugccgccgccgaucaaccaguucucccaaaccaucgacaaacaaacagccacccaauuauucaaaguguuggagaaauaccgaccggaaaccgccuugcagaaaaagaaccgacugaaggccaaagccgaagcuaaaguggccaaaaaggaagaggccccgaccaaaagacccaacaccuuaagagccgguacuaacacagucaccaaguugauugaacagaaaaaagcccaauugguggucaucgcccaugacguagacccuauugaauuggugcucuuccuucccgcccugugcagaaaaaugggaguccccuacugcauagucaagggcaaagccagguuagggcugcuggucaggcguaaaacuugugcgacugucgcccuuacccaagucgauuccggagacaggucgaacuucaacaaacuccuggaggucgucaagaccaacuucaacgaccgcgccgaugagaucaggaggcacuggggaggcgguauccucgguuccaaauc

SEQ ID NO: 4756 - RNA, 655 nt, Psylliodes chrysocephala
guuucugguauguacuggggccuaacagcuuuagaauuaaugaaugccucaccgccacauagcauagaagagauuuuagaguauauaaaaaagugucaagaugccgaaacugguggaauaagugcauguguuaaccacgacccucauauucuucacaccuuaagugcaguucaaauucuuuguaucuacgacagucuaaaagccauugauguggaaggaguugugaaauauauaaaaaaauuacaguugccugaugguaguuuuaugggugauaaauggggcgaaauagauaccagauucucguuuugugcuguugcaacauugucauuauuaaauagaauggaugcuaucgauguuaacaaggcuguugauuuuguagcuucauguaaaaauuuugauggugguuuugguucaagaccacuuucugaaagccaugcaggcuuaauuuauugcuguguuggauuucuaucuguuacaaauagguuagacauuguagaucgugauacccuugcuuggugguuaugugagagacaauuacccucuggugguuugaauggucguccagaaaaauuaccagauguuugcuauucaugguggguguuaucaucucuaacaaucuuaggaagauuacauuggauugauggcaaugcuuuga

SEQ ID NO: 4757 - RNA, 724 nt, Psylliodes chrysocephala
uauggagguugugugugaagcuacccaaucaccggauucacaaaucaaaguagcggcuuugcaauguuuaguuaaaauuaugucucuguacuaccaacacauggaaccuuacauggcaccggcacuauucccgauuacguuggaggccaugaaaucagaaaaugaugcuguagcuuugcaagguauagaauucuggucgaauguuagugaugaagaagucgauuuggccaucgaagauacggaagcuacugaggcuggcaggccacccacacgaguuuccagacauuacgcaaaaggcgcccuacaguacauuauucccauucuccuucaaaagcuuacuaaacaggaagaguuagacgacgaagacgauuggaauccuagcaaagcugccgguguuugucucaugcuucucgccacauguugcgaagaugaaauaguuccacacgugcugccauuuauuaaagaaaauauuaaauccgacaacuggcguuuccgggaugcuucucuaauggcuuucgguucgauuuuaggcggauuggaaaauaacacuuugagaccucuuguugaacaggcaaugccaacuuuaauagaacuaauguacgacagcagcguaauugugagagacacugcagcguggacguucggaagaauaugcgaaauuauucccgaagcggcgaucaacgaaacuuuccuuaaaccccuucuggagagucuaauaaccggu

SEQ ID NO: 4758 - RNA, 678 nt, Psylliodes chrysocephala
uuacaggagacacccaaaugagauaaguguuccaaugucaguagaauuugaugaauuugcaaaagcuagagaaaauccuaaugaagauauggcuaauuucguagaauucacugaugaagaagguuauggaaaauauuuagaucugcaugaaugcuaugaaaaauauauaaaucugaagggaauagagaaacucgacuacauuacuuacuugggcauguuugaucaacuguaugacauuccuaaagaaagaaaaacuggugaauacagaaaauaccuguuaugucucauugaauaucuaacuugguuuguucaacguauuagaccuuuaauggaucuugaugcugauuuagaagaacaaauugaucagguuuugucuaauugggauacugguacuguuccaggauggccaaaagaaacugguucugcuuuaacaaauguuggggcccauuuggaucuuucugcauuuucaaguugggaagaauuagcuucuuuaggcuuggauagauuaaaaucugcccuuauggcauugggacucaaauguggagggacuuuggaagaaagagcucaaagguuauuuucaaccaaaggaaaggguucacuggaucccucacuuaugacaaagaauaguaaaaauaggauuacuaaagaaaaagaaaucucaagacacagagaauuggg

SEQ ID NO: 4759 - RNA, 521 nt, Psylliodes chrysocephala
cucuaggacguuuauuggcacuuuuaaagcauuugauaaacauaugaauaugauucuuggagauugugaagaauuucguaaaauaaaaccaaaaaauucaaaaguugaaagagaagaaaagcgaguguuaggguuuguuuuauuaagaggagagagcauagugucuuuaacuguagaaggcccuccuccaccagaagaaggacuuccuaggguaccuauucccggagcagcaccagguccagguauuggaagagcuggagguaggggaaugccuccagguaugacaggugucccuguaggucuucaaggaccuguaagaggaguagguggcccaucucaacagguaaugacgccuggagguaggggacaagucucagcaccaccacaaaugaaccaagguccaccuagaaugggugggccaccaccuggcaugauggguccaccuccugguaugaugggaaugccgccucaaaugggaaugggacgugguggaccgccuccaauggguaugagaggaccuc

SEQ ID NO: 4760 - RNA, 653 nt, Psylliodes chrysocephala
guacauagcgacuggauguucucuaacugauuuacauuacaccuacagagugggaauuucaacagcaagugaaauaauacagcacacaugcaagcuaauuuggaccaaaaugaaagagcaauguaugccaaagcccacaagagaaaacugguuggaaauagcacaugguuuuuuucgaaacgccaauuuuccccauugcguggguacuauugacgguaaacauauucgagugauaaaaccacaacaaaguggaucuuuguauuuuaauuauaaacauuuuuuuucaauucaacucuuggcaaugugcgauucaaacuauuguuuuacguuuguggauauuggggauuacggcaaaaacagugauucaaguauuuuuaaaaauucggaucuuuacaaaaaguuaucgacaaaaaaacuaaaccuuccugaucccgacuuuuuaccagaaaaggaugacuguaaaauccccuauguuauuauuggagacgaagcguuuggcuuaucguuuaauguaaugcguccauaugguggaaaauuuuugccaauacagaaaagaauuuauaauuacagacuaucuagagcacgaagguauauugaauguacuuucgggauuuuugcuaacaaguggagaauauuccaucguccucuuaacg

SEQ ID NO: 4761 - RNA, 664 nt, Psylliodes chrysocephala; identical to SEQ ID NO: 4738

SEQ ID NO: 4762 - RNA, 656 nt, Meligethes aeneus
cagaucaaggaacagacacaaaaagucuaaaaacagacgcgauucucauagcagcagcagcucggauucauccaacagcaguagcagcaguaguucagauaacaguuuaaaauuauuggagaaauuaaaggaagaacgucuaaagcaaguagaugccaaaaagaagcaaaaagaguugcuuaaagccacagaaacagcaggggaaaaaagauugagacgguuguuaaaaaagcaagcgaaagaaagaagcagaaaggagaaaaugggcugggacaaugaauauuugcacuacaccaacagugauaaccccuuuggagauggcaaucuacucucuacuuuuguguggaacaaaaaauuguccaaagaaggccucacaggggucagucaugaagaauuggagacuagaaauagguucaaacaggaagaaaacaaaagggagcuggaaaagguuaagaagaggagguuggagagggaauuggaaaggcagaaaagggaggaggaaaugggaauguugcagaggagcaaagaggcagcacaauuugaagagugggagaggcaagaggauaacuuucacuuggaacaagccagacuaagaucacauauaagaauacaagauggcagagccaaacccauagaccuccucgccaaauacauaa

SEQ ID NO: 4763 - RNA, 737 nt, Meligethes aeneus
ccuccagaacagauguuugaguugaugaagcaaaugaaacaaaccauacaaaacaauccaacugaagccagacaaaugcuucugcaaaacccucaauuagcuuacgcucuacuccaagcucaagugguaaugaaaauaaucgacccccacucagcagugacucuacugcacccuucaaaccaaguaccgcaaacuuugaugccuggagauaagauaccgcacauucccauaaaccaaaguuacgcgacgccuuuaccgaccccuguacaggcucccaggcaggauuuucaaccuguaccaccuccgauuaugcaucaaaacaaucaaccugucuuuacaggucaagauguggacuugagaucgcuggauccaaggggcgguucagauccaagacuaacaagagggaugggggaucaagacaugaggacuuugccugcuccauuggccaauccauugccuccggugggcgaaggauuuaacagggaucccaggggguccacagccaguuuuccgaacgaccccaggcagcaaucucaaagggucgaccccaggcaaaaaaauauaccacccccacaaaugccaccccaaccaaucagaccgccuccacaggcagugccagcuccgccuccagucccaucaagggcacaaauuucccaugcugccaacaguccaaauauugggccugcuggggcgucagaccaagaaaaggcugcccucaucaugcaaguccuccaauu

SEQ ID NO: 4764 - RNA, 660 nt, Meligethes aeneus
uaaauuaaaggcagggacccguguagcuuuggauaugaccacuuuaaccauuaugagauacuugccaagagaaguugauccgcuagucuacaacaugagucacgaagauccaggagauguaacuuauucugcuauuggugguuuaucagaacaaaucagggaauugagagaagucauugaacuuccuuuguugaacccugaauuguuuaugagaguugggauuacuccuccaaaagguuguuuauuauauggaccaccagguacugguaaaacucuuuuggccagggcuguagccucucaauuagaugcaaacuuccuuaaaguuguaucuagugcaauuguugacaaauacauuggagaaucugccaggcuuaucagagaaauguuuaacuaugccaaagaccaucaaccuugcauuauuuucauggaugaaauugaugcuauugguggaagaagauucucugagggaacaucugccgaucgugagauccaacguacccucauggagcuguugaaccagauggaugguuuugauucucuuggucagguuaaaaugaucauggcuacaaauagaccugacacuuuggacccugcucuuuugcguccaggccguuuggacagaaaaauugaaauuccacuucccaaugaacaggcuagauu

SEQ ID NO: 4765 - RNA, 455 nt, Meligethes aeneus
aaugagcuccguuugauaggccaaagguauuuguuucaauauggagaaucgauucccugugagcaauugguaucgugguugugugauguaaaacaagcuuacacucaguaugguggaaaacgcccauuuggagucucaaucuuguacaugggaugggacaaacauuauggauaucaguuguaucagucagaccccaguggaaauuacaguggauggaaagcaacuugcauuggaaauaacagugcugcugccauauccagcuuaaaacaagaauacaaggaaggagaaaugaccuuaaaagaugcuaaaucauuggcuguuaaaguuuuaagcaaaacacuggauaugaccaaacuuacuucagaaaaaguugagaugucaacucuaacaagaaaagauggcaaaacuuuuauuaauauccuagcaggcacagaaguugaggcucuuauaagcga

SEQ ID NO: 4766 - RNA, 727 nt, Meligethes aeneus
gaaauugcuagugaaugggcugaaacugauuuaacuuucgauaaagguuuaagggagaauuuaauuuuacuagcaaagcaaauugugccuuacaauauggcgcauaaugcugaggcugaagcaugugauuugcugauggaaauugaacguuuagaucuucucgacgaauauguugaugauaauaucuauccuagaguuugcuuguauuuaacuaguugugugcccuauguggcugauccagaaaauacaacuuuauuacaaacugcauuguuauuguuccguaaauuuaaacaauauccacaagcuuuaagauuggcuaugcaguuaaaugaucauucuuugauugaagacaucuuuauuaccuguccugauacugcuguccaaaagcaguuggccuacaugcugggcagacagcaaaucuacaucgaaauccccgauaccacucccgaauacgaggaccuuaucgaaauaauggcgaauugucacuugaacaaucauuuccugaaucuggccagagagcuggacauaauggagccgaaaacucccgaggacguguacaagucgcaccuggagaacagccgaccgcaauucggcggcagucaaguggacucggcccggcaaaacuuggcggccaguuucgugaaugguuucgugaacgcugccuucggucaggauaaauuguugauggaggacgguaacaagugguuguacaagaacaaagagcacg

SEQ ID NO: 4767 - RNA, 750 nt, Meligethes aeneus
uugguuggcaauucugaaaccaucaaugaauuaccaacaaauguuuacgugaauuuggaaagugucaacggaaauauggauuacagugcgaauuacaucauuccaaauaacuacgaugaauacaguauagagaauucuucauccccucaagcuucguacuuguugaauagagauccaaacauggcugcagcuucaaucagauauugcacugaaccugaagguccauaugcagguggugcuguagugcaaaacccagguggccacaucgcgcaauacagcggucagcaaaacuaccacaucagcuacgcucagaacuggacuccucagucgcagucagcuucaguuuacaacgguccgggucagaugcuggcgcaagccgacagcacgcaguucaacgguuacgccaauggcggcggaagcaguggcggccuaaacgagggggcagggacaucgucaaacccacaggaauuaauaucaccaaauagcaacagaagaaguggaguaaauugugcgaauuguaagaccacaaauacaacguuguggagaagaaauaaucaaggggaaccaguauguaacgcauguggacuuuacuucaaacuucacgggguuguaaggccacuaaguaugaagaaggagggcauccaaacaagaaaaaggagaccaaagaauaccuccagcucugggccgagcucuucuauaguucaccauucuucuaggcugggcacacccgcacaacacuacacaucucca

SEQ ID NO: 4768 - RNA, 795 nt, Meligethes aeneus
cguuugucgaagcuagucuacacggaugcaaacacaacaaaaaaagucgcgagggaagaccgcgacggaaaaacccgaacaggaaacgccaggaccuguacaaaucccggaaaagcccgaccagcaguccggaggaggaggaagaagaggcgagcgacgacgacgcccuacccaccggcuaccaucaaauauccauccagcugcuggaccugaugcacacguugcacacgaggaccgcgcagauuuucaaguggugggccgaggagggcggcgagaucgcccaggagacgucgcuguggacgcagggcuggugccccuuacugcagggcaucgcgcgguugugcugcgacguccggaaaccggucaggaugagcgccaucacguaucugcagagggcgcuguuggugcacgauuugcagacgcugagcgggccggagugggaggcgugcuuccacagggugcuguuuccacuacugagauaucuauugcaaccacucacuccuaaagagcccauggcuauggaggagaccaggaugagagccgcgacuguuuuaucuaaaguuuuucugcaccaccuaacaccacugcuaucccuuccaacauucuucaaucuuuggcugguaaucuuggacuuuauggagaaauacaugcacgcagacaagagcgaucugcucuacgaagccauaccggaauccuugaagaacaugcugcucguaauggacuccgcgaaaguuuucgacgcgccggacggccacaagagucaccuuugggcggccacuugggagaagaucaaca

SEQ ID NO: 4769 - RNA, 271 nt, Meligethes aeneus
augcucuaugagaagcguuucgggcccuucuucgucgagccugugauagcaggguugcauccgacgacuaaugaaccguuuauuugcaacauggauuuaauuggguguauuaaucaaccugaugauuuuguugucggugguacagccucggcacaacuuuacgguaugugugaagcucugugggagccuaauuuaggcccugaagauuuauuugaaacgacugcacaggcuuuaauuaaugcuuuugauagagaugcuauuucugguuggg

SEQ ID NO: 4770 - RNA, 768 nt, Meligethes aeneus
aucaccaaguucucuuccaccaacauguggccgcuuuuagaaauuuugacuguguuaccugaagaauuagaaaauagaucugugaggcuaggcgagaacaggcgacuagacguccugaacgacuucaaaaguugcucgacaacaauuuuagaguuuuuaaagcauugcgcuaacaccuacacggauaacucgcaagaaaacgugcaggugaacauuaaaauccuacgguguuucacuucguggguuuccgucggcgccuucgagcucuccgaguugggaaacaacaucgugaucaacagagcguucgguauuuuaaccuacaaaccugagggggagaaacagacuguugggggcgcgcugcacagcgccgcuacugauugcauuugcacucuauugcaauguuuggaggauaauaauaaccagcagauacuggagacguacuuguuuaauaacguuauuaauuuagagguggcauaccacaugucuguagccaacgaagaucaggauaaguccauuaauuacuguaggguuuucaccgaguuggccgagucguuucuggaaaaaaucauaaugaauagcaacaauaaaucgcaacauuacgcgaugaaaguucuagauuuagugcuaauuugcguggggcaccacgauuacgagguagcagaaauaacuuucaacuugugguacguuuugagcgaggauuuauaccagaaaaacaacaaggaaauuaccgaaauguuucgaccuuacgucgaacgauuaauaacggcu

SEQ ID NO: 4771 - RNA, 648 nt, Meligethes aeneus
ucuuguugcucgacuaucagccguugcaguucaagcuggaccccagauuggcccggcuucugggcgugcacacccaaaccagacccgugaucauuuccgccuuguggcaguacaucaaaacgcaccgauugcaggacgcgcacgaaagagaguacaucgugugcgacaaguacuuggagcagauuuucaacugcucgcgcaugaaguucgccgagauuccgucccgcuugaacccgcugcugcacccgccggauccgaucgucaucaaccacgugauuucggucgaaggcggcgccgagagcaagcagaccgccugcuacgacaucgacgucgaggucgacgacacgcucaaaacgcagaugaacaacuucuugcugagcaccgcgagucagcaggagauucaaggguuggauucgaagauucacgagacugucgacaccauaaaucagcucaaaaccaacagggaguucuuccuuaguuuugccaaggauccucagcaauucauacacaaguggaucgucucgcagaccagggaucuuaagaccaugacagacguuguugguaacccugaagaggagcgcagagcagacuucuucuaucaaccuugggcccaagaagcaguuugucguuacuucuacaccaaggugc

SEQ ID NO: 4772 - RNA, 330 nt, Meligethes aeneus
agaggguugggaguuaauagaaccaacuuuggacgagcuggaacagaaaaugcgcgaagcugagacugaaacucaugagggaaaacguaaaaaugagucgcuguggccgauauucaaaauacaccaucaaaaaucgcguuauauauucgauuuguucuacagaagaaaggcuauaaguagggaguuguacgauuauuguuugaaugaaaauauagcggauaaaaauuugauugcaaaguggaagaagcagggauaugaaaauuuguguugcuugagguguauacaaaccagggauaccaauuucgggacgaauugcaucuguaggguucc

SEQ ID NO: 4773 - RNA, 718 nt, Meligethes aeneus
uaacgaauugcagcgagauaugccggcagcuacacuagacauuuuagguagcauacaacaucccaauaaugaggaguguggcaucagggauguuugggcacauaacuuggaggaugaauuucgaaccauuagacagauuguacaaaaauaccaauauguagccauggauacugaauuuccugggguuguagcaagaccuauaggugaauuuagaaguucugccgauuaccaauaucagauguuaagauguaacguugauuugcucagaaucauacaacuggggcucacauuucuugacgauaauggcaaaacgccuggaggcucuuacaccacguggcaguuuaacuuuaaauuuaaccugcaggaagacauguaugcccaagacaguauugaucugcuaacaaacuccgguauccaguucaaaaagcacgaggaugaaggcaucgagccgcuggaauucgccgaacuacucaugacaucggguauaguucugauggacaacauuaaaugguugucguuucauucggguuacgauuuugguuaccugaucaaguuguuaacugauaacacuuugccccaagaugaaaacgaauuuuuugaucucuugaaacuguacuuucccaccauauaugaugugaaguaccugaugaagucuuguaagaauuuaaaaggagguuugcaagaaguugcagagcaacuggaccuugaaagaauaggc

SEQ ID NO: 4774 - RNA, 693 nt, Meligethes aeneus
uuuccauuuccauccuccagcaaaucgacaccuaugugagggaaugccaggcucuuaucuuggcccccacaagagaauuggcccaacaaauccaaaagguugucauugcuuugggagacuucauguccgcgcaaugccacgccugcaucggcggcacgaaugucagggaagacaugaggaaauuagagacuggagugcacgugguggugggaacccccggcaggguguucgacaugauaacgcgaagggcgcugcgcacgagccacaucaagauguucguucucgacgaggccgacgagauguuaucgagagguuucaaagaccagauucacgacguuuuuagaacgcuaaacucggacgugcaggugauccugcuguccgccacuaugccgcaggacgugcucgacgucaccaagucguucaugaggaacccgauccguaucuuagucaagaaggaggagcucaccuuggaggguaucaagcaguucuucguguucgucgagcgugaagauuggaaguuggagacuuugugcgauuuauacgacacgcugucgaucacgcaggccgucaucuucugcaacacgcgccgcaagguggacuggcucaccgagaacaugcacaagaaggacuucaccgugucggcgaugcacggagacauggagcagagggagagggacguuauuaugaggcagu

SEQ ID NO: 4775 - RNA, 525 nt, Meligethes aeneus
aauauuaaugccgccaaagcuguuugugaugccaucagaacaaguuugggccccagaggaauggauaaaaugauccaaucagcaaacggcgaaguuacaaucacaaaugauggggcaacaaucuuaaaacaaauaaaugucauucacccugcugcaaaaauguugguagaauuguccagagcccaagauguugaggcuggugacgguaccaccacaguaguuguuaucgcaggagcucuuuuaaaugcagcagaaaaacugcuuagcagggguauucacccuacuguuauuucagauaacuuccagaaagcugcuguucaugcagugaauauccuaaacgaaaucucuaucccggugguacuaaaaaaccgcgaccaacugcugcaaagcgccuccaccucgcuaaacuccaaaguggugucgcaacaauccuccucucuggcgcccauagccgucgacgcggugcuaaaaaucgucgagacgggucgcgagcaggcuugcaaccuguccgacauaaaggugauc

SEQ ID NO: 4776 - RNA, 740 nt, Meligethes aeneus
aaaaccaucagcaaguguugccuugcauaaacauaguaaugcuuuggucgauguuuugccuccugaagcagauuccuccaucagcauguugucggcugaugaaaaaccagauguucaauacagcgacauuggagguauggacaugcaaaaacaagaaaucagagaggcuguugaauugccucugacacacuuugaguuguacaagcagauugguaucgacccacccagagguguguugauguaugggccccccgguugcgguaaaaccauguuggccaaggcaguggcccaccauaccacggcugcuuucauaagaguaguagguucggaauucguacagaaauauuugggcgagggccccagaauggugcgcgacguguucaggcucgccaaagaaaacucgcccgccauuauuuucaucgacgagaucgaugccaucgccaccaaacguuucgacgcucaaacuggagcggauagggaagugcagagaauucugcucgaguuguugaaccaaauggaugguuucgaucagacuaccaacgucaagguuaucauggcuaccaacagggcugacacguuggacccugcucuauugcgucccggccguuuggacagaaagaucgaguuuccauugccugaucguagacagaagagauugguguucacuacuauuacaucuaggaugaacuugucugaagagguugauuuggaagauuauguagcuagaccugacagaaucu

SEQ ID NO: 4777 - RNA, 461 nt, Meligethes aeneus
cguuauuuaucguguguuuuucguauauuuuaacuggaauaagaugucuaaaauaaagcuacagaguuccgauggagaaaccuuugagguugagaucgaaauugcaaaauguucuguaacaauaaaaacuauguuggaagaucuuggaauggaugaagaugaggaggaaguuguuccauuaccaaaugucaacucugcuauauuaagaaaggucauucaaugggccacauaucacaaagaugacccuccaccaccagaagaugacgaaaacaaagaaaaaagaacugaugauauaucuuccugggaugcagacuuuuuaaaagucgaccagggaacuuuauuugaacuaauuuuggcugccaacuaccuagacaucaaagguuuguuggauguaacuugcaaaacuguggccaacaugauaaaaggaaaagccccagaagaaauccgcaaaacuuucaaca

SEQ ID NO: 4778 - RNA, 651 nt, Meligethes aeneus
uggauugagcaguuaaacgauugcaagcaacuuacagaaaaccaagucaaaacuuuaugcgauaaggccaaggaaauccuuuccaaagaaagcaacguacaggaaguaaaaugccccgugaccguuugcggggacgugcacggccaguuccacgaccugauggagcuguucagaauaggcggacgcagccccgacacaaacuaccuuuucaugggugauuacguugaccgugguuacuauuccguggaaacggucacauuacuggucgcccugaaggugcgguacaaagagagaaucacgauucucagaggcaaccacgaauccagacagaucacacagguuuacgguuuuuacgaugaaugucugaggaaguacgguaacgcgaaugucuggaaguuuuucacggacuuguucgauuauuugccauuaacugcccucgucgauagucagauuuucuguuuacauggaggcuugagccccaguaucgauacuuuagaucacauuagagcuuuggaucgucuacaagaaguuccucacgaggguccuaugugcgaccugcugugguccgauccggacgaccgcggcggcuggggcauaucgccucgcggcgccggcuacaccuucggccaggacaucuccgagacguucaac

SEQ ID NO: 4779 - RNA, 515 nt, Meligethes aeneus
aaacuuugaccggaaaaaccaucaccuuggaaguugaaccuucugauaccauugaaaaugugaaagccaaaauccaagacaaagaagguauccccccagaucagcaacguuuaaucuucgcaggaaagcaauuggaagauggaagaacccucucagacuauaacauccaaaaggaauccacccuccauuuaguacuccguuugagaggugguaugcaaaucuuugucaaaaccuugacaggaaagaccaucaccuuggaaguagaacccucugacaccaucgaaaacguuaaagcuaaaauccaagauaaggaagguaucccaccagaccagcaacguuuaaucuuugccgguaaacaauuggaagauggucguaccuugucugacuacaacauccagaaagaauccacccuccauuugguacuccguuugagaggugguaugcaaauuuucgucaaaacuuugacuggaaaaacuaucaccuuggaaguugaacccuccgauaccauugagaau

SEQ ID NO: 4780 - RNA, 735 nt, Meligethes aeneus
gauaacguucgggaauaccagaaaauugucgacgccgaauggaauauucuguaugaaaaguuaagaaaaguccacgaaucgggcgccaaugugguucuuuccaaacucccuauuggcgacguugcaacgcaguacuucgcagauagggacauguucugcgcgggccgcguccccgacgaagacaugaagcgcacccugaaggcgugcggcggcgccgugaugacgaccgcgcacgaccucaaggacgccgugcucggcaggugcgaccuguucgaggagcgccagaucggcggcgagcgcuucaacuucuucaacggcugcccgaacgccaagacgugcacguugauccugcgcggcggcgccgagcaguuccucgaggagaccgagcgcucgcugcacgacgccaucaugaucguccgaaggacgaucaagaacgacgcgaucgucgcgggcggcggcgccaucgagauggagcugucgaagaugcugcgcgaccacucgcgcaccaucgccggcaaggagcagcugcucauaggggcgaucgccaagucgauggagaucaucccgaggcagcugugcgacaacgccggcuucgacgccaccaacauccugaacaagcugaggcagaagcacgcgcagggccacugcugguacggcgucgacaucagcaaggaggacgucagcgacaaucuggacgcuugcgugugggaaccggccauuaucaagaucaacgcg

SEQ ID NO: 4781 - RNA, 717 nt, Meligethes aeneus
gcauuacccgauauggaaguaguaggucuuaacuuuucaucagccacaacuccagaguugcuguuaaaaacuuucgaucauuauugcgaauacagaaaaacacccaacgguguuguguuagccccaguacagcucgguaaaugguugguauuauucugcgacgaaaucaacuuaccagauauggacaacuacggaacccaacgcguaauaauguuccuacgucaaauagucgaacaaaaagguuucuaccgcgcuuccgaucaaaccuggguaucucucgaacguauucaauuugugggcgcuuguaauccgccuacagauccaggcagaaagccuuuaucgcacagauuucuucgucauguaccaguaguauacguggauuacccuggugaaacuucuuugaagcagaucuacgguacuuuuacgagagcgauguuaagguuaacaccagguuuaagagguuauucggaaccguugacaaacgccaugguggaguuuuauuuggcgucacaagacagauuuacucaagauaugcagccucacuacguguacucaccucgugagaugacucgauggguuagaggaauuugcgaggcuaucagaccucuggauaauuugccaguugaagguuuggugagguugugggcucaugaagccuuaaggcuuuuccaggacaggcuuguugaagauacugaacgucgauggaccaaugaaaac

SEQ ID NO: 4782 - RNA, 660 nt, Meligethes aeneus
gccauacguuuugaagacuguaccucggaaagaaccgucaucaaguacaugacggaugguacguugcauagagaguuuuugucugagccggacuugcagucuuauagcgucaugauuaucgaugaagcucaugagagaacuuuacauaccgacauucuuuuugguuugguuaaagauaucgcccgauucagaccugauuugaagcugcugauauccagugcaacucuggaugcgcagaaguuuuccgaguuuuucgauggagcgccgauauuuagaauacccgguagacgauuuccagucgauaucuauuacacuaaagcucccgaagcugauuacauagacgcuuguguuguuuccguacuucaaauacaugccacacaaccccugggggauauuuugguauuucuuacaggucaagaagaaaucgaaacuugccaagagcugcucaccgaccgugugagacguuugggcucuaaaguuaaagaacucuugauucuaccgguauacgcuaaccuucccagcgauaugcaggcgaaaauuuucgaacccacaccaccaggugcaagaaaagucguuuuggccaccaacauugcggaaacuucgcugaccauagacaacaucaucuacguuaucgauccaggguuugcaaaacaaaaccac

SEQ ID NO: 4783 - RNA, 683 nt, Meligethes aeneus
cuccgaaaucaaaaagaccgaaguuuuaauggagaacuuucggagagccaucggguuaagaaucagggaaacaaaggaagucuaugaaggugaagugagcgaguugaccccugucgaaacagagaauccugcuggagguuaugguaaaacagugagucauguuauaaucgguuuaagaacugcaaagggcaguaaacaguugaaguuggaucccagcaucuacgaggcucuucagaaggagaaaguugagguuggagauguaauuuauauugaagcaaacaguggggcuguuaaacgacaagguagaucugaugcauaugcaacugaauuugauuuggaggcagaagaauauguuccauuacccaaaggagauguacauaaaaagaaagaaguugugcaggacguaacuuugcacgauuuagacgcagcaaacgcaaaaccgcaaggggggcaggacguguuaucgaugauggggcaauuauugaaacccaaaaaaacggaaaucaccgauaaacugcguaaggaaaucaacaaaaucgucgacaaauacaucgaccaggggaucgcggagcugguuccgggcguuuuguucaucgacgagguccacaugcucgacauugaaaccuucacguaccugcacagggcucuggaaagcacaauagcccccauagugauuuucgcua

SEQ ID NO: 4784 - RNA, 684 nt, Meligethes aeneus
ggaauuuugaaggggcuagaaauaauccauuucaauuuaaacauuugcaauuaugccacaguuugcaugaguuggcuaaagugucaaguccaaaagugguuuuggccaguucagcugacauggaaagugguuauuccagggaauuauuuuuacagugguguuccaaucccaauaauaguuuaauaauuacuucaaggacuucuccuggaacuuuggcaagggaacuaguugauaauggaggaaauagggaaauugaaaugaauguggaaaaaagaguuaaguuggaaggggcugaguuggaagaauaugaaaaaaagaugaaggaguuaaggaauguuaaaaaagaaagugacaacgaaucagacucugacgacgacaucgagaugagcguuaucuccaagggccgucacgacaucgugaucaaacaggagggcaaagugucgggcgguuuuuucaaggucaccaaaaaacaguaccccauguacccguucagcgaagagaaaaucaagugcgacgaauauggagaaauaaucaagccugaagacuacaagcuggcggauguggugccugaggaggacaacaaggagaacauugugaucaagaaggaggaggaggauauaacugaaaucccggaaauccccacaaaaugcaucauucuaaaccguacaguccaaguaaacugcc

SEQ ID NO: 4785 - RNA, 687 nt, Meligethes aeneus
auacagagcagaauggcaaagguaccaggagcaacaaaaagcuaaagaggaggaaauauuggaaagagaaagaguugcuuaugcacaaauugauuggcaugacuuuguuguggucgaaacuguagauuaucaaccguuugaaaucgguaauuucccgccgccaacuacuccagaagaagugggagcacguuugcuuauucaagagagaauugaagaaggagaggacauugaaaugcaacuugagagcgaugaugaggaaucugcaccacccacugaugaagguuuaagucauaugcaagacaggacgcacggucgcaaagguagagaugauaaucgcguacaagacauggaagaggauaguuccgaugaggacucucgcggaccaucaaagccuucucagccuucaauucaaccaccaaugccgccaauaccugauaagguugucgucaagaaauaugaucccaaacaagcuguuaaagucaccagaccaaccgugggugaugacuuuuugguaucgccuaucaccggcgagaaaauccccgccagcaaagugcaggagcacaugcgcaucggccugcuggauccaaggugggucgagcaaagagacaagcaggugauggacaagaugaaccaggaaaccgucuacgccgccgguucugcaauugacgcuagucugaaauuguuggc

SEQ ID NO: 4786 - RNA, 769 nt, Meligethes aeneus
acaacaacuaaaguggugguucacccuuuaguuuuauugagugucguggaccauuuuaaucguaugggcaaaauuggcaaccaaaaacgugugguugguguucuuuuagguugcuggcgggcuaaagguguccuagauguuuccaacaguuuugcaguuccuuuugaugaagaugacaaagauaagucagugugguuucuggaccacgauuaccuagaaaacauguauggaauguucaaaaaggugaacgcacgugaacggguagucgguugguaucacacagggccaaaauugaaccagaaugacauucaaauaaacgaacugaucagaagguauuguccaaauucgguauuaguaauuauugaugcgaaaccuaaggaucucggucuucccacugaagccuaccaggcuguagaagagguacacgaugaugguucaccaacaucgaagacuuuugagcauguuccuagugaaauuggggcagaagaggcugaagaaguugguguugagcauuugcuaagagauauuaaggauaccacaguggguacauugucucaaagaauaacgaaucaauuguugggggugaaggggcugcauugucagcugagagaaauuagagacuaucucauacaaguuagugaagaaaaguugccuauuaaucaucagauuaucuaucagcugcaagauaucuucaaucuuuugccugauauuaaucaggagaacuuuaauaaagcauuuuauguuaaaaacaacgaucagauguugguug

SEQ ID NO: 4787 - RNA, 398 nt, Meligethes aeneus
guggaagaaaaguucagcuggagaauauaaaugccggaaagcaaaucgccgacgugauaaggacauguuuggggccacaagccaugcugaaaauguugauggacccgaugggggguaucgugaugacgaacgacgguaacgccaucuugcgugagauuacuguacaacacccggccgcgaaaaguaugaucgaaaucgcacgcacacaagacgaagaagugggcgacgguaccacuucagucaucguacuggccggggaaauguuaguggccgccgaacaauuuuuagagcaacagaugcaccccacagucaucaucagggaguacaagaaagcuuuagaagacauuguuacguuguuagaggggcccuuaagugugccuguggacaggaacgauaag

SEQ ID NO: 4788 - RNA, 570 nt, Meligethes aeneus
ucauuucagcccauacgccgacaacggagggagcguuguugcgauagccggagaugacuuuguaguuaucggagccgauacucguuugagugcuggcuucucaauuuacaccagagaucaaaacaaguuguuuccucugucgaaaaccacuguuuuggguugcgcugguuguuggugugacaccuuaacccuaacucgcauucugaccucucgcaugcagauguaccagcaggagcacaacaaaacaauguccacgguggcuugcgcucaaauguuguccaccauguuguacuacaagagguuuuuccccuacuacauuuccaacgucuugguuggguuggauaacgagggaaaaggcugcguuuacagcuacgaucccauuggacauugcgagaaggccaccuacaaagccggagguucugcaggggcucuguugcagccccuuuuggauaaccagauugguuugaagaauauggagauaaucggggauucaaagcugacgauugagaaagcuaccaauaucauuaaggauguuuuuauuucugcagccgagagggacauuuacacugg

SEQ ID NO: 4789 - RNA, 688 nt, Meligethes aeneus
agcuuuagaacagcugacaagguugaauauuaauuacccaauguuguuuaagcuggucaauaagaaaacaaaucguacaacucacugugguguccuugaguuuguggccgaugaaggaaagguuuauuuaccacuauggaugaugcauaauaugguguuggacgaaggagauuuuguacaaauggaaaguguuucuuuaccugugggaacguuuuccaaauuucaacccuuaucuccagaauuuuuggacauuaccaacccaaaagcgguuuuggaaaacuguuuaagaucauuugcgugccuaacgucgggagauaucauagcugugaaauauaauucaaaaguuuaugaauuauguguacuggaaacaaagccuggugaugccauaagcauuauugagugugauaugaauguugaauuugaagccccgguggguuacaaagagcccgaacauguuaaaaaagaggacgaagacaugcaaaucgauccuucggaauuaaugcccgaacccgcagguuucauagcauuuaaaggggcgggcaauagacuugacgguaaaaaaagaaaagauuccacgucaagcgacucgacgauguugccgaccaaaaccgccuauguuaggggaauccccgauuaugauuacgaaauugguacguugaaauuuauaagaaggaauuuuaaaccggcc

SEQ ID NO: 4790 - RNA, 534 nt, Meligethes aeneus
uugaagaacgucaaaauggccaucuugaccugcccguucgagcccccgaaacccaagaccaagcacaaguuggacgucaccagcguggaggaguucaaggaguugcggcaguacgagcaggacaaauucaaggaaaugguugauuuggucaagaaggcuggcgcaaauuuggccauuugucaaugggguuuugacgaugaagccaaucauuuacuguacucgcaagguuuaccagcugucagaugggucggcgguccggagaucgaacugaucgccauagcgacgggcggcaggaucgucccgcgcuucgaggagcucacccccgacaagcuggguucggcggggcucgugcgcgagcuggccuucggcaccaccaaagacaagaugcuggugaucgaggacugcuccaacucucgcgccgucaccauccuggugcgcggcggcaaccagaugcugguggccgaggccaagaggucucugcacgacgccuugugcgucgucaggagccugguucuggaaccgaggguuguuuac

SEQ ID NO: 4791 - RNA, 207 nt, Meligethes aeneus
aagucaaaaaguggaaugccguugcuuuaugggcuugggacauuguuguggauaauugcgcuauuugccgcaaucauauaauggauuuguguauagaaugucaggcaaaucaggccucugccacuucagaggaaugcacuguagcuuggggcguuuguaaucacgccuuucauuuucacuguauuucaagaugguuaaagacucggc

SEQ ID NO: 4792 - RNA, 535 nt, Meligethes aeneus
ggcuaaaaucgccgaauuagaaucggcugaaaaggagaaaaugaaggagaaggucgauaagauacugaaacacaaaccgacgguguuuauuaaccggcaguugaucuacaacuacccggagcaguuguuugccgaugcggggguuauggccaucgaacaugccgauuuugacgguauugagcgauuagcuuuggugacaggaggcgagauagcuucgauguuugauaaccccggggauaucaaauuggggacuugcgauuugauugagcaaauuaugaucggggaggauauuuugcugcguuuuucggguguugcuuugggggaagcuugcacuguggugauuagaggcgcgacucaacagauuauagacgaagcugaucguaguauccacgaugcacuuugugugcuagcugcaacuguaaaagagagccgcguuguuuacgguggcgguugcagcgagacuuugauggccugcgcggugcgcaaagccgccgccaguacuccgggcaaggaggccguagcuauggaggcuuac

SEQ ID NO: 4793 - RNA, 661 nt, Meligethes aeneus
ccuccaccaagucgaauacgccauggaggccguaaaucugggcucugcaacaguuggccuuaaaagcaaaacucacgcuguccugauagcccucaaaagggccuccuccgaauugucggccuaccagaaaaaggugaucaacaucgaugaacauauuggaaucaccauuuccgguuuaacugcagaugcaaggauuuugagcagauacaugaggacugaguguuugaauuacaaguauucucaugauacuguguugcccuuaaauaggcuuauuuccacuuuggggaauaagaugcagguuugcacgcagagauaugauagaaggcccuaugggguuggauuguugguugcugguuuugacgauaaaggugcucauaucuaccaaacuugcccaucugcaaacuacuacgauugcaaggccauguccauuggugcuagaucucaaagugccaggacuuacuuggagaaaaaaaucgacgaacuccauaaugcuccucuggaagauuugauuaaacaugguuuaagggcguugagagauacccuucccccagagguggauuugaacaccaaaaauguuucuauuggauuugugggcgacaaacagccguuuaaaauccuggaugaggaugaaaccgcucccuucuuggcuuugauugaagga

SEQ ID NO: 4794 - RNA, 655 nt, Meligethes aeneus
ggaauggcauaaaagagugcaguuguaugaaggaaaaccccaugaaauuauuaauacuuauacugaagcaguacaaacaguugacccaaaauuggcuguugggaaacuacacacauuauggguugaguuugcaaaauuuuaugaaagcaauguccaaauugaugaugcaagauugauuuuugaaaaggggacccaaguucccuauguaaaaguagaugauuuagcaaauguguggugcgaauggacugaaauggaaauucguaaugaaaauuaugaugaugcauuaaaguuaaugcacaaggcaacaguaaugccagcuaaaaaaguagcuuaccaugaugacacagagucugugcaagcaagacuguauaaaucuuuaaaaguuuggucuauguaugcugauuuggaagaaaguuuuggaaccuauaaauccuguaaggcuguuuaugacagaauuauugauuuaaaaauugccacuccacaaaucauuauuaauuaugggguauuuuuggaagaaaauaacuauuuugaggaagcauuucgcgcuuaugaaaaagguauaucauuguuuaaauggccaaauguuuaugauauuuggaauacauauuugacaaaguuuuugaaaagauauggugguaguaaguuggagagagcg

SEQ ID NO: 4795 - RNA, 694 nt, Meligethes aeneus
uggggguuuagaugacaaaguuuccgaaucauuauuaugggagcuuuuugugcaagccggacccuuagugaauguucacaugccuaaagacagaguuacaaugaugcaccaggguuacggguuuguagaauuuaugggagaagaagaugcagauuaugcuauaaaaauuaugaacaugauaaagcuguauggaaaaccgauaaggguuaauaaagcaucagcccaucaaaagaaucuggaugugggagcaaacauauuuauaggaaauuuggaugcagaaguggaugaaaaguuauuguaugauacuuuuuccgcguuuggagucauauuacaaacuccaaagauaaugagggauccugaaacgggcaacuccaaagguuuugcuuuuauuaauuuugcaaguuuugaagccucugaugcaucuauagaagcuaugaaugggcaauaucuguguaaccgaccaauuucuguaucauaugcauucaaaaaagauucuaaaggagaacggcaugguucugcugccgagagauuauuggcugcccagaacccauuaucucaagcugauagaccucaucaacuguuugcugaugcuccaccaauggguaugaugccuccuggaaugucaauggcaccaccaccacccccaguauugauaaugccgcccccaccuccaaccccuacaaauaugcaaccu

SEQ ID NO: 4796 - RNA, 625 nt, Meligethes aeneus
cuacuuggauuucagcgaacgucauggauacaucaagggggugguaaaggagaucauccacgaccccggucgcggcgcccccuuggccauggucaacuucagggaccccuacaaguuccagaccaggaaggagcuuuucauugccccagaaggcauguacaccggacaguuuguuuacuguggaaagaaagccaacuugcaaaucgguaacguuuugccaauuggagccaugccugaagguaccaucgugugcaacuuggaagagaaaacuggugaccguggucguuuggcccgugcaucugguaacuaugccaccguaauugcccacaaccacgacacaaaaaaaacuaggguuaaguugccaucuggagcaaaaaaagucauucccuccaacaacagagccaugguugguauuguagcuggugggggucguauugacaagccaaucuugaaggcuggucgugccuaccacaaauacaagguuaagcguaacugcuggccuaaggugagaggugugugcaugaaccccguugagcauccucacggaggugguaaccaucaacauauugguaaggcuucgacggucaagaggggaaccagcgcuggucguaaagucggucucauc

SEQ ID NO: 4797 - RNA, 270 nt, Meligethes aeneus
guaaacaguuggcaaccaaagccgcacguaaaagugcaccagccaccggaggugucaagaaaccacaucguuacaggccuggaacaguagcucuucgugagauccgucguuaccagaaaaguaccgaauugcucaucaggaaauugccuuuccaacguuugguucgugaaaucgcucaagauuucaaaacugacuugcguuuccagagcuccgccgucauggcauugcaagaagccagcgaagcauacuuggucggucuuuucgaagaua

SEQ ID NO: 4798 - RNA, 644 nt, Meligethes aeneus
cagagcuucuucuugagcucgaccaccuugcgcacgcgcugcaugaugaagucgcgcuccgccgucaccaucuucucgcgcuccucggccguuuuguagaagaagcccgaguucacuucgcucuucucguacuccaugcucacguugcaggugaggauguacgcguuuuucagcuguuugggcaugucgggguggcggcacccgugguccaucacgauaccuuugaccaaagaagugucagcuucaguuuugugcugcaucuccaucaacucaaccaugugcaagucgacggguuugucgcccugcuugauggccaaaaucccgucgacgcacaccucggccagaacgucggccaacuuccggugcaccuugguccucaagcuggucuugcacacguccaucaggcucucucuggacgccucgacggggaucuugaucuucuccaagaccuccagcgccuuggcucuggcuuugucgaagcccucggccaggauccucgggugcaaaccuucggauauguagaugucggccugcuugaggagcucgccgaucaccaggacgguggagguggugccgucgccugucaugucguccugcgcgguggaagcccuggcuaucaaggaggcgguagggugcuggauuug

SEQ ID NO: 4799 - RNA, 785 nt, Meligethes aeneus
aaguauuucguagucggagcuggagcaauuggaugugaauuauugaaaaauuuugcaaugguugguuuaggaacccaaggaggagaaauuacugucacugauauggaucuuauugaaaaaucaaaucucaaccgacaauuuuuauuuagaccucaugauguucaacagucaaaaucuguuacagcagcaaaggucaucaaaaaaaugaacccagauguaaacauugcagcucaugagaauagaguuggaguggacacugaaaauguguaugaugauaaguuuuuugaaaguuuagacgguguugcuaaugcauuggacaauguugaugcaagaauguauauggaucguagauguguuuauuaucgcaaaccuuuacuugaaucugguacuuugggcacuaagggaaauacccaagugguuguaccuuucuuaacugaaucauauaguucuucucaagacccaccagaaaaaagcauccccauauguacuuuaaagcauuucccuaaugccauugaacacacuuuacagugggcaagagaaacguuugaaggacuuuuuaaacaaaaugcagaaaacgcaucuuuguaucuaaaagauccugaauuuguugaacgcacucuaaaacuaccuggcguucaaccgcuugacacguugcagucuguuaaggcagcuuugauugaugaacgcccaaaaucuuuugaagauugcauucauugggcuagacuucauuggcaagaacaauauagcaaucaaauaaagcaacuuuuguuuaacuuuccgccaac

SEQ ID NO: 4800 - RNA, 791 nt, Meligethes aeneus
uauugucgauugcgguuuugaacauccaucggaaguacagcaugaauguauuccacaagccguucucggcauggacaucuugugccaagcaaaauccgguauggguaaaaccgccguguucguguuggcaacguugcaacaacucgagccuaccgaaaacguggucuacguacugguaaugugccacacgagagaguuggccuuccaaaucagcaaagaauaugaacgauucagcaaguacauguccaacaucaaaguuggcguguucuuugguggguuaccuauucaaaaggaugaagagcuguuaaaaaacaauugcccacacauugugguugguacuccuggcagaauauuggcguugguccguucgaagaaguugaaucucaaacaccucaagcauuuuauucuugacgagugcgacaaaaugcuggaacuauuagauaugagaagggacguucaagaaauauacagaaacacaccucacggaaagcaaguaaugauguucagcgccacucucagcaaagaaauucgucccgucugcaagaaguuuaugcaagauccaauggaaguuuacguugacgacgaagccaaacuuacccuccacggucuccaacaacauuacguuaaacuaaaagagaacgaaaaaaacaaaaaauuauuugaauugcucgauguucuugaauuuaaucaagucgucauuuucguuaaaucaguacaaagaugcguugcacuggcccaauuauugacugaacaaaauuucccagccauuggaauucacagaggaauggacc

SEQ ID NO: 4801 - RNA, 627 nt, Meligethes aeneus
cgagcaagcaagacaaaucgaaaaagcgguggcgaauaaggaaaaccgcuuuauuuugaggguuuugaggugcuugccgaacacgagacguaaauugaacgguauagugcugagaaguuugaucucgcagauauauccuuugucugaacgggaagcuuuguugucuuuuguugaagaggcuguagggucugagauugauucucagacgagggcgagaucagcaacuaaaacccccgugucggaaguugacuuguacauccaucucaucauucugguacguuugauugauacaaacaaacuagaagaagccuuacguugcucccaggcuuuaauggguaaaaucaccagucaaaacagacguacuucggaucauauugccgcuaaaugcuauuucuaccacucccgcgucgccgaauuaaccgacaaacuugauacaauucgugcguuccuacaugcacgguuaagaacagccacacugagaaaugacuuugaagggcaagcuguacuuauaaacugccuauuaagaaacuaucugcauuacucucuauacgaucaaucagauaaauuggugagcaaaugcguuuuuccugaaacagcaaguaacaaugagugggcaagauuucugua

SEQ ID NO: 4802 - RNA, 712 nt, Meligethes aeneus
aguggauaugacccaucagagcacaaagcuguaauagaagaauuccaaaaaguugaagaagccaaaagacaauuaaaagcugacaaauuggaugcuaaugaagauagugaggaagaaggugaaaaagaugaggauaaauauguggaugaaguugauaugccugguacuaaaguagauaguaagcaaaggauuacuguaagaaauuuaaggauaagggaagauacagccaaauauuuaaggaauuuagauccaaauucagcuuacuaugacccuaaaacaagaucuaugagagaaaauccaaauccaaguaaggaugauccuuacucuggugaaaauuuugugagauucacuggagauacaacgaaacauuuaaaugcacaguuguuugcaugggaugcuuacgaaaaagguguugauguacacuuacuagcagaacccacaaaauuggagcuuuuacaaaaagaauaugaacagaagaaagaacaauuuaaaggcaaaauucaaaacaacauccuggaaaaauauggaggugaagaacacuuggaugcaccuccaaaaacauuacuuuuagcucaaacagaagacuauguugaauacucaagaucaggaaaaauuguuaagggacaggaaaaagaaaucauaaaauccaaauaugaagaggauguuuacauuaacaaccacacaucuguaugggguucauuuuggaaaggug

SEQ ID NO: 4803 - RNA, 388 nt, Meligethes aeneus
agauaccggaaauuucgcaugggguagcgaaggcacagcccgcaaaacccguaucaucgacguuguuuacaaugccaguaacaaugaauugguucguaccaagaccuugguaaagaacgccaucguugucauugaugccacaccauucaggcaaugguaugaaaaucauuacauuuuaccuuugggacgcaagaagggagccaaauugacugccgaugaagaagcuauuuuaagcaaaaaacgcagcaaaaaagugcaaaagaaauacgaaacaagacaaaaaacaucuaaaguugaaccugcuauugaagaacaguuccaaacugguagacuauuagcaugcuuggcuuccaggccuggacaauguggaagggcugauggauauguu

SEQ ID NO: 4804 - RNA, 198 nt, Meligethes aeneus
ugaggcucucucugaaagggcuguggcugucguagucgauccuauucagucuguuaaagggaagguugugauugacgcuuuuaggcugauaaauccuaauaugauggucuuagggcaggaacccagacagaccacaucaaauuuggggcauuuacagaaaccuucugugcaagccuugauucauggacuaaacaggca

SEQ ID NO: 4805 - RNA, 674 nt, Meligethes aeneus
ccacuuaugaaauggugggaggucuggacaaacaaauuaaggaaaucaaagagguuauugaguugccugugaaacaucccgaauuguuugaugcucuuggaauugcacaaccuaaagguguacuguuguacggcccaccugguacugguaaaacucuguuggcucgugcgguggcccaucacacugagugcaccuuuauucgcgucuccgguuccgaguuggugcagaaauucauuggcgaagguucgcgaauggugcgcgaacuguucgucauggcucgcgagcacgcgcccuccaucauuuucauggacgaaaucgauuccaucgguucuucucgcauugagucugguucagguggagacucagaaguacaaagaaccaugcuggaacuuuugaaccaguuggacgguuuugaggcaaccaaaaauaucaaggugaucauggccaccaacagaauagauauuuuggacccugcucucuuaagacccggcagaauugaccguaaaaucgaauuccccccaccaaaugaagaagccagauuggacauccugaaaauucacucgagaaaaaugaacuuaaccagaggaaucaaucuuaggaaaaucgccgagcuaaugccuggagcuagcggagcugaagucaaggguguaugcacugaagcagguauguaugcu

SEQ ID NO: 4806 - RNA, 459 nt, Meligethes aeneus
ugguugaaaucggccuucgagcugcaaagcuucagcuucuuucagcgcggcuccgugcaggaguucaugucguuuuucugcaaaaccauaguggaacgaaccauuccagcuuccaggcaaucugucaacgaaggagaguauuugugucacguguacgugagaggcgauaauuuagcuggcguugugauaaccgaucaugaguauccaucgagagugucacacacuuuaauuacaaagauuuuagacgaguuuucuguuaaauuuccuguggagaguuggccccaauugcaagaaagagacguggcguucccacaguuaaauacuuacuuagcgaaauaccaaaaucccagugaggcagaugcaaugacuaaaauacaagaagaucuggaugaaacaaagauuauucuacauaacaccauaacagcuguccuucaacgaggcgaaaaacuggacgauuua

SEQ ID NO: 4807 - RNA, 293 nt, Meligethes aeneus
gauagggcaagaauagaaugccaaaaccauugguuuguuuacaacgaaaacaugagcguugaaucuugugcccaagcgguuucgaauuuggccauucaguucggcgauuccgacgacgacggggcggccauguccagacccuuuggaguugccauuuuguucgccggaauugacgaaaaggguccccagcuauaccacauggacccuucgggcacuuucguucaauucgacgcgaaagcgauugguuccgguucggagggagcgcagcagagccuucaggagguuuaccaucg

SEQ ID NO: 4808 - RNA, 725 nt, Meligethes aeneus
acgcauuuguugaacaaguuaccagaaaaguggccucguacuugggugaaguucuugaggaucaacgggacaaacuucaggagaacuugauggccaacaacaccgacuugccaagcuaucugacccgauuccaaugggacaucgcgaaguacccgaucaagcagucgcuucgcaacaucgccgacaucaucagcaaacaggucggccagaucgacacggacuugaagaccaagucuaccgccuacaauaacuugaagagcagucuucagaacauggagaagaagcaaaccggcagcuuguugacucgcaacuuggccgauuuggugaaaagggagcauuuuauuuuggauucggaguaccucaccacccuuuuggugauuguucccaagagcucuuuuaaugaauggaacgccacauacgaaaagaucaccgauaugaucguacccagguccaccaauuugauuauccaggacgcugaguauggacucuacacgguaucuuuguucaaaaaggucguugaugaguucaaacuucacuccagagaaaagaaguucauuguuagggacuucacuuacaaugaggaagaauuggcugccgguaaaaacgagauuaccaaguugguuacugauaagaagaagcaauuugguccuuuggugagguggcugaaggugaacuucagcgaauguuucugugccuggauucacgugaaagccuugagaguguuu

SEQ ID NO: 4809 - RNA, 669 nt, Meligethes aeneus
caucucgucgcaguagaagucguuggggccgcgcaggauuauagaggccgcggugcgggccuuuggcuuuuuaauaaugaucaacucaucaucgcagauucucuccuggguuacuucggccgcuucaccaaccauacugcugucgaaaguuucaucaccguccauguuggucaaggaugugagauaagcggcuccgguggcuuuggcgaugcgcuugaggucgaccuucuugacccugcgaacggccauggcguucuucucgacgaaauacuugaggcagaggucgucgaugccgccggaaaccaggacgacguucacgcccgucgccaggaucuucucgaugcgcuccuucgucauguccagcucgcgguuccugaugcccuccaacuuguccgggucgcugaucaggaccugcacgcccaacuucaucuuggacuuuugcagcgaaaaguccaggcacgcgaucuucgcguuggcgaucuucuugggcauggccuggcuggcgacggugcaguucagcgcguaacccugcaccaagacgcucucccucgcacuucugccgugcgccuugaggauguugaccgccuugaugggguacauggccuggccuuucggguccuggaucuugaccgccugagcggcguccacgaccauggucgagaacagauc

SEQ ID NO: 4810 - RNA, 654 nt, Meligethes aeneus
ccgggggcuuucuauaauuucccaaacacgaaauccggcccaagcgacgaauuucaacauucucaggcucccauaacgacagcaacguccauuguggcuauaaaguacgccaccgggguuauaauugccggugauuugcuggguucguaugggucuuuagcccguuacaggaauugccccagaguuuugcaagucaaugagaauauuauucuuggagcuggcggagauuacggcgauuuccaguacauaaaaaacuuuauugagcaaaaaauuguucaagaagaauguuuggaugaugguuuuaagcuaaaaccaaaauccuuguacuguugguuaacaaggguuauguacaguuguagaagcaaauuugauccccuguggaauaauuugguuauaggaggaauucaagauggugaaccuuucuuggguacaguagacaaacuaggcacugccuucacagauaaaauaaucugcacaggguauggggcucacauugcuguuccuuugcuuagagaggcuauggaaaaaaauccaaacaugucuaaagaugaagcuaaagcucuuguugaaaaauccauggaagucuuguuuuacagagaugccaggaguuucccuaaauaccaaguugcuauaauugaccaaaaugaagguucg

SEQ ID NO: 4811 - RNA, 779 nt, Meligethes aeneus
gaaaauacaggcguugucagaggauacuaauaauaauuuaaagaagaauguauaucaaaauuauggucaauuuauugauacagccaaagaaauaucccauuuggagagugaaauguaucaauuaucccaucuauuaucugaacaaaagucccuuuugaacucucuggcaucaacuuccuuaaugggggauaauagcaauuuaacuagaaacaaggaaagaucugaggagaaaauuauugaggaacaaaaacagaaaacucaaucaauucuagagaaaguggagggaugcaaagauguuuuagauaucccagguagaacguucuugcaugagggagaucuuuuggaauuagauucuuuagaaaauaaaccaauuaaaccagugcauguuuauuuauuuaaugaugguuuuaugauuacuucaagaaauuccaauagucgaggauuaaugaaauauaaguuugaaguuauguaugaauuaggcaguuuagcugugguuaauguuagagauuuaggggauguuaaacaugcuuuuaaguugcuaauauuuccugaaacuagaauauuucaaugcucuucaaauucaaauaagaaagauugguuggauaaauuugaucaagccaagaaaaaccagcuuucacaggauguccaaagacgcgaaucuauaauagaaagaucaccuucaagaaccacuauagaaucaggcauacacagcacuuuaagugaaucugaagaugacuugguuauuauaacacauccagaaugguuuuuggauuugccug

SEQ ID NO: 4812 - RNA, 688 nt, Meligethes aeneus
gucaagagagcaccauagagauagaagaaacagaucuagagauagagaucgaagcaggagacauaggucaagaucuagggaaagaagaaggucaagggacagaagaagcagaucaagagaaagaaagcacgauaaacaugauagaguuaauaauaagaauaagcaugaacgaaguccagaauuggaugaugauccgguuccaggaaaaauauacaguggcaaaguagccaauauagugccauuuggauguuuugugcaaauugagggguugaaaaggagaugggagggguuggugcauauaucccaauuaagggcugaggguagaguuacuaauguuucugaggucacugcuagaggcaacaaaguaaaaguaaaaauccucucaguaacuggccagaaaguaucuuugucgaugaaggauguuugccagaugagugguaaggauuuaaauccacugucacaugcuccuucugaaagggaagauagggauagaaauccggauaggcccacaaguagcuccacuaguguguucagauugccuguagguacugaugaaggagaagaggauuccaggaagaaaaucaccaaaaugucuaguccagaaagaugggaaaucaagcagaugauuucguccgguugcauagauaaaagugaacucccagaauucgacgaugaaaccggacuuuua

SEQ ID NO: 4813 - RNA, 714 nt, Meligethes aeneus
gaggagguucuucgaaaacuggcguagcaaauggauuugaaauauuugaaauagcccaugaugggaaaaaauuuauugcugaagaggugaccagacacgaaacaggacccaguguuguuaugaauugcucaucguacaguaacaguaaacauuccuacuuaguggcaggccaagaaagucauugucaguuauacaguguugauaguguucuagucagagaugaagauaauguggaaaauguuggugaaaaucacacggaagugaggcaacguaaagcaaaaccuaaagaacaaacagacaauaacagaaaugugaaaaagagauuaaaguuuaauaucaagccuauggacagugugcagacugauuuuaauggacaggaaccuuuguugagaguuaugcggauagggcacaauggaaaaaugcuggcaacuggugguacagauaauacaauuaaacuauggaaauucccuaacuuagagccccuagcaacauuaaaagcccacgaaaaagaaauugaugacauagauuuuagccaucaugguaauuuuuuaauaacuguugcaaaagacgguuuggcaguauuaugggauaguuuaaaggguaaagaacuuaacaggcuggaauggaaacaaccugagggaucaaaauauuuauacaaaagaugcagguuuggccuuaucgaggggcuggacgagaaaaggucugcucuguaca

SEQ ID NO: 4814 - RNA, 702 nt, Meligethes aeneus
caccacgauaaacuucuggaaaaccugaaacgcgaacaagaagaacgcgacgaugaagaaaacaucaaaaauaaggagcaggacauccugaauuugggcgagaaguauaaaaaagaggguaaggcuaaggaacucgcggaacuaauaaaggccacaagaccguuuuugggggaaauaagcaaggccaaagcugcuaaacugguuagaucuuugguugacuucuucuuggacuuggaggcuggcauugguauagaagugcaacuguguaaagaaugcauagaaugggcaaaggaggaacgaaggacuuuccuucgucagucacuugaggcgagguuaauagcccuauauuucgauaccgguauguuugcagaggcucugcuguuaggaucaacucuacuuaaagaacucaaaaagcuagaugacaagaauuuguuaguugaagugcaacuguuagaaagcaaaaccuaucaugcuuuaagcaauuuaccuaaagcccgugccgcuuuaacuuccgcucguaccaccgccaacgcaaucuauugcccccccaaaaugcaagccgcccuugauuugcaaucaggaauuuugcaugcugccgacgagaaggauuuuaaaacugccuauucauacuuuuacgaagcguucgaggguuuugacagugucgaaucaccgaaagcucuaacagccuugaaauacaugcug

SEQ ID NO: 4815 - RNA, 551 nt, Meligethes aeneus
gaaaaacacgacuugcagaaccucaacgaucguuuggccagcuacauagauaaagugcgguauuuggagcaggaaaacucgcguuugaccagggaagugcaaacuucgcaggaaugcacuacgcgggagaucaccaacaucaaauccauguacgauguggaacucagcgacgcccggaagcuucuggacgagacgcacagggaaaaagcucgccuggaaaucgacgugaaacgucugcuggaagaaaacgacgaguuaagggacgauuuggcgcgcaaaagcaaagaucugaugaucgcugacaacucugcacguaucaacgaaaccaaagccaacgagaugcagcugaaguacacccaggccaaccaggacgccaaaaaggccaucaacgaugcccgaaacuuggagaaggagcgcgacaagcugcggaagcuucuggacgagcaccgcaaacaucuggaagaagagaguuuggcacgcgucgaaauugaaaacgcaaaccaaaguuugagggaagagcucuccuucaaagaucagauccaccagcagau

SEQ ID NO: 4816 - RNA, 787 nt, Meligethes aeneus
cucuuaacucucauggacggcaugaaaaagagcucgcacguaaucgugauggccgccaccaaucguccgaauucgaucgaucccgcucuacgucguuucggacgcuucgaucgcgaaaucgacaucggcauccccgacgccaccggccgucuggaaguuuuacgcauccacaccaaaaacaugaagcucgccgacgacgucgauuuggagcagaucgcugccgagacgcacggccacgugggcgccgauuuggccucgcuaugcuccgagagugcucugcaacagaucagagagaagauggauuugaucgaccuggaggacgaucaaaucgacgcggaaguacuaaacucgcucgccgucacgauggagaacuuccgcuacgcgaugacaaagagcagcccguccgcucuccgcgaaaccguggucgaaguacccaacgucagcugggaagacaucggcggccugcaaaacgucaagaaggaacugcaggaguuggugcaauaccccguggaacaccccgacaaguuccugaaguucgggaugcagccgucgcgcggaguucucuucuacggcccgcccgguugcgguaaaacacuccuggccaaggccaucgccaacgagugccaggccaacuucauaucgaucaaagggcccgaguugcugaccaugugguucggcgaguccgaagccaacgucagggauauuuucgauaaggcgcguucggccgcuccuugcgugcucuucuucgacgagcuggauuccaucgcuaaauccagggguggaaaug

SEQ ID NO: 4817 - RNA, 655 nt, Meligethes aeneus
uuuacugucaucugucgaccagcccuugaaaguggcuaaagauaaggauucaggcaaagauuauuuguugugugauuauaauagagauggcgacucauauaggucuccgugguccaacacauacuacccaccucuagaugauggcuccaugccuucugaacgccuacguaaauuagaacucgacgccaaccaugcuuucgaucaauauagggaaauguacuucgaaggcggcguaucgucgguguacuuuugggauuuggaccacggauucgccggcguuauucuaauaaaaaaaaccggcgacggcaguaaaaagaucaaggggugcugggacucccugcauguggucgaagugcaagaaaaaaguuccggcaggaauucacacuauaaaaugacuucuacugcuauguuguggcugcagaccaacaaacaggaauccgguacaaugaauuugggcggcagucuuacccgacagauggaacaagacagcguagugagcgaguccaacccacacaucgcgaauauagggcgcauggucgaggauauggaaaauaaaauucgcaacacucuaaacgaaaucuacuuuagcaaaacuaaggacaucgugaacaguuuaaggucggugcagccguugaacgagagucgucaacagcag

SEQ ID NO: 4818 - RNA, 679 nt, Meligethes aeneus
augauacuccaguggauccaaucaauggggugguucagccucuuguuaacccagcuccggaaaggccaggucgugucacuaaucagcuccaauuucuacaaaaaacugugcuuaaggcugucagcaaacaucaauuugcauggccuuuugcagcaccuguugaugcuaaaaaacucaauuugccugacuaccauaaaauaauuaaacaaccuauggaccugggaacaauaaaaaagagacuggauaacaacuacuauuggucaggcaaagaaugcauacaagauuuuaacacaauguuuucaaacuguuauguguacaauaaaccaggugaagauguggugguuauggcacaaacuuuggagaaaguauuucuuaccaaaguagcagauauacccaaggaugaaguaguuguggaaccaccagcaaaagguggcaagggcaaaaagggaagaacaaguagugggucaggaaccgguggagcuacacccacagcagggagaggaagaccuccaggugcugucucuucaacuagcgcgacuccaguggcaacaacaacaggaucaucaggucuaccacuaggcacacaagcucccaccacaguuccuggcaguacugccacaacaacaaucacaccugcaucgacacacagcucucuuccuccccaaccaauaucacagaa

SEQ ID NO: 4819 - RNA, 426 nt, Meligethes aeneus
ccaaaagguguacaaaagccagcgcuuccgcgcugguaaagguaagaugcguaacaggaggcgcauccagcguaaaggaccauuggucguguaccaucaagaccaaggauugcgucgcgcuuuccgcaacauccccggcaucgaccucaucagcgucggcaagcuuaacuuguuaaaauuggcuccugguggucacguuggacguuucgucaucuggaccgaauccgcuuuccagagauuggacaaauuguucggcaccuggaaaacuccauccggcgaaaagaagggauacaacuugccgcaacccaagauggccaauacagaccuuuccagguuguugaaggccgacgaaauuaaacaaguucucagagcuccacagaagaagauuguacgucgccagcgucgucucaauccaaucagcaacac

SEQ ID NO: 4820 - RNA, 659 nt, Meligethes aeneus
gaagaagaagaagaagcccauauucagcgacgcagccuugcaagaagcccaggaaacguucggaguggacuucgacuacgacgaguucuccaaauacgaacaggacgaguaugaagaugaugaagacgaagaagacgacgauuacgaggaggacgacgauggcgaacgcagacgaccuccgaagaaagaaagacgcaaaaagcccacgaaaaaauccauauucgaaguguacgaacccagcgaguuaaaaagagguuucuucaccgauuuggacaacgaaauucguaacaaggacguucccgagcgcaugcagcuccgcgacguucccauaaccccggucgcggacgauuccaccgagcuggacgacgaggccgaauggauuuacaaacacgcauuuugcaaaccaaguguuuccaauauggaagcgaauuugacgucugaacagagggaaaaauugaaaaaggguccgcaaacugugacgaaaauucgcaaagcucuggauuuuaugcgaaaucagcaguuggaaguuccuuuuaucgcuuuuuacagaaaggaauacguccaacccgaauugaacaucaacgauuuguggaaaguuuauaaauucgacuccaaguggugccaacugaaaucucgcaaggagaaccugaugaaacugu

SEQ ID NO: 4821 - RNA, 718 nt, Meligethes aeneus
aauggagaucaaaccuggacaagagauugaauugugucacauguuccuugauuguugcgcugaacagcguaccuacgaaaaauucuucggccuccucucgcagcgcuucugccaaauaaacaagacuuucaucgaaccguuccaacaaauuuucaaagauaccuauuccacaacucacagacuugacgccaaucgauugagaaacguuagcaaauucuucgcgcauuuauuguucaccgacgccaucggcugggaagugcucgauaucaugaaauuaaacgaggaagacaccaacaguuccagcaggauuuucaucaagauuuuguuccaggaguuguccgaauauaugggauuagcgaaguugaauaaaaggcuaaaggaugaaacuuuacaggaauauuucgcggggcuauuuccgagggauaacccgaagaacacgcguuucgccaucaauuuuuucacgucgaucgguuuaggaggucuaacggacgaguugagggagcacuugaaaaacgugccaaaacaucuggaagugauggcuuugaaagcagauucgagcagcucuagcagcaguagcagcaguuccaguaacgauuccagcagcaguucagauucuuccgaugacgaggguuccaggaagaagaaaacaaaaaaauugaaaaccccggacaaaaagaagaaacagaaagaagaugaaaaacccaaaaagaaaagcgag

SEQ ID NO: 4822 - RNA, 706 nt, Meligethes aeneus
acccuucaguaagauaccgaagugauugggaacgcaacguggaacuagcgcagaugauucagcaaaaguuggaugccuauaaagcggaugagcccacaaugggagaggggccugaaaaagcgagaucgcaacuuuugauucuugaccgcggcuucgacugcguaucacccaugcugcacgaacuuacauuccaggcaauggccuacgauuugcugccaaucgaaaacgacguguacaaauaugaagcuucagcgggaguauuuaaggaaguguugcucgacgaaaacgacgaguuauggguagaauuacgacaucagcauaucgcuguagugucgcagagugugacgaaaaacuugaagaaauuuaccgauucaaaacgaaugacccaaagugauaaacaaucaaugaaagaucugucacaaaugauuaagaaaaugccccaauaucaaaaggaguuaucuaaauaugcuacacacuugcaucuugcugaagacugcaugaaaucuuaccaaggauauguugacaaauuauguaaaguugaacaagaccuagcaauggguacagaugcagaaggagaaaaaauuaaagaccauaugcguaacaucguaccgauuuuacuugauccaaaaauaacaaacgaauaugacaaaaugagaauaauugcucuauaugcaaugauuaaaaauggcauaaccgacgaaaauuu

SEQ ID NO: 4823 - RNA, 786 nt, Meligethes aeneus
cgcauguagcaucaaaaguuuugcauuugggcgaucaacucgacaguguuaauggccccagggccagaguuguggaggcacaaaaauuaaugacacacuuaaacgaguuuuuuaccacuggcccucuaacgucaucuuuauucacagauccuaaacgaguagaugaggcugcagauguaauacagaaacuauuuguuauuucucaagauuuacccaaugaaaaauuuagcggcguacuugaaaaaauaaaaagaaaauaugcggauauugaaagaucuuuaauugaagaauuuacugaugaauuaaaaagggauaaugucgauagaaugaaggaaauugcuaguguuauguaccaguuuaagggauauucucgcuuaauuaaugaauauaucgaauauagucaagcugggugucuccacacaaaagaaauuuucuacagucaacucuuggaguuguguagaaaaaacuacgaaagaauaaaggaaguuuucauaaauccugaccagguuauguccaaauuuguucuaaacauuuaucaacucaaaauccaggaacacauuagauuaaggcucucugauaaguuggaaacauauaauuauuugaagacucucuaugaacuauuaucaaagacuaaccaacugucaaaugauuuagcuauggugcauguuagcagugacaagaauuuuuugaauaaguuaacaucaaauauuuuuagcaaauauauugacaauuauauacaauuggaauuaaaauguuugagagguagauguucgacgaaccuacaaa

SEQ ID NO: 4824 - RNA, 650 nt, Meligethes aeneus
ccgcagagaacguuuaagacaacuugcguuggaaacuauagaucuucagaaggaccccuauuuuaugaaaaaccauuuggggucauaugaguguaaguugugcuugacgcugcauaauaacgagggcaguuacuuggcgcauacucaggguaaaaagcaucaagccaauuuggcuagacgugcugccaaggaggcaaaagaugcaccuucgcuaauccagccugaaaagccaagaguugaacccaagaaguuugugaagauugguaggccugguuacagggucaccaagcagagggauauugagaaugggcagcagagcuugcuauuucagauugauuauccagaaauuggugacauggugauaccacgucaucguuucaugucagccuaugagcaaaaaauugagccgccagaccgcaaauggcaauaccugcuauucgcagccgaaccauacgaaacgauuggcuucaaaguaccgagucgcgagguggaaaaaaccgacacgaaauucuggacgcacuggaacagagacacaaagcaauuuuucuugcaguuugcauuuaaaaacgaagcaaaaaagagcaccaccauaauaacccgaccagggcacauuauugcuggagugccaccuccuccaaugaugccaguac

SEQ ID NO: 4825 - RNA, 258 nt, Meligethes aeneus
ggaaaauugauugaagccgaagacaacaugaauugccagaugacgcagaucaccgucacuuauagagacggcagagucgcucagcuagaaaauguuuacauuagaggcucgaaaaucagauuccuaauucugcccgauaugcugaaaaacgccccaauguucaagaaacagaccaaagcggguacugcggggcgaggaaaaagcgccauacugcgagcacaagcucggggcagagggcggggucagccuccuauucga

SEQ ID NO: 4826 - RNA, 650 nt, Meligethes aeneus
aaaacuguaguuguugcugccgauaaugauucccaaauugccaggguuucuauaauuuuaagagcugggucaagaaacgaaaccgccgaaaauuuggguauuacccauuuauugagaaauugugcaggacuauccaccaaaaaugccagccaauuuaucauuacucgcaacauucaacaaguuggcgccaguuugaccgcaaccucggaccgcgaaaccauuuccuacacccuugaagguaccagaucggcugucgaaaaaguuauaccauacuuuacugaaguugccacacaacaaguuuucaagccaugggaagucgccgagaauaccggacguuugcaccucgacauugccacccgcccauugcagguuagagcaauugauuuguugcacaaagccgcuuuccguaccggucuugguaacucgauguucauuccgaaauuccacauuggcaaaauuucuucggaaucuuugcaacacuacgugugcgagaacuucaccagcggccgcgccgcugucguugguuugggaauggacgaagccgaaguaaccaagaucgcucaaucuuugcacuugggaucuggggaaggucaaacaagaccaucuccauacaaaggcggugaaguaagauccgauaagggaggagauuu

SEQ ID NO: 4827 - RNA, 183 nt, Meligethes aeneus
agaggacgaaaaugaucgaaugacuaaugaguuaaaagacaaaauuggcguuuugaaaucucuaucgauagacaucggcaaugaggugagguaccaagauaaacugcuuaacgaugucgacgacgacuuggaaaggacugggggguuccuugggaauaccaugaaucgagugaugcgacuaac

SEQ ID NO: 4828 - RNA, 640 nt, Meligethes aeneus
augacgacuuuaucacccagacaggcucaaagggaacauguuuuggcgguaucccgugacuucgugucccagcccagauuaacuuacaagacaguuucugggguaaacgggccuuugguaauuuuggaagacguaaaauucccuaaauucuacgaaauugugcaacugaaguuggcugauggcagcauucguucgggacaaguuuuagaaguaagcgguucuaaagccguaguacaaguuuuugaggguacaucuggaauugaugccaagcacacgguaugcgaguucaccggagauauuuugcguaccuccgugucagaagacauguugggacguguuuucaacggaucuggaaaacccauugacaaaggacccccaaucuuggcggaggacuucuuggacauccaaggucagccgaucaacccguggucgcgcaucuaccccgaggagaugauccagaccggcaucacggccaucgacgugaugaacucgaucgcucgcggccaaaagauccccaucuucucugccgcgggguugccgcacaacgagaucgccgcgcagaucugccgucaggccgggcucgucaaggugcccggaaaaucggugcucgacgaccacgaggacaacuucgccauagugu

SEQ ID NO: 4829 - RNA, 537 nt, Meligethes aeneus
ccuagaacaaccaggagauguuguggcuuaugcagcugauuauuuucaaagauuacgggaaaccagaacuacuuccuuaaucuaugggggcucagggacacaggauuugaugucuccugaugagucuacaauaucaggagaagaagaaccaccaauagaacguuucacguccagacguaaaucaguauucgccgagacuuacgaucccgaagaggaugacgacgaugaugacggcauuaagacgguguuucccaaauccgacgagcagaggcaaagauugucagaagcuguucguaacauauuguuauuuagaucguuggacaaagagcagaugagcgagguuuuggacgccauguucgagagaaaaguucagcaagaugaauugguuauuaagcagggagaugauggggacaacuuuuauguuauacaaagcggaauauuucaugcuuugguggcuagcgaaccagcccagguuccgacacacauccacacguacgauaacgccggcaguuuuggcgagcuggcuuuguuguacaa

SEQ ID NO: 4830 - RNA, 742 nt, Meligethes aeneus
uuugguucaguuguugaugcgggccuuccaagacacucagaggcgugccagcguggcaaguggugguagcaaucaaccggguacuuaugcugacggaguucgcauggaggaaaucauagagggcacugugggugcuuugcauauccuugccagagagucgcauaaucgugccaucauucgacagcaaaugguugucccaauauucguuggacuucuguucaacgacaucgaaaacauacagcgcgucgcagccggcguucuuugcgaacuugccgccgauaaagaaggcgccgaaaugaucgagcaagagggcgccaccuccccacuaaccgaacugcugcauucaagaaacgaagguguugccaccuaugcggcagcgguguuguucagaaugagcgaagacaagccgcaagacuacaaaaagagacuguccauggagcugaccaacuccuuguuccgcgaagagaaccucuggaaccccgaucuuggaaucgguuccgaacuacaggaaauuuugagucccgagcacuacgauaaccuguauccacaagaucccccaaguguacacagcagccauggcaguagaccauaccaacagcaaggguaugaccagauaccaauagacaugcaagguuuggagaucgguucccacggaggcggcaacggcuccaccuacagugcaauagaugcgauggaagucaccagcggugaaccggaucucaacuuugacgguaucgaucag

SEQ ID NO: 4831 - RNA, 653 nt, Meligethes aeneus
ggagaaagcgaaaaacacaaaaaacgucgccccuauuuagccucugaauguaaaagccucuaugcuugugaaaaauggaggaugcagauuauucgggagauugccaaaaaaguggcgcaaauucagaaugcugguuugggggaauucaggaucagggauuuaaaugaugagauaaauaaguuguugagggagaaacggcauugggaggaucagauuaaggaguuggguggcccugauuaucaacguguuggaccacguauguuggaucaugaagggaaagaaguuccagggaauaggggguauaaauauuuuggggcugcuaaagaguugccaggaguucgagaguuguuugagcaagaaccuccgccucccccaagaaaaacuagagcugaacucaugaaggacauugaugcugacuauuauggguacauggaugacgacgauggcauccuacuuccauuggaaacaaaagcugaaaaaacaucaauucagaagaaaguggcagaauggaaagagaaaaaggagaacaggcuaaacaaagcuucagaugaugaagaugacgaagaggaugaaaauauuuaugcgguggaagaaucugaugaggaagagcaaccccaaguaauagacgggucccagcaaagauuuguugcuca

SEQ ID NO: 4832 - RNA, 499 nt, Meligethes aeneus
cggugaauucgagaagaaguacguggccacacuggguguugaagugcacccgcugguguuucacaccaacaggggggcuauuagguucaacgugugggacaccgcgggccaagagaaguucgguggccugcgagacggcuacuacauucagggacagugugccauaaucauguucgaugucacaucucgugucaccuacaagaaugugcccaacuggcacagggaucucgugaggguuugcgaaaacaucccaaucgugcugugcggcaauaaagucgacauaaaagauagaaaagucaaagccaaaagcaucguuuuccacagaaagaagaaucuacaguacuaugacaucucugccaagucgaauuacaacuuugaaaagccguucuugugguuggcuagaaaacugauuggcgaccccaacuuggaguugguugccgccccugcuuuggugcccccagaagugcaaauggacccccauuggcagcaacaaauugaa

SEQ ID NO: 4833 - RNA, 348 nt, Meligethes aeneus
uauguacaggguggguuuucaagguuacuucuuaggaguugguggaaccuggaauuuaaaugaagaaaaaaaugcagaugcugaaauuguggcaucgggaauuuuuguuggguacaucauauacacugugguuucucugauuagcuuuuguuuugcugcaggugaucauaaaacaaccuuuacugauguuuuaaugaacguuguugggguuuucauguggguagcaguuggugcaacugcuuuacauuacuggcaugguuaucuggcugaacauaaauauaccgcuauaaacucagaaagacagguugguuuagucauggguucucuauguauuauaaacggggcagc

SEQ ID NO: 4834 - RNA, 706 nt, Meligethes aeneus
gaagaacuaaaagcgaaggcagaacgcgaauuggcccugcguucgcaagucauccagagagaauuucccagaccgcacgacguuaacuuggcaguguugcggccgccgcacgaguccuacucucuaacggaccuccagaaggccgaggaacuaaucaaaaccgaaauggucaccaugcugcacuacgacaaccuaaaaaacccgauaccgaccaccaccaccaagcgaucaaacuuaucgcaagcgcagcaacuggcguuccucgagcaacauccauacgaaaauuauaagcccgaggauuuggacguugccaagguucugcuuaagcgagaaauggacgucgugaagcacggcaugaaccacggggagcuuccguuggaugccuacacccaggugugggaagagugccuuggacaaguguuguucuuaccaaaucagaauagguacacucgugcaaauuuggcaagcaaaaaagacaggcuugaaucggcagaaaaaagauuggagcaaaaucgaucacacauggcuaaagaagcaaaaaaagccgcuaaaauggagaaaaaacuuaagaucuuaacuggugguuaucagucuagagcucaggucuuaauaaaacaguugcaugaucuuuuugauaauauagaucaagcaaauuuggagcuaaauacauuuaaguuuuugcaagaacaagaaaagagugcuuugc

SEQ ID NO: 4835 - RNA, 362 nt, Meligethes aeneus
caaugcucauccagacaaacuaaagaaaaaaauuacgagggaguuaaucacaacgauuuuggcuagaaaaccaaaaaugugcagcuuuuuggaauggagggaccuaaaaauugucuacaaaagauaugccaguuuguauuucuguugugcaauugagcaagaugauaaugagcuccuaacauuggaaauuauacaucgauauguugaacuguuggauaaauauuuuggaagugugugugaguuggauaucauuuuuaacuuugaaaaggccuauuuuauacuugaugagcuacugcuuggaggugagauacaagaaaccaguaagaagaaugucuuaaaggcaauagcugcucaggauuugu

SEQ ID NO: 4836 - RNA, 661 nt, Meligethes aeneus
cuuguauucgaaagagcagcggcggcagacuuucauaucgcguuuguacgacaauuuccgcgacgaaauggcgaagaacaaggaaaugaaagagucgcugaagaaauuucgagaggaggcccaaaaauuggagcaaagugaugcguugaaagcugccaggcacaaauuugagacuguagagaaggaagcuagugagggaaguaaaguguuuaaggagaaguuugauaguauuaaagaaaaagugcaagggguuguugacgaaguggguaaaucagauauugcaaaaaaagcugguaaaaucucugaagguauugguaaaacaaccaccucauucacggaaaaagcacaagaaaucggcaaaacaagcgcauuucaaagcauaucgcagacagccgaagcaguuaaaaaagagauugacacuacaaguauggagggcagaguuuaugugagucccacaaaguuaaggaagagaacagagacaucugcagugcaaaacgugaaguucuaugaacccaaugaggaagcaacaggcauagaacuacacaaagacucaaaauucuaccagucguggcaaaguuucaaagacaacaaccccuacguucacaaaguaauggauuggaaauuaaaguaugaugaaagugauaacccccuuaucagagcu

SEQ ID NO: 4837 - RNA, 640 nt, Meligethes aeneus
ucaaaagccuaaacaguuuguaaacaacacaacugguuuaaaccagaaacuggaagaaauaaagucaucuuugccauggauugaauuacuugauuguguuaacaaacaagcuccacuugcaccugaaauggcagcacagauguuggaacaagagcaaaaaagagagaaucaauuaaaaaacaacaaaaaguugcaacaauuugcucccacagaugauccuguauugaacgauuucaaaagagaaaugauguuucacagacaagcacaagcugcagugcaagaggcuauaccaaaauuaaaagcaauggauauugcuacuaaaagaccagacgauuauuuugcggaaauggcuaaaacugaugcucauaugcaaaaaauuagagagcauuuaaugcaaaaacaacagcagcaacaaaggagugaacgggugaagcaguugagaacacaaaggaaagaagggaaaaugauacaaauccagacgaaacuucaaagacaacaggagaaaaaggaaaugauggaucaaguaaagaagguaagaaaagggcuuuccaaagauuuggacuuuuuggaugguaagaaaaauaaggccauaucuagaaagucgcuggaaaaaagaaaaaugagggauaagaaguuuggc

SEQ ID NO: 4838 - RNA, 688 nt, Meligethes aeneus; identical to SEQ ID NO: 4812

SEQ ID NO: 4839 - RNA, 711 nt, Meligethes aeneus
aucgcuccaucgauaacaaagcuauguacgauacauucucugccuuugguacuauucucaguugcaaaguagcucaagacgagaauggcaccagcaaagguuacgguuuuguccacuuugaaaccgaagaggcagcuaacaaauccauugaaaaaguaaaugguauguugcucaauuccaaaaagguauacguaggcagauuuaucccacgcaaagaacgcgaaaaggaacuuggagaaaaagccaaauuguucaccaacguguaugucaagaacuuuggugaagaucuaacugaagaacagcugagaauaauguucgagaaauauggugucaucaccagcuacaagaucaugagcaaagacgacggcaaauccaaagguuuugguuuuguugccuuugagagcccugaagcugccgaaacugccguugaggcgcuaaaugcagguaaagaauugguggagggcaagccuuuguacguuggccgcgcucagaagaaagcagaacgucaacaggaauugaaacgucguuuugaggcauugaaaauggagagguugaaccguuaccagggcgucaacuuguacgugaagaaccucgacgacaccaucgacgacgaacguuugagaaaggaauucuccccauucggaacaaucaccucggccaaggugaugauggaagaaggcagaagcaaaggauucgguuucguuugcuuuu

SEQ ID NO: 4840 - RNA, 650 nt, Meligethes aeneus
aaccgaauauuugugcgaaccuuuaagaaaaugccuaaaagacgaagauccguacguacgaaaaacagcugcaguuugugucgccaaacuguacgacauuucaucggguuugguugaagaccaggguuucuuggagcaacuuaaagaguugcuaagugauucuaaccccaugguugucgccaaugcgguagcagcucuuucugaaauaaaugaaaguaguccaacuggacaaccauugguugagcucaguacaaguacaauaaacaaacuuuugacugcuuugaacgaauguacggaauggggacaaguuuucauccuugauucuuugucaaauuacacucccagagaugaaagggaagcucaaagcauuugcgaaagaauuaccccacgauuggcccaugcaaaugcugcuguaguccugucagcugucaagguuuuaauaaaaaugauggagauauuggccggugauguugaguuuuguaauacucugagcaaaaaauuggccccaccuuugguuacacugcucaguucugagccugaaguucaguauguugcuuugagaaauauuaacuugauugugcaaaagaaaccugacauuuugaaacaugaaaugaagguuuucuucgucaaauacaacgacccaaucuacg

SEQ ID NO: 4841 - RNA, 348 nt, Meligethes aeneus
gagaaguaggugcaacaucaucuuuggcaccuaaaauugguccacuugguuugucuccaaaaaaaauuggugaugauauugccaaaggaacugcugauuggaaaggucucaaaaucaccguucagcugaaaauucaaaaucgucaagcagccauuuccgucgugccuuccgcagcaucucuuaucauaagagcucuuaaagaaccaccacgugauaggaaaaagcaaaaaaauauuaagcacaguggaaacauuacauuggaugauaucauuucuaucgcaagacaaaugaaaccacguuccauggcuaaacaauugucuggcacaguuaaagaaguucuugggaccg

SEQ ID NO: 4842 - RNA, 718 nt, Meligethes aeneus
cgagcaaauggaagaagaacuaacugcagaagccaccaaauuagguauaucaauaguauuuucccaugagacugaaccguuagguacugcuggaccaauugcucuagcuaagaacauuuugcagaaaagugccaagccuuucuuuguacuaaacucugauauuaucugcgauuuuccauuuaaagaacuggcugcuuuucacaacagccaugguaaagaggguaccauuguugugaccaaaguugaagagcccuccaaauaugguguaguuguauacgaugacgguaacugcauugaaaguuuuguggagaaaccccaagaauuuauuuccaacaaaauuaaugccggcuuguauauuuugaauccaaguauuuuaaauagaauugaacuccgucccacuucuauagagaaagagguuuucccuggaauggccucugauaaggaauuguaugccuuugaauugcaaggauucuggauggauguaggccagcccaaggauuuccuaacugguaugugcuuguaucugaagcauuuaagaucccagaacucugaaaaauuguacaagggaccagguguuguugggaacguccuaguucacccuucagcuaaaauuggcucaaacugccaaauugggccuaaugucacuauaggaccggggguagucauugaagaugguguuuguguuaagaggugcacaauccuaagagaugccaccaua

SEQ ID NO: 4843 - RNA, 657 nt, Meligethes aeneus
ucaaugagguguucaacgaugugcgaaaguuguugaguaacgaugauuuguuaaaagacggggccggcggagcuuucucgcaguacaacaaagaucaacuuaccccaguuaggaucgagaacgcugaccauuugguuuuaauaaccgaauacaacgaucuaggaggcugcagauucuucgauccaagaucaaaacagagcuucagauacgaccauuugcgcaaagaagcgucugauuaccaggcauucaguccggacagugcggcggaaccuuggcgcgccgcacuagaugccgaauuuauccauuacacaagaaaccacuacaaagauggaguauccaguguuguuucaaggaaccagggagguguuauaacccuuacugccugcauugaagaccaucaguuucagcccaagaacuucuggaauggcagguggagaucgcaauggucuauuuugaucaauucgggggcugccacugcugaagucaggggcauacuuaaaguccaggugcauuauuaugaagaaggcaacguccagcuggugagcacgaaggagaucaaggaaucgauuucuguaacgagugaggcgcagacagccaaagagaucgugcaauuaauugagacagcagaaaacacuuaucaaacugcgauuucugaga

SEQ ID NO: 4844 - RNA, 783 nt, Meligethes aeneus
auagucuccuuaccguccaaagaugaggaucaaaaaaggcuguacgacgauuuuggucugaaauggaugcuggacgauagcgacguccccgaugucggacgcgccauguuuuaccgcgaauucggcaggacuucuuccaccuacaacaacaaaacuuucguacccgaguacaaguuuaagccugaagauaucauaccggcgaaucgguccaaguuuaucgaagaugcuuaccaaauaugcuucacggacaacagagagugccucuaugauuauucggugacguugaauagagacguggcucauuucacgaguaacuacaaggcgacuauauuaaaaaugaaggagauaagucgggacaaaauuauaucuugcgguguccuggaaacgccccgguucgguagaaaaaauacuuaccucuuuacuccggguacgaagguuacuuaugaauguaauaccgacuuuauuuuggugggagacccgagaagaacuugcuugccgaaugguagaugggacauaccgaauuacggauacacugaguguuuacgucagcaggaguacuccucuaggaacgcagcuacgacuuggggaauaauucuggcgauucucauaccauuaauuuuguuguugcuauacggggcguggagaguuuaccaaaacuacaucgacaccgacgauacuacguggaaguacgacccugcgucucguagggccucuagcgugcaaaaacugaacacuaaggcgccuguggaagaaucggaggaguacgaaaccgauuaugacgau

SEQ ID NO: 4845 - RNA, 778 nt, Meligethes aeneus
cgaagacaaccucgaaaaagugaaaaacgcuucgagcaacaccgaacuaaucgacaacaucaaaaacuucggccaaaacgugaacgaccuaaugaaccaagcugccaaacgucaacaggaacugaaagacccgcagcugcgcgacgauuuagccgccgcaagggcagugcucaaaaaacauuccaccaugcugcugacagcuucgaagguguacgugcggcacccggagcuggcggccgcaaaagccaacagggacuacgugcucaagcaagugugcgaagcugucaacacgaucaacgacguuugccaaggacggccgcagcagcccacgucggggcccuacgacgggcccggcgagcucgcagcugcgcucgacgacuucgacgaucacacuguuauggagccgcuggccuacaacgagguccacacgagaccuucuuuggaagaaagacuggaaaguauuaucagcggggccgccuugauggcggauuccagcugcaccagagaugagaggcgugaaaaaauuguggccgaguguaacgcgguccgucaggcucugcaggaucuucuuucggaguacaugucuaauaugggaaacaaugagaagagugaagguuuaggcagagccauugaaaauaugggaagaaaaaccagggauuuaagaaggcagcugagaaaggcaguuguugaucauauuucugacagcuuuuuagagacgaacgcuccgcuuuugaucuugauaaaagccgcgcagaacggcaacgaaaaagagguugaa

SEQ ID NO: 4846 - RNA, 702 nt, Meligethes aeneus
cuaguuuuggggcuacaacugccacaucaacaacagguacuagugaggcuccgccggcuuuugauauaggugccaguacagcuacauugucuacaacuuucacaccaauuguagggaguucggcuccaaguacaguugguuuguuguuuacugggucugcacagagcacuacauccccuaaguuuuccaguuuggcuacaacaacuucagcagcaccuagccuaacacuagggggcacuacauccacugcaggaacugcuguuuccauaucagcugcagcugcaacuagugccccagcaggaucucucacauuuggccagcuggaagauucuauuaacaaauggacaauugauuuagaagaacaagguaaauuuuucaucaaucaagcuaaacaauuaaaugcuugggauucccuauugauuucaaauggugagaaaauuuugaauuuaaauggaagcauugaaagaguuaaacagcaacaaacucagcugaaucaagaguuggauuuuguuuuggcacaacaaaaagaguuggaagaguuaauugcucccuuggaaaaggauuuaauggauauaccuguuacagauauugaccgcaaucaaauguaccaaaugucagaaaugauagauucacagcuaaaacaaaugucagaugacuuaaaagaaaucauagaacauauaaaugagucccacaaagaugaag

SEQ ID NO: 4847 - RNA, 433 nt, Meligethes aeneus
aucuggcaagcuacucuuucuggggcucgacaaugcuggcaaaacuacgcuguugcacaugcucaaggacgauagacuagcacagcaucuuccuacauuacaucccacuucugaggaacugucaauaggaaauaugagguuuacaacuuuugauuugggcggucacucgcaagccaggaggguauggaaggauuauuuuccagcgguggacgcuauuguguucuugauugacgccaacgacagaucgagauucgucgagagcaaacaagaacuugacucgcuacuuacagacgaaaccuuguccaacugccccgugcugauccucggcaacaaaaucgauuugcccggugcggcguccgaagacgagcucagaaauuucuacgccuuguuuggacaaaccacaggaaaagguaaaguagccaggucagauuug

SEQ ID NO: 4848 - RNA, 350 nt, Meligethes aeneus
acacacaaacauggauccuuuggauauccuagaaaaacguauuacagcucuggaacugcaaguauuaccgaaaaauggcgaaauuaauagcgcccaagcuauuacagaacuauuacuacaaacccacaacauguuaacaucagccuugagcugcagagaggcuauaucauccauauuacaacacuuaucgacaauuaacaacuaccuggacccaaacaacggagaaacagaacuugaaacugaagccaagcgacaauaucuacucgaaugcuacccugagauaaaagaaacagugcaagcuauagccacaauaggaagucuaaccucauucacugacucagcgaauauca

SEQ ID NO: 4849 - RNA, 716 nt, Meligethes aeneus
agaaggggaaucgauaaggacgguaauguagccaacuuugucgagacagagcaauugguggauuaucagggcgauaaagcuaguuuugugcagguuagggguucuauaccgcuguuuuggcaucagaaucccgauuuacguuacaaaccacccccaacuuuguuggaaaucgauccccaagaacacaaugccgccugucagaagcacuuggaagcuuuggcgguuuuguacgguaaacaggucaugguugauuugguugaccaaaaaggaucugaggguagauuggagaaggcuuucaaagacaccauacacacuuuggcuuacccuucgguuaaauaugaaccauuugauuuucacgcugagugcaggaagaugcggugggauagauuguccauuuuaauugauagguuggcuuuggaccaggaugagaugggauauuuucuguuguuaagagaugguucguuguccuuacuucaggagggcauuuuuaggacuaacuguauagauugccuggacagaaccaauguuguccaaagcaugcuggcacauagaaaccuggaaauaguccugaaaaaauuaaauguaauccagacaaaucaacggcuggaagagcaguacacuuucgagcauuuauucaaaaacgugugggcagauaaugcagacguuauaagcacucaauauucgggcacuggugcccugaaaaccgauuuuacccg

SEQ ID NO: 4850 - RNA, 734 nt, Meligethes aeneus
ugacucucagauaagagccauugagaaaacguuugaugauacuaaaauucccauugaaaagcauuacagcaaaccaaaugugguaccaguugaaguuuuaccgcuauauccagauuucaguuuguggaaauauccuugugcacagguuauuuuugauucugauccagcuccuguaggcaaacagguuccagcucaaauugaagaaaugucucaagcuaugauucguggugucauggaugaaaguggugaacaauuuguugccuacuuccuuccaacugaagauacccuagagaaacguagacaagauuucaucaacaauguugcauaucaagaugaugaagaguaugaguacaaaauggccagggaguacaacuggaaugucaagaguaaggcuagcaagggcuaugaggagaacuacuucuuuguggugcgucaggaugguauuuacuacaaugaguuggagacaaggguuagguuaaguaaaagaagacaaaagguuggucaaccugcaagcaauaccagacuaauugugaaacacagaaccauggauggcaacgaauuuagaaugcagagauacagggaaagacaacuagaaccaccuggugaggaugaagaagaauucgagccggaaccagaagaaauacaacagcaagaugaagaaagucaagcgggauccgaccaagagaaagaagaugacaaagaggaaaaaggaagcagugauggggaaagaucaa

SEQ ID NO: 4851 - RNA, 708 nt, Meligethes aeneus
gggaggcuuauuugaggaaagccgaguauuacagucguauuggugauaaagacaacugugugagcacauuuagacagaccuaugacaaaacuguuucacugggucaucguuuggacauuaucuuucauuuaauucguauuggguuguuuuuuauggaucacgauauuauugugcgcaacaucgauaaggcuaaaaccuuaaucgaagaagggggcgauugggauaggcguaaucguuuaaaaguguaccagggggcuuacugcauggcugugagggacuucaaaacggccgccacuuuauuuuuggacacuguaagcacuuucaccucguacgaguugauggauuacaagcaauuugugagguauaccguguacacuucgauaaucaguuugcccaggaaucagcugagagauaagguugugaaggguucugagauuuuggagguuuugcauucugagccuuuugugaaggauuauuuguuuucccuguauaauugucaauaugcugaguuuuucacuaauuuggcugaagucgaaagcguucuacguaaagacuacuuccuaaacccucacuaccgcuauuacgugagggaaaugcgaauuuuagcuuacacacaacuucuagaaucguacagaucucuaacauugcaauacauggccgaagccuucggaguuuccaagcaauuuaucgaccaggaauuaucgacuu

SEQ ID NO: 4852 - RNA, 514 nt, Meligethes aeneus
ggaggcaauucccaauaugaauaguaaagauguugaagacaucuucaagggcguuuugacugacgaaucucaagagucccaagagagcaaccuauuuccaauacaaucgaauccaguuuucccgccgacuccagcgccucaaaauccaaugccuaauccgauuucuauguugaacccugucguucggccgaccacuuugccgaacguaaaucaaagugcgcugaacucgccucacagcuuuccuccacaaucgccguaucauucugaauauagcaacaguccgcaguuuaguccugcguucucugaaccaccacccaguccauggguuggaagcgauaacucggaaauggacucuucauccggacagucgacuuacaaucagcguucuucggaaaagaugaaggcggacgaaaguuugugugauaaggcgacaauuucugcaguucuuuacgcgaauguuaaacauccugaauggaaaucugaauaucccauuuggacugauagauacaagcag

SEQ ID NO: 4853 - RNA, 745 nt, Meligethes aeneus
aguucgagauaaacugcucgaacccgggcgacaugggcgcugcgcagagccccaagcccauuccgccgcccccucuggcggucgccgccgucaacaugcgcugcgccaucaaccccaagacccugcagaacgagaucgucaugauuuccugccucacgcacaccagauacgcccuggacaagcagccucccaagccgccuuuugaacaccauuuuugcguguugacuuguccgaaaaguuccaugaugccucuggacuuucacaagcaacugggcaacuacaaggccaccaaaguccaaaaaauggacucggaaaaggcccuauuaaacuacuucaucaaccaauucagccgcauagaccccgacuuggucgugggucacgauuugcagggcuaccaaaucaacgugcucuucgacagauugaaagcgaacggcaacgccgcggccgacaaaaucggcagaaugcgccgggccgacaaguugaagaacgagcgcguucuuuuugucgguagauuaguuugcgacuuaaaaagaucggcuaaagaguugaucaaaucgcggucguacgacuuggacgcccucugcucggcgguguuaagaguuaaggaggguuuaaggguggaguuggagcccgaggaugugcccaagauguaccaaaccucggagaauauccucaaguugguaucuuucacgaugcaggauacuucguauauacuucaaauuauguacgacuugaacgucauacc

SEQ ID NO: 4854 - RNA, 630 nt, Meligethes aeneus
aaguaguucauaccgugacguugcacgaaaucgacgucaucaacuccagaacgcacggauuuuuggcuuuauucuccggggacaccggagaaaucaaaucugagguuagggagcaaaucaacggaaaaguggccgaauggcgcgaagaaggcaaggccgaaauuauaccggguguucuauuuauagacgagguccacauguuggacaucgaguguuuuucguuuuuaaauagggcguuggagaacgauaugucccccauuguuaucauggcuaccaacagaggaauaaccaagauaagagguacuaauuauacuuccccucaugguauaccgcuggauuuguuggauagaaugauuauuguucccacuucuccauacaaugagaaggagaucagggagauuuugagcauccguugcgaagaagaagacugucagaugucggagaacgcgcugggcgugcugacgcgcauagccaaagaaacaucuuugcgguacggcaugcaacugaucaugacguccagccugauaucgcgcaagcgcaaggcgcaagaaaucgacgucgaagacaucaaacgggccuaccaacuguucagcgacgauuccaggucggugcaguuccugagggaguacc

SEQ ID NO: 4855 - RNA, 749 nt, Meligethes aeneus
acuaagagccacagaaguugaggauauaauugagggaaaugaugauaaguauaaagcugucucggugcacaccagcgauccgccgcugguaagggagggcaaaacaaaaaaaaacaugcagugggugccaucguugcccaauuccagccaucuggaugcgguaccgcaagcaacacccauuaaccgcaaccgcguggcugcaaaaaaaguacgaacuuuuccgcuuuguuucgacgacacugacccugaaauuaacgcugaaaacgcuugucagggggagcuacuggugccgauuagguuggacauggaaaucgagggucaaaaauugcgcgacacuuucacguggaauaaaaacgagagucugauauccccagagcaguuugcugaaguauuaugugaugacuuagauuugaauccucuuacuuucguuccugccauagcccaggcuauuagacagcaacuggaggcuuucccccccgaacccccugccauuauggaggagucuugcgaucagaggguuauaauaaagcugaacauccacguggguaauacuucuuugguagaccaaaucgaaugggacaugagcgagaaaaaaaacaaccccgaggaguuugcuuugaaguugugcgccgaauugggguuggggggggaguuugucaccgcgauugcuuauucuguucgcggucaaauaucauggcacgccagaaccuacgcuuuuuccgaggccccauuaccaacaguggagguuc

SEQ ID NO: 4856 - RNA, 499 nt, Meligethes aeneus
aauuggugauuguuggugacggggcauguggaaaaacgugccuuuugauuguguuuagcaaggaccaguuuccugagguguacgugccgaccguguucgaaaauuauguugcggacaucgaaguggacggcaagcaggucgaguuggcguugugggauacggccggacaggaggacuacgaccguuugaggccccuuuccuacccggacacugacgucauccuuaugugcuuuuccgucgauucucccgacuccuuagagaacauaccggaaaaauggacaccggaaguuaagcacuucugcccaaaugugccaauaaucuugguaggcaacaagaaagaucugcgcagcgauccgucaaccauuaacgaguuaaaaaagaugaaacaggaaccuguaaaaccacaggacggccgcuccauggccgaaaaaauuaacgcguucgcuuacuuggaguguucggccaaaagcaaggagggcguccgagaaguuuucgagaa

SEQ ID NO: 4857 - RNA, 753 nt, Meligethes aeneus
gguuaacaguggacagugauauuuauguuuggaccuaugaagaaaacucugauuuagcuuauuucgaugggaucaacgaaaccauuuugugugugggauuaguaaaacccaaaccaggaguuuuucauaauuucauaaaauauuuguugguucuuacgacgucaguggauauuguuguguugggaguuacuuuuacugaaggggcugagggggauaaugaugagauacagcuuauaccugauccuguguucacaauuucaacagauggcgccacaauauccaccauuucuggcacugacucuggaagauuguuuuuggguuccaaggaagggaaucuauuugaaaucuccuaccaggcugaaagugguugguuuggaaaaagaugcaaaaaagucaacuuaucgaccaguucucuuucauuucugguaccuucauuuuuaaaugcagcccuuagcgaggaggauggcaucgcucaaauugcaaucgauaacaccagaaauauacuuuacauuuuaacugaaaaaggauccauugaaguuugcgacuugggagaaaaaggaaauacguuuucuagaguuaccaaguuaucgcaggcucaacuuguaucucaagccaugaccacugucaaaacguuggacagccaaaauuuccgccccaucgugagcauauccgccguggaggcaugcgacucggccaacguuaaccugguggccguuucucaaacuggcgugcgauuuuacauguccgugguga

SEQ ID NO: 4858 - RNA, 662 nt, Meligethes aeneus
ggugcuggcaaaaguuuuauucgugcuguguccaauaucacguggccggacuaaaaccgcuaggucugcuacuacuuccugcuguuucgggagcuguuuuccugaaaaaauccacuuuuucguucuugcggccuuuagaaccuuuggagcacaugaccuuguguggcgauuacauguacaaagaccaauucguggaauauccacuauuaggcgaugauuuggacaacaugggcgacguuaugagccuauuucagguuaucguuuacuuggaacagcaaaugagcgacauuuuccugacaacguuugaaaaagaaauggccacucuucaaucccccgauguuauaaugucaaaguuacuagaaaaaauucacacggaaauggacagugaguucacaaaucaaguguccgguauguugggucaauguugcgaccucuacaaggcgguucacaaaguucucgaacuucuccgcuaugaaaaucucaacacaugcgauucugauguuaauccuuucgcgcuucaucacuucaguucucacuugggggugucgguuguggccgguugcauacgucagcaagcugucacccgguucucgauuugccggaauuuauuguugauuugcaacauucuuuuguacagaaaagaauuggaauggggcauuuug

SEQ ID NO: 4859 - RNA, 750 nt, Meligethes aeneus
uuccaaggaauccuacaagcugacauucaagaguuuauucccuacguuuuccaacuacuaucucugcucauggaaaacacgcccccuggugccgugccugaaacguacaugcagcuguugccauguuugcuggcuccaguguugugggaaagaccagcaaauauuucccccuuggugcgguuauuaagcgcuuuugcaacucaggccgcgccucaaauugucgggcaagauaaauuggguggauuuuugggaguuuuucagaagcugauagcuucaaaauccaaugaucaugaagguuuccauuugaugagguguauaauacaaaauguuccaacugaagcuuuacaagccuacaugaaacaaguauucuuucuacuuuuccaaagguuaucaucaagcaaaaccacaaaguuuguuauaaauuuaauuguuuucuucuguuuguaugcuguuaaauauucagcaaacgauuuggucguuacuauugacggaauucaggcacagauguuugguaugguucuggaaaaaauccuuaucccagauuugcaaaaaguugcuggcaacguugacagaaaaauugucgcuugugguaucacaaaguugcugugugaguguccagaaauguacacagggacguaucaaaaauucuggccccaauuauuacaggcauuaaucgcauucuuugaaaugccaguagaugaaacaagucucccagacgaucauuucauugaaaucgaugacacuccaaca

SEQ ID NO: 4860 - RNA, 474 nt, Meligethes aeneus
ugaacccuuuucaguucgaaaucacguucgagugcauugaggaacugaaagaagauuuggaauggaaaaugauuuacguugguucggcagaaagcgaggaguacgaucaagucuuagauuccguauucguaggccccauaccugaaggaaaacacauguuuguguuucaagcugacccaccaaauguaucaagaauucccgaaaacgaugcuauugggguuacaguuguucuauuaacuuguuccuacagaagccaagaguucauacgagugggauauuuuauuaauaacgaauauagcgacccagaguugaaagaaaauuccccgagccccccucaguuugauaaagugaugaggaacauauuggcuucugagccgaggguuacaagguuuaaaauuaacugggaggagccgaaucagcaggaaaauggucaggguucgggggaaaaucaggcacaaacaucuagugucgagg

SEQ ID NO: 4861 - RNA, 652 nt, Meligethes aeneus
ggacuaaccccaacuuuaggccuaggaauggguaugucgaugccaacucgauauguuccagguuauggcagcaguuugcagucucaaacgccgcaacauacgaugaugucgccuaugauaaacuuaggugguaccaguggagguccaggggccacaccuaguaguaauauggggccugcgacaccugcaaccccugcuacaccucagaccccacauucccaggauccagggauuguuccccaguuacaaaacauuguuucuacaguaaaccuaaacugcaaacuggaccugaaaaaaaucgcgcugcacgccagaaacgccgaauacaaccccaagcguuucgcggccgucauaaugcgaauccgggaaccucgaacgacagcccugaucuucuccuccggcaagauggugugcaccggggccaaaagugaggaagacucgcgguuggccgcgcgaaaguacgcgcguaucauccaaaaguuggguuuuaacgccaaguuuuuggauuuuaaaauacagaacauggugggcaguugugacguuaaguuccccauaagacuggaggguuugguguugacgcacggcucuuuuagcuccuacgagccggaguuguuccccggauugauuuaccguauggugaaacccaggauug

SEQ ID NO: 4862 - RNA, 332 nt, Meligethes aeneus
guuauuccgacgaaaugagcuucacuuuggccuccggcaaccagguguucuacgaugccaaaucaguuaagcaagucgacgugccgucuuucuccggcaguuuugguauuuuacccaaacauguacccacucuggcuguauugaaaccaggaguaguuucuguuaucgaagauagugguaauguuaaaaaaauauucguuuccagugguacagucacaaucaacgaagauucguccguacaaauuuuggcggaagaagcccauccuguggaaaguuuggaccguucugcugcccaggagguuuuaaguaaagcucagagcucuaugucgucu

SEQ ID NO: 4863 - RNA, 672 nt, Meligethes aeneus
aaaauaagcagggaugcucacgaggcugaacuuaaacuaaaaaaggaaaaagaggcaguuaaaaaagcugcaucugccaaaaaacaagaagcugaaguuguuaaaccagcugaaauuaaggaauugacugaugcugaagcugaacagcugcaggcugaguuaaacgcuaaaaagggagggucugaagcugcaccugcuaaagcugaagaagggaaaggcaaugaugaagaagaggaggaugaagcugaaaaaggaaaauugaaaccaaaugguggaaaugguugugaucuggaaaaauauaaauggacacagacucuacaggauguugagguuaggauuccauuaaacgucaacuuuagggcgaaacaaaaagaucuggucguuaaccuaacgaaaaaacauuuaaccgucggugucaaaggucaaccucccauaguggacgaugauuuucccuacgaaaucaagcuggaggaguccacaugggugauagaagacgguaaaaguuugcuaaucaauuuagaaaagauaaacaaaaugaacugguggaauaaauuggucaagucugauccggaaauaagcacgaaaaaaaucaacccggaaccgucgaaacugagugauuuggauggggaaacccguggacugguugagaagaugauguacgaucaaaggcaa

SEQ ID NO: 4864 - RNA, 317 nt, Meligethes aeneus
cgcgaaagauggguauguauuuauccagcauacaucaacaguaaaaaaacuuuagcucaaggcagaagaauaucaaaagaaaaaugcgucgaaaacccaacacaucaagaaauaagagauguguugcuggcagcaaacuugaaaguuggaguggaaaauaaaauuuacucaagagaaagaaguaaggagcuuuuguaccgugguagaauaagagugcaauuaaagaaugacgaugguucuuuauucaauccaaguuuucccuccagagagaguauuaugcuucauuuaggagacaugauuccuaagcugaagacacg

SEQ ID NO: 4865 - RNA, 662 nt, Meligethes aeneus
aagcccaagacuaugaaaggacaagacaaguauacaaagcuuguuuagacuuacuaccucacaaaguauucacauuuucaaaagucugguuauuauaugcaaaauucgaaauaagacaaaagaauuuaaccacugcuagaaaaguauuggggauguccauuggcaugugcccaagagauaaacuguuuagaggauacauugaguuggaaauucaguugagagaguuugauagauguagaagauuguaugagaaguuuuuggaauuuggaccugaaaauuguguuacauggaugaaauuugcugaacuagaaacauuguugggugauguggauagagcuagagcuauuuaugaguuagcaauuaaccaaccuagguuggauaugccagagcucuuauggaaagcuuauauugacuuugaaauaucacaggaagaaccugaucaugccaggcgauuguaugagagauuacuugaacgaacaaaccaugugaaagucugguuaucuuaugccaaauuugaauucaacaaccauucagaagaugagauaaauauaggucuagcaagaaggguguuugaaagagccaaugaaacacuaaaaucuuguguagauaaagaauccagagugcuucuuuuagaaaacuggaaggaguuugaaaacacccau

SEQ ID NO: 4866 - RNA, 619 nt, Meligethes aeneus
agccagaaagaaagauccaauucagagagaaaguacuguggacugcaaucacccuauucaucuuuuuaguauguugucagaucccacuuuuuggaauuaugaguucagacucagccgauccauucuacuggauucgugugauucuggcuucaaacagagguacccuuauggaguuggguauuucacccauuguaacaucuggccugauaaugcaacuuuuggcuggugccaaaauaauugaggucggugauacaccaaaagacagggcuuuguuuaauggagcacagaaauuguuuggaauggugaucacagugggucaagcaaucgucuacgugaugaccggcauguacggcgacccggccgaaaucggcgccggagugugucucuugauuaucauacaacuuuucgucgccggucuuaucgugcuccuccucgacgagcuccuccaaaaagguuacgguuugggguccggcaucucucucuucaucgccacgaacaucugcgaaaccauaaucuggaaagcguucucucccgccacggugaacaccggaagaggcacugaguuugaaggcgcggucaucgcucuauuccaccucuugaccaccagacaagacaaaau

SEQ ID NO: 4867 - RNA, 337 nt, Meligethes aeneus
gaccguuuauuaagggguacaacuacuuuauauauugguaauuuaucguucuuuacaacagaagagcaaauuuaugaguuguuuucgaaaugcggcgauauucggcguguuauaauggggcuggacaaauacaaaaaaacgcccuguggguucuguuuuguugaguauuauaacagagcugaugcugaaaauugccuaagauacauuaacggaacccgauuggacgauagaaucgugagaaccgauugggaugccgguuuuauugagggaaggcaauauggaagagguaaaacuggaggacaaguuagagaugaauauagaacugauuucgauggcg

SEQ ID NO: 4868 - RNA, 651 nt, Meligethes aeneus
ugcccuggauagaucaguuaaagcuucugauuuagaauugcauccaccaaaaaacccauggagucaugauggaauucuuaguucgcuugaucaugcagguauaagaagaggcuacgaaguauacaaacaagugugcgcugcgugccacuccaugcgcuucaucgccuaccguaacuugaucggcgugucgcacaccgaggccgaggccaaagccgaagccgaagaaaucauggucacggacggacccgaugagcuuggcaacauguucaaacgcccaggaaaacuuuccgacuacuucccgagccccuaccccaacgaagaggcugcgcgcgcagccaacaacggcgccuauccacccgaucuuagcuacauuguugaugcacgucacggaggugaagauuauaucuuugcccuguugacuggauacugcgaucccccggccggcgcaguuaucagagagggucaauacuucaaccccuacuucccggguggcgccauuuccauggcucaagcgcucuacaaugaagccauggaguacaccgacgguacuccagccacugccagucaauuggccaaggauguguccacuuuccuuaaauggacauccgagccagacuuugacgaccgcaagaggauguucauuaaagccgu

SEQ ID NO: 4869 - RNA, 752 nt, Meligethes aeneus
ugcuaguuuuggguaugcauuggauccuucagugaguggcgaaggagagaaacuuaagguugugggugcuaaagagguuaauagcgagucaacggaaauaacaacuguguuugagacuaccaaagugagaccuuuagauaagcgaaagcgcaagaaaaacaccgacgcaggcgacauagaaggguuccuuggcccguggggcggcuucauagacgagcaacgcaucaugaaaccgaccgaagaggaagccaucgagcucgaagaacucguaucgaagaaaacgaaacgcggcaaagucgucgaagagaagccgaucgaggaaaaaucgguguugcacaucaaggacgcgcuggauuaccagggccgcucguuccugcacgcgccgcaagaugucggggucaaccugcgcucggacucgccgcccgagaagugcuuccugcccaagucgcacauacacaccugguccgggcacuccaagggcaucgcggcccucagaugguuccccaggacggcgcaucuauuccuaucggcuuccauggauugcaggauuaaguugugggagguguacaacgaacgcagaugcaucagaaccuacuacggccaucggcaagcggugagggacauaaauuucaacaacuccgguaagcacuuccucuccgccgguuacgacagauacaucaaguugugggacaccgaaacgggacaaguuuugucccgcuucacggcccgcaaaauucccuacugcgugaaau

SEQ ID NO: 4870 - RNA, 231 nt, Meligethes aeneus
ccagcuuguugagguuagaucuguccccagaguccaccugcgucagcgcgacggccgagcaagucuuacgucucaccagcaaucccaagcgggcuuugccuuucacgaugcaguacgguacccccaucuuccugcagagggcaggcaagaacaaaaccagcucaauugggucgacaucgugggcgaugaccaccaauugggcuuuuuucugcucaaucagcuuugugaccg

SEQ ID NO: 4871 - RNA, 735 nt, Meligethes aeneus
ggcgcuagaauugaugaguauuaacacuaaaaaucaaaaagugauagacuuuauaguaaaaugucaggacccugagucuggagguaucagugggugcaucgaucacgacccccauaugcuacacacguuaagugcggugcaaaucuugguuacaauggaugaaguaaaugccauagacguagaggggguuguaaaguacguugugaguaaccaacaggaagacgggaguuuuacaggggauaaauggggggaaguugauacacgguuuucuuuuaccgcuguggcaacacuggcuuuauuaaaucguuuggaugccauugauguuaaaaaagcuguugaguuuguacagucguguaugaauuuugauggcgguuuuggcuccaggccuuuaucggagagucaugcaggacuuauuuauugcuguuugggguuuuuguccauuacaaauagucuucauauuguugaacaagacacucuggcauggugguuaugugagaggcagcuuucaucgggugggcuaaauggcagaccagaaaaacucccagacguauguuacucuugguggguguuaucaucucuaucaaucuugggaagaauacacuggauaaaucacucugcaauccaaaauuacauaaaagcaugucaagauguugaaacugggggcuuuuccgacagaccuggaaaugucacugauccuuaucacacauuauuuggccuggcaggguuagguuuauu

SEQ ID NO: 4872 - RNA, 717 nt, Meligethes aeneus
ugggggaaauagucauguugcccgaauggcugccgguuugcagcucaaaaaccaacuuacaucaaaagaugccaccaacaagguugucuaucagcagcgcuggcuugcuuuccccgaagaagugaggaguuacaucaaaaagaauguggugggugcccucggaaccgaaacaaaucguccaucuucggcggcgcagugcgucgcguacaucgccgucgcggaacuuccgcagaaacaauggccggauuuaauucaaacguuggucaacaacgugugccaugcaaauucuaccgaaaugcagaaagaggccacccucgaggccaucggcuacaucugccaggaaaucgauucggacgugcucgugacgcaagcgaacgauauucucaccgcuauuauacacgguaugcggguauccgagcagaguaaccacgucagauuggccgccacgcaggcucuauuaaauucguuggaguucacgaaaggcaacuuugaucaacccacugaaagaaauuucauuauggagguugugugcgaagccacgcaaucgcccgauucgcagaucaaaguugccgccuugcagugucucgucaagauuaugucucucuacuaccaguauauggagccuuacauggcgcaggcucuuuuucccaucacucuagaagcaaugaaaucggagaaugaugccguuucguugcaagguaucgaauucuggucgaa

SEQ ID NO: 4873 - RNA, 764 nt, Meligethes aeneus
gauggacuuggacaaagacuuacaagaagaagccgacaguauuauaaauauuugggagagcgguacuguuccaggauggccaaaagagacugguucagcauuggcaaauguuggugcacauuuggaucuuucagcauuuucaaguugggaggaauuggcuucuuugggucuggaucguuugaagucggcuuuauuggcuuuaggguuaaaauguggaggaaccuuggaggagagggcacaaagauuguuuucaacaaagggaaaagguucuuuggauccaucauugaugacuaaaaauaauaagggaaaagccaauaaggaaaaagaacaacugagacauagggaccuugcuauguuggaagcucagauuuauagacuggccgauuuaguguccacucaaaggggagcaacaaaagaaaauguucaaaggaaacaagccagaacugacggagaaagaaacgacagugaaaaugaggaaagugaagaggauagucccgaugaaggugacgaugaugucccauauaaccccaaaaauuugccauuggggugggauggaaaaccuauuccuuauuggcuguauaaauugcaugguuuaaauaucagcuacaacugcgaaauuugugguaauuuuguuuauaaggguccuaaagcuuuucaacggcauuucgcggaauggagacaugcucaugguaugaggugucuugguauuccaaacacggcucauuuugccaauguuacgcaaauugaggaugcuauugcuuugu

SEQ ID NO: 4874 - RNA, 499 nt, Meligethes aeneus
gucacucugcaagacucgcgaacguucauaggaacuuucaaagcguucgacaagcacaugaacaugauucucggcgauugcgaggaguuccgcaagauaaaagcgaaaaacuccaaaguggagcgggaggaaaaaagaguuuuagguuuuguuuugcugagaggggaaaguaucgucucucugacaguggaaggccccccacccccggaagaaggccucccgcgcguccccauaccuggagcagccccagggcccggaauuggcaaagcagccggccgugguaugccagcgggcauggcuggagucccgguggggcuccagggacccgugaggggcguuggaggucccucucagcaggugaugacgccuggaggcagggggcagguggcggcaccuccacaaaugaaucagggaccuccgagaauggggggaccaccuccaggcaugauggggcccccuccugguaugauggguaugcccccaaauauggggauggggc

SEQ ID NO: 4875 - RNA, 724 nt, Meligethes aeneus
acaugcucugcuauuuggaaagcuuuaagugaagaauauuuaccauaucccacagaacaaaguuggaaaaaaauugcuguugauuuugaaucaaaguggaauuuucccaauugugugggugcaauugauggaaaacaugugagaauacaagcaccucaacauucugguucagauuuuuuuaauuauaaagaauucuuuagcaugauauugcuagcaguuugugaugcaaauuaucgauuuacugugguugacauuggugcaaaagggagacaaagugauggaggaguuuuucgcaacaguacuuuuggaaaacaauuuuucucaaacuccauuaauuuaccugcuccaagaaaacuugcagaugaugaagaaccaacuccauacuguuuuguaggugaugcagcauuucccuuuggaguuaauuuaaugcgaccauacccuggaaacuuucuuccacagaaugaaagaauuuucaauuauagauuaagucgugcaagaagaacaauugaaaauacauuuggcauucuuguugccagauggagaauauuagaaaaaccaauuauugcaaagcuugaaacuauugaaaaaaugauaagugcacuuguaugucugcauaacuuuuugaggaaaucagacucagauaagguugacagcaacagguacuguccuucuaauuuuguggauagagaaacagaaacaggugaacuuaucgagggagaaugga

SEQ ID NO: 4876 - RNA, 707 nt, Meligethes aeneus
aguccagcuuuuucucagagcgucggacagccgcccagcaguccuaugagaaguucgccuaugccaagaagcccaaugguaaaccaaauccaaucaccgaugaguaugcguaguccagcaaugccggaaagaccaacuagcguggagaauccuggaacaccaagaaccccuuauaacccccaaaacguggagaacaugcaggaaaauaacgucuccaacaccacuacagaugguggcggcgguaacccgcgcaaccccguaaauccaauaccguuucccuuuggaagguuugggucauuuaaguuggguuugagggguggaucuccaaugugggguggcuuuggccggggggcuaaaagagucccaacgccaccugugacuucuaccggcgugggugcuugcguaucuaaaccgauugcugcaacgaaugcguugguagauucggcaacuucccaggugccgccuaaaccaaagaaagaaucccauuauagcaaaguaucgauucuuaagaaaaaaucugcacccacaauaaccaacaggcaaucuuuuguggccaauaaagugagcucacuuguuaguucagauuauaacgaauucgaugacaguucgucuacuccaccaguaacuccuccaccuucaucuucgaccagcaggaaugucguucagaaaacgauacauaaaaaaauugccgaagaaaccaaagaaaa

SEQ ID NO: 4877 - RNA, 748 nt, Ceutorhynchus assimilis
agguugagaagccacauaagaauucaggaugguagagccaagccuauugaucuacuagcaaaguauaucagugcagaagaagaaguagaugcuguagaaaugcacgaaccuuacacuuaucuuaauggacugcaaauaaaagauuuagaagaucuuguagaagauaucaaaguauauaaagaguuagagaggggcaagaauuuagacuacuggaacgauauuacuguaauuguagaagaugagcuucaaaaauuaagaaaacugcaaagagaacaagauuuugaugcuggaauugguagacgcgaaggcauaaaucaagcaguagcccaagacguuacagcaguauucaaaggcaaaacagccauacaacuugaggaucuucaaaagcaaauugaaagcaaaaucaguggcaaaucugaugguauugacauaggcuauugggagucgcuuuugucucaauugaaagcucacauggcuagagccagacuuagagacagacaucaacuuaguuugaagagaaaacuucaaguauuaaaagcugaacaagcuguaacugugccugaaauaaaugcugaaaauaguaaucagucuucacaaaguccacaagaauccaaaccaggaacuucacaagaaucagcagacaaugaaagucaaagcgaugaggaaggugaaaauaaugaagaagcagccagugauauacucaaugaaugcuuuguugcuuaccaaaauggcaacuacaguccuaaac

SEQ ID NO: 4878 - RNA, 655 nt, Ceutorhynchus assimilis
ucgucuaugaucgugaaaccgggaaaccaaaagguuauggauucugugaauaccgugaccaagaaaccgcccugagcgcaaugagaaaucuaaauagcuacgaaaucggaggucguaacuugcgaguggacaaugcuuguacugaaaaaucucgaauggaaaugcaaaauuuacucaaccaaccacccauagagaaucccuauggagaaccgguucaaucagaaaaagcuccugaggcuaucaguaaagcaguugccucuuugccaccagaacaaauguuugaauugaugaagcaaaugaaagaaacuauucaaaacaaucccacugaagcuagacaaauguuauugcaaaauccacaauuugcuuaugcuuugcuucaagcacaaguaguuaugaaaaucaucgaugguuauacagcugcaucacuucuucauccuguaaaucaaguuccagcaacgcuuaugccuggagacaaaaacguuccuguucaagugccuauaaauagagaguuucaagcugcuccagcuccaguugcuccacccaggcaagaguuucaaccuguuccagcuccaauuauuauuccaaacaccaaucauagugcaccaguguuuacuaguaugaaugauguugauuucagagcuauggauccaagagu

SEQ ID NO: 4879 - RNA, 668 nt, Ceutorhynchus assimilis
gucuuucugagcaaauucgggaauuacgugaaguaauugaauugccucuaaugaauccugaauuguuuaugagaguaggcauuaccccaccuaaagguugucuuuuauaugggccuccugguacugguaagacuuuacuagcuagagcugucgccucucaguuggaugcaaacuuuuuaaaaguagucuccagcgcuauuguugacaaguacauuggagagucggcaagauuaaucagagaaauguucaauuaugccaaagaccaucagccuuguauaauuuucauggacgaaaucgaugcuauugguggacgaagauuuucagaagguacuucugcugaucgugaaauucagcguacccuaauggaacugcuaaaccaaauggauggauucgacucucugggacaaguuaaaaugauuauggcaacuaaccgucccgauacuuuagauccagcucuauugaggccuggucguuuggacaggaaaauugaaauuccuuugcccaacgaacaagccaggcuugaaauuuuaaaaauccaugcagggcccauugcuaagcauggagagauugauuaugaggcaauuguaaagcuuucagauaauuuuaauggggcugauuugaggaacguuugcacugaagcuggucucuuugcuaucagaucugaacgg

SEQ ID NO: 4880 - RNA, 653 nt, Ceutorhynchus assimilis
uaccaggucgaauacgcuauggaagccauuuccuuggccgguaccugcuugggaauauuagccaacgauggcauuuuauuggcugcagaaaggcguaauaccaauaagcuuuuggaugaaguuuucacuucagagaagauuuauaagcuaaacgaagauauggucuguaguguagcugguauaacuucagacgccaaugucuuaaccaaugagcugcgccucauuggccaaagauaucuguuccaauacggacagucaaucccuugugaacaauuaguuucuuggcugugcgacgucaaacaagcuuacacccaauaugguggcaagaggccuuuuggaguaucaauuuuguacaugggcugggacaaacauuauggcuaccaauuguaccaaucugacccuaguggcaacuacagcgguuggaaggccacuugcauuggcaacaauaguucugcagcaauuuccagucucaagcaggaauacaaagaaggcggcaugacauuaaaagaugccaaaacuuuggccaucaaaguuuugaguaaaacuuuggacaugaccaagcugacaucggagaaaguugaaauggccacuuugaccaggagcaacgauaaaacagucacuaguauucugacuggcaaagaaguugaagcauu

SEQ ID NO: 4881 - RNA, 668 nt, Ceutorhynchus assimilis
aaccaaaaaccccugaagauguuuacaaaucucauuuggaaaauaccagaccuucuuuuggagguagucaaguagauuccgcaaaacaaaaucuugcugcuaguuuugucaaugguuucguaaaugcugcuuuuggccaagacaaacuucucauggaagaugguaauaaguggcucuacaaaaacaaagaucauggcauguugagugcaacagcuucacuuggauuaguacuuuuaugggauguugauggggguuugacuccaauugacaaguacuuauacucuucagaagaucauauuaaaucuggagcacuucuagcaugugguauagucaacuguggugucagaaaugaaugugacccugcucuugccuuauuaagugacuauguuaugcauagcgcuccgaucauaagaauuggugcaauauuaggucugggauuagcguaugugggcucuaacagggaagcaguacucggccuacuguacccaguauuuuccgauaaaaguucuaauauggaaguuauuggaauggcugcuuuggcuuguggaaugauuucaguugguucugaaaauucccaaguaacuacgauccucaugcagacauugauggacagaucugaagaugacuugaaggauacuuaugcuagauuuauaccuuugggaguuggc

SEQ ID NO: 4882 - RNA, 730 nt, Ceutorhynchus assimilis
aaacugcacaguacucgaauaacggacaguauccaccggaugguucucaguauuugcagcaacaucaguacaguaccaugcaguaucaguuggaacggaauagcggggaaaguccuccgauuuugaauaauaauguguuagugaggaauaaugaucccacuuuggcgucuuccagauaucaucaggaucuccgguuuucagcaagcaacuacgaacaacaauuaaaccaaaucacccugacagcaccccaaacgggccaaacguaccaaaucaguccagcgagcgcuggaucagauuccuggucgacguccaguaccgccacaacgcaguaccagcaaaccuaucaaggugcugccaacgugagcguccaccaagcugacagcaguacagcucaucaguacuacuugaacagcaacuggccagcgggcgcuuuggaggauggaggcaacaacguuucggcgcagaggucgccguccucagaggcuaacaauagaaggaaugggguggcaugugccaacuguaaaacuuugaacaccacucuauggagaaggaacaaccaaggagaaccuguuugcaaugcuugcgggcuuuauuucaaauugcaugggguaaaucggccaauaaguaugaaaaaagaaggaauccagacuaggaagagacgaccgaaaaacaauucuucuguucauaauggagcuggaguuucuggcaugccucaacgauuaagcaacac

SEQ ID NO: 4883 - RNA, 698 nt, Ceutorhynchus assimilis
caccacaacagauuggacuauaauuuucacuuuauuagagugcguaggggcaggcgcucagccuccaaaaccuguagcagacgauggcagcacuugcgcagaccaaucaaagucagauggcgaaaaucaaauaaacagcgacgaagaaaguguaguaucagacagaggcuacaccucagauucugaacuaacaaaaaaacaaaaagcaauucuggcaacuucucccuguggcacuccaaacacaggaggcuggauuuuggugggcaacgaaggcgaaauuguuggucgaacagugccuccgacacaauacggcauugcuuuggaaagaaauuuaggcccacacgauucaaugaguuugauaaaaugcugcgaaagcuuggcauuuuuaguuagagacguggcccacauaacaccguacaauuucgacauuugcguacaauguauaaggacuuuuguugaggcaagccuacaaacugacaacaaaaaacgcaaaagaaaagucgccucucguaggaaauccgaauuaagaaguccugcggcuaguaguccaagcuguagugaagaugacgauuuuccuagugguuaucaucacuugcuuuuagacuugaugcauacguugcacacgaggacugcccaaauuuucaaauggugggcggaggaaggcggcgaaaucgcucaagaaaugucacuguggacuc

SEQ ID NO: 4884 - RNA, 468 nt, Ceutorhynchus assimilis
gaagauucgguauccaagcucaaacccuagcaacaaauuucgaaaaagucuucgaaauggggccccaucucuacgucggucugcccggcuuagccaccgauacccaaacagucagagaaaaacugcgguucagaaaaaacuuguacgaacucaaagaaaacaggcugaugucgcccaaaguauucagcgcuaugcugucucauaugcuguacgaaaaacgcuuugggccguucuuuguagaaccuguaguagcugguuuagacccgaaaaccuacgagccauuuauuugcaauauggaucuuauugguugcaucaaucagccuaaagauuuuguuguaggagguaccgcuucugcacaauuguacgguaugugcgaggcuuugugggaacccaaucuagggccugaggauuuauucgagacuauuucgcaagcuuugauuaaugcuuuugauagggaugcuguuucug

SEQ ID NO: 4885 - RNA, 676 nt, Ceutorhynchus assimilis
gcaaaccuguaguacuggaaauauggcccauuuuauugaaagcuacagauaaguaccaaaaggauacuagaaccauggaaagguguuguaggaguauuagguuuaugcuuagaugugcuagucaacaaguaugugaaauauuggaaaguuuaguuagacaaauaauaaggcuuuauaacgagcacaaacauucuugccugcucuauguuggcaguauucuaguggacgaauaugcuccaaauucccaaugugugaacgggcuuuuagauauguuacagguauuuauugaacccacauuucacauguugcaacaagaagacggucuucgaaaucauccggauacuguugaugacuuuuucagauugugugcucguuucauccaacgagcuccaguuccacuacuccguugcaacgucuugguucccauaauccagugugcaauguuagcugccucguuggaccauaaagaggccaacauguccguaaugaaguuuuuuaacgaccucauuaaccaagguuugacuggacauucuuugcccgauuuugccgagagacaccagcuggucaaagcgauuuuggaccaauuaggacagcaauugguuaacgcuuuagugcaggcuugcguguuuuauuugcacacuuauaugcuaagcgaaguuggagauguuuuugugca

SEQ ID NO: 4886 - RNA, 662 nt, Ceutorhynchus assimilis
ccauuuaguugaauggcaccgaacacuuacaacacaagaaacagaugguuuccaggucaagaggccaggugauaaaaauguccgauguacgauacuucugcuuuuggauuaccagccuuugcaguuuaaacucgauccuaggcuugccaggcuacuuggaguacauacgcaaacccggccaguuauuauuucugcuuuguggcaguauaucaaaacccacaaguugcaggauacucacgagcgggaauauaucauuugcgacaaauauuuggaacagauuuuuaauuguuccaaaaugaaauucgcugaaauuccacaaagauuaaauccuuuauuacauccaccggauccaauuguaauaaaucacguaauuucaguggagggaggagccgaaaguaagcaaacugcuuguuaugauauugauguggaaguugaugauacauuaaaaacgcaaaugaauaauuucuuguugagcacugcgagucagcaagaaauucaaggauuagauucgaaaauucaugaaacuguugacacaaucaaucaguugaaaacaaauagagaauucuucuugaguuuugcuaaggauccgcaacaauuuauucauaaguggaucguuucgcaaacuagagaccuaaaaacuaugacggauguuguuggaaauc

SEQ ID NO: 4887 - RNA, 749 nt, Ceutorhynchus assimilis
guuugggcucauaaucuggaagaugaauuccgaacuauuagacagauuguccagaaguaccauuacguggcuauggacacugaguuuccugguguaguggcucgucccauaggagaauuucguaguucagcugauuaucaguaccaaauguugcguuguaacguugacuuauuacgcaucauucaguugggacugacauucuuggacgauaauggaaaaacgccugggggcaguuauacuacauggcaauucaauuucaaguucaacuugcaggaagauauguaugcccaagacaguaucgaccugcucacaaauuccgguauacaguucaagaagcaugaagaugaugguauucaaccuuuggaauuugcagaacuccuuaugucaucuggcauuguacuaauggacaauauuaaauggcugagcuuucacucuggauaugauuucggauaccugaucaaacuccuaacagauaguaaccuacccccugacgagaaugacuuuuucgauuugcugaaacuguauuuucccgcgauuuaugauguuaaauaccuaaugaaaucaugcaaaacacuuaaagguggccuucaagaaguggcggaacaauuagaacuagaaagagugggaccccaacaucaggcugguucagacucgcuuuuaacuggaauggccuuuuucaaaaugaaagaaauguucuuugaagauacuauugacgacucaaaauuuucuggacaucuauauggcuuggg

SEQ ID NO: 4888 - RNA, 800 nt, Ceutorhynchus assimilis
uucuccauuucgauucugcagucuauagauuuaaccaugcgggaaacgcaaguacuuugccugucgcccacaagagaauuggcuguacaaauucaaaaagucauucuggcucucggcgauuuuaugaacgugcagugccaugcuuguaucggugguacuaaucuuggugaagauaucaggaaauuggauuauggacaacauguuguuagugggacuccaggaagagucuaugauaugauucguagaagagcuuuacguacaagagggguaaaaauguuaguccuugacgaagcagaugaaauguugaauaaaggcuucaaagaacaaauuuacgauguguaccgauuuuuaccaccauccacacaaguuguacuuauuucugcuacccuaccucacgaaauucuggaaaucacaucaaaauucaugacagauccaauucguauuuuaguaaaacgugaugaauugacauuggaaggaaucaaacaauucuuuguggcuguagaaagagaagaauggaaauuugacacauugugugacuuguaugauacuuugacuauaacacaagcuguuauuuuuugcaauaccaaaaggaaggucgauuggcugacugaaaaaaugagggaaaacaauuuuacuguuagugcuaugcacggugacaugccucaaaaagagagagauaauauuaugaaggaguuuagaucaggacagagucguguuuugauuacuacugauguaugggcaagagguauugauguacagcaagucaguuugguaaucaacuacgauuugccaaacaaucg

SEQ ID NO: 4889 - RNA, 766 nt, Ceutorhynchus assimilis
gguaccaccucaguaguagucauugccggagcucuccuagaugccgcugaaagauuacugaaccguggcauucaucccacagcgauuucugaaucuuuccagcgagcagccgugcaugcuuugcagauuuuaaacaacauugccaccccaguggaacuaaacaaccgagaacaacuaaucaaaacugcagcaacuuccuuaaauucaaaaguagucucucaacaaucuagccagcuugcuccauuagcuguagaugcuguacuaagaauuguugaaccaggucgugaagcugccuguaaucucagugacauaaaaguccucaaacaacuuggcgguacaguggaagacaccgaacuuaucaacgguuuaguguuuccgcaaaaguuggccaacguuucugguccaaaaaggauggaaaaggccaaaauuggucuuauccaauuuuguauuucaccuccuaaaaccgauauggaccauaacauuguuguuucggauuauuccgccauggauagaguucugaaggaggaacgugcuuacauuuugaauauuguuaagcaaauuaaaaaggcuggauguaauguuuuauugguccaaaaauccauccucagagaugcagucucugacuuggccauccacuuuuuggacaaaaucaagugcauggucaucaaggacauugaaagggaagacauugaauucguuugcaaaaccuugaguugccgucccauugcuucucuugaucauuuugucgccgaaaauuuaguauccg

SEQ ID NO: 4890 - RNA, 653 nt, Ceutorhynchus assimilis
ggucaucggccaauuuuuagaggcuguagaccaaaacacuggcauagugggauccacuacaggcucaaacuauuacgucagaauucuaucgacuauugacagggaauugcugaaacccagcgccagcguggcucugcauaaacacagcaaugcgcuggucgacgucuuaccaccugaagcugauucuuccauaagcaugcuucaagccgacgaaaaacccgaugucagcuacggugauaucgguggcauggacaugcagaaacaagaaaucagagaagcuguagaacugccuuugacgcacuuugaacuuuacaagcagauuggaauugauccuccaagagguguuuugauguacgggccaccuggauguggaaagacuauguuggcuaaagcuguagcucaucauacaacugcugcuuuuaucagaguaguaggaucugaauucguccaaaaauacuugggagaaggaccuagaauggucagagacguauuuagguuagcuaaggaaaacucuccagcaauuauauucauugacgaaaucgacgcuaucgcuacaaaacguuucgaugcucaaaccggugcugaucgugaaguacagagaauccugcuggaauuguugaaucaaauggaugguuuugaucaaaccaccaacg

SEQ ID NO: 4891 - RNA, 286 nt, Ceutorhynchus assimilis
gcucagugaccauuaagacaauguuggaggauuugggcauggacgacgaagaagaagaagcugugccucugcccaacgucaacucugcuauuuugcguaaagugcugcaaugggccacuuuccacaaggacgauccaccaccgccagaggaugaugaaaacaaagagaagcguaccgaugacauuucuucuugggacgcugauuuucugaaaguugaccaaggaacguuguucgaauugauuuuggcagcuaauuauuuggacauaaaagguuuguuggaugucac

SEQ ID NO: 4892 - RNA, 793 nt, Ceutorhynchus assimilis
augacugcaagcaauuaacggaaaaucaagugaaaacuuuaugugauaaggcaaaggagauucugucaaaagaauccaaugugcaagaagucaaauguccagucacaguaugcggugauguacacggucaguuccaugaccucauggaacuguucaggauagggggucguagcccggacacaaauuaccuauuuaugggcgauuaugucgaccgugguuacuacucaguugaaacaguaacacuauuaguugcccucaaaguccgcuacaaggaaagaauuaccaucuugaggggcaaccacgaaucaaggcaaauuacacaaguuuacggcuucuaugaugaaugcuugagaaaauacggaaaugcuaauguuuggaaauucuuuaccgauuuauuugacuauuuaccacuaacugcucuaguugauagucaaauuuucuguuugcacggaggauugagcccuagcauugauaccuuggaucauaucagagcuuuagaucgucuacaagaggugccucaugaaggcccaaugugugaccuguuauggucggauccggaugaucgagguggauggggaauuaguccuagaggugcugguuacacuuuuggacaagacaucucggaaacguuuaaucauucuaauggacugacacuaguuuccagagcucaucagcugguuauggagggcuauaauuggugucacgauagaaacguuguuaccaucuuuagcgcacccaauuacugcuacagauguggaaaucaagcugccauuauggaauuggaugaugcacu

SEQ ID NO: 4893 - RNA, 722 nt, Ceutorhynchus assimilis
agaccaacagcgucuuauuuuugcuggcaaacagcuugaagauggcagaaccuuaucugacuacaacauucaaaaggaauccacucugcauuugguacucagacugagaggugguaugcaaaucuuuguaaaaaccuugacugguaagaccaucacccuugaaguagagccauccgauaccauugaaaacgucaaagcuaaaauccaggacaaagaagguaucccaccagaccagcaacgucuuauuuuugcuggcaaacaacuugaagauggccgcacccucucagauuacaacauccaaaaagaauccacgcuucacuugguauuaagauugagagguggcaugcaaauuuuugucaaaacuuugacuggaaagacuaucacccuugaaguugaaccuucugauaccauugagaaugucaaggccaaaauccaagauaaagaagguaucccgccagaccaacaacgucuuaucuuugcuggcaaacaacuugaagauggccgcacccucucagauuacaacauccaaaaagaauccacccuccauuugguauuaagacugagaggugguaugcaaauuuucgugaaaaccuuaacugguaagaccaucacucuugaagucgaaccaucugauaccauugagaaugucaaggccaaaauccaagacaaagaaggaaucccaccagaucaacaaagguugauuuuugcuggcaaacaacuag

SEQ ID NO: 4894 - RNA, 724 nt, Ceutorhynchus assimilis
ucgugagaaaugguaaagcaacaauaucgaaugauggggcuacuauaaugaaauuguuggauguuguucauccugcagcaaagacuuugguugacaucgcuaggucacaagacgcugaaguaggcgauggcaccacuagugugguuuuacuugcuggagaguuuuuaaaacauauuaaaccauauguugaggaagguguucauccuagaauuauuauuagaucuguccggaaaugcuuacaacuaugccuggccaaaauuaaugagauuucugugaaaaucaacaaagcaaaugugucagaauuucguucauuauuagaaaaaugugcugcaacugcaaugaguucaaagcuaaucaaucagcaacgaguauuuuucucuaaaaugguuguagaugcaguucuacuacuugaugaacuuuuaccacugaauaugauuggaauuaaaaaaguacagggugguggccuagaagauucuauguugguugcagguguagcuuucaaaaaaacuuuuucauaugcuggcuuugaaaugcagccaaagauuuauaaaaacugcaaaauugcuuuauugaauauugaauuggaguugaaagcugaaagagacaaugcugaagugcguguugauaaugucaaagaauaucaaaagauugucgacgcugaauggaauauacuuuacaagaaacugcaaaaaauccacgaauccggagcuaauguugugcuuuc

SEQ ID NO: 4895 - RNA, 650 nt, Ceutorhynchus assimilis
ugacuauguagacgcuuguguaauuucugugcuacaaauucauguaacccaacccuugggggacguuuuaguauuuuuaacuggucaagaagaaauugaaacuugccaagagucacugcaagaccguuugagacguuugggcuccaaaguaagggaacucauaauauugccuguauaugcuaauuuaccuagugauaugcaagcuaaaauauuugacccgacuccaccuggagccagaaaaguaguauuggccacaaauauugcagaaacuucuuugacaauugacaacauaauuuacguaauugauccaggauuugcaaagcaaaaucacuuuaacuccagaacaagcauggagaguuugauggugguaccaauuucaaaagcuucagcuaaucagagagcugguagagcuggccgaguggcugcaggaaaguguuuuagauuguacacugcguggucuuauaaacaugaauuggaagagaauacagugccagaaauucaacgcauuaauuuaggaaaugcuguuuuaaugcuuaaagcuuuaggcauuaaugacuuggugcauuuugacuuuuuggacccgcccccucaugagacauuaguguuagcucuugagcaacuguaugcuuugggugcuuugaaucaucaug

SEQ ID NO: 4896 - RNA, 765 nt, Ceutorhynchus assimilis
aagggcuauugguuugagaguaagagaaacuaaagaaauuuaugagggagaaguuugcgaacucucuccuguggaaacggaacaucccguuggaggucaagguaaaucugucagucauguaguaaucggccuaagaacagcaaaaggcaccaaacaacuaaaacuugauccgaacauuuaugaggcucuacaaaaagaacgagucgaaguaggagacguaauuuacauagaagcccucaguggggcuauaaaaagacaaggaagaucugaugcuuucgccacugaauuugauuuggaagcugaagaguacgugccucuacccaaaggagauguacacaaaaagaaggaaguuguucaggauguuacauuacacgacuuggaugcagcaaaugccaagccacaagguggucaagauguucuuucaaugauggggcaauuauugagauccaaaaaaaccgaaauaacugauaaauugagaaaagaaguuaauaaaauugucgacaaauacauugaccaagggauugcugaauugguccccggaguacuuuucaucgaugaaguucauaugcuggauauugaaacuuuuacuuauuugcacaaggcuuuagaaagugccauugcuccuaucguuauuuuugcuacaaaucgaggcagaugucuuauuagagguacugaugauauuuauucuccgcacggcauuccauuagauuuacuugauagacucuugauuaucaggacugugccauacgaucguccagauaugga

SEQ ID NO: 4897 - RNA, 676 nt, Ceutorhynchus assimilis
aaggaaaagguuacggucucacgauaacuccuuuaccagcaggccacaugauuggcggaacaauauggaaaauaaugaaagcaggcgaagaagauaucauauacgcuaacucauucaaccacaaaaaagagaggcacuugaacgguugcgaauuggaaaaauugcaaaggccuucuuuguuuauuacugaugcuuucaaugccaguuaucaacaggccagacguagagccagagaugagaaauugaugacaaacauuuuacaaacucuuagaaauagcgguaacguucuaauagcaguagacacugccggcaggguauuggaauuggcccacauguuggaucaguuguggagaaauaaggaaucagggcuuuuaacauauucucuagcacuuauaagcaauguagcuuacaauguugucgaguuugccaaaucgcaaauagaguggaugagcgacaagcuaaugagaaguuuugagggugcgaggaacaauccguuucaauuuaaacauuuaaauuugugccacagcuuacaggaauuaaauaaaguucccagcccaaagguaguuuuggcuacuagcccugacuuggaaauggguuuugcuagggaacuauuuuugcaaugguguucgaauucaaauaauaguguaauuauuaguacaagaacaucuccaggaac

SEQ ID NO: 4898 - RNA, 772 nt, Ceutorhynchus assimilis
aagaacguauagaagacggcgaagacaucgaaaugcaacuugaaagugacgacgaugaaccuacaaauguagauucaggccucagucauauggaagacagaacaggcccuacaagccguaaagauaacaaucaagugcaagauauggacgaggagaguucagaggaggaauaugaaagagaacagccacaacccauacaaccaccuaugccuccggcuuuggauaaagugguuguuaaaaaauaugauccuaaaaaacaaacaccaaaaguuacuagaccaacuccaggggaugauuauuuggugucgccaauuacaggagagaaaauuccugcuaguaaagugcaggagcauaugcggauugguuuguuggauccuagauggguggaacaacgugauaaacauguuacagacaaaaugaaucaagauacaguuuaugcucaagguccagccauagaggccaguuuaaaauuguuggcugaacgucguacugauauuuucggugugggagaugaggaaacugcuauugguaaaaaaauuggagaagaagaaagaagagaugaaaaggucacuugggacggacacacuucuaguguggaggcggccacuagggcugcaagggcuaauaucaccuuggaagaucaaauacaucaaauucacaagguuaaagguuuacuuccugacgaagaaaaagaaaaaaucgguccuaagaacuugcaaggcucaaacaaaaugaaaaugccaccggcuccgaucauuaaaccuccaccacc

SEQ ID NO: 4899 - RNA, 796 nt, Ceutorhynchus assimilis
aaaaucggcaacuccaaaagaguaguagggguuuuguuggguuguuggcgggccaaaggaguuuuagauguuuccaacaguuuugcagucccauuugaugaagacgacaaagacaaaucuguuugguuuuuggaccacgacuacuuggaaaacauguaugggauguuuaaaaaagucaacgccagagaacguguuguggguugguaccacacuggacccaaauugaaccaaaacgacauugcuauuaacgaauugguaaggcgguacuguccaaauucuguauugguaaucauugaugcggaaccaaaagauuugggcuuaccaacugaagcuuaccaagcaguagaagaaguucaugaugaugguucaccuacuucuagaacuuuugagcaugugccaagugaaauuggagcagaagaagcugaagaaguagggguggagcauuuacuaagagacauuaaagauacaacuguugguacuuugucucagagaauuaccaaucaguuauugggccucaaaggccuucacucgcaacugagagaaaucagagacuauuugauacaagucagcgaaucaaaauugcccauuaaucaucagauaaucuaucaguuacaagacauuuucaacuuauuacccgauaucaaucaauuggaauucaauaagucguuuuaugugagaaacaaugaucaaauguugguuguuuacuugucuacucuuguccgguccauuguggcuuugcacaauuugaucaacaauaaauugaccaacaaagaugccgaagaaggcaaaaaggaag

SEQ ID NO: 4900 - RNA, 759 nt, Ceutorhynchus assimilis
cccauugacaaaaacgacaaagccgcucuuagcaauguugucagagguugcguuggcaccaaauucauuggcaaaugguccgauuuggcagugaaaaucgcuuuggacgccguccauacugugaugcuggaggaaaaugguagaacugagguggacauuaaacgauaugccaaaguugagaaaauucccggugggucuauugaagaaucagaaguuuuaacuggaguuaugcucaauaaagaugucacucaucccaaaaugagacguuauauugagaauccuagaauuauuuugcucgauuguucuuuggaguauaaaaaaggagaaucucaaacuaauguugaaauuacuucugauggugauuuuacuagaauguugcaauuggaggaagagcacgucaggaggcaaugcgacgaaguuauagcccucaaaccggauuugguguuuaccgaaaaggggguuucagauuuggcucagcacuuuuuguugaaagcaggaaucagugcuauucguagaguaagaaaauccgacaacaacaggaucgcucgcgccuguggcgccaccauaguaaauagaaccgaagaauugcaagaauccgacgucggaacuggagcgggucucuuugaaaucaaaaaaaugggcgacgaauacuuuugcuacaucaccaagugcaaaaacccgaaagcuugcacaaucauuuugcguggugccagcaaagauaucuuaaacgagaccgaaaggaauuuacaagacgccuug

SEQ ID NO: 4901 - RNA, 550 nt, Ceutorhynchus assimilis
ggauuuaaucccuacgcugacaauggcgggaguguuguggcaauagcaggcgacgacuucguuauaaucggagccgacacgcgucugagugccggguuuucgauuuacacucgcgaacaaaacaaauuguucccauuguccaguaccacggucuugggcuguucugggugcuggugcgacacccucacuuugaccaggauuuugaagucucgcaugcaaauguaccagcaggagcacaacaaaacaaugucuacuacugccugcgcccaaaugcucuccacuaugcucuauuacaaaagguucuuucccuauuacauuuccaauguauuaguugguuuggauaaugauggaaaaggggugguuuacaguuacgauccuauuggucauugcgaaaaaagaacucacagagcuggaggaucugcgggugcucuauugcaaccacuuuuggauaaucaaauuggcaagaagaacauguugaaugugaaagaagaaccgguuucgcaacagagagcuuuguccaucauuaaagauguguuuauuucagcugcug

SEQ ID NO: 4902 - RNA, 736 nt, Ceutorhynchus assimilis
ccaagugcucuagaacaacuuaccagacucaauauaaauuacccaauguuauuuaaacugacaaauaaaaauucuggaagagaaacacacugugguguuuuggaauuuguugcugaugaaggaaaaguuuauuugccauuauggaugaugcacaauaugaaccuagaagaaggcgagcugguacaaauggaaagugucucucuaccugucgguacauuuuccaaauuccagccauuaucuccagaguuucucgacauuacuaacccgaaagcuguauuagaaaauugccucagaucguuugcuugccucacuaaaggagauguaauugccgugcaauacaaccaaaaaaucuaugagcuuuguguauuggaaaccaaaccagguaaugccauaagcauuauugaaugugauaugaauguagaguuugcugcgccugugggauacaaggaaccugaaauagugaggaaaccugaagaggaaauggcuguagauccugcugaauugaugccggagccuacuggauuuauagcauuuaaaggagccgguaauagauuggauggaaagaaacggaaggauucuacaucuacugauguuucgccacauaaaccaauauacgucagaggaauuccagacuaugacuaugaaauuggaaguuugagauucauuagagcaauagcaaaaccaaaaaauaaugauaauaaugaaagugaugaguuuaaaccguucucuggugaag

SEQ ID NO: 4903 - RNA, 718 nt, Ceutorhynchus assimilis
aaaugauggugucuccugacggugauguuaccguaaccaacgacggcgccacgauucuaaaaaugauggacaucgaacacgaaauuggcaaacuccuaguagaacuaucccaaucucaagacgacgaaaucggcgacgguacuacuggagucgugguacucgcuggggcuuugcuagaacaagcagccaguuuaguagaccgcggcauucaccccauaagaauagccgacgguuucgaaauggccugccaaacugccguagcucauuuggaaaaaaucgccgaacuuuucccgguuuccgccaccaaccccgagccucuuauacaagucgccaugaccacuuuagguucaaaaaucaucaacaagugucacagacaaauggccgaaaucgcagucaacgcugugcuagcuguggccgauuuggaacagaaagaugucaauuuugagcugauuaaagucgaaggcaaaguggguggcaaauuggaagacacuguauuaguuaagggagugguuaucgacaagacaaugucgcacucgcaaaugcccaaggagcugaaagauguuaaauuggccauuuuaacuugcgcguuugaaccaccaaaaccuaaaaccaagcauaaguuggauguuggugauguugccgcuuauaaagaguugagacaauaugaacaggaaaaauucaaagaaaugguuaauuuggugaaaaaugcuggagcuac

SEQ ID NO: 4904 - RNA, 208 nt, Ceutorhynchus assimilis
gguucgaagugaaaaaguggaaugcaguagcccuaugggccugggauaucguuguugacaauugcgcuaucugcagaaaucacauaauggauuuguguauagaaugccaggcuaaucaggccuccgcuaccagcgaagaaugcacugucgcuuggggcguuuguaaucacgcuuuccauuuucauuguaucucgagaugguugaagac

SEQ ID NO: 4905 - RNA, 652 nt, Ceutorhynchus assimilis
guuuggcucgacaauuaagguugacucuauggccaaaauugcagaacuagaauuagcagaaaaggagaaaaugaaagacaaaguaaauaagauucucaaacacaacgcuaacguuuuuaucaaucgucaauugauuuacaauuacccagaacaauuguuugcugaugcuggcguuauggcaauugaacaugcugauuuugauggcauugaaagauuagcauuaguuacugguggugaaauagucuccacuuuugaucaaccagaaucuguaaaauuaggaacuugugaucucauugaacaaaucaugaucggugaagacauuuuguugagauuuagugguguugccuugggagaggcuugcucuauaguuauucguggugcaacgcaucaaauuauugaagaagcugacagaucccuccaugaugcuuuaugugucuuggccgccacaguuaaagaacaucguguaguguauggaggagguugcagugaaacuuuaauggcuguugcuguuaguaaagcugcuuugaauacgcccgggaaagaagcuguugcuauggaagcuuuugccagagcucuucuacaacugccaacgauuauugcugacaaugcugguuacgauucugcgcagcuuguagcggaauuaagagcaucc

SEQ ID NO: 4906 - RNA, 673 nt, Ceutorhynchus assimilis
ucugcaccaagucgaauacgccauggaagcggugaaccuggguucagcuacuguggggcucaaaaguaacucgcaugcggucauuauagcccuaaaaagagccuccucugaauugucugccuaccagaaaaagaucaucaacaucgacgaucauauugguauuacuauaucagggcuuacugcagaugcaaggauuuugagcagauacaugagaacagaguguuugaauuauaaguacucucacgauacuuauaugccaaugaauagacuuauuacaacuuuaggcaacaaaaugcaaguuuguacucaacguuacgaucgucgucccuacgguguaggccuuuuaguugcugguuuugacgauaagggcagccacauuuaccaaacuugcccuucggccaacuuuuacgauugcaaagccaugucuauuggguccagaucucaaagcgccaggacuuacuuggaaaagcauuuggaucaauuauuaaacagcagcuuagaagaacuuauuaaacacgguuugagggcuuugagagacacccuuccuccagaaauagauuugucuaccaaaaauguuucuauugguuuuguuggcaaggaaaggcaauuuaagauuuuagaagaagaggagauugcaccuuauuuaggacuuauugaaggugaggagagaaga

SEQ ID NO: 4907 - RNA, 740 nt, Ceutorhynchus assimilis
gaaacuuguccagaagccuacugcaaaaaccucuacuuacucuaugccaaacuugaggaagauuacggaauggcccaucaugcaauggcaguuuacgaacgugccacacaagcugucucacaagauuccaugcuggaaauuuuuaauauuuacaucaaaaaggcaucgagcauuuacgggauaccaaaaaccaggcagauauaugaaaaggcuauuucugucuuaccagagaaggacauacgggauguuugucuaagauucgccgauauggaaacuaaauugggagagauugacagggccagggguguuuauucgcacuguagccagauuugcgauccuaggauuacaggggaauuuuggcaaacuuggaaggaguuugaaguuaaacaugggaaugaggagacuaugagagaaauguugagaauuaagaggagcgugcaggcaaccuauaauacucagguuaauaugaugucaguccaaauguugggaucauccucaccucuaggaacuacagccgauuuagcaccaggcgaaaaggauggaaugcgacuguuggaagucagagcugccgaaauggcuucuucuucaggugcucaaaaaucggcgaccagcgguauaauguuuguuagaggcgaaacucaaggagguaaaaaggauaaagugguuaauccagacgaaaucgauaucgaugccgacgggggugaagacgaagauggggaagaugaugaggauccugaacc

SEQ ID NO: 4908 - RNA, 689 nt, Ceutorhynchus assimilis
ucuugauguuggugccaauauauuuauugguaauuuagaucuagaaguugaugaaaaauuacuuuacgacacuuucucugcuuuuggaguaauacuucaaacgccaaagauuaugagggauccagaaucuggaaauuccaaagguuuugcuuucgucaauuucgccaacuuugaaucuucggaugcuuccauagaagccaugaauggacaauacuugugcaacaggccaauuuccguaucuuacgcuuucaagaaagauucaaaaggagaaaggcacggaucagcugcugaacguauuuuggcugcacaaaauccguuaucacaggcugacagaccccaucaacuguuugcagauucuccaccaaucggcaugaugccaccaggaaugacgacugcuccuccaccaccaccaggaauguugggucuaccgccacccucugugacacccaacacuacgauuccacccccaccgccugcuguucccccaccagcaucauuuccugcaggaauuccgccgccuccguuaccgcccucucaaccaccuuugccgccaauugcacccccaccgccuccagcuucuaagccaggugugaugaacccaccagcaccauggaaagggggguuggguaaucccccaccaccaccuguaccaccaguaucugauccaaacuucuccaaauugcuucugc

SEQ ID NO: 4909 - RNA, 553 nt, Ceutorhynchus assimilis
cacacgaaaaagaggaaaggggcgcccaaauugcguuacuuggacuuuuccgaaagacauggcuacaucaagggugucguuaaggacauuguucacgaucccggcagaggagcaccuuuggcuuucguacauuuccgugacccuuacaaauucaagacacguaaagaauuguucaucgcccccgaaggaauguacacuggacaauuugucuacuguggcaagaaagccaauuugcaaauuggaaauguauugccaguaggaaccaugcccgaagguaccauuguguguaaccuugaagaaaaaacuggugacagaggccguuuggcucgugccucugguaacuacgccacuguaauugcccacaaccacgacacgaaaaaaaccagagucaaguugccuucaggcgccaaaaaaguaaucccauccaacaacagagccaugguugguaucguagcugguggagguaggaucgacaaacccauccugaaagccgguagggcuuaucacaaguacaaggugaagaggaacugcuggccuaagguuagagguguug

SEQ ID NO: 4910 - RNA, 264 nt, Ceutorhynchus assimilis
gaaagcugcacguaaaagugccccggcuaccggaggagucaagaaaccucaucgcuacaggccuggaaccguugcucuccgggaaauucgccguuaucagaaaaguacugaauugcugaucagaaaacuuccauuccagcgcuuaguucgugaaaucgcucaggauuucaagaccgauuugcguuuccaaaguucagcaguaauggcuuugcaagaagccagugaggccuaccuggugggucuuuucgaggacacuaaccuuug

SEQ ID NO: 4911 - RNA, 686 nt, Ceutorhynchus assimilis
ccugauuggugaacucuugaagcaggcagacaucuacauugcagaaggccuccauccgagacuucuugcugagggcuuugauaaagcuaagaccaaagcuuuagaaguccuggacaaaaucaagauccccauugaaaucaauagagaaaauuuauuggauguuugcaggacuagucuaaggacaaagguucaucaaacuuuggcugauguccuuacagaaguuugugucgaagcagucuuagcgauaagacccaaagacaacaaaccuguugauuugcauaugguugaauuaaugcaaaugcaacacaaaaccgagacugauucaucauuaaucaaagguuugguacuugaucauggaucccgucauccagacaugccaaaacgucuggaaaauugcuacauuuuaacuugcaaugugaguuuggaauaugaaaagagugaagucaauucuggcuuuuucuacaaaacugcugaggagagagacaagaugguucuugcugaacgugaguuuauugaucagagagucaagaaagucauugaguugaagaaaaaaauuugcacugguaccaauaagacuuuuguuaucaucaaccagaaaggaauugauccuaugagcuuggaucaauuagcaaaggaagguauuauagccuuaagaagagccaaaaggcgaaacauggaacguuuau

SEQ ID NO: 4912 - RNA, 767 nt, Ceutorhynchus assimilis
gcucaugccaauagagaucauauugcccaaguagcugcuagcauugagguuccuguauuuguuccaagaucuggggugaaaauugcgguuacugauucacaaauggccgccaacgguaacaaugucgaccuggaucguauuacucaacuuacucaagaaauaccaaccagggauaaaauugauggugucauguugaaacccuuggacuucgagaaggaugaugacaccaauuuccauauggauuucauuguagcggcaucaaaucugagagcccucaacuacaaaauuccuccugcggauagacacaaguccaaacuuauugcugguaaaauuauuccagccauugcuacaaccacgucuguggucgccgguuuaguuugucuggaacuuuacaaauugauucgaucucaaagaagucuggaaccauuuaaaaaugguuucgucaauuuggcucuaccauucuuuggauucagcgaaccuauugcugccccacaaaaggaauauggcgaaaacaaauggacauuaugggacagauuugagauugauggagaaaugacuuuagcugaauuuuugcaauauuucaaagauaaacauaauuuggaaaucacaaugcuuucgcaaggcguuugcaugcuuuacucauucuucaugcaaaaagccaaagcucaagaacguuugggccuuucaauguccgaaguggugaggagaguguccaaaaaaaagaucgaaccucacguuaaagcucuggucuuugaauuguggugcaa

SEQ ID NO: 4913 - RNA, 729 nt, Ceutorhynchus assimilis
uccaaaaggaugaggaugugcugaaaaauaguuguccgcauauuguugucgggacaccuggcaggauuuuggcgcuuguuagguccaagaaguugaacuugaagaauuugaagcauuuuguuuuggacgagugcgacaaaaugcuggaguuguuagauaugagaagagacgugcaagaaaucuacagaaacacaccacacggcaaacaagugaugauguucagcgccacccuaagcaaagacauccgcccggucugcaagaaguuuaugcaagaucccauggaaguguauguggacgacgaggccaaauugacucuucacgguuugcagcagcacuacguuaaauugaaggaaaaugaaaaaaauaaaaaauuguucgagcuuuuggauauucuagaauuuaaucagguugucauuuuugucaaaucaguccaaagauguguggcuuuggcccaacuauugaccgagcaaaauuuccccgccaucggaauccacaggggaauggaccaaaaagaaagauuguccagauaugaacaauucaaagauuuccaaaagagaauauugguagcaacaaaucuuuuuggcagaggcauggacauugaaagagucaacauuguauucaacuaugauaugccugaagauucagacacuuaccugcacagaguugccagagcgggacguuuugguaccaaaggccuugcaaucacuuuuguuucagaagagagugacg

SEQ ID NO: 4914 - RNA, 770 nt, Ceutorhynchus assimilis
ugacuugauugcugcuaagugcuacuuuuaucauucuagaguagcugaauugucuaauaaguuggacacaauucgugcuuucuugcaugccagauugcguacagcaacuuugaggaaugacuuugaaggacaagcaguucuuaucaauugucuguugaggaauuauuugcacuauucacucuaugaucaagcagacaaguugguuuccaaguguguuuuuccugaaacugcuagcaacaaugaaugggccagguuuuuguauuauuugggaagaauuaaggcugcuagguuagaauacaguguugcucacaaacacuuggugcaagcuaugagaaaggccccccaaaacacugcuguaggcuucaggcaaacuguucaaaaacuuuuagugguaguagagcuucuucugggugauauuccugaaagacagauuuucaggcaaccugccaugcgucacucguugagcuccuacuuccaacucacucaagcaguacguaugggcaacuugcaacgauuuggagaaguuuuggaaaacuuugggccccaauucaggcaggaccauacuuauacauuaaucuugcgcuugcgccauaacgucaucaaaacugcucuuagaaguauuggccuagcuuauucgagaaucucuuugcaagauauugcacaaaaguuaggcuuggauucagcugaagaugcugaauucauuguggcaaaagccauaagggaugggguuauugaggccacauuagacgcugaggguggcuauaugagaa

SEQ ID NO: 4915 - RNA, 651 nt, Ceutorhynchus assimilis
uccccaguacauuuccaaugcuccuugguacuaugguacuagugggccuacgcucaagcaucaaagaccucaagaggagcaccagaagcaguuuucuggacuagacgagugguaccagagaggauuggacacaucaaaaauugucaccaaauuccgaaaaggugccugugaaaauuguggugcaaugacccacaaaaaaaaagauuguauggaucgacccagaaaaauuggugccaaauauuccaaauccaacauucugccagaugaauauguucagaaaaacuuggcguugaguuuugauggcaagcgggauagauggagcggauacgauccaagugaacacaaaacuguuauagaagaguuccaaaaaguugaggaagccaaacgccaacuaaaagcugagaaacuagaugcugagaacucagaugaagaggaaaaggaugaggacaaauauguagaugaaguugauaugccuggcaccaaaguggacagcaaacaaagaauuacugugaggaauuugcguauaagagaagacacugcaaaauauuugaggaauuuagauccaaauucugccuauuaugaucccaagacaagaucuaugagagaaaaucccaauccuggaguggaugagacacaccaaggagaaaacuu

SEQ ID NO: 4916 - RNA, 503 nt, Ceutorhynchus assimilis
aggaaguucgaauuaggacguccagcugccaauacgaaauugggagcccgcagaauccauuauguccguaccagagggggcaacaucaaguaccgugcccucagaauugacacuggcaauuucgcuugggcuagcgaagguacugccaggaaaacucguauuaucgacguuguauacaaugcuagcaacaaugaauugguucguaccaagacuuuggugaaaaaugcuauuguuguuguugacgccacuccguucaggcaaugguaugagacgcacuauauuuugccuuuggguagaaagaagggagcuaaacugacagcagaagaagaggcaauuuugacaaaaaagaggagcaaaaaaguccaaaagaaauacgaaaacagacagaaaaucgccaagguugaaccugcgauagaagaacaauuucagacugguagauuguuggcuugucuagccucaagaccaggacagugcggucgagccgacgguuacaucuuggaagg

SEQ ID NO: 4917 - RNA, 669 nt, Ceutorhynchus assimilis
aaguuaugggucucaugcugggcgaauuuguagaugacuacacuguaaggguuauagauguguuugcuaugccccaaaccgguaccggugucaguguagaagccguagauccaguauuucaagcaaaaauguuggacaugcugcgccaaacuggaaggccugaaaugguggugggcugguaccacucgcaucccgguuuugguuguuggcuuucaggagucgacaucaacacucaacagucuuuugaggcuuugucugaaagagcuguugcuguuguagucgaucccauucagucuguuaaagggaaaguuguuauugaugcuuucagguugauuaacccaaauaugaugguuuugggccaagaaccucgccaaacgaccuccaauuugggacaccuucaaaaaccuucagugcaagcucucauucacggccugaacaggcauuacuacucgauuagcauaaacuacaggaaaaacgagcuggaacaaaaaaugcugcucaauuugcacaaaaaaucuuggauggacggccucauguuggcugacuauucagaaaacuguaguaccaaugaaaaaacuguugcugaaauguuggaauuagccaagaauuauaacaaagcucuugaagaugaagagaaaaugacuccggaacaguuggccaucaaaaaug

SEQ ID NO: 4918 - RNA, 769 nt, Ceutorhynchus assimilis
gcgaaguagucaaaccaauggacaagaaaaaaguccuggucaaaguccacccugaaggaaaauucguagucgauauugacaaaaacaucgacaucaaugacgucacuccuaauugcagaguggcuuugagaaacgaaaguuacacucuacauaaaauacuucccaacaagguugauccauuggucucucuuaugaugguggaaaaagugccagauuccacuuacgaaauggugggugguuuggacaaacaaaucaaggaaaucaaagagguuauugaauugccuguuaaacauccagaauuguuugaugcucuugguauugcucaaccaaaaggcguuuugcuuuaugguccaccuggaacugguaaaacucuucuagcaagagcuguagcccaucacacugaaugcacuuuuauucgugugucugguucugagcugguacaaaaauucauuggagaaggauccagaauggugcgagaauuguucguuauggcucgagaacacgcccccucuaucauuuuuauggacgaaaucgauucuauuggaucgucucguaucgagucugguucaggaggugacucagaaguccaaagaacuauguuggaauugcugaaucaacuggacgguuuugaggcaacuaaaaacaucaaagucauuauggcgacuaaucguaucgauauucuggauccggccuuguugagacccggucguauugauaggaaaaucgaauuuccaccaccgaaugaagaagcccguuuggacauuuuaaa

SEQ ID NO: 4919 - RNA, 450 nt, Ceutorhynchus assimilis
agcuacuuucaaagaggcucugugcaagaauucauguuguuuugugcuaaaaccauugcugaaaggacaauaccagcuucgaggcaaucuguaaaagaaggcgaauacuuuugucauguguauguaagagcugacaacuuagcaggaguuauuauuucagaccaagaguauccuucaagaguaucucauacguugcucaccaaaauccucgaugauuuugcugauaaaaucccuucuaccaguuggccuaauuuacaagaaagagauguggcuuuuccgcaaauaaauaccuauuuagcaaaauaccagaagccagccgaggcagauauauugacaaaaauccaaggagaauuggaugaaacuaaaauuauauugcacaauaacauugcagcuguuuuggauaggggcgaaaaguuggacgaccuaguuuccaagucugaagguuugagu

SEQ ID NO: 4920 - RNA, 621 nt, Ceutorhynchus assimilis
uagguuccacugcuauaggaauaucuacaagccaagggguaguacuugcuguugaaaaacguaucacuucacagcuuauggaaccaacgacuauugaaaagauuguagaagucgauaagcauaucgguugugcuguaucuggccucauugccgauuccagaacuaugauugauagggcucgcaucgaaugccagaaccacugguuugucuacaaugaaaauaugacugucgagucaugugcucaagcaguauccaacuuggccauucaguuuggagauucggaugaugauggggcagcuaugucuaggccuuuugguguagcaauuuuauuugcugguaucgaugaaaaagguccccaacuuuaucauauggauccaucugguacuuuuguucaauuugaugccaaagcuauugguucuggcucagaaggugcccaacagagucugcaagaagucuaccauaagaguaugacgcuagaagaagccaccacuucggcacugacaaucuuaaaacaaguuauggaagaaaaauugaacucgucaaauguugaagugaugacuaugacuccugauaagcuguuccauauguuuucuaaagaucaaguagaagaggcucugacuc

SEQ ID NO: 4921 - RNA, 737 nt, Ceutorhynchus assimilis
uauuugaccagguuccagugggauaucgccaaguauccuaucaagcaaucgcugaggaacauugcugacauuaucagcaagcaagucggucaaaucgaugccgauuugaagaccaagucgacggccuacaauaauuugaagggcagcuugcagaguuuggagaaaaaacaaacuggaaguuuguuaacaagaaaucuggccgaucuugugaaaaaggagcauuucaucuuggacucugacuacuugcaaacauugcuuguaauuguucccaaggcucagguccaugaauggaacgcgaccuacgaaaaaaucacugacaugaucgugccaagaucgucucagaugguuacucaggauaacgaauacggccuauucacuguuacacuguucaaaaaagucauggacgaauucaagcaucaugccagagaaaagcgauucauuguaagagacuucacuuaugaugaagagcaauuggccgcgggcaaaaacgaaauuaccaaauuggccacggacaaaaagaagcaguucggaccguuggucagaugguugaaagucaauuucagugagugcuucugcgcauggauccaugucaaagcccuuagaguauuuguugaauccguauugagauacgguuugccagucaauuuccaagcaauccucauucaucccaauaagaagucaaugaaacgucuuagagauguuuugaaccagcuuuauggacauuuggaugguagugu

SEQ ID NO: 4922 - RNA, 656 nt, Ceutorhynchus assimilis
uuguaaagaagccugcagauauauucaagaucauuuaacuauuccuguagaggauuugggaaaggaauauauuaucaauguugccaagacuucuaugaguucuaagauuauuggagcugaugcagauuuauucucugcaaugguuguugaugcagcauaugcaguuaaaguuacagauguuaaagguaacccucuauauccaauuaaggcugugaacguacuuaaagcccauggacgaagugcuagagaaaguaccuuaauccaagguuacgcccuaaacuguacaguagccagccaggcgaugcccaaaaaaauuguuggcgccaaaaucgccugucucgauuuuucuuugcaaaaagcuaaaaugaagaugggaguccaaguacucaucaacgacccugacaagcucgaagcuguccgugcucgcgaacuagacauaaccaaagagagaauccaaaaagucuuguccaccgggguuaaugugauuuugugcucgggagguaucgaugauuuguguuugaaauauuucgucgaggcuggagcuaugggagugaggagagucaagagggucgacuugaagcguaucgcuaaagcuacuggggccacguuuuugacuucucugucaaacauggauggugaggaaucauuugaugcca

SEQ ID NO: 4923 - RNA, 621 nt, Ceutorhynchus assimilis
aguacaacccaacgauuucaggcaacacacucaaucuccagugacaacaucuacuucucuaguagcugucacuuacgauaaaggcaucauuaucgcuggugaucuuuuagcuucauacgguucacuagccagauacagaaauugcccaagaaucguuaaagugaacaacaacauaauuuugggcuccaguggcgauuaugccgauuuccaauacguucaaaauuuuauugaacaaaaagugauaagugaugaauguuuggaugacgguaucacccucaaaccgaaaucucucuacugcugguugaccagaauccuauacaacagaagaagcaaaauggauccacuuuggaauaauuuuauuguugccggaauucaagacggagagccuuucuuaggcacggucgacaaacaaggcacugcguacucugacaaaauuauuugcacuggcuacggugcucauauugccacuccuaugcucagagacgcucuggauaauaaaccucaacucacgcaagcugaagcuagagcucaaguugaaagaugcauggaaguuuuguacuaucgugaugcuagaaguuuuccuaaguaucaauuggggauuauugaugcugaucaaggugu

SEQ ID NO: 4924 - RNA, 764 nt, Ceutorhynchus assimilis
ucgaaggagauuugcuugaaauagacgcaacagagaauacagcaaucaaauuuguacauguuuauuuguuuaaugacaguuuaaugcuaacaaacagaaauucuaauaguagaggcuugaugcgauacgccuuugaaagcuuauacgaacuuaguagcuuggcugugguuaauguacgagauuuaggcaacauuaaacacgcauucaaguugcuuauauuuccagauacacgaguauuccaauguucaucuaaugcuaguaaaaaagaguggcuggauaagauugaucaagccaaaaaaacccgcuuggugcaagagcaacaaaaacgcgaauccucuuuggaaaaaaucuccccugcccguuccauuucaguugacuuaaacaucaacagccagccugaagaaauauucacccaucccgauugguuuuuggacaucccugacgaacuagacguuugcaucgcccaaagacaauucgaagacgcugucaaccacauaaacaaaucaaaaaccuacauaaacaaacacccagaauaugugggagcaauucagaaaaaaaucgaccaaaaacaaaacacccuaguugaaaugcuaaugaaagagcuugaaguuaauccugaaaaauccuugcaaggugguuuaagagcuacuagaacagcugucagauuguugaaccaauuaggucgcuccacccaaucaugugacuuauuuuuaaagcuuugcucuagcauguuaaaaauccaaugcaaacgagugaaaagagag

SEQ ID NO: 4925 - RNA, 785 nt, Ceutorhynchus assimilis
gccagugacaaagauuuagcugaauuuaucauacauuuaucagagaaaaacaacaccaaugauucauucaagaaagcccucauugaagcuggugcagaauucgcagauucauuuauauccaauuuguugagaauaauacagcauaugagaccuagaaaagaccagucaaaggaugaaauuguucaagaggaaaaaagugaacuugcacagaaauuuccagguuuagcuauaccaaaugagccucagaaaccuuugggugaugaugaaaauauugauucaaaauuagaaaauucuaauaaagcuaaaaaacaggauaaugauguuguagcagaucuuauggcacaauuugaagcugaggcaccaucugcuaguaccaauuccaaaacugaaaaaucaagaaaaaggucuagaucaagaaaccgauccagaucaaagaacagauccagaucuagggaacguaggcgcgacagaucucgugaugacaaaaaagguagauacagggacaggucaagggaucgucaucgagaaagagaucgugaccgugagcgugauacugaaagaagaagagaaaggcacagaagcagaucuagggagagacgaagaucaagagacagaagggacagaagucggucuagaaguagaaccaggagaggcagagaggaugauuuugauaaaaaaaauaaauuugauaaggguaguguggaacuugacgaagaucccgugguaggcaaaguuuacaacgcuaaaguagcaaauauugucccuuuugguuguuuugugcaacu

SEQ ID NO: 4926 - RNA, 658 nt, Ceutorhynchus assimilis
aggcuaaaguuuguccucaguccuggcgauaguguucaaacugauuuuaaugguacugaaccuuuaugcaggguuguaaggcugcauccaaauggaaaacuuauggcgagugguggaacagauggugauauucguauguggaaauucccuggccucgaaccauuagcaaaacuaaaggcccacacuaaagaaauagacgauauagacuuuaguucuuuuggcaaccuucucaucacaauagcuaaagauggccuggcaguuuugugggauuguguuaaagguacugaaauuaaaaggcucaagugggagcagccucaaggaucaaaguauuuauacaaaagaugcagauuuggaucaauugaaggccaacaaaaaucggcuuuguauauguuagcuaaucccacaggaguggcuaaaaggcagaaauccuaucugcaacaaugguauccagaggaagguauucuaaaaagaguaacagaauuugaugaaaguuuaucugccuuggcagucagagaugaugguagauucauagcuguagguacaauguuuagcggaucuguaucuauacauguagcauuuaguuugcagcgcguuuuaaauguagcgggugcacauuccauguuuguaacaggccuagaauuucucccaguguccaauc

SEQ ID NO: 4927 - RNA, 800 nt, Ceutorhynchus assimilis
ggccaaagaagaaaaacgaaccuuucuucgccagucuuuggaagccagguuaguugcacuguauuucgacacuggcauguucagugaagcccuacagcuugguucuacuuuacugugggagcugaagaaguuggacgacaaaaauuuacuuguagaagugcagcuacuagaaaguaaaauuuaucaugcauugaguaaucuuccuaaagccagagccgcuuugacuucagcccguacaacugccaacacaauuuauugucccccaaaaauccaagccucuuuagaucuucaaucaggcauauuacacgcagcagaugagaaagauuucaaaacagcuuauucauacuuuuaugaggcauuugaagguuucgacaguguagaaucaucaaaagcacuaacagcuuugaaauauaugcuuuuaucaaaaauuaugcuaaaucauucugaagauguucagcaaauugucagcgaaaaauuggccaucaaauacgcaggcagggauauugaugcaaugaaagcuguggcucaagcuucccauaaaagaucuuuggcugauuuccaaguggcacucaaacaauacaaagcagaacucgaagacgacgucauaguuagggcucauuuggacacuuuauaugauaacauguuggaacaaaaccuacugagaauuauagagccuuacaguagaguccaaguugauuauauagcaaaggcuauaaaacuguccauggcacaaguugaacaaaaauugucacaaauuaucuuagaugggaaauuugaugggauuuuggaucaaggcgaag

SEQ ID NO: 4928 - RNA, 653 nt, Ceutorhynchus assimilis
cagagccgagaucgaaaauauguaugauagcaagauuaagagucuucaaacggccgcuaauagacacucugcagccgcugccaaugcuuuggacgaagcucgucaaguucguaccagaaucgacacucuauccagccgagucacacaguuggaaaaugaaaacggcgcauuaguggccagaucaagagaucuugaaaaaauauuggagcacgaacguuugagacacgccgaagaacuggcagccuuggaaggcgaacuguccaggaugagagaagagaugaacguucaacugcaagaguaccaagaccuuauggacauuaaggugucucuagauuuggaaauugcggccuacaggaaacuauuggaaucugaagaggacagauugaaaaucacuccagcaggacaagaacgcgauguuucucacucgagcagucgcaguuuggcacaacguuacacuccaagccgucacaacacgaaacggaagcgcuuucugauggaagaaagucaagauuccagccuaucagacuucagcguuaccacuucuugcaagggcgacauugaaauucuggaagccgacccugaggguagauuugugaaauuaguuaacaagagcaaucaagaaguuucacuuggugguuggcaauuacuucgua

SEQ ID NO: 4929 - RNA, 681 nt, Ceutorhynchus assimilis
auucuguugaaggucucaccggcaaccucuuugaaguguauuugaaaccauacuuccuugaagcuuacagaccaauucacaaagacgacguuuuuaucgucagaggaggcaugcgugcuguggaauuuaaaguuguagagacggauccugcuccauuuuguauaguugcuccugacacuguuauucauugugauggagauccuauuaaacgugaagaagaggaggaagcuuugaaugcuguggguuaugaugauaucggaggcugcagaaagcaacuggcacaaaucaaggagaugguugaguugccuuugaggcauccaucauuguucaaagcuauuggaguuaagccuccaagaggaaucuuguuguaugggcccccagguacaggaaagacauugauugcuagggcuguggcuaaugaaacuggugccuuuuucuuuuugauuaacggucccgaaauuaugagcaaauuggcuggcgaaucugaaaguaauuugcguaaggccuucgaagaggcagauaaaaauucuccugcuauuauauuuauugaugaauuggaugccauugccccaaaaagagaaaaaacccauggagaaguggagagacguaucguuucucaacuuuuaacuuugauggacggcaugaaaaaauccucucacguaauuguaauggcugcuacca

SEQ ID NO: 4930 - RNA, 676 nt, Ceutorhynchus assimilis
aaaaaucugagcgaccucaucgauuugguacccaguuugugcgaggaucucuugucuucggucgaucagccuuugaaaaucgccaaagacaaggaaacuggcaaggauuacguuuugugcgacuacaaucgagauggugacucguacagaucuccuugguccaacaccuacuaccccccacuggacgacggccagaugccuucagaaagacuacgcaaguuagaacuggacgcaaaccacgccuuugaccaauacagagaaauguacuuugaaggaggcgugagcucagucuacuuuugggacuuggaucacggauuugcugguguaauucugauuaaaaaaaucggggaugguucuagaaaaaucaaagguugcugggacucuuuacaugugguugaggugcaagagaaaagcucgggcaggaacucgcacuacaaaaugacuuccacugccaugcuguggcugcaaaccaaugaaacagguucaggcacuaugaauuugggugguaguuugaccaggcaaauugagcaggacucugcagucaacgagaauaauccucauauugcuaauauuggcaggaugguugaagauauggagaauaaaauaagaaauacgcucaaugagauuuauuuuagcaaaacuaaggacauuguuaauaguuuaagaucgguccagc

SEQ ID NO: 4931 - RNA, 795 nt, Ceutorhynchus assimilis
uggaagaaaguacgaaacguaaaaaagaaaagaaaaaacaaaaaaugaaagacaaaccgaaaaagaauucaguacaagcgcuggcccuucccaacaguacugguccccgagguccaaaaccgggagcaggggcgccaggagugaacgcgggcgggccggcgggcaaacgcgcgaaagcgggcagaggagcgggagcgggcggggcggguccgggucgcaaaaaagcgcagccaguguccgugguaccggcguucgauucagaggacgaggacagcgccaagccgauguccuacgacgagaaacgucaacugucgcuggacaucaacaaacuaccaggcgacaaacuaggucgagucgugcacauaauccaguccagggagccgucguugagggacucgaauccggacgagaucgagauagacuucgaaacguugaaaccgucaacguugagagaacuggaaaguuacgucgcgucgugucucagaaaaaagccacguaagcccuacuacaaaaaguuaccgggcaaaucaaaagaggaacaaaucgcagagaaaaaaaaggaacucgaggaccgacuacucgacguaaaucauaaaaucggacccaccaaaaaggcgccuaaaaaagaugcaaaaucugauccuacaggagcaggugcaggacacaugucaucguccagcuccaguucggacagugacaguucgacgucguccaugagcagcagcucgagcgauuccagcgacagcgaagcaggugccucggcagccaggcaggcgaaaaagccuaaaaucgcga

SEQ ID NO: 4932 - RNA, 686 nt, Ceutorhynchus assimilis
ucuucccauugucuucaaggccccaaucaggccugauguggucaacuuuguccaucagcaaguuuccaugaaccgucgucaaccuuacagcguaagcgacacagcaggacaucaaacuucugcugaauccugggguacuggacgugccgucgcccguauuccccguguucgugguggugguacccaucguuccggacagggugcuuucggcaacaugugucgcgguggucguauguuugcucccaccaaaccuuggcgccguuggcaaagacguguaaacaucaaucagcgucguuacgcuuuggcuucagcuaucgcugcuaguggcguaccagcuuuagucauguccaaaggacauguuguugaucaaaucccagaauugccuuugguagucuccgacaaaguccaggaauugaccaagaccaaacaggcuguucaguuuuugaggcggaucaaggcuuggccagacauccaaaagguauacaaaagucaacguuuccgcgcugguaaagguaagaugcguaacaggaggagaauccaacguaaaggaccuuugguugucuaccaucaagaucaaggucuucguagggcuuuccguaacauuccuggaaucgaccuaaucaguguugaaaaacucaaucuuuugaaauuggcuccugguggucauguuggacguuucaucaucu

SEQ ID NO: 4933 - RNA, 734 nt, Ceutorhynchus assimilis
uuuggaugacagacuggaagaugaagauuaugacuuguuggaagaaaacuuggggguuaaaguggaaagaagaaaauucaaaagacugagaagaauucaagacgaagaaagcgaaggagaagacgaaaacgacgcugaacaagacagagaacaaaucgcuaacgauuuauuuucugaagaugaaagagauggaggaaguagaaaggaugaugaaagacauucugaacgcagucacagaccaacaguugucgauccagaucaauuugcugaagaagaagacgaaggcgaauacucagacgcagaugauuucaucguugacgacgacgguaaaccaauagcccgaaaaaagaagaagcccaucuuuacugaugcugcuuugcaagaggcccaagaaaccuuuggagucgauuucgauuaugaugaauuuucgaaauaugaugaauacgaugaugaagaggaagaugaagaagaugaauaugaggaggacgaagaaggcgaaagaagacgccgccagaaaaaggcagccaaaaaacgcccaaccaaaaagucaauauuugaaaucuaugaaccgucugagcuuaaacgaggcuucuuuacugauuuagauaacgaaauccguaguacagacaucccagaaagaaugcaacuuagagaugucccauuaacaacagugccugaugauucaacugaauuagacgaugaagccgaauggaucuacaaacaagccuuuugca

SEQ ID NO: 4934 - RNA, 671 nt, Ceutorhynchus assimilis
cgaaugaugcaagcagaaauaacugauaaaucaucagcagcauuucaaagaauugcuugggaagcuuuaaaaaaguccauucauggauucauuaacaaaauaaacacgucaaacauuggaauuauugcaagggaauuguugcaugaaaauauaaucagaggaagagguuuauuauguaaaucaauuauucaagcucaagcggcuucaccaacauuuaccaauguauaugcagcauuaguugcuguuauaaauucgaaauuucccaauauuggagaacuuuuacucaaaagauugguauuacaauucaaaagaggcuucaaacaaaauaauaaaaccauuuguauaucagcaucaacauucauugcccauuugguuaaccagucuguugcacaugaaauuuuagcacuggaaauuuuaacgcuacuuauugaaacuccuacugaugauucuguagaaguuucaauugcauuucuaaaggaauguggacagaagcucucagagguuacaagcagagggauuaaugcuauuuuugaaaugcuaaggaauauuuugcaugaggggaaauuggaaaaaaggauccaauacaugauugaggucauguuucaaauaaggaaagaugguuucaaggaucaugcugcuguuauugaagagcuggacauuguggaagaaga

SEQ ID NO: 4935 - RNA, 739 nt, Ceutorhynchus assimilis
ugaggaugauaucugcuugcuguaaaaugcacaauauuucagcugaaggcauaacuuugguugaagauauuuucaaaacccgcgaaccauugcccacaauggaagcuguuuaucugauaacuccuucaaaagagucuguggaagcacuaaugagggacuuugacggcaucaaacauauuauguacaagggggcacauguuuucuucacugaagcauguccugaccaguuaauuaaugacuuagcucgucacccuguggccaaauauauuaaaacccuuaaagaaaucaacauugcuuuuguaccaaaugaagcucagaucuuuucguuggauugugccgagacuuuccaaugcuacuauaauccagccuauucccaaaaauacagcgccaauauggaaaggauggcagagcaaauagcuacuuugugugccacuuuaggcgaauauccuucuguaagauaucgcagugacugggacaaaaacguugaacuagcccaacugauucaacaaaaauuggacgccuacaaagcagaugaaccuacaaugggcgaagguccagaaaaagccagaucacagcuguugauucuggaucgcggcuucgauuguguuuccccacuuuuacacgaauugacuuuccaagcuauggccuacgauuuguuaaauauacaaaaugauguuuaugaguaugaagcuucugcugguguaaaaaaagaaguccuccuugacgaaaacgacgaaau

SEQ ID NO: 4936 - RNA, 674 nt, Ceutorhynchus assimilis
cgaguaguagacgcucaaaaacugaugacccauuuaagugaauuuuuaucaaaugguccguuaaccagcuccauuuucaacgaucccuauagaaucgacgaagcggcugacguaauacagaaacuauuuuuaauaucacaagauuugccuucgcccaaguuugaaaauguuaaaaggaaaaucgaaaggacuuacucggauauugaaaaggcuuuaauugaagauuuuguuagggcuaugagcaaagaggaucugguuaggaugagggcuauagcuaacgugcugagucaguuuaaagguuacagccaguguguugaugccuauauugaucaaagucaagcagguuguuuguugagcaaagacguuuucgcucauuugguuccgcuuugcaagcacaacuacgaaauuauaaaagaaguuuucaauaguccagaacaaguaauggcuaaauuuguucugaacuuguaccaguugaaauuggcugauuauauagacuccaggcuaagugcuaaaguuggcagcuacgguuacuugcaaauacuuuaugaguuguacucaaaaacaaaucaguuuuccaacgaauugagcgucuaugauuuggguaacgaucagaauuauuugagcaaauugacuacgaagauuuuuaauaaauauaucagcgauuaugugcagau

SEQ ID NO: 4937 - RNA, 678 nt, Ceutorhynchus assimilis
agggaaagauugaggcaauuagcccuugaaaccauagauuugcaaaaggaccccuauuuuaugaaaaaccauuugggguccuacgagugcaaauugugucugaccuugcacaacaacgagggaaguuauuuggcccauacacaaggaaaaaagcaucaggcuaauuuagcuagaagggcagcuaaagaagccaaagaugccccuagcaugcuacaaccugaaaaacccaggguggaacccaaaaaauucguuaaaaucgguagaccuggauacagggugaccaaacaaagggaccccgaaacuggacagcaaagcuugcuguuucaaaucgauuaucccgaaauugccgaucauguuuugcccaggcacagauucaugucugcuuacgagcaaaaaauugaaccuccagaccguaaauggcaauauuuguuguuugcugcagaacccuaugagacuauagcauuuaagguuccuagcagagaaguugaaaaaaccgaccagaaauucuggacucauuggaacagagacaccaaacaauuuuuccugcaauuugccuucaaaaucgaaaacaagaaacugaccaacauagugccaaggccuccuaugaugggaguuggaauaccuccuccaccuccuauguugccaguaccuccaccaccgagaccuccaauguucaau

SEQ ID NO: 4938 - RNA, 260 nt, Ceutorhynchus assimilis
ugaccugcgaaacuauuaccggcgaaguuuacagaggaaaacuuaucgaagccgaagauaauaugaauugccaaaugacucaaaucacugugacuuaccgggacggcagaguagcucagcuagaaaauguuuacauuagagguucgaaaaugagauuuuuaauacugccggauauguugaaaaaugcuccuauguuuaagaagcaaacuaaggcugggguggcugggagaggaaaaucugggauacuucgagcucaagug

SEQ ID NO: 4939 - RNA, 774 nt, Ceutorhynchus assimilis
cgaaacgagcgaaaaucuaggagccgcucacguaauucgcaccgcugccggucucucgacacaaaacaugacucaguucgccaucacccgcaacauucaacaacuaggagccagucuaaccgccacuuccgauagagaaaccauuucuuacacccuagaaggcacuagacaagccguggaaaaagcucuaccauaccuaacagaaguagccacccaacaagucuuuaaaccaugggaauuggccgaacucucagaccgucucagaaucgauuuggccacaagacccuugcaauugcgcgcagucgauuugcuucacaaagcagccuuccguacggguuugggcaauucgcuuuacgcgcccaaauuccaaauuggaaaaauuucaucugaaacucuucagcauuacgugucgagcaacuucacuucggcuagaggggcuguuguuggauugggacucgaugaaugcaaaauggacgagcuggcucagucuuugacuuuggacgacagcaauggccauguuaaugugaguccuuacaaaggaggcgaaauaaggucggacaaaggugggaguuuugccuuuauggcuguagcaggugaaggggcuucgguuaaaaacccuaaagaagcuauggcuacugcuguuuugcaacgggcgcucggaguuggaccucaaaucaaauggagcacuguagauaaugguauuuugagcaaggcuauuugcaguagugaaggcuacgccucuucugcuauuagugcuaccuauucagacacagg

SEQ ID NO: 4940 - RNA, 185 nt, Ceutorhynchus assimilis
caacgaaaucgaacacgaaaaugaacguauggcacaggaacuaucugacaaaauaggcguccugaaauccuuauccauagacaucgguaacgaggugcaguuccagcacaaacuguugagggacguagacgaugacauggauagaacuggaggguuucucggcaaaaccaugucuaggguaguca

SEQ ID NO: 4941 - RNA, 750 nt, Ceutorhynchus assimilis
uugacgucaugaacuccauugcccguggucagaagauucccauuuuuucagcagcugguuugccccacaacgaaaucgccgcccaaaucuguagacaagccggucuugucaaggugccuggaaaaucaguucuagaugaccaugaggauaacuuugcuauuguguuugcugcuaugggugucaacauggaaaccgcuagauuuuucaaacaagacuuugaagagaaugguucuauggaaaacguaugcuuguucuuaaacuuggcaaaugacccaacuauugaaagaauuauuaccccacguuuagcuuuaaccgcugccgaauuuuuggcuuaucaaugugagaagcacguucuaguuaucuugacugauaugucuucauaugccgaagcguugcgugagguauccgccgccagagaagaaguacccggucgucgugguuucccagguuacauguacacugauuuagcuaccauuuaugagcgugcuggucguguugaagguagaaacgguuccaucacucaaauucccaucuuaacgaugccuaacgacgacauuacgcauccaauuccugauuugacugguuauauuacugagggucaaaucuauguagacagacaguugcacaacagacagaucuacccgccaguuaauguguugccauccuugucgcguuugaugaagucugcuauuggugaggguaugacccgaaaggaccacucugauguaucuaaccaacuguaugcuugcu

SEQ ID NO: 4942 - RNA, 266 nt, Ceutorhynchus assimilis
gcggauaaagaaacccaaacaauaccaugcgguaaaccaaaaguacccgaagguuaucaggauuuauugcuagaguuuaccauaaauuguaaucuccaucauccgagaaaccucgucgauuaugccgcugaauauuuugccgccuugaaagaucaaaaacauaccaagauugucuacgaucugguuuguacugagaaagaagaaaaaacagacagggacaguacugcuuuuagugaagcuacaacagucacggauucggaauuuuc

SEQ ID NO: 4943 - RNA, 740 nt, Ceutorhynchus assimilis
agacuauugaauccgccaucacguuggcccuuggugaaagcuguaauuggacugaucaggaaccuugcacugugccaggauaacuucgcaccauuacgggaaucuugugcuaucaauuauuuggugcaauuauugaugagagcuuaucaagauacacagagacgagcuagcuuggcaaguggaggcagucaacaaccaggaacuuacgcugaugguguuagaauggaagaaauuauugaagguacuguuggcgcucuacacguucuugccagagaauucuacaaucgcgaacaaaucagacaacaaggcguuauucccguuuucguacaacuucuauucaacgacaucgaaaauauacaacgaguagcugcuggaguacuuugugaauuggccgccgauaaagaaggggcggauuugauagagcaagagggcgccacugcaccgcugaccgagcuuuugcauucacggaacgaagguguugcaacauacgcugcagcagugcuauuccguaugucugaagauaagccucaagacuacaaaaagcgccucuccauggaguuaucaagcucacuguuuagagaggagaaccuuuggaacccugaccugggcauggggacagauuuccaggauauuuugaguccggaacaggccuaugauaauauguacgcccaagggccgccuaguguacauagcagccacacugguaggccuuaucagcaacaaggcuaugaccagauacc

SEQ ID NO: 4944 - RNA, 654 nt, Ceutorhynchus assimilis
agcuuguaugcaugugagaaauggcguaugcacauuaucagagaaauagcuaaaaaagucgcucagauucaaaacgcugguuuaggugaauuuagaauaagggauuugaacgacgaaauuaacaaauugcucagggagaaacggcacugggaagaccaacuaaaagaacuuggugguccugauuaucagaaaaucggcccucgaauguuggaucaugaaggaaaggaaguaccaggaaauagaggauacaaauauuuuggagcagcaaaagagcuaccugguguaagagagcuuuuugaacaagaaccaccuccuccuccuagaaagacccgggcagagcuaaugaaagauauugaugcagauuauuauggguauauggaugaugaugaugguauuuugauaccacucgaaaugcaagcugaaaaaauagcuguccaaaaagcaguaacagaauggaaggcaaagaaagaagcuagaaaggcugcaggugaagcuucggaugaagaggaucaagaaguaaguguauaugcaguugaugaggacguagagaaagaugaaauacuagaagauccaagucagcaacuucucgaugggucacaacaaagauuuguggcucacguaccaguuccaucacaacaagaaaucgaacaagcc

SEQ ID NO: 4945 - RNA, 501 nt, Ceutorhynchus assimilis
aaaaccaccuuuguaaagcgucauuugacuggcgaauuugaaaaaaaauauguagccacccucgguguagaagugcaucccuuaguuuuccacacaaacagaggcgaaauccgcuucaauguuugggauacugcuggccaggaaaaauuuggaggucuucgugaugguuauuacauccaggggcagugcgcaauuauuauguuugauguuacuucucguguaacuuacaagaauguaccaaacuggcacagagaucuggucagggugugugagaauguuccaauuguacuuuguggcaacaaaguggacaucaaagauaggaaagucaaggcuaagaguauaguguuccauaggaaaaaaaaucuacaguauuacgauaucucugccaaauccaacuacaauuuugagaaacccuucuuguggcuggcccguaaacuaauaggcgaucccaaucuggaguuuguagcuaugccagcgcucguaccaccagaaguacacaug

SEQ ID NO: 4946 - RNA, 773 nt, Ceutorhynchus assimilis
agagagguugcuucugaaagugguguggauucaacggacacuuuguugaaugacuacacuguuacgccucaugcuacagccacuccaagaacaccggcagcacaaacugacagaauuuuacaggaagcucaaaacguaauggcacuuacccacguugauacuccacucaaaggcggccugaauacuccauuacauaauucggauuuuagugggguugugccucaacaacaagcuauugccacuccaaacacuguguuggcuacuccuuauaggucaguuaggagugaaacugguucaacuccuggaaauacagguuuuaugacacccaaaaguggagcuauggugccaguggguggaacaucuacaacuuauguggcaccaucuauaagggauaaauuaaauauuaauacugaagaugcccuagaaguaggagauacuccagcacagcaucuuauguaucagauguccaccaagcagcaacuuaaaaugggcuugaguaguuuaccaacgccuaaaaaugauuacgaaauuguuguuccggauaaugaagaacagacuauuccagaacaagcucaagaaaaaucaauugaagaccaagcugacguagauaugagauaucaagaagaaaugaaagccaaagcugccaaagagcuuuuauugagaucacaggugauccaaagagauuugcccaggccacaagauguuaaccucucaguuuuaaggccugccaaugagaguuacucacugacugagcuccagaaagcagaagaacu

SEQ ID NO: 4947 - RNA, 360 nt, Ceutorhynchus assimilis
uugcacauccagacaaauugaaaaagaagauuaccagagaacuuaucacuacuauacuggcuaggaaaccuaaaauguguaguuuccuugaguggagagaccuuaaaauaguguacaaacgauaugcuaguuuguauuucugcugugcaauagaacaagaugacaacgaacuucuuacuuuggaggucauccauagauauguggaacuccuggacaaauacuuugguaguguuugugagcuugacauuaucuuuaacuucgagaaagcuuacuuuauauuagacgaacugauguugggaggugaaauacaagaaacuagcaaaaagaacguucucaaagcgauugcugcacaagaucuuc

SEQ ID NO: 4948 - RNA, 774 nt, Ceutorhynchus assimilis
agcuggaaagauuucagaggagauuucaaaaaccacacauucaauuggggaaaaagcacaagaaauagguaaaacuaaugcuuuucaaaguaucagcaaagcuacugaagcaguuaaaaaagaaauggauaccaauaguaugcaagguagaguuuacguuaguccaauaaaacuucggaaaagaacagaaaccucggcgguacaaaaccaaaaacauuacgaaccaaacacagaagcgauggguauugagcuacauaaagauucuaaauuuuaucagucauggcaaaauuucaaagacaauaauccauauguucacaaagucauggauuggaaauuaaaauuugaugaaagugaaaacccaguaauaagggcuucaagggugcuaacugaaaaaguaucagauauuaugggaggacuauuucagaaaacugagcuuucagaaacuuuaacugaaaucugcaaaauugacaacaguuuugauacuaaacgauuuuuaaaacagugcgaagcugacauaauacccaauguauuggaagcuaugacuaggggugauuuggaaguucuaaaagacuggugucacgaagguccuuacaaucucuucucgauuccuauaaaagaagcuuacacgaaagguuauaaaauagagucaaaaaucuuagauauagauaauguagaucuagucauggguaaaguaauggaacaagguccuguucuaauaauuucauuuacuucccaacaaguaauggccguaagagauucucagggaaauguggu

SEQ ID NO: 4949 - RNA, 678 nt, Ceutorhynchus assimilis
aauugaagccgggacuaaauacaguacaccaagcaccaaaaaaggcaguuaacaauguugaagguuuaaaucacaaacuagaggaaaucuauuuaaaucuaccauggaucgaaagauuagacugcauaaacgcacaagcaccuuuagcuccagaacuggcugcucaauuaauggcucaugaacagaaacgagaaaaccaauuaaagaauaauaaaaaacugccacagcuuaaagcaagcgaggauccuauauugaaugauuuuaaaagggaaauggaguuucauagacaagcccaagccgcuguacuugaugccauaccaaaguugaaggcucuuggaauaccuacuaaaagaccugaugacuauuuugcugaaauggcaaaaacagacgagcauaugcaaaaaaucagagaacauuugaugacaaagcaacagcagcaacagagaagcgaaagaguuaaacaacuaagacaacaaagaaaagaaggcaaaaugcuucaaauacagaccaaacuccaaaggcagcaagagaaaaaagaaaugcuggaccagguuaaaaagcaccgcaaaggagucucgaaagaucuagacuuccuggauuccaaaaaaagcaaagcuauuucgcggaaggcauuggaaaagagaaauaugaaaaauaagaaauuuggauuugguggca

SEQ ID NO: 4950 - RNA, 725 nt, Ceutorhynchus assimilis
cacuucgaaacugaagaagcggcaaacaaauccauugaaaaaguaaauggaauguugcuuaacggcaaaaagguuuacguuggccgcuucauuccucgcaaggaaagggagaaggaacuuggagaaaaagcgaagcuauuuacuaacgucuauguuaagaauuucggagaggaauuaucagaagaacaauugcguaacauguuugaaaaauacggaaagaucacgagcuacaagaucaugaauaaagaugauggaaaaucgaaaggauuuggguuuguugcuuuugaauguucggaagcagcugaggcagcaguggaagcacuuaauggaaaagaaucaguugaugggaaaccucuuuacguuggucgugcucagaagaaagcugagcgccaacaagaguuaaaacgucgcuuugaggcuuuaaaaauggaaagacuuaaccgauaccaagguguuaacuuguaugucaaaaauuuggaugacacaauugacgaugaacguuuacguaaagaauucacuccauucggaacaauaacuucagcuaaaguaaugauggaagaagggcguaguaaagguuuugguuuugucugcuucuccuccccugaagaggccaccaaagccguuacugaaaugaauggacgcauagucggcuccaaacccuuguacguggcauuggcucagaggaaagaagacagaaaagcucauuugacaucccaauacaugca

SEQ ID NO: 4951 - RNA, 751 nt, Ceutorhynchus assimilis
aaaucucgauacacuggacgaaccagaagcucgugccucaaugguauggauuaucggugaauacgccgaacgaaucgauaacgcugacgaacucuuggacaguuuccuggaaggauuugccgaugaaaacgcucaaguacagcuucaguuacuaacagccguuguaaaacuguuccuaaaacgaccacagcacacucaaggucuagugcaacacguucuaaguuuggccacucaagauucugauaaucccgauuugagagauagaggauuuaucuauuggagauuauugaguaccgauccggccgcagcuaaggaaguaguucuugcugauaaaccacugauuucugaagaaacugacuuauuagagccuacacuguuggaugaauuaauaugucacauuucaucuuuggcuagugucuaucauaagccuccuacagcuuuuguggaagggcgcagugcugguauaagaaaaacguuaccagcgcgucaagggucugaagaagcuccuacucaggaagcaacaguuauuccaaaucaggagagucucauuggagauuuauugucaauggaucuuggggggccaacuauacccacuccagcugcugcaccuguuguugcuccaacuaguaauguggaucuguuagguggaggauuagauguuuuguuggguggugguccagaaguaaccagcaacguaggugcugcucccucaaccacaggccuucuaggugacaucuucggaaucacaaca

SEQ ID NO: 4952 - RNA, 382 nt, Ceutorhynchus assimilis
gaaguaggagccacaucaucccuugccccuaaaaucgguccccuaggucugucucccaaaaaagucggugaugacaucgccaaaggcacagccgauuggaaaggucugaaaaucacuguacaauugaaaauccaaaaucgucaggccaccauuucuguaugccccucagcggcuucucuaaucauuaaagcuuugaaagaaccaccaagggaucguaagaagcaaaagaacaucaaacacagcgguaacauuucuuuugacgauguaaucucuaucgccagacaaaugaggccccguuccauggccaaaaacuuggcaggcacaguuaaagaagucuuagguacugcccaaucuguuggcugcacaauugaugguaaggcac

SEQ ID NO: 4953 - RNA, 655 nt, Ceutorhynchus assimilis
gaacuagccgaugaagcuaaaaaauugggcgugaaaaugguguuuucgcaugaaacugaaccgcuaggaacugcuggcccuauagcuuuggcuggagaacauuugagaaaaagcgacaaaccguuuuucguguuaaacucugacaucauuugugauuuuccauuuaaaaaguugauugaauuccacaaaucgcacggcaaagaaggcaccauuguagugacaaaaguugaagagccuucaaaauacggugugguaguuuacaaugagcaaaagugcauugaaagcuuuguagaaaaaccucaggaauuuauuucaaauaaaaucaaugcgggauuguauguuuuaaauccuaguguuauugauagaauagaacuuaaaccaacuucaauugaaaaagaaguuuuuccuaauauggcaacugacaaucaauuguuugccuucgagcuggaaggauucuggauggaugugggacaaccaaaagacuuuuugauuggaaugugcuuguaucuuaaacauuugaggagugcagauccagagaaauuguacaggggaccaggcguaauagguaaugucuuaguagacccuacagcaaaaauaggcaaaaguugccaaauaggaccaaaugucaccaucggcccagguguaguaaucgaag

SEQ ID NO: 4954 - RNA, 724 nt, Ceutorhynchus assimilis
ggcgaguuuaacgagguauuuaaugauguuagaaaauugcuggacaacgacgaccugcucaaagagggggccagcggggcauucgcccaauacaacaaggaccaacugacccccguccgaauagagaauucugaucauuggguacugauuacugaauacaacgauuuaggaaauaauagguuuuuugauccccgcuccaaacaaaguuuccguuaugaccaccucagaaaagaagcguccgacuaccaauccuacagcccggauacaacagccgaaccguggcggucugcccucgacacagaauuuguucaauacacaagaaaucacuauaaagaugguguaugcagcguuauagggcgcagccaagggggcguggucaguuugacagcauguaucgaggaccaucaguuucaacccaaaaauuucuggaaugguagauggcguagucaaugguucauaacccuaaacgguaccucaggugccgaacuacgagguguccucaaaguacaaguccacuacuaugaagaagguaacgugcaacuggucagcaccaaggaaacaaaagacacagucagcauuaccacugaagcacaaacuguuaaagauauuguucaggcaauagaggcugcggaaaaucuuuaucaaacugcuauuucggagaauuaccauacaaugucugauacgacuuuuaaagcucuuagaagauuauugccagucacacgua

SEQ ID NO: 4955 - RNA, 718 nt, Ceutorhynchus assimilis
uacaaacgaaaacgcaaacauuagaauuucgcuuuggggcuaccgcgaaaccuccauaagacccucacuauuauacauuacagauauagcugaaaacguccaaaacacuggagaguacacgauaguaccuucacaguaccgcaacagagaaaacaccuuuuuaaccgacauaaaauucggcuucauucaaaucaauuuaaccgaaucaauaccuauucaguacgauuauagcgguaccacucaaacaacuacccaagcuacaaccauuaacccuguaguauggagcaggccuauaccuuuaggcugguacuucggcuggcaaugggaacgcauguacgguaccaacuggcccaaaaccuuaugcgacgauuggcuaaggaccgacagauaccuaaaaaacuuugcccacgagcuaccgcaauguccuugcacccuggaacaagcccucaucgacaaaggcaaauacaugcccgauuuugauugcgacaaagacucaaaccccacuugcuacuacaacaaccaagcaguacauugugugagaacugguucuccuacacuagaagguuccgagcaacaguguugcuacgacaaaaaccacuaccuaauguugucuuaugaccaacaauggggcuccagcccgaaacguugccacaauuuaggccuaaugccguaccaggaagcaacaaaaguacccacuuugucucaaugguucaacgau

SEQ ID NO: 4956 - RNA, 193 nt, Ceutorhynchus assimilis
aauccuugggucaguagguaucgaagcugaagcagaaaaacugaaaaaggucaucucugagcucaauggcaaauccaucgaggaaguuauuucucagggccgagaaaaguugagcuccaugcccacugguggcgcugcugcacccgccgccgccgcuggugcugcuccagcagccgaagagaagaaagagucc

SEQ ID NO: 4957 - RNA, 764 nt, Ceutorhynchus assimilis
agaagucauaaaugcugccaggauuuuggcagcuaggccucguagcaaaguugcucaagagaauauggacgcguuuagacuuacuugggaaaaucaggugcggauuuuaacagaugcuauugaugacauaacaaccguggacgauuucuuggccguauccgaaaaucacaucuuagaagaugugaauaaauguguguuagcucuccaggaaaaugaagcugauacucuggaaagaacugcugcugccauuagaggucgaacuggacggauaggaguuguuguugcagccgagauggauaauuacgaaccuuguaucuauaccaaaaggguuuuagaagcuguaaaggugcucaaugaucaagugaugccaaaguuuacacaacgcguacaaguugccguucaagcaauaauaaauggacaacagggucaacccucuaaagaauuggacgaaaaugaauuuauugaugcuucaagauuggucuaugauggcgucagagaaauccgcagggcaguucuuaugaacagggcugaugaagauuuggauccagaagauguugaacuugaugaaaauuauacuuuggagacuaagaguaaaucgagugcccauacaggugaacaugguguugaugaauauccugauauaagugguaucacaacagcccgugaagcuaugggcaaaaugccagaagaagaccguaagaagauccuucagcaaguagaauacuucagaagugagaaacucaaguuugacagagaaguggcua

SEQ ID NO: 4958 - RNA, 776 nt, Ceutorhynchus assimilis
aggauuuggugguuuuggauugggaacugcagguaagcguccagcuccugcuucuguaacaucuacagcugcaaccagugugccaggacuucaguucagcuucaguucaccagcuucugcagcugcaacaacugccacaacuacuuucacuccuauuguugguuccacugcaacuagcacuauaaauguuccagcaacagcuccaacuuccagugcuccaaagcugggauuagguguugcaccuacuacuacuacuccggcaaccacaggauuuucuuuggguuuagguaguacagcugccacuacaacaacuguuacuucagcucagucgacaacuucuacagcagccacuacaaccacuggaucacugacuuuugcccaauuagaagaugcaaucaacaaauggacuauugauuuggaagaacaaggaaaauucuuuaucaaucaagcuaagcagcuuaacgcuugggacacuuuauugauuucaaauggugacaaaauucugaauuugaacaccaacauuguaaaaguacagcaacaacaaucccaacuagaucaggaauuggauuuuauuagugcucaacaaaaagaacuggaagaacuccuggugccacuagaaacagaauuaauggauguuccugcgacugauaucaacaggaaccaaauguaucaguuuucagaaauaauugauucacagcuuaaacaaauuucugaugaucuaaaagaaaucguugaaauaauuaaugguucaaauaaagaccaggacacuucaaauc

SEQ ID NO: 4959 - RNA, 449 nt, Ceutorhynchus assimilis
cuuccugggucuggauaaugccggaaagacaacacuguugcauaugcucaaggaugaucggcuagcucagcaucuuccaacgcuacauccuacaucugaagaacuuucgauuggcaacaugagauuuacuacuuuugauuugggaggccacacacaagccagaagaguauggaaagauuacuucccagcaguagauucaauaguguucuugguagacgccuacgauagaucuagauuuaaagaaaguaaacaagaauuggacucguuacucacagacgaaaguuuggcaaauuguccuguuuugauuuugggaaauaaaaucgacuugcccggcgcugcuuccgaagacgaacuuaggaauuacuuugccuuguaucaacaaacaacaggaaaggguaaagugccaagagcagaucuuccaggacgcccccuggaacucuuuaugugcu

SEQ ID NO: 4960 - RNA, 423 nt, Ceutorhynchus assimilis
aauauugcccaaggaaaccucguuggaaaacaagucccaggccaucaccgauuuacuguugcagucucaaacgaugaucacuuccgcucugagcugucgagaaucaaucacuucuauccuaggccacaugacuacaaucaacaacuauuuggacccuugcaauugggaaaacgaucuggaaguugaagcuaagaggcauuacuuauuggaauuguauccagagcucagaaacacuguccagcugguacguucuguccaaaaacucaucccauacaccaacucagauaagaucaugaaagugacugagcugucaggcaaacuggagcagcugacugaaaccaaucugguuguauacucagaaagucgagacgugacucagaaggugcuaaaaucauugcaacaauacaaugacaucaccaccuc

SEQ ID NO: 4961 - RNA, 742 nt, Ceutorhynchus assimilis
aggagacagagcuucuuuuguucaaauuagagggucaauuccuuuauuuugguuccaaaaacccgaccucagguauaaacccagcauugauauugaccauagugucgauccucaggagcaucaaaaugcuugucugaggcauauugaaucgauggccggaguuuauggcaggcaaguuaugguugauuuggucgaucaaguuggaucagaagguagauuagaaaaagccuucaaagacaccaucaauuauuuagcucauccguccgugagauaugaaccauucgauuuucacgccgaauguagaaaaaugaaauggcaucgauuaucaauuuuaauagacagagugucuuuggaucaggacgaaaugggguacuuuuugauuuugaaagaugguacucuguccucauuacaagaaggugucuuuagaacaaacuguauagauugccuggaucguaccaauguaguccaaaguauguuagcgcacaggaauuuagaaauugugcuuaggaaauucgauauuuuaagcccagaucaaaagcuagaaaugcaacuuucuuucgagucuuugaacaaaaauguuugggcugaucaugccgaccucaucaguacucaauauucagguacuggagcuuugaaaacggauuuuacuagaacgggcaaacgaacaaaagcgggacuuauucaggauggaaucaauucguugaugcguuauuauaagaauaacuuuaacgaugguuuccga

SEQ ID NO: 4962 - RNA, 685 nt, Ceutorhynchus assimilis
cguguaaaguacagcaacaccuuaccagacuuaccauuugaucugaaauuuaucuccuaccccuuugagccuucaagauuuauccaauacaauccaaccucuuuggaaagaaacuauagauacgauguccuuacagagcaugauuugggcguaaauauagaccuaauaaacaaggacacuuauccuacugaaccggguguuguuuuggacccagcugaugagaaacuucucgaggaagauauucuugcgccacaagauucaaaaagaucccggcaccaugcuaaagcagucuccuggcuuagaagaacugaguacaucuccacugaacaaaccagauuucagccacaaacaauggacaaaguggaagccaaaguugguuuuagcauuaaaaaaucucucaacaaugaaacacauuauauggauagaaaugcgcaaauugaggcuauugaaaaaaccuaugcagacuccaaaauaccuauugaaaagcacuauaguaaacccaacguuguaccaguugaaguguuuccaguuuauccugauuucaauuuguggaaauauccuugcgcucaaguuauauuugauucagauccugcuccgguugguaaagguguuccagcucagauugaagaaaugucucaagcaaugauucguggugugauggacgaaaguggugagcaauuuguug

SEQ ID NO: 4963 - RNA, 790 nt, Ceutorhynchus assimilis
uaugaacucguuugccaagacgccggcuggaaaaaagacgaaaaacuccugaaaaccuucaaaacgaaaaacgaggaacaaauaaagaagcuggacgaagcuauugaagaugcggaaaagaauuugggcgaaauggaagugagagaggccuacuugagaaaagccgaauacuacaguagaauaggugacaaagaaaaugccaucagcaccuucaggcaaaccuaugacaaaacuguaucuuuggggcacaggcuagacaucauuuuccacuugauaagaaucggguuguuuuucauggaccaugaucuuaucacgaggaauauugaaaaagcuaaaacccugauugaggaaggaggcgauugggacagacgcaaucgccucaaaguuuaucaaggggcuuacuguauggcuguaagagacuuuaaaacugcugcuaacuuguuuuuggacacuguuagcacuuuuacuucguaugaguugauggauuauaaggcuuuuguacguuauacgguuuauacuucuauuauaaguuugccaaggaaucaauugagggauaagguuguaaaagguucagaaauccuugaaguauuacacucugagccuuucgucaaagacuaccuguuuuccuuguacaauugccaguacgccgauuuuuucaaaaacuuagccaaaguagaagagauauugagaaaggacuacuuccucaacccccacuacagauacuacauccgggaaaugaaaauaucagcuuacacucaacuguuggagucuuacaggagucucacuuugc

SEQ ID NO: 4964 - RNA, 659 nt, Ceutorhynchus assimilis
uguggguuuagcucaguuaccuggcguaagggcugguuggcaauguagaaaaugucgcaauugccaaguuugucgaaugaugggggacgaaacuaaauugaugaguugugagcagugcgacaagguuuaucacgccagcugucaacgcccauuaguuacguccauuccaaaauaugguuggaaauguagauguuguagaguauguggcgacugugguucccgaacaccaggcgcuggucuaucuucuagauggcauuuacacuauacaguuugcgauucgugcuaucaacaaagaaauaaagguuguuguugcccaauuugucaaagggcuuauagaucacaugcucauagggaaauggugcaauguggaaccugccgaaaguuuguucaugggacaugugauccagaagcagauuugguaacauaucaacagaaaaaggaaauaaauccugauuaugaguaucauugcguuauuuguaaaaauucauugcagcaacucuccagccgcccugucacuagcaaaagaucaagucuagaugacuuuggagauuuguccgcuucccaagaaucuuuauaugaugacauaucagaauuugauaugccuucugaagaaucuuucagagggacaggguugggaaaaggcaaaccauaugcaagua

SEQ ID NO: 4965 - RNA, 762 nt, Ceutorhynchus assimilis
cgcgauguuucuacguuuaguaaacugagcagggucaagcgggcagaaaagggccgcuugguacaagauuuguuuaccggacguuugguggcggauuuaaaaauuuccgccaaagaauuaaucaaguccagaacguacgauuugccaacgcuuugucagcaaguccuuaagcuacgagaagaccaaauaacagauuuggaaccagacgagguuguaagaauguaugaaaacacagaagauauuuuuaaauuaauagaauauacaaugcaagauacugcuuauaugcucaaaaucuuauacgauuuaaacauuauuccuuuggcauugcaaauaaccaacauagcaggaaauauuauguccaaaacacuuauggguggcagaucugagagaaaugaauauuugcugaugcaugcuuuucaagaaaaggacuauauuguuccagagaagaaguucaaaagaagaagaaacaauaaugauagccaacaaguagcuaagaagaaaccugcauaugcaggugguuugguucuggaaccuaaaaucggcuucuacgacaaacuucuuuuacucauggauuuuaauucacuuuaucccagcaucauacaagaauacaauauuuguuuuaccacauuacccaccacagacgaagacaauaauuuaguuuugccugauaaaaaucuaccucccggcaucuugccuguggaaauaaaaaaacuuguugauaguagaaagcaaguuaaaaaguuaauggccacuccugaucua

SEQ ID NO: 4966 - RNA, 714 nt, Ceutorhynchus assimilis
ggcggaaaaaugauugagaguguuuuaaaggaaaaaguucaaucgggagauguuauauuuauugauaaagcaacuggaaaaauuacacguauugguagaucauuugcaagagcacgugauuacgaugccacaggugcucaaaccagauuuguucaaugcccugaaggagaauugcaaaaaagaaaagaaguaguucauacaguuacuuugcaugaaauugauguaauuaauagcaggacgcauggauuuuuggcuuuauuuucaggugauacuggagaaauuaaaccugaaauaagggaccaaauuaauggaaaaguggcagaauggagagaggaaggcaaggcagaaauugucccuggaguucuauuuauugaugagguucacauguuggacauugaaugcuuuucauuccugaacagagcauuagaaaacgaaauggcuccaauuguaauuauggccaccaaucguggcauaacaaaaaucagaggcaccaccuacaaaucuccucacggcauuccuuuggaccuuuuggaucguacaauuauugucccuacaaguccuuacgaagagaacgaacucaaagaaauucugagcauccgaugugaagaagaagacugucaaaugucagauaaugcuuugacugugcugacaagaauaucuaaagaaacuucuuugagauaugguaugcagcugaucaugacguccaguuugauu

SEQ ID NO: 4967 - RNA, 760 nt, Ceutorhynchus assimilis
ggauguucagaagguccauuacaaaugaagaaagaaaacgauugauugauuugggacuuucacaacacugccuugccaguaguguaucuuugcuaagggcuucugaggucgaagacaucaucgaaggaaaugaugacaaauauaaagcugucucgguucauacaagugacccaccaguaccaagggaagguaaaagcaaaaagaaccaacaauggguaccaucuuugccaaauuccagucauuuagaugcuguaccacaagcuacuccgauuaauagaaacagaguugcugcaaaaaaaguaagaacuuuuccuuugugcuuugaugauaccgauccccagcucaacauugaaaaugguugucaacaagagguucuggugcccauccguuuggacauggaaauugaaggacagaaauugagagacacuuuuacuuggaauaaaaacgaaagcuuaauaacuccagaacaauuugcugaagucuuaugugaugauuuggauuugaaucccuugacuuuugugccugccauuucucaagcuaucaggcaacaguuggacgcuuuuccuccagaaccuccuaguauuauugaggaaaacgcugaucaaagaguuauuauuaagcugaauauccauguuggaaacacuucauuaguugaucaaguugaaugggauaugagcgaaaaacaaaacaauccagaagaauuugcuuugaaauugugcucugaacugggauugggcggagaguuugucacagcaauagc

SEQ ID NO: 4968 - RNA, 474 nt, Ceutorhynchus assimilis
aguaauugucggugauggagccugcgggaaaacuugccuguugauuguguuuaguaaagaccaauuuccugaaguguacgugccuaccguuuucgaaaauuauguggccgacauugaaguggauggaaagcaaguugaacucgcuuuaugggauacugccgggcaggaagauuacgaccgucuucgcccccugucuuauccagacacagaugugauccuuaugugcuucucaguagacucgccagauucuuuagaaaacauacccgaaaaauggaccccugaaguuaaacacuuuuguccuaauguacccauuaucuuaguugguaacaaaaaggaucuccguaaugaucccacuacaaucaacgagcugaaaaauaugaagcaagaaccagugaaaccgcaggaugguagaucuauggcugaaaaaaucaacgcauuugcuuaucuugaguguucagcuaaaagcaaggaagg

SEQ ID NO: 4969 - RNA, 797 nt, Ceutorhynchus assimilis
acacaacggcuuguacuuauauuuaugcagaauuuuaaggcuuauuuggaauagacauuguguggaacguuucuguccugauggugaauucgcuuuguuucaaagcagcauaucuguagaagacuguaucaaauugcaaaauaauuuaaaugcccugcacaauuuuuugacuuuaaauacugauuuuucuggaacuacuaaucaaauggcaauucauaauaauucuacauugaaucaaacuuuggugcgucagccugucacacuucaggacgcucaacuuauagaacgcaagucuuuggaugcccuaaagacuuuucugugucauuguugucaaauuaugggcuuguggaggauauugugcgaucaucaauuucacgagcuggucgcuuguuugccggacaacgaccaggaaauuuugcagaagacuacuuucaaggaauuguuccuuuucagaaaagacauuugcacuguuuuaauacaaacuuuggugaauagcuauuuaggugauaaugcuucaguggacgcuauuaguaauaggcuuauggagguuuguccgcauuuguauaagccugaggaugcugcuuuuacgaaggccagcgaacuucucaaaacaacacgaggcauacaaaacguagaugaaagagaagagaaacuuuuaacggcgcugcaacucugcaaaaauauagcuccaaaugugaaacuuccugugguuugcaaacaauucacugccuuaaaagcuuacaaggcugucauagaacuuugcgccuacugugcuagaaggauagaccccgacaaua

SEQ ID NO: 4970 - RNA, 656 nt, Ceutorhynchus assimilis
cagugucuauaugcguccaauggaaggaggaggaacuuggaggccugucaucaaggaagcuguucacgaaaaagaggcacuugauggaaaaucagauccucgucaaguuuauucgcagcaccuuuuccauccuggaagauuuccauuauacacauugaauaaaucuuuggggacuuuaaugaaaaacgaagucaaauuaacaucaguggcagcccuaaaacaagccauaugccuagcaauagaaaacgauauccaaaaucaauucgccgacaucgaagauauaaccgacgaggaauauuuggaaaaagccaaauggugcugggaaaaauucuacucaaguugcugucaguauuaucaaaucagccugaaacccuuaggccugaugcuucugccucaaaacucugcagcuauucucauuaggaaagcaaccuuuucacuugucagacccauggaaccuuuggaacauauguuuuugugcaacgauuccgguuucaaagaucaguuuauaaauuuugcucuuuugggcgaagaacaagacuuacuggauaaugucaagaaauuauuugauuugauugucuuuauugagagucaaaugagcaaaaauuuaaagacuacuuuugaaagggaaauugguauuacuuugcaaccaaagcuug

SEQ ID NO: 4971 - RNA, 800 nt, Ceutorhynchus assimilis
guuuguuaguaggcacaggauuagaaccaaaaaaugauuuacuagucuccaaugcauugcaauuuuuaucuaccguagccgaaagaaaucauuauagaaauuuauuugaagacgaucaaguuuuaagcagcauuugcgaaaaagucaucaucccaaauauggaauuuagagaaucugaucaagaauuguuugaagauaauccagaagaauuuacaagacgagauaucgaaggcucagauguggacacaagaagacgugcagcaugugauuugguuaacacuuuaagugugcauuucgaggaaaaaauaaugaaaauuuuuggucaguauuuacaagucauguuagccaaauucgcagagaaucccaaaaguaacuggcgacacaaggaugcagcuuuauauuuagugauaucguuagucagcagaggagcgacacaaaaacacggaguaacucaaaccaguaaauugguagauauuucccaauuuuuccagcaaaauauuguagcugaguuacagcggcccaauguagacgaacuuccuguacugaaagcugacgccauaaaauauuugaugacuuucagaucaguguugcccaguacuuuaguuguuuccagccugccccaguugauuagacauuugagcugugaaagcgcgguaguucacacuuaugcagcuuguuguauagaaaaaauacuaaucaugagagauaguaauaaucauccacaugugacaggagcucaaauucaaccuuuugcugcugaauuaauuucacaauuguuuggaguuuuggagaagccagua

SEQ ID NO: 4972 - RNA, 475 nt, Ceutorhynchus assimilis
gaacccguuucaauucgaaaucacguucgaguguauugaagaacuuaaggaagaucuggaauggaaaaugauauacguuggaucagcugaauccgaggaauucgaccaaguuuuggauucuguuuuuguuggccccauuccagagggcaagcauauguucguauuccaggcugauccaccaaacguuucgagaaucccagaaaacgacgcuuuggguguaacaguuguccuucuaaccugcuccuacagagcccaagaauucauaagagugggcuacuucaucaacaacgaguacagcgaucccgagcucaaggaauugccacccagcccaccacaauucaacaaaguuaccagaaauaucuuggcuucagaacccagaguuacccgauucaaaauuaacugggaagaaccgaacgcucaggaauccaugccuggaccaucagaaaaugccgagccuauaccuaucccgccacua

SEQ ID NO: 4973 - RNA, 651 nt, Ceutorhynchus assimilis
gcaaccaauaacaagucaggugcccccuuuggccccaaugggugggcuaacgcccacuuuaaguuugggcauggguaaugccauugcaaugccccauacaaaauaugugacugguuucaguaugccuaugggggguaauaauaguggaaugaccccacagacaccucaacauucaaugaugacuucgaugguaaauuugggggguacaggggguaguacccccaguaugacccccauagugggagggccuucgacuccaagcccgaugacccccaugacgccccauucugcugauccuggaaucguaccucaauuacaaaacaucguauccacaguuaaccuaaacugcaaacuggaccugaaaaaaaucgcuuuacaugccagaaaugccgaguacaacccgaaacguuucgccgccgucauaaugcgaauaagggaaccccgaaccacggcccugauuuucaguuccggcaaaauggugugcaccggagccaaaagcgaagaagauuccagauuagcugcccgaaaauacgcucggaucauccagaaguugggauucaacgcaaaguuucuggauuuuaaaauacagaacauggucggcaguugugacguaaaauucccgauccguuuggaagguuuagugcugacuca

SEQ ID NO: 4974 - RNA, 334 nt, Ceutorhynchus assimilis
gcuacgcugaagaaaugaacuuuacuuuugcugcuggaaaccaaguauuuuaugauggaaaaaguguaaaacaaguugacguaccaucauucucaggcaguuuugguauccuccccaaacacguccccacuuuggcuguccucaaacccggaguaguuucuguauacgaagaggaugguggugucaaaaaaaucuuuguauccagugguacaguuacuauuaaugaagacucuucaguacagauuuuggcugaagaagcacauccaauagaaaauauugaugcuucagcugcuagagaacuucucacuaaaucacaaagucaacuuucuucagc

SEQ ID NO: 4975 - RNA, 741 nt, Ceutorhynchus assimilis
ugaaagaauaagccguuccagccgugaggccgaacugaaagcaaaaaaagaaaaagaggcugcgagaaaagcuaaaaaggaggcuaaaaagcuugaagagcaaucuguucagccugcagaaauuaaagaacugacagaugaagaagcggaaaaguugcaaaaagaacuugacacuaagcaaaguguugaaaguguugcaaccucaagcgcaguuggcacuucuucugaaacaacggaugagguaacugaagaggaagaagaugaaucagaaaagggaaaaauuaaaccuaauaaaggcaaugguugcgauuugggcaaguacaaauggacgcaaacauuacaggauauugaguugagaauucccuugaacaaaaacuaucaagucaaaggaaaagaucugguagucaaucuaacgaaaaagcaucucguuugcggauucagaaacgaaccuccuauuaucgaugacgauuuucagcaugaaauuaagcuagaagaaucuacaugggugauagaagacggaaaaacucuacuuuuuaauuuggagaagaucaacaaaaugaacugguggggcaaacuagucaugucggaucccgaaauuagcaccaagaaaauuaaucccgaaccgucgaagcucagcgaccuugauggcgaaacuaggggccuuguggagaagaugauguacgaucagagacagaaggagauggguuugccuacuagcgacgaacagaagaagcaagaugc

SEQ ID NO: 4976 - RNA, 325 nt, Ceutorhynchus assimilis
gaaagauggguuugccucuauccagccuacauaaacagcaaaaaguccuuggccgaaggcagaagaauccccagaaauaaauguguugaaaacccgacuuaccaagaaauaagggauguucuugcugcagcagguuugaauguuggaguugaaaacaagcucuacagccgcgaaagaagcaaagaacuccucuacagaggucgcauucgcguucaacucaaaaacgacgacggcucuuuggucaauccugcauuuucuucaagagacacacugaugcuucaucuuggugacaugauaccaaagcugaaaacgcguuugcauaaac

SEQ ID NO: 4977 - RNA, 726 nt, Ceutorhynchus assimilis
cuacgaagaacuagaagcccaagacuaugacagaacuagacaaguauacaaagccuguuuggaacuacuaaaucauaaaguguucacuuuuuccaaaguuugguugcucuaugccaaauuugaaauaaggcaaaaaaauuuaacaucagcuagaaaaauacuuggaauggccauaggcaugugcccaagagacaaauuauuccgcggcuacauagagauagaaauucagcuaagagaauuugacaggugcagaaaauuguaugagaaauuucuggaauuugggccugagaauuguguuacuuggaugaaguuugcugaacuugaaacccuauugggcgauuuugagagagcuagaggcauuuaugagcuugcaauuaaugugccuagauuagacaugccagagcugcuauggaaaucuuauauugauuuugaaauagcucaagaagaaccagaaaaugcuaggcaaauuuaugagagacuuuuagaaagaacuucacacguuaaaguauggcugucuuaugcuaaguuugaauuaaaccaagagucugaugaugguaugaacauucguuuggccagaagaguguuugaaagagcuaaugaaaaccugaaaaguuccccggacaaagagagcagggcguugcuguuugaaaauuggaaagaguuugaaaauaugcauggagaugaaacaucucugaacaaaaucaccaacaugaugcccaagagaau

SEQ ID NO: 4978 - RNA, 770 nt, Ceutorhynchus assimilis
accgggcauuauuuaauggugcacaaaaauuauuuggcaugguuaucacuguuggucaagcuauugucuauguaaugacagguauguacggagauccugcagaaauuggagcaggaguaugccucuugaucaucauccaguuauucguugcuggacuuauaguauugcuucuggaugaacuuuuacaaaaagguuauggauuaggaucugguauuucucuuuucauugccaccaauaucugcgaaacgauuaucuggaaggccuucucaccagcuaccgucaacacuggacgugguacugaauuugaaggagcuguaauugccuuguuccacuugcucaccaccagacaagauaaaaucagggcuuugcgugaagcuuucuaccgccagaacuugccuaacuugaugaacuuauuagccacuauuuuaguguucgcuauagugauauacuuccaagguuucaggguggaccuaccuaucaaaagugcaagauaccgcggacaauauuccaguuauccaaucaaacuuuucuacaccucaaacauacccauuauuuugcaaucugcucuaguuuccaacuuguauguaauaucccaaaugcuggcaguaaaauuccaaggcaacauucugauuaauuuacugggcguuugggcagauguaggcggugguggcccagcaagaucguaccccaucggugguuuauguuacuauuuaucuccaccagaaagugugagucacauucucgaagauccaguucacgcuuuccuuuac

SEQ ID NO: 4979 - RNA, 339 nt, Ceutorhynchus assimilis
cuucuacgccucucauguacccucuacguaggcaaucuaucauucuacaccacugaagaacaaauauacgaacuauuuucaaaaugcggcgaaauccgucgaaucauuaugggccuggacaaguacaagaaaaccccgugcggguucugcuuugucgaguacuacauucgugaggacgcagaaaauuguuugcgguacauuaacgguaccagacuggacgauaggauagugaggacugauugggaugcgggcuuuauugaaggccgucaguauggacgagguaaaacuggcggucaaguuagggacgaguacaggacagauuaugaugcaggaagaggc

SEQ ID NO: 4980 - RNA, 728 nt, Ceutorhynchus assimilis
aagaaaagcacugguugguagccuggguauacuggcaggaggagcuggagccauuauuuucgcccuggacagguccgugagggcuucugaauuagaauugcacccaccuaagaacccauggagccacaauggcugguuugauuccuuagaucaugcuaguguaagaagagguuacgaaguuuacaagcaaguauguucggcuugucacucauugagguuuauugcuuaccguaacuugguaggagugacacauacugaggaagaagcuaaggcugaggcagaagaacaaaugauuacugauggaccugacgaagcugguaacauguucaaaaggccuggaaaacuguccgacuacauccccaguccuuaucccaaugaagaagcugcuagagcagcuaacaauggugccuacccaccugauuugaguuauauuacguuggccagacauggaggugaagauuacauuuucgcucuucuaacggguuaccaugaugcuccugcuggaauugcucuaagagagggccaguauuucaauccguacuuugucgguggugcuauuucaauggcccaaucuuuguacaacgaaguaauugaauauagugauggaacaccagccucugccagucaacuugcuaaggauguaucaacuuucuugaaauggaccgcagaaccagaauucgacgaucgcaaacgcaugaugguuaaggcgaucggcauuuucaccauuu

SEQ ID NO: 4981 - RNA, 748 nt, Ceutorhynchus assimilis
uuuuuccgcaaaaacccuacaaauaugcgcggcccccacaguccuaccccccgccauugacgaagacaaaauccacauccaucccgauacuguagagcuccaauacaaccccaaauacgaagaguuauuugcuccaacuguggggcccacaaaccccuucaaacccaaacaucaagaaaucgaaaaaaacacgcuuuccggccacguagaaccggcccauguaagcgaauuccaauucgaaaaccaacgccgcaccuuugcaaguuacggcuacgcuuuggaccccucuauaagcgcacaugaacaaggccucacuaaaguaauuggcgacucagaagaagccaccgauucacucaaaacuguauuugaaaagacccaacucagacccuuggacaaaaggaagcgcaaaaaaaacgacaaaccggacgauauugaaggguuuuuaggccccuggggcggauucgaagacgaacaaaaaaucgcaaggccuacagaagaagaacaggccgaauugcaagaacuuguaagcaaaagaaccaaaaaaggcaaagaaccugaagaaaaacacacagaagaaaaaucaguguugcacaucaaagaugccauugauuaucaaggcagauccuucuugcacgccccccacgaugucggaguuaaccucaaaucugacaugccuccugauaaaugcuucuuaccuaaaucccacauccacuccuggaccggacacacuaaaggcgucucagcuauu

SEQ ID NO: 4982 - RNA, 672 nt, Ceutorhynchus assimilis
agcuccucuugcuguaaaaaaaguagaagcaaagaaagaaguaacuccuuuauucgaaaagaggccaagaaacuuuggaauuggucaagacauccaaccuccacgugaucuuuccagauucguaaaauggcccaaauacaucagaauccaaaggcaaaaagcugucuuacaaaaaagauugaaggugccaccaccaaucaaccaauucacccagacuuuagauaaacaaacagcaacucaacuuuucaaaguuuuggaaaaauacaggcccgaaacugcccuucaaaagaagaacagguuaaaggcaaaagcugaggcuaaaguggcuaaaaaagaagaggcucccucaaagaaacccaacacucuuagggcagguaccaacacuguuaccaaguuaauugagcaaaagaaagcccaauugguuguuaucgcccaugauguugaccccauugagcuuguacucuuccuuccagcccuuugcaggaaaaugggaguaccauacuguauuguuaaaggaaaggcucguuuggggcuccuugucagacguaaaacuugcucagcuguagccuugacccaagucgauuccggugacagauccaacuucaacaaaaucgucgaagccaucaagaccaacuucaacgaucgcggugacgaaauccguaaacacugggg

SEQ ID NO: 4983 - RNA, 768 nt, Ceutorhynchus assimilis
ucuucgagucucugguauguauuggggccucacagcucuggaacuaaugaaagcacagccugugcaaaguaaagaccacauuauugcuuauauuaaacaaugccaggacccacaaaguagaggaaucagugcuuguauuggucacgauccccacauacuucauacacuuucugccguccaaauauuggcuauguacgauaaacuugaugcaauagacugcgaagggguugugaaguauguacaaagucuccagcaaccugacggaagcuuuucgggcgauaaauggggugaaaucgauacgcguuucucuuuuuguucuguuaugacguugacuuugcuuaaaaaagaggaugcuguugauuuggacaaagcaguggaauuuguucagaguuguaagaauuuugacgguggauauggaucgaggccucuaucagagagucacgcaggauugguuuauuguaguguaggauuuuuuucacuuacaaagagauuagauuugguggauagagauacuuuggcuuggugguugugugaaaggcaacuaccuucagggggcuuaaaugguaggccagaaaaauuaccagacguuugcuauucgugguggguauuagcaucuuuggcuauauuaggaagauuacauuggauugauggagaagcgcugaaaaacuuuauuuuugcuugccaagauacugaaacuggugguuuugcagauaggccuggagauguagcggauccguuucacacaguauuuggaauugccgcauuauc

SEQ ID NO: 4984 - RNA, 656 nt, Ceutorhynchus assimilis
aagccaugccaacacuaauagaacuuauguaugauagcaguguuguagucagagauacagcagcuuggaccuucggcaggauuugugagauaauaccugaagcugccauaaaugaagccuuuuugaaaccauugcuggaaaguuugauuacuggacuuaaagcugagcccagaguuggagcaaauguuugcugggcauuuucagguuuggcugaagcugcauaugaagcugcuaaccgcgacauuggcggcggugaugauccaacuccugaaacuuauuguuuaucgcaauauuuugaauuuauagugcaaaggcuauuggaaacuacagacagaccagacggggcacaggccaaucuuaggccugcugccuacgaagcccuuauggaaaugauuaaaaauucgccuagggauuguuacguuacuguacaaaagacaacaaugaucauuuuggagagauuacaacagguccuucaaauggaaucucacauuaguaaucacaacgaucguucccaauucaacgaucuacaaucccuauuguguggcacauugcaaucuguuuugagaaaggucacuccugaggaugccccucaaauuucagaugcuguuaugacagcucuccuaacaauguucaacucaaacaaaagugguggaguc

SEQ ID NO: 4985 - RNA, 741 nt, Ceutorhynchus assimilis
aaugagaucagugugccaaugucuguggaguuugacgaguuagcaaaggcaagagaaaauccuacugaggaaaugucaaauuugguggaauuuacugaugaagaaggauauggaaaguuucuggacuugcacgaaugcuaugaaaaauacaucaacuuaaaaggcauagaaaaaguugauuacaucaguuaccugaguauguuugaucagcucuacgacauacccaaagaaagaaaaacaggcgaauaccgaaaauacuuaaauugucucauagaauaucuauguugguuuauccaaagaauaaaaccuuuauugcauuuggacauucuuuuagaugacgaagcuagaaaggcugcuauagaaugggaaacggauucuuguccuggauggccaaaagaagcagggucugcuuuggcuaauguuggagcucauuuagacuugucugcauuuucuaguugggaagaauuagcuucacucggacuagauagauugaaaucugcuuugauggcgcuggggcucaaauguggagggacuuuagaagaaagagcacaaagacuguuuucaacuaaaggucaaagcucacuggauccugccuuaaugacuaaaacaacuaaaggaaaggcaagcaaagaaaaagaauuguugagacaaagagauuuggcuaugauggaagcucaaauuuacaaacuuucugagauaguuagugaccaacgaguagcaacuaaagaaaacguccaacgg

SEQ ID NO: 4986 - RNA, 535 nt, Ceutorhynchus assimilis
acgacucucgaacguuuauuggcacguuuaaagccuucgauaagcauaugaacaugauuuugggcgacugugaagaguuuagaaaaaucaaacccaaaaauuccaaaguugaacgggaggaaaagcgaguacuuggcuuuguguuauugagaggcgaaacuguuguuucucugacuguagaaggaccuccgccaccagaagagggacugccuagaguaccgauuccaggagcaacuucuggaccaggcauuggcagagcugcaggucgaggaaugccugcaggaaugagcggagucccuguaggauuacaagguccagucagagguguaggcgggccaucucagcaagugaugacgccuggaggaagaggucaaauggcggguccaccacaaaugaaccacgguccaccuaggaugggugcaccuccaccaggaaugaugggcgguccaccaccugguaugaugggcaugccuccaaaugccaugggcauggguagaggugguccaccaccgccaccaaugggaauuagaggucc

SEQ ID NO: 4987 - RNA, 681 nt, Ceutorhynchus assimilis
auuacacauaucgacugggcauuucaacuaucagcauuguuguggaagaaguuuguaccguuauuuggacuuugcucaaggaugaauguauggguauaccaaguaccgaaaagugggaaaacauuuccauggaauuugaagagcgugcaaauuuuccuaauuguaucggagccgucgauggcaaacacaucagaauuauuaagccgacaaaaaguggcucucucuuuuuuaauuauaagcauuucuucucaguccuuuuauuagccguuugugacgcgaauuauugcuucacuuauaucgauguuggagcauauggaaaguuuucugauuccacaguauucaaaaaugguccguuuuggcaaaaacuucaaaacgauucauuaaauaucccaaaaggaaaaccuuuaccuaaagaaaguauugcucaaccuuaugucauagugggugaugaagccuucccgcugacaaaaaauuuacuacggccguaugcacgaaagaaucuaaauuacaaaaaaaaaauauucaacuauagguuaacccgugcuagaagauauaucgaauguaccuucgggauauuaucaaauaaauggcgaauuuuucacagaccauugaauguaaguuuacgccuuucaaaaaaaauuauuaaagccugcugcauucugcacaacuuuguucguguaa

SEQ ID NO: 4988 - RNA, 659 nt, Ceutorhynchus assimilis; identical to SEQ ID NO: 4964

SEQ ID NO: 4989 - RNA, 672 nt, Nezara viridula
gagacgacaagagagagaacaagaaaggcaagaacgggaagaagccaugaugagauugcagcgcgauaaggaagcugaacaguuugaggcaugggcaacgcaggaagaucaguuucaucuugagcaagcaaggcugagaucaaggaucaggauagcugaugccagagcaaaaccuauugaucuucuugcaaaauauaucaauucagaagaagaaguggaugcuguugagaugcaugaaccauauacuuaucuuaauggucuaucaauuaaagaccuugaagaccucguugaagauauuaaggucuauaugaaauuagaaaaaggaaaaaauuuggauuacuggaaugauauuacuguuauuguugaagaugaauuguauaagcugaggaaaaugggaaagaaaucagacuaugaagcagcuguuggcagaagagaagguauucaugaaucuguagcuaaagaaguaucuucagucuucagagguaaaacagcuucacaacuugcagccaugcaaaaacagauugagaagaaaaucagugauaaaggugaaggaaucgauauuggauacugggaaucucuucuuucccaacuaaaagcucauauggcacgagcucgucucagagauaaacaccaagaaaaccuaaaacagaaauuggaauuacucaaagcgga

SEQ ID NO: 4990 - RNA, 792 nt, Nezara viridula
caguggaaucugauaaggcaccggaagcuauaagcaaagccguugcuucauuacccccugagcaaauguuugagcuaaugaaacagaugaagcuuuguauacaaaacaauccuacagaagguaaagcaauguuguuacagaauccucagcuagcguaugcucuuuugcaagcccaggucgugaugaggauaguagauccacagauugcuaucacaauguugcacaaggccaacccaagcguaccuccucuucagccgccuccugucgaggcaauacggccugugccugugccacagccugcuccagcugucgcaccgccuccaguuguaccgccaauagugcagacgagaccugucguggaaccggaguggguaccuccggcuaggccgcaucaaccaccucauccaccaacauucauuccucaaccagguggugauuuagauaugagaacauuggacccgaggguaccaccggugagauugaaucaagaccaagacuugaggauaccuccgaugguuccagcgccucagcagccuccggcucagccuccucagccguacccucaggaacaugugauaucaaguacuguucgggauccaagacaguaucgugauccucgcacaggugcagcaccuguucccgucccgccaagaccgguuguugcccaggcaguggugccaccacgaccuguagcuccuccacccagucauaucacaucagcgcuuccuccugcggcuucagaccaggagaaggcugccuuaauaaugcaaguacuacaacuuuccgaggaac

SEQ ID NO: 4991 - RNA, 709 nt, Nezara viridula
uggucagauuguuggagaaguauuaaagcagcuuacugaagaaaaauuuauugucaaggcuaccaaugguccaagauauguuguugguuguagaagacaacuugauaaauuaaaacuuaaaucuggcacgaggguagcauuggacaugacaacuuuaacaauuaugcgacauuugccgagagaaguugauccauuaguguauaacaugucucaugaagauccaggagauguaacauauucugcuauuggaggucuugcagaacaaauuagagaacuucgugaggugauugagcugccucuguugaauccugaacuuuuucaacgaguugguauuacuccaccuaaaggaugucuacuuuacggcccuccugguacuggaaagacuuuguuggccagagcuguagccagccaauuagaugcaaacuuccuuaagguagucuccagugcuaucguugacaaauauauuggagaaagugcucgucuaauuagagaaauguuuaauuaugcaagagaucaccagccuugcauaauuuuuauggaugaaauugaugcuaucggaggucgacgauucucagaaggaacaucugcugaucgugaaauacaaagaacucuuauggaacuucuuaaccaaauggauggauuugauucucugggacagguuaaaaugaucauggccacuaaucgucccgauaccuuagacccugcucuu

SEQ ID NO: 4992 - RNA, 628 nt, Nezara viridula
gaagcaauaagucaugcagggacuugucucgggauccuagcaaacgauggcauuauucuuguagcugagaaaaggaauacuaacaaacuucuugaugaaucaguauauucagaaaaaauuuucaaacuaaaugagaacaugauaugcaguuuagcugggaucacagcugaugccaauguucugacuaaugaguuaaggcuuauuucucaaagauauuuguuacaauauggagaaacaauuccuugugaacaacuugucucgugguugugugacaucaaacaagcauacacucaguauggagguaaaaggccguuuggaguauccauauuauauauggguugggauaagcacuauggauaucaacuuuaccagucugacccaaguggaaauuacucugguuggaaggcaacauguauagggcauaacaguggugcagcuguuuccaguuugaagacugauuacaaagaaggugaaaugacagugaaagaugcuuuggcuuuggguaucaaaguucuaaguaaaacauuagauacugcuaagcuuucaguugauagaguugaaguugcgacauuaucucaaaagaauggaaaauguguuacuuguauccuaccuacugaagagguucaag

SEQ ID NO: 4993 - RNA, 740 nt, Nezara viridula
auuggggccaugaauauguuagacaauuggaaggagagauagcggaugaaugggccucuacagaagaaaaagauaagcugcuagguuugguggagaguauaauuaaauuugauauggagcauaaugcagaaauccaagccugugaucucuugauggaaaucgaccgacuugauaugcuggacaagcucauggauuugacuaauuauucuagaguuugucuuuacuugauuaauugugcaguuuauguagaagagccagaaagaggaaauauuguaaaugguguuaugaaucacuacaugcgauuuaaggaauauccccgugcacugugccuugcuaugcaauuaaauaaacaugacuuaaugauagacaucuuuaaccaaugccaagauccauugguucguaaacaguuggccuuuaugguaggcaggcaacaguuaagucuggaauugagugaugaccuaccugacaaaucagaucucacuaacaucaugucuaaugcccaugugaaugaucauuuucacaguuuaggaagagaguuggauaucauggaaccuaaaaccccagaagaaguauauaaaguuugguuagaaggguugguccuucgcccaacuuacaaucuggaaguaccucucgauucugcuaggcauaaucuugcuucuacauuuguaaaugcuuuugugaaugcuggcuuuuccagagauaaguugguaucaguugaagauggcaacaaguggauguau

SEQ ID NO: 4994 - RNA, 650 nt, Nezara viridula
ucagugcacagguuacuuacgugacgggaggaggcagccgaggagaguacgugacggccaaccagccuggcuacugguccagugaguacgucuaccagcagccgcagcaggagauccagcugccuccaggaacacccuacgucuucuccagcaaugggcaggcuaccugggccaucgacgagucuuacgaucccaauaugcugucuacgagcgacaucaaggagugcguaaacugcgcggcgagcguuaccccgcuguggagaagggacgggacuggacaccaccucugcaacgccugcggccucuacagcaggaucaacggaguacacaggccaccggugaggacucaccacaagaaaguacacaauauuggcaacagaagaaauggcguaagcugugccaacugccagacaaauaauacaacccucuggcgcaggaacaauacaggagaaccagugugcaaugcuugcggccuguauuuuaaacuacacgguguaaauaggccucauaccaugaagaaggaagguauccaaaccaggaaacggaaaccaaagaacccccaaguaaaccuuccaaguccuaaaaacgauauaaagacaacaggugaaaaaucaggcaguugggauaaaugugacaacgaccuacuagac

SEQ ID NO: 4995 - RNA, 696 nt, Nezara viridula
cucuucuccaaggcauauccaggcuuugcucacacccuaauagagcuguucggaugucagcaauaaccuaucugcaaagagcgcuucucaugcaagauuuacagucccucuccggagaggaaugggaagaauguuuuacucaagugcuguuuccacuccuguccacucuauuaucuguuaauauuccagcgauugaagaaacaaggauaagggcagccacuguacuauccaagguguuccugcaccacuugucuccucugcaaacccuuccuaguuuugcacagcuauggcugacuauacuugauuauauggauaaguauaugcacgcagacaacagugaccuacuuuaugaggcuauuccugaaucauuaaaaaaccucuugcuuguaauggacucggcugguguuuucaauggauuagacgggcgcaaugagauuugggucguaacuugggaucgaauuagcucauuccuucccaaccuucaggcagaccuauuuaaagaucaucuaccaguuguagaugcuaguucacuugaaacaaaagaagcuuuagaaacaucuaaaagugaaacagaagucguucaaaccgagcaaccaacauugcaaaggccuccaggcucucaacagucaucuccucuaccuccguuaaugccuaaaccuggagaagcuguugaaauaucuggaccuacgacuaaca

SEQ ID NO: 4996 - RNA, 473 nt, Nezara viridula
guguugcuauugcuucagacuugagguuugguauucaagggcagacuguuucgacuaauuuugaaaaaauuuuugaaauggguccucacuuauacauuggacuuccuggguuaacuacugauacauuuaccguucuaaauaaacuuaaauuuagggcaaacauguuugaauugaaagaagauaggaaaauagcuccagauguguuucuuucaauggucucgaauuuguuguaugaaagaagguuugggccauuuuuuguugaaccuauaauugcuggauuaaaaccaaaaacguuugaaccuuuuauagcuucgauggauuuacuugguuguccuaacaaaccugaagauuuuguaguggcaggaacagcuucugaacaacucuacggaaugugugaagcucuuugggaaccagaucuuaguccugaagauuuauuugaaacuauaucucaagcccuuguuaaugcuugugac

SEQ ID NO: 4997 - RNA, 799 nt, Nezara viridula
caggcgaugacucuuaaugauguaacugacaauauaguuguggcuacagcuuuccauguucuugccaauagaauggcaucauccaauuuacaugaagcagccgccgauuguguuugcucucuucuugaaugccuugaagauaacaauaaucaacaaucgaucgagaugcaacuguucaacggagucauuucauuagagcaaccguuucauauuucugucgcacaugaagaacaugaaaaguguguuaauuauugucgaguauuuacagaacuugcugagaguuuccuagaaaaaauaguuagugggaguagucccaacaaagcacauuuugcuauuaagauuuucgaucucguucuaacuuguguuggucaucaugacuaugaaguagcugccauuacauuuaauuuaugguaucgucuuucggaagaauuauaccaaaagaaaaacucuggacugaccucuuuauucaaaccauacaucgaaaggcuuauugaagcauuauguagacauugucagauggaacccgaucaugaagggauccuugaagaaggggaugauuuuccugauuuuaggaugaaaguugcugaacugauucgugaugucguauucauaaucgguucuuccaacugcuuuaggcaaauguuuauuucccuacaggggccaaauaccaccugggacaccacagaagcagcguuguuuauaaugcaagcugucgccaaaaacauuauuccggaagaaaacgauguugucccuaagguugucgaggcaauuuuaaaccuuccuccaaacacacacauag

SEQ ID NO: 4998 - RNA, 709 nt, Nezara viridula
ggaaguaguggcaagaagaaaaagaagcuggcagauaagaucuuaccccagaaaguacgagaccuggugccggagucacaagcauacauggacuuauuggcauucgagagaaaauuagauucuacaauaaugagaaagaggcuugauauucaggaagcguugaaacgucccaugaagcaaaaaaggaaauuacgcauuuuuauuucuaauacuuucuauccagcuaaagaggcaacugagacggaagaaggcaguguagcauccugggagcugagagucgagggaagacuguuggaagauucuaaaaaugauccuaacaagccuccaccguuacagguaaagaggaaguuuuccucuuucuucaaaagucuuguuauugaguuggauaaagaacuauacgggccagauaaucaccucguugaauggcacagaaccccuaccacacaagaaacagaugguuuucaggucaaaagaccaggugauaaaaauguuagauguaccauacugcuccuuuuagauuaucagccuuuacaguucaaacuugauacccgacuugcucgucuucuaggaguucacacucaaacaagaccuguuauuauaagugcgcuuuggcaauauauuaagacucauaaauugcaagauccgcaugaaagagaguauauaaauugugacaaauaucuugagcaaaccuucaguuguccaaggauga

SEQ ID NO: 4999 - RNA, 297 nt, Nezara viridula
acccuagaagaauuagagcagaagaugagagaagccgaaacugaaccccacgaggguaaaagaaaaguugaaucuuuguggccaauuuuuaaaauucaucaccagaaaucgcgauauauauaugauuuauauuaucggaggaaagccauaaguaaagaauuguaugagcauugucucaaugaaaauauugcugauaaaaauuugauagccaaauggaaaaaacaaggcuacgaaagucuuugcuguuuaagaugcauucaaaccagagacacaaauuuuggaacaaguugcauaugc

SEQ ID NO: 5000 - RNA, 667 nt, Nezara viridula
gacacugaauuuccuggagugguggcaaggccuauuggugaguuccgaaguucagcugacuaucaguaucagcuucuaaggugcaauguggaucuucuccguaucauucaauugggacuuacuuucuuggaugaaaauggaaaagcuccagcugguccuuacaguaccuggcaguucaauuuuaaauuuaaucucucggaagauauguaugcucaggacaguauugaucuucuucaaaauucuggaauacaauuuaagaaacaugaagaagaugguaucgacccuguugauuuugcagaacuucucaugaccucagggaucguccugauggagaauauaaagugguuauccuuucauaguggcuaugauuucggauaccuauugaaacugcuuacgaaucagaacuuacccaaugaugaaagcgaauucuuugagcuucugaaaaucuacuucccuacuguuuaugauguuaaauaucucaugaagaguuguaaaaauuugaaagguggucuucaagagguugcugaccagcuggagcuuacgaggguaggaccacaacaucaagcuggcucggauucguuauugacaggaauggccuuuuucaaaaugagagagauguuuuucgaagauaauauagacgauggcaaauacugcggucacuuauacg

SEQ ID NO: 5001 - RNA, 718 nt, Nezara viridula
acaagggacacucaaguuuuauguuugucuccaacaagagagcuugcuguacaaauacaaaagguuauucuugcuuugggugaucucaugaauguucagugccaugcuuguauaggaggaacaagcuuaggagaagauauuagaaaacuugauuauggucaacauguuguaucugguacaccuggucguguuuucgauaugauaaaacggcgaacucuaaggacaaggucaaucaaaguauuaguucuugaugaagcugaugagauguuaaauaaagguuucaaagaacaaauuuaugauguauaucguuucuuaccuccagcuacucagguaguucuuauuucugcaacccuuccccaugaaauucuugaaaugaccagcaaauuuaugacugacccaaucagaauuuuaguuaaacgugaugaauugacauuggagggaauaaaacaauuuuuuguugcuguugaaagagaagaauggaaguuugacacacucugugauuuauacgauacuuugacuaucacucaagcuguuauuuucugcaauacaagaaggaaggucgauugguuaaccgaaaaaaugagggaugcaaauuucacaguuuguucuaugcauggugauaugccucagaaagaaagagaugcgauaaugaaggaguuuagagcuggaaaaagccgagugcuuauaacaacagacgugugggcuagagguauugaug

SEQ ID NO: 5002 - RNA, 763 nt, Nezara viridula
ugaugaaccguggaauucauccaacaacaauuuccgaugcauucagcauugcaguugaaaaggccaucccaauuuuaagagagaugucuauuccucuacaacaaaacgauaacgaaagucuuaucaggagugcaucaacaucucuuaauucaaaggucguuucucaacauucaucgauauuggcuccauuagcugugaaugcuguucuuagaauuaccgacccaaagaaagacaaaaaugucgaccuaaaagauaucaagaucauuaagaaacuuggaggcaccguggaagauacagaacucauugagggcuuagucuucacgcagaaguuggcaaauauaaacggaccaaagcgucuugagaaagucaaaauuggucucauucaguuuugcauuucucccccuaaaacagauauggaucacaacguggucaucuccgacuaugcagcaauggacaggauucuaaaagaggaaagagccuacauacucaacauugcgaagcaaaucaagaaggcuggauguacuauguuguugauccagaaaucuauuuuaagggacgccuuguccgauuuagcuauucacuucuuugacaaguugaaaauuauggucgugaaggauaucgagagggaagauaucgauuucgucuguaagacucucggcugccgacccauugcgucuuuggaucacuucaccagcgaggcucuggucagugcugagcuagcagaagaaguaucggcaggaucuucucguaucgucaaagugac

SEQ ID NO: 5003 - RNA, 737 nt, Nezara viridula
gcuucaagcugaugagaaaccagauguucaguauucggacauuggugguauggacaugcaaaagcaggaaauucgugaggccguagaauugccuuugacgcacuucgaacucuaccgccagauugguaucgacccuccuaggggcgugcugauguacggcccaccgggcuguggcaaaacuaugcuugccaaagcaguugcucaucauacuacugcugcauucaucagaguaguuggcucugaauucguucagaaauaucuuggagaaggaccgagaaugguucgugauguuuucagacucgcgaaggaaaacgcuccggccaucaucuucauugaugaaauugaugcuaucgccacuaaaagguuugaugcucagacuggugcagauagagaagugcagaggauucuauuggaacugcucaaccagauggaugguuucgaccaaaccacaaacguaaagguuauaauggcuacaaacagagcagacacauuggauccugcucugcugcgacccgguaggcuggacaggaagaucgaauucccucuuccugacaggcggcagaaaaggcucgucuucuccaccaucacugccaagaugaaccucuccgaggagguugacuuggaagacuacguagccaggccggacaggguauccggugcugacauaaaugcuauuugccaagaggcuggaaugcaugcuguccgggaaaaucguuauaucguccuugcgaaagauu

SEQ ID NO: 5004 - RNA, 347 nt, Nezara viridula
uugcaaaauguucaguaaccauaaagacuauguuggaagaucuagguauggaugaagaugaagaagaaguuguuccuuugccaaauguuaauucugcuauuuuaaagaaaguaauucaaugggcuacauaccauaaggaugauccaccaccaccugaagaugaugaaaauaaggaaaagagaacagaugacaucucaucuugggaugcagacuuuuugaaaguugaucaaggaacucuuuuugaguugauuuuggcugccaacuaucuugauaucaaaggccugcuugauguuacaugcaaaacaguggcuaacaugaucaaagguaaaacuccggaagaaauucgu

SEQ ID NO: 5005 - RNA, 714 nt, Nezara viridula
ggagucaaaugugcaagaagucaaaugcccugucacaguuuguggagauguacauggacaguuccaugacuuaauggaacuguuuagaauaggaggaaggucuccagacacuaauuauuuguucaugggugacuauguugauagaggguauuauucuguggagacagugacauuacuaguagcucuaaagguaagauaucgagaaagaaucacuaucuuaagagguaaucacgaaucacgccaaaucacacaaguauaugguuucuaugaugaauguuuacguaaauauggaaacgcaaauguuuggaaauauuucacagauuuauuugacuauuugccauugacggcucuuguuaauggucaaauauuuugucuucaugguggucuuucaccgucuauagacacucuugaucauauccgugcuuuagaucgucuucaagaaguuccacaugaggguccuaugugcgacuugcuuuggucagauccugaugacaggggugguuggggcauaucuccaagaggugcugguuacaccuucggucaagauauuucagaaacauuuaaccacucuaauggucucacucuuguguccagagcucaucaacuuguaauggaaggcuauaacuggugucaugaucguaauguuguaacaauauuuucugcaccuaauuacuguuaucguugugguaaucaagcagcuauaauggaguugga

SEQ ID NO: 5006 - RNA, 704 nt, Nezara viridula
aggcaugcagaucuuuguuaagacacuuacugguaaaacaaucacacuugaaguugagccuucagacacaauugaaaaugugaaagcuaaaauucaagauaaggaaggaauuccuccagaucagcagagguugauuuuugcagguaaacagcucgaagauggucguacauugucugacuauaauauucaaaaggaaucuacucugcauuugguccuucgucugagaggaggcaugcagaucuuuguuaagacacuuacugguaaaacaaucacacuugaaguugagccuucagacacaauugaaaaugugaaagcuaaaauucaagauaaggaaggaauuccaccagaucagcagcgauugaucuuugcuggaaaacaguuggaagauggucguacuuuaucugauuauaacauucagaaggaaucaacacuacauuuaguauuacguuuaagagguggaaugcagauuuuuguuaagacgcugacuggaaaaaccauaacuuuagaaguugaaccgucagauaccauugaaaauguaaaagccaaaauucaagauaaggaaggaauuccgccagaucagcaaaggcugaucuuugcaggaaaacaguuagaagaugggcguacucuuucugauuacaacauccaaaaggaaucuacuuuacaucuuguacuuagacuucgaggaggcaugcaaauuuuuguca

SEQ ID NO: 5007 - RNA, 747 nt, Nezara viridula
uguggaugguaaugggaaagcaacaauaucaaaugauggugcuacuauuuuaaaacauuuggauauagugcaucccgcugccaaguguuugguggauauagccaaaucucaagaugcugagguuggagacggaacuacaagcguaguccugaucacuagugaaauuuugaaacagcuaaaaccauacguugacgagggugugcauccuagaauaaugaugaaagcagugagaaaggcaacacaauuauguuuagacaaaauuaacagcuuagcuguuaagauugaaaagaguagugcagaacaacaucgcucucugcuggagaggugugcugcuacugcacucaguuccaaguugauucaucagcagaaagauuuuuuuucgaaaaugguuguugaugcuguguuguuguuagaugaacuccuuccacuugaucucauuggaaucaagaaaguaccugguggagcuuuggaggaaucuuuguuggucucugguguggcauuuaagaaaacuuuuucuuaugccggcuuugaaaugcaaccuaaaaaguacaccaauccaaaaauagcuauucucaacauugaauuagaauugaaagcagagagggacaaugccgaaaucagacuugauaauguagaggaguaucaaaaaguaguagauguugaauggcaaauucucuacgaaaaauuggacacuauuguuaaaucaggagcucagguugugcugucuaaacuuccaauaggcgaugu

SEQ ID NO: 5008 - RNA, 683 nt, Nezara viridula
aacaggaagcagagaagaagaagguucagucucaggaaauccagucccagauugaaaaacaaaaacuacuuauagcgcagaagagagaaggugugauggcagaucuugcccaaguggaaccagcuguuauugaugcucagcaggccgugaaagagauaaagaagcagcagcugguugagguuaggucuauggccaacccucccgcuguagucaaauuggcacucgaguccaucugccuccugcuaggugagagugccacugacuggaaguccaucagggccgucgucaugagggacaacuucaucaauucuaucgucaacaauuucucuacagaaaauauauccgaugaaguuagagagaagaugcauacccguuaccugaguaacccagaauacacauuugaaaaaguuaacagggccaguauggcuugugggcccauggugaagugggccguugcccagaucaguuaugcagacauguuaaagaaaguggaaccacugagggaagaauugcgaucauuagaagagcaggcuggugagaaugaacaaaaaggagaagacacaaaagcacucauugcgcaguuggagaagaguauagcagcuuacaaggaagaguacgcccaacuaauacaggaagggcuugcgauuaagcaagauuuagaaaacguucaagcuaagguugau

SEQ ID NO: 5009 - RNA, 689 nt, Nezara viridula
gaggaggaacagaugucaucugcuguauuucacuuuggcgcuaagaaaaaagauaaaucccaagaagaauacgauuuaguucuagauaaucagaucgaguuuauucaggcuaugagucuagcuggaacuaaagaaaagccugagccacaauuaacagaaaaagaaagaaaaagauugacuauugaagaaacucaaaaaagccucccuguuuacaaguuuaagaaugaacuuguacaagcuaucaaggaucaucaaguucugauuaucgaaggugaaacaggcucagguaaaacuacucagaucccacaguauuuauaccaaucaggcuuuacugaugaugguaagaagauuggauguacucagccaaggagaguugcugcaaugucagucgcagcgagaguugccgaagagauguccguuaaguuaggaaaugagguagguuacaguauucguuuugaagauugcacuucagaaagaacaauuauaaaauauaugacggaugguacucuucaccgagaauuucucucugaaccagaucugcaaacuuacagugugaugaucauugaugaagcucacgagagaacguugcauacagacauauuguucgguuuaguuaaagauauugcuagguuuagaucagaucuuaaacuucuuauauccagugcuacgcuggacgcagaaaaauucuc

SEQ ID NO: 5010 - RNA, 660 nt, Nezara viridula
ugaaggugaaguuacagagcucacaccuguagaaacagaaaauccaaugggaggguaugguaaaacuguaucccaugugaucauuggcuugaaaacagcgaaagguacaaaacaguugaaguuagacccuagcauucaugaaaguuuaaccaaggaaaagguagaaguuggagauguuauauacauugaggcuaacaguggugcuguuaagaggcaaggaaggagugauacauaugcuacugaauacgaucuugaggcagaagaauaugucccucuaccuaaaggcgauguucauaaaaaaaaagaagucauccaagaugugacauuacaugaucuagacguugcaaaugcuagaccacaaggagggcaagauguuuuaucaauaauggggcaacuuauuaagucaaagaaaacagaaauuacugacaaguuaagagcugaaauuaacaaaguuguuaacagguacauagaccaagguauugcugaacuagugccuggggugcuuuuuauugaugaaguccacaugcuggauauagaaaccuucacuuaccuucaucaggcucuugaaagugcgauagcuccuauuguagucuuugcuacaaaucgaggucguugucaaguuagaggggcugcagacauuauuucaccacauggacuacc

SEQ ID NO: 5011 - RNA, 682 nt, Nezara viridula
gugaauuugugcgcauagaagauuacaaagcuccugauaccgcuaaacguccuccugaaaaaaagucuaaaaagaaggaugaugauauuuuagauccugccgauauuccaaccaaauguguuucuuaugagaagucacuaacuguaaaugcucaaguucaauacauagauuuugaaggaagaucugauggagaaucaguacagaaaauaaucacucaguugagaccaagaagaguaauacuuguccgugguaccucagaaaauacggaagcuuuagagaagcaucuuuugcaauggucugaggcuaaaauauucugcccgaaaaaaggugauauaguggaugcuaccacugaaagucauauauaucaaauaagauugacagauucuuuaguaucuucauuacacaugcaaaaagguaaagauucagagcuugcauggauugaugcuauuaccaaauaccgucagaaacccucugacacuaugcagucgacagaagaaauggaaguugaagaagaugguaauuacagcauuuacaaugaugacuacuuaacucuggaaccucuccccuuaacugaagucaauccucaucaagcaguguuuauaaaugaguuaaaauuaucagacuugaaacaaauuuuaucucguaaugguauagaaucugaauucucuggugguguauugug

SEQ ID NO: 5012 - RNA, 780 nt, Nezara viridula
aauuggucuguuggauccucgcugggucgaacaaagagacaaacacauucaggauagaaucaaccaggagacugucuacgcaggagguucugcuauugaggccagcuugaaacaacuugcggagagaagaacugauauuuuuggugugggugaugaagaaacugcuauugguaagaagauuggugaagaggauaagaagaaagaugauaaggugacuugggauggucacacuucgagcguggaggcugcaacucgcgcugccagggcuaacaucaccaucgaggaacagauccaccagauucacaaggugaagggauugcucccugaugaagaaaaggagaagauaggacccaagccugucccaggagcggggagcagcagcggaggaaauccaauggcugguggcccccaaaucguuguccaagccaaagccccuccccucccuccuccaccgaaggugccuccacuuccaccuccagcuccucugccgccuccaccgggccuuguaccucagccacccauaaugaugguaccugcaccucuucguccuccgcuaaugguuccgccgggagcauuccccguaguugcugcuacuccuucugcuuucauggcuccaccaggaacugcgcccuugccccccgccccgcagccgcccccucaggucacucagguggggaacuuguuaaagcacgucgcuucugccucugugggcgaggcugaugaugagccuaugaccaagaaggcuaaaacagaagauugucuuguaccagaagcucaguu

SEQ ID NO: 5013 - RNA, 674 nt, Nezara viridula
uaguuuugcagugccauuugaugaagaugauaaagacaaaucaguuugguuuuuagaccaugauuauuuagaaaauauguauggcauguuuaagaaaguuaaugcaagagaaaaaguuguuggcugguaucauacaggcccaaaguuacaucaaaaugauguugcaauuaaugaacuuauacgccguuacugcccuaacucaguucuuguuauuaucgaugcaaaaccaaaggaucuugguuuaccuacagaagcauauagagcaguugaagaaguacaugaugaugguucuccuacgacaaaaacauuugagcauguucccagugaaauaggggcugaagaagcagaggaaguggguguugaacaucugcugagagauauaaaagauacaacugucggcucacuuucgcaaaggguuacuaaucaauuucuuggucucaaaggccuuaaucaacaaauucaagacaucagggauuaccuuaugcagguuguugaaggaaaauugcccaucaaccaucaaauaauauaucagcuucaagacauauuuaaucuccuuccugacaugaaccaugggaacuuuguugauucauuauacauaaaaacaaaugaucagaugcuugucguuuaucucgcugcccucguuagagcuauuguugccuugcauaaucugauca

SEQ ID NO: 5014 - RNA, 776 nt, Nezara viridula
cacaagaugaagagguuggagauggcacuacaucaguugugauucuuuguggucaaaucauggcagaaauugaaagacauauagaugaaguccauccuacgacaaucauuaaagaauuuaaaagagcuuuggaugauauuuuaaaaauacuuccagacauaaguacuucucuugaucuuaaggacaaagcuaaagugauagaagugguuaaaggauguuuagguaccaaauuuuuagguacuuggucugaaauggcuugucagauggcaauugaugcuguagauacugucagagaucuaaaaggucuuggaauugauuuaaaaaacuuugcuaaaauugaaaagguuccuggugguuuuauugaagauucuaaaguauuggaagguguaaugcuuaacaaagaugugacacaucccaaaaugucacgguucauuaaaaauccacgaauuuuauuacuagauuguucucuugaauauaagaaaggggaaagucagacuaacguggaaauaauuaaggaaggugauuauacaaggcuucuacaaauugaagaagaguacauugaaaaaaugugcaaucauauuauugagcagaaaccuaauguugucauuacugaaaaaggaauuuccgauuuggcucaacaccaucuuuucaaggcugguauuacagccauucguagaguuaagaagacugauaauaacagaauugcucgagcaguagaugcaacuauuguuagucguguggaagaaaucaaaccuuaucauauugguuguggugcu

SEQ ID NO: 5015 - RNA, 568 nt, Nezara viridula
ugcaccuucuuuuaguccauauucugaaaauggagggaguguaguagcuguagcuggcgaugacuucgcaauuauagcaucugauacacguuuaaguacagguuuucaaauuuauaccagaaaccagucaaaauuauuuaaauugucugacaaaacaauucuugguaguacugguuguuggugugauguucuuucucuuacuaggcuuguucaaacccggauaaaaauguaucaguacgaucauaauaaaguuauguccacuccagcaguugcccaaaugcucucuguacuacuuuauuauaaacgcuuuuucccauacuauguagccaauauucuugcuggaauagaugauaaugguaaaggagugguuuacaguuacgauccaaucggucaucaugaaagcucaaaauucagagcuggaggaacagcuggagcuuuauuacaaccacuguuagacaaucagcucgguauguugaaucaagaaaauguucaagacaaaacauacacuuuggaaaaagcccaugcaauuguaaaagaugucuuuauaucagcugcugaaagagauauu

SEQ ID NO: 5016 - RNA, 739 nt, Nezara viridula
gggaaugaaagggaugauguugaacguggggguaaaauuauuaugccuccuucagcacuggaucacuugacuagauuaaacauuaauuauccuaugcuuuuuaaguugcauaacgcgaaaacgaauagaucuucucacagugguguauuagaauuuguugcagacgagggaaaagucuauuuaccccacuggaugaugaggaauuuaaugcuugaagaaggugauguuauugagauagaaagugucucccugccuguugcaacuuuuucgagguuucagccucaggcuccagauuuuuuggauauuucgaauccuaaagcagucuuggaaaacugucucagaaacuuugcuuguuuaacuacuggugacauuauuaauauuaaguauaaccaaaaagauuaugagcuuucuguuuuagaaacacaaccaggggcagcaguaacaauuauugaaugugauaugaauguugaauuugcugcuccuuuaggauauaaagagccuaauucugaacaggagucauuggaugagucaucugaaagaacagaaaacuuaucuaaugagggaaguggauucaccccauucuuuggugaaggcuauaggcuugauggaaaacagaagaaagcgauugaagaugaaaauaugaaauuuaaaaucccgacugugagaggaauuccugauuaugacuggaaaguaggugugauuaccuucaugagaaaugugcgucaaccuguuaaagaag

SEQ ID NO: 5017 - RNA, 743 nt, Nezara viridula
agcuaccaucaugaagcaaauggauguggauaaugaaauugcaaaacugauggugcaacugucucaaucccaagaugaugaaauuggagauggaacuacaggagucguuguucuugcuggugcuuuguuagaacaagcugauguuuuauuagauaaagguauucauccuauuagaauugcagauggguaugaauuagcugcucgagcugccauagaacauuuagauucuaucgccacaaaauuuccuguugauccuaauaauuuagaaccucuuauuaagacugcuaugacaacucuuggaucaaaaaucguuaacaaaugucaucgccaaauggcagaaauagcuguuaaggcaguauuaucaguggcugaucuggaaaagagggaugucaacuucgagcucauaaaaguugaugguaaagucgguggaaggcuggaagauucuaugcuugucaaagggguggucauugauaaggauuucucucauccccaaaugccaaagguauuaaaggauguuaaaauagcaaucuuaacuugcccauuugaaccgccuaagccaaaaacaaaacauaaguuggauguaacaucuauugaugacuauagggcguugaggaaguacgaagaagagaaauuuaauaccaugguuucucaagucaaagaggcaggugcuacucuugcuauuugucaauggggauuugaugaugaagcaaaucaucuucuucuaaagagagaacuuccugcag

SEQ ID NO: 5018 - RNA, 195 nt, Nezara viridula
gcaguggaaaaggugaaaaaaagagguucgaaguuaaaaaauggaaugcuguugcacuuugggccugggacauaguuguugauaauugugcuauuugucgaaaucauauaauggauuuauguauugaaugccaagcuaaucaagccucugcuacaagugaggaaugcacaguggcgugggguguuuguaaucaug

SEQ ID NO: 5019 - RNA, 661 nt, Nezara viridula
uggacaagaaaguuggucaauuccagccuaaaaggguugaaaaugccagaauucuuauugcaaauacuccucuugacaccgauaaaauuaaaguuuucgguucgagaauacguguugacucuguagcuaaaguggcagauuuggaauuagcugaaaaagaaaagaugaaggaaaaaauugacagaauuauaagucauaaaugcaacguauuuguuaaccgucagcugauauauaauuauccugaacagcuauuugcugaugcuggaauuauggcaauugagcaugcagauuuugaugguauugaacgccuagcgcuugucacugggggugaaauugucucuacauuugauacaccugagcuuguuaaauuaggugaaugugauuuaauugaggaaauaaugauuggugaagacaauuuguugagguucaguggagucaaguugggagaggccugcaguauugucauaagaggcgcaacacagcaaauuguugaugaagccgaacggucucuucacgaugcauuguguguacuuguaaccacugucagggauaagaaaacuguuuuuggugguggauguucagaaauaauuauggcgagugcuguaagcgaugaagccaucaauguuacuggcaaagaagcaguugcuauggaauccuuugc

SEQ ID NO: 5020 - RNA, 689 nt, Nezara viridula
ccgguuacaucagguugaauaugcuauggaagcuguaaagcuuggagcagcaacuguuggugugaagaauaaacaguaugcuguccuuguugcucuuaaaagagcaucuucagaacuuucagcucaucaaaagaaaauuauuccucuugauaaucacauaggcaugagcauuucuggccuaacugcugaugcucguauauugagucggcaaaugagaagugaaugucuaucuuauucauauucauauggaacugaaauuccuauuaucaggcuuaugaauaaaauaucuaacaugaugcaaaguucaacucagcgcuaugacagaagaccguaugggguuggucuacugguugcaggauuugaugccgacgguccucacauuuuucaaauuuguccuucugcaaauuuguaugagugucguucaauggcuauuggugcuagaucccagagugcaaggacguauuuggaaaagcaucuagcagacauuggaaacucuggcacccucacagaccuucuuaagcaugcacuucgggcucuuagggauucuucuccuaaugauacagaacuuagcucuaagaauguagcaauagcgguaguaggaaaagauaccccacugaaggaauuaucugaggccgacacccagacuuaucuggacaugauccugagugaagagagaagaaguggcgaua

SEQ ID NO: 5021 - RNA, 680 nt, Nezara viridula
caaggaauggggugaacauaaucuaugaaagagcauuaaaagagcuuccuggaaguuauaaacugugguauaauuauuuaauacuaagaaaaagacagauuaaaggacgaugcauuacagauccuucuuuugaacauuuaaauaauacuuaugaacgaucuuuaguauuuaugaauaagaugccuaggauauggauggaauauugccaguuucuuguugaucaauguaagauuacuaaagcccgucacguauuugauagaucuuuaagggcauugccuaucacccagcaccaucguauuuggccucuuuauauaaaauucuuaaaaaaacauaacauuccagaaacugcaguccguguauuucgaagauaucuaaagcucugcccagaagauacagaagaauauauugauuauuuaacugcaauccaucgucuagaugaggccgcuguuagauuggccgauauuguaaauacugaugauuuuguuucaaagcauggaaaaucaaaccaucaguuguggacugaauuaugugauuuaaucucuaaaaauccucaggaaguuaggucucugaauguggaugcaauaauaagaagugguuugaaaaaauauacugaccaguuaggucauuuauggaauucauuagcugauuauuauaucagaaguggacuuuuugaaaaggca

SEQ ID NO: 5022 - RNA, 777 nt, Nezara viridula
gaguuauuuguucaagccggaccgguugucaauguucauaugccgaaagacagagugacgcaacaacaucaaggcuauggcuuuguugaguuuuugggugaagaagaugcugauuacgccauaaaaauuaugaacaugauaaaaguucauggaaaaccuauucgugucaacaaggcuucagcacaucagaaaaauuuggacguuggggcuaauguguucauugguaaucuggauccugagguugacgaaaaauuguuauaugacacauuuucagccuuuggagucauucugcagacaccuaagauuaugagggauccugauacaggaaauucaaaagguuuugcauuuaucaauuaugcuucauucgacgcuucagaugcugccauugaugcaaugaauggccaauuucucugcaaucgcccaguuucaguuucuuaugccuauaagaaggaugcuaaaggugaacgacauggaucggcggccgaacgucuccuagcugcucaaaacccauuaucacaagccgacagaccucaucauauguuugcagaugcucccccugcaccucugccaccuccuccaguacugccgccaccuccuguuuucaauccuccacccccuccucauaugccaccuccuccguuaccaccucaacggaugguugcuccuaugccuccaccuccuccugguccuccuccaccaaugccuccuggaaugaugccauggccuccaaugcaaccacacuuuccaccuccuccuccuccaccaccuacaaacaaa

SEQ ID NO: 5023 - RNA, 627 nt, Nezara viridula
ugaggucuuuagauuucgcugagaggcaugguuacaucaagggaguugugaaagauauuauccaugacccugguagaggagcuccuuuagcaguugugcauuuuagagauccuuacagguuuaagacccguaaagagcuuuucauugccccugaaggaauuuacacuggccaauuccuguacuguggaaagaaagccaacuuacauguuggaaauguuaugcccgucggcacuaugccugaagguacuaucaucuguaauuuggaagagaagaccggagacaggggucgguuagcuagagcuucaggaaauuaugcuaucguuauugcacacaauccugauucaagaaggaccaggguuaagcuuccaucaggugcaaagaaagucauucccucuaacaacagagccaugguugguaucguugcuggagguggacguauugauaagccaguccuuaaggcuggucgugccuauuauaaauauaaggcaaagaggaacugcuggccuaagguuagagguguugccaugaacccagucgagcauccucacgguggugguaaucaccagcacaucgguaaagcuuccaccgucaagagaggaacuucagccgguagaaagguuggucuua

SEQ ID NO: 5024 - RNA, 261 nt, Nezara viridula
gggguguuaagaagccucacagguauaggcccgguacagucgcucugagagaaaucaggagguaccagaagaguaccgagcugcucaucaggaaacucccguuccagagguuggugagggagaucgcccaggacuucaagaccgaccugagguuccagagcucggcagucauggcccuccaggaggccagcgaagccuaucucguaggucucuucgaggauaccaacuugugcgccauccacgccaagagggugaccauca

SEQ ID NO: 5025 - RNA, 681 nt, Nezara viridula
cucccugauaaaccccuagauuuacacaugauugaaauuaugacaaugcagagccgucuugaaucugaaaccagauuaguuagagggcuugucuuagaucaugguucacgucacccuaauaugcccaagaaacuaaccaaugcuuauauucuaacguguaacguaagucuugaauuugagaaaacagagauaaauaguggguuuuucuauaaaucagcacaggaaagagagaaacuggucgcauccgaaagagaguucauugaguuaagaguugcaaaaauuauugcuuugaagaaaucuguaugugauggaacagacaaaggauuuguugucauuaaucagaaagguauugauccugucucuuuggauaugcuagcuagagaaggaauaauggcucucaggcgagccaaaagaagaaauauggagagacuaacuuuagcuugugguggaguagcgaugaauagccuugaugaucucacugaagauugucuuggacgagcaggucucguuuaugagcauguucuuggagaaacuaaguauacauuugugucugauugcccaaacccucauagcgucacuguacuuguucauggcccgacuucauaugccauuacucaaauucaagaugcucuucgggaugguuugagagcugucaaaaaugcaguugaagaugguggugua

SEQ ID NO: 5026 - RNA, 677 nt, Nezara viridula
gaauguugaggucccugaauuuacuccuaaaucagguguaaaaauugcuguaacugauucgcaaauggccaauggagcuggugggcaaguugaucaagauagaauuggacaguugcagaacgaacuaccuucaaaagaaauguucaacggcuuaaauaucacaccccucgaauuugaaaaagaugaugacaauaaccuucauauggauuucaucguugcugcaucaaauuugagagcugcgaauuacaacauaccuccagcugauagacacaaaaguaaguugauagcugguaagauuauaccagcuaucgcuacuacaacaucagucguugcuggucuaguuuguauugaacucaugaaguuggcuaaggguuauaaagauauaaguuuguuuaagaaugguuuuguuaauuuggcgcuuccauucuuuggauucucugagccuauauuagcacccaaauugaaguauuacgaaaaugaauggacauuaugggaucgauuugaaguuacuggagagaugacucuuaaggaguucaucgauuacuucaaggauaaacaucagcuggaaauaacaauguuaucccaagguguuuguaugcuguauuccuucuuuauggcuaagagcaaauuagaagauagacuuaaucuuccaaugucggaagugguucguagaguuu

SEQ ID NO: 5027 - RNA, 750 nt, Nezara viridula
aauaguugauugcggcuuugaacauccuucugaagugcaacaugaguguauaccgcaagcaguucuugguauggauauacuuugucaagcgaagucuggaauggguaaaacagcuguauuuguguuagcuacccuucaacaaauggaguugacugaaaaucaaguaacaguuuugguuaugugucauaccagagaauuagcauuucaaauaagcaaagaauacgaacgauuuucuaaauauaugccaaacaucaagguugcuguauuuuuuggugguuuaccuauccagaaggaugaagaagucuuaaaaaauaauuguccucauauuguaguugguacaccaggacguauuuuagcuuuagugaagaauaaaaaacuaaauuugaaaaaccugaaacauuuugugcuagaugaaugugacaagaugcuugagcaguuagacaugaggcgugauguucaagaaauuuuuaggaauaccccucauaguaaacaaguuaugauguuuagugccacacuaaguaaagauauaaggccaguuuguaagaaauuuaugcaagauccgauggaaguguauguugaugaugaagcaaagcuaacccuacacgggcuucagcaacacuauguuaagcuaaaagaaaaugaaaaaaacaagaaauuauuugauuuacuugacaucuuagaguuuaaucagguuguaauauuuguaaaaucaguucagagauguauggcuuuggcucaacuguuauguga

SEQ ID NO: 5028 - RNA, 717 nt, Nezara viridula
cuuucuguaucaguccuccgcaauauaauaucuucauuuuauuuaaguaguccugaaaaagaugcuuuauuucuauauauugaagaugcuguagauucagauaccauccaaaaaacaaaacugaucaaaaauucuaauguuccucucuugccagaaauugaugcuuacauucauuuguugguacuugugagacuaauagaugcuggaaaggaaucagacgcugugaaguguucugaugcucuuauggccaagauaacugcucaaaaucgcaggaguuuagauuuaguggcugcuaaauguuacuuuuaccauucucgaguuuaugaacuuacuaaccaauuggaaaaaaucagaggauuccugcaugcuagacucagaacugccacucuuagaaaugauuuugaaggucaagcaguuuuaauaaauugccuuuugagaaauuacuuacauuauaaguuguaugaucaagcugacaaauuaguauccaaaucaguauacccagaaucagcaaguaacaaugagugggcuagauuucuuuauuauuuaggaagaauuaaagcagcucguuuagaauauucagaaucacacaagcaccuaguucaagcucugagaaaagcuccucaacaugcugcugucggguuuaggcagacuguucaaaagcuugcugucacuguugacuuacuucuuggugauauuccagaccgacagauauuucgu

SEQ ID NO: 5029 - RNA, 755 nt, Nezara viridula
agaaaauuuugugcgcuucaccggagauacguuagaucaugcaaaagugcaguuguucgcaugggaggcacauaacaaggguguugacguucauccucuuggagaacccaccaggcuggaaguacuuaagaaggaauuuguugggaagaaagaagaguucaaacaaaaaggacaagaagaccucauuaaaaaauaugguggagaggaacaucuaaaagccccuccuaaagaacuuuuauuggcucagacugaauauuaugcugaguauacucguuauggaacuguuauuaagggacaagaaaaagaaguggugagguccagguaugaggaagaugugcuuauaaauaaucauacaacuguauggggaucauuuuggcauucaggaaaauggggauauaagugcugucauucuuuuauuaaggggucuuauugcacuggugaagcugguagacuagcggcaucugcuggagagguagcugucaagggcccggcauuuauuccuccacauccgucuacaccaucugccuccuccucuucuacgucuuccgauucuucaucgucgucgucaucaucagaggaugaagaagagaaagaaaggaugaagaagaaacaagaaaagaagaaagcgaagaagaagaagcaaaaaguaaagaaacuuaagaacaaaaucaaaaauaagaaaccugaagaaaagacugaagaagaaaaacuucaggaagccuugaaaaaggaggaagaagcucagaaagaaggug

SEQ ID NO: 5030 - RNA, 520 nt, Nezara viridula
aacccaucagaaagaagaggaaguaugaguuaggaagaccagcagccaacacuaaguuaggcaccaaaagaguucauuugguaagaacuagaggagggaauacuaaauuuagggccuugagauuggacuauggaaauuuuucaugggguucugaauguuguaccagaaaaacucgucugauugauguagucuauaaugcaucaaacaaugagcuuguacguacuaaaacacuugugaagaaugccauaguugugauugaugcuacuccauucaggcagugguaugaagcccacuacgcucucccauuaggaaggaagaagaaugccaaauugucugaagcugaggaggcuguccuauacaaaaagagguccaggaaaacggaaaacagguauaaggcgaggcagaaacuggcuaaagucgaaccugcauuagaagaacaauuccagacuggucguuuacuugcuugccuagccagccggccugggcaauguggacgagcugaugguuacauccuugaggg

SEQ ID NO: 5031 - RNA, 736 nt, Nezara viridula
uucucuggcucuccuuaagauguuaaaacauggaagagcuggagucccuauggaaguuauggggcuuauguuaggagaauuuguugaugacuauacuguaagaguaaucgauguguuugcuaugccacagacaggaacaggugugaguguagaagcuguggauccuguuuuccaagcuaaaauguuagacauguugaagcaaaccggucgccccgagauggugguaggaugguaucauucccauccaggauuugguuguugguuaucagguguugauaucaacacucagcaaagcuuugaagcucuuucagaaagagcuguagcuguuguuguugauccaauccagagugucaaaggaaaaguugucauugaugcuuucagauuaauuaaucccaauaugaugguucuuggccaagaaccacgacaaacuaccuccaauuuggggcaucugcaaaaacccuccguacaggcuuuaauacacgguuuaaaucgccauuauuauuccaucagcaucaacuacaggaaaaaugaauuggagcaaaaaauguuguuaaauuuacauaagaagucauggauggauggacugaugcucucugacuauucagagaauuguaaaguuaaugaaaccacagucggggacaugcuugaauuagcuaagaauuacaauaaggcauuagaagaagaggagaaaaugacacccgaacaacuugcuauaaagaacguugguaagcaagau

SEQ ID NO: 5032 - RNA, 660 nt, Nezara viridula
ucguuaaagugcauccugaaggaaaguuuguuguugauauugauaaaaauauugauauaaaugaugugacuccuaacucucgaguggcuuuacgaaaugagaguuauacucugcacaaaauucuaccuaauaaggucgauccucuuguaucauugaugaugguugagaaaguuccagacucuacauaugaaaugguuggaggucuugauaagcaaauuaaggaaaucaaagaaguaauugaacuuccuguaaaacauccagaacuguuugaugcacuaggaauagcucagcccaaaggaguuuuauuauauggaccaccuggaacagguaaaacacuuuuggcaagagcaguugcccaucacacugagugcacguucauucgugugucaggaucugaguugguucagaaauucauuggggaaggauccagaaugguuagagaauuguucgucauggcaagagaacaugcuccaucuaucauauuuauggaugaaaucgauucaauagguucaucacguaucgaaucugggagugguggugauucugaaguccagagaacaauguuagaguuauugaaccaauuggauggcuucgaagccacaaaaaauauuaaggucauaauggccacuaauaggauugauauuuuggacccugcucuuc

SEQ ID NO: 5033 - RNA, 453 nt, Nezara viridula
ugguugaagacagcuuaugauguccaaaguuuuggguauuuucaaagaggaacugcccaggacaccauggcuuuugccaguaaaacaauaguugaaaggacucaaucugcgaccaggcaaucugucaaagaaggagauuauauuugucacguuuauguaagagcugacaacuuagcagggguugugauaucuaaucaugaauacccucaucgaguugcccacacucuaauaacaaaaguauuggaugaauuuagugcuaaguauccaccuucaacuugggcaucagcaaaugaagccaacauugauuuuccugcauuagcagcucaccuucaaaaauuucaaaauccaaaagaagcugaugcucuuaugaaaauucaaagugagcuugaugaaacgaaaaucauucuucauaacaccauuggagcuguuuuagagcgaggagagaaauuagac

SEQ ID NO: 5034 - RNA, 624 nt, Nezara viridula
uuucaaguggaguaugccauagaagcuauuaaguuagguuccacugcaauagguguuugcacuccagaaggaguuguaaugggagcugaaaagagaauuaaguccacauuaauggagccagaggcuguagagaagauucugcaaguugaugaucauauugguugugcaguaagugguuugauggcugauucuagaaccuuaguggagcaugcuagaguacagugccuuaaucauugguuuguuuaugaugaaaagaugccuauagagucggcugcccaggcaguuucaaauuuggcuaucagauucggugaugcugaugaagaugcuggcccagcgaugaguaggccuuuuggaguagcugucauguuugguggauuugauuauagaggaccucaacucuaucauauggacccuucagguacauucauuuauuuugaugcuaaagccauagguucuggaagcgaaggagcacaacaaagacuucaagaguuguaucauaagggaaugagccucaaagaagcuacacauaugauuuugacuauuuugaaagaaguuauggaagaaaaauugaccgauaacaacguagaaauagcaguaguaacugcagaagagaaacaauuucgu

SEQ ID NO: 5035 - RNA, 650 nt, Nezara viridula
gaucaggucacucacaaaguagcucaguaucugggcgaaguuuuagaggaucagaaggauaaauuacaggaaaaccuaauggcuaauaacacugauuuaucuaccuauauuacaaaguuccagugggauauggcuaaguauccuauuaagcaaucucuucguaauauugcugauauuauaagcaaacaagugaaucaaauugaugcugaccugaaaacaaaaucuaccgcuuacaauaaucuaaaaagcagccuucaaaauauggaaaagaagcagagugcaaguuuguugacacggaacuuagcagacuuaguuaaaaaagaacauuuuauuuuagacucugaauaucugacgacauuauuaguuguuguuccaaaaucaaacuucaaugaguggaauaccagcuaugaaaaacuuacuaauaugauaguuccccguucaagucaacuuguuuaucaggauucugauuuugguuuguucacugucucauuauuuaagaagguuguaaaugauuuuaaauuaauggcuagagaaaagaaauuuguuguacgugauuuuauuuauaaugaagaggaacuagcugcuggaaaaaaugaaauuacaaaauuggugacugacaagaagaagcaauuuggaccucuaguucguug

SEQ ID NO: 5036 - RNA, 691 nt, Nezara viridula
uaugcccuuaauugcaugguugcaucaaugggaaugacuaagcgaguagaaaaugcuaaaguugcuugucucgauuucucuuuacaaaaaacgaaaaugaaauuagguguagaaguuuuaguagaagacccuaaucaguuagaagcgauuagagauagggaagcugauauuacaaaagacagaauucaaaaaauucuuaguguuggaaccaauguaguucuuuugagugggggcauugaugacauuuauaugaaauauuucaucgaagcaaaugcuauggugguaaggaggguuaaaaaagcugacuuaaaacgaaucgcuaaagcaacuggugccucuuuugcaacaucccuaacuaauauggaaggugaagaaucauuugaugcuagcuuauuaggagaggccgcugaagugucucaagaaagaauuugugaugaugagcuuauccuuguuaaagguccaaaagcacacucagcugccuccauaauccuccguggaccuaaugauuauuucugugaugaaauggaaagaucaauucaugacucauugugugcaguaaaacggguucucgaaaguaaaacaguuguggcuggugguggagcuguugaagcugcuuuaucaaucuauuuggaaaacuuugccacaucuuuaaguucaagagaacaguuggcaaucgcugaguacgcuaaau

SEQ ID NO: 5037 - RNA, 634 nt, Nezara viridula
acagcacacuugaagaucaucaaguuaaaauuaucaaagcuccggauuuucuaacuaggacuuuauauccuaugacaacuacagcaucugugguuggaaucaaauucaauaaugguguugcuauugcugcagauguugguggcuauuauggaucauuaaaucguuucaaaucucuugauaggcucuacaaaguuaauaacaacauuguaaugacaacaacuggagauuaugcugauuuucaauacaugagagaguuaauucaacaaaaaguuaucagugaagaaauuuuagaugauaguuuuuccuuaaaagccuuuucucuucauacuuggcucacucgccugauguacaacagaaggucaaaauuugaucccuuguggaauaauguuauuguugcugguuaugauaacaauggacccuuccugggaauaguggacaaacuagguaugaguuaugaagauaguuguguagccacugguauggguggauaccucgcuacuccgcucuugagggauguguuugaacgcgguaaaggaaauuugacuaaacaagaggcccaugcugcccuucagaaauguauggaaaucuuguacuacagagauacacaaucacuuccuaaguuccgaauugcaac

SEQ ID NO: 5038 - RNA, 759 nt, Nezara viridula
guauugaucagcguucuccuaucagaguugaacgucagugcugaaaaaucauuacaaggaggucuucgagcuagccggagagcuguuaggcuacuuaaucagcugaacaaaucaacccaggcaugugaacuguauuugaaaguuuguacaaaccuccuaaaagcacaaaguaaacgagugaaaagagagggcgcaacaguggcauacgucaagagauuaucagaaguauauuuuucaaaucuagcgucuauaacuucugaauuucaauaccgugcauucccucacaaucaagauuguacaucagcuuuuguuguaugggugucaauggaagccucucauuuccuuucacacaucauaaagcaaguauucaucccucagacaccucucgguacgcuagcagagugcauagacauuauuaggaagcaaucucagcagaugugugagcuuggacuagaucuaagcuaccagguuaauggccagacuaugaccgcaguuacacgcgcaguagcugaagcaggagagaaagcuguugaugccgucaaggugagagcugccgaagacccauggagaccguccaggcagacgcagcaaucagucaacaagauucagucagaguuagggcucccuguuucagaauaucuggcucaggauggagucuuugagcugacugcaaacagccugucuuuugcuaaguuguuauccucuuugacggaugagggucuuaugauauccugucaggauuuggaguucgcacuaagu

SEQ ID NO: 5039 - RNA, 677 nt, Nezara viridula
ccgaugaagagccauaaugagaaaaaguugaaucugucuacgauuaaggaagacccugaagacaaugaagucgaagaugcgauggcagcucuugaagcuuuagcuccuucuaaagaaaugaaauucaauuacaagacugaaagagcauccaagucuccagaaaaaauuauuaaacaagaauuggagaagcccagaaaacguagucgcagccguaguagaaauagagacaaaaagagaaauaggaguaggaguagaaguagaggaagaggaagaaguaaagagaagacauccaguaaaagcaggcagagaagugugagucgagggagaagaagaagaaguagagacagaaguucuagucgaaauagaaaucauguaaagaacagggauagagaaaggagagacaaaaaugaucguaggaguagaagcaggagcaaugguagaaagaggaaugaaagaagucggagcaggagcacugguaggagaagaaaugacagaagucggagcaggagcuaugacagaaagaaaaaugacaggaaacgagaaaaugaagaugagaagaauaagaaugaugaaccucuugaacccgaaguugguaaaauauauaauggaaaaguuaccaauaucguuucuuuugguuguuuuguucaaaucgaggguuuaaagagacguugggaagg

SEQ ID NO: 5040 - RNA, 713 nt, Nezara viridula
guauuagcguggagaaggagguuuccgaagaaucaaugaauggcacaucggauccaccuaaucucagacacagaaaaacuucuaaaaaucaccagaaugggaucagugaagugacaaauaauguuaaaaagaaauuaguuuuuaaauucaacucuggggauaguauacagucugauuuuagugaaaaggaaccaugccaaaggguaguuacaauaucucguuguggcgguuggauggcaacugguggcacugaugguauuguaaggaucuggucauuuccuggccuucgaaugauuagagcucuuaaggcccacacgaaggagcuggaugauuuacauuucaguccugauucaaagcagguagccaguguggcaaaagauggacaagcaauuauuugggagcugaagucaggaaaacagguucauaaacuugauuggacucauccuacaggaaucaaauaucucuucaaacgaugucgguucggugugguugaggguaaagguuguagauuguuuacuacagcuaacccuguggcuggugggaaggaagcccaaggcuggauccacgccugggacgauggucguauuuccaagucgacugcuguaucugaaccuacuucagcacuugcuguuagagacgaugguguuuucauugcuauuggcaccauguucacaggaucuguauccauuuacauagcauucucccuucagaga

SEQ ID NO: 5041 - RNA, 701 nt, Nezara viridula
agugcguucuuugguagauuauuucuuggaucuugaagcuggaauaggaauagaaguucaacuuuguaaagaguguaucgaaugggcuaaagaugaacacaggacuuuucucaggcagucacuggaagcuaggcuuaucgcucuauauuucgacacaggaauguuuacagaagcacuacagcuuggcucaagucuucuuaaagaauuaaagaaauuagaugauaaaaauuugcuuguugaaguccuuuuguuggaaucuaaaacuuaucaugcuuugagcaaccuuucaaaagccagggcugcuuugacaucagccaggacaacugcuaauuccauauauuguccacccaaaaugcaagcagcccucgauuugcaaucugguauauuacacgcagcagaugaacaagauuucaaaacagcuuacucauauuucuaugaagcuuuugaaggcuaugauaguguagagagcccaaaggcuuuaguugcucuuaaauauaugcuucugaguaaaaucauguuaaacacaccagaagacgugcagcaguugguuagcgggaaacuugcucuuaaacaugcugguaaagauauugaugcaaugaaaucaguugcucaagccagccauaagagaucacuugcugauuuccagcuaacuuuaaaaaauuacaagaaagagcuugaggaagauccaauuguacgagcuc

SEQ ID NO: 5042 - RNA, 652 nt, Nezara viridula
aaaugcugugcaaaccuuacgugaagauuuuucauucaaagaacaguuacaugaacagcaguuauuggaaacucguacuaaaaaacaaguggaaauaagcgaacuugaugguagauuaacccaggaguaugaagaaagauuauaccagagucuccaagaaauacgcgaucaauaugaaugugauauugaaaauaacaaggaagagauuaaaaaacuguaugaggaaaaaauccgcagucuugguagucaauugacacggaacagcaaugcagcagcaauggcuauugaagaaaugaaaaauaugcaagcuaaacuuaaugagcuuaauaggaaauuacuugacuuagaagcugacagaaaugcagcccagcaaaaggcuagagauuuggaaaagauuuuggaacaggcuaaagcucaauauauggaagaauauagucagagagaagcugaaaucacaacucuucgugaagagauggcucaccaaguucaagaauaucaagauuuaauggauaucaaaguugcauuagauuuagaaauagcagcuuaucgaaaguuacuugaaggagaagaagcuagguugaauauaacaccugugaguucuccugcucagacuucuucccguaaauuuuuagggaggaaaaggaaacguacu

SEQ ID NO: 5043 - RNA, 702 nt, Nezara viridula
auuguuauggcugcuaccaacaggccuaauucaauugaugcugcucuuagacguuucggacgauuugaucgugagauugauauugguauuccagauacuacuggacguuuagaaguucuucgaauucacacaaaaaauaugaaacuugcugaugauguuaauuuagaacagauugcagccgaaacacauggucauguuggugcugauuuagcaucucucuguucagaagcagcucuucaacagauucgugaaaaaauggaucuaauugauuuagaagaagaccaaauugaugccgaaguucuuaauucucuugcuguuaccauggauaacuucagguaugcuaugggcaaaaguagcccuagugcccuucgugaaacagugguugaaguuccuaauauuacuugggaugauauugguggucucgauaauguuaaaaaagaguuacaagaauuaguucaguauccuguugaacauccagagaaguucuugaaguuuggaaugcaaccuucccgugguguuuuguuuuauggaccaccagguugugguaagacuuuguuggccaaagcuauugcuaaugaaugccaggccaacuucaucucgguuaaggguccugaauuauuaacuaugugguuuggagaauccgaagcuaauguccgugauauuuuugauaaggcuagagcugcugcaccauguguucuuuuu

SEQ ID NO: 5044 - RNA, 673 nt, Nezara viridula
uccaagucuuugugaagaacuguugucuucaguagaccaacccuuaaaaauugccauugauaaagggguugguaaagauuauuuguuaugugauuacaaucgggauggugauucauacagaucaccuuggagcaauacauaugauccucccuuagaagaugguucaaugccuucugagaggcuaagaaaacuagaaguagaagccaaugccgcuuucgaucaauauagagagauguauuuugaaggcggugugucuucuguuuaccugugggauuuggauaugacugguuuugcaggugcuauuuuaauuaaaaaggccggagaugguucgaaaaaaauuaaagguugcugggauucuauucacguaguugaaguucaagaaaagacaacugggcgaaaugcucauuacaaauuaacuucaacuguuaugcuuuggcugcaaacuaacaaaacuggcucagguacgaugaaccugggagguaguuuaacuaggcagauggaacaagaugcaccuguuucagaggcuucuccacacauugcuaauaucggccgaaugguagaagauauggaaaacaaaauuaggaacauacuuaaugauauuuauuuuggaaaaacuaaagacauugucaauggcuuaagaagcacacaggcauuaucagaacagaaagcccag

SEQ ID NO: 5045 - RNA, 677 nt, Nezara viridula
guccaacagaaucagacaguccccagcuugaccaugacaacagcuaccgguacaauuguaaauaaaucugucggggcuacacagcccguaguaccguuagcaagcaccaauaaacuuaccguaccuacaguaucugcagucgcacacccugaaccugugaaaccugucguggcaucucauaguagccugccucaacaaccugcgaggccgaccgcuacagcagccccucucacaaccgcuaagagagcgucaaucccuacaccugccacagccuuagguauaccuccuccugcgccaaccagccuugaaacagguccugucgagauuaaacaagaauuggauguuccuguuucacuagcuccugugccagaccacuuggauuucaaaaaccuuuuggaaguuaagcccgaguugaaugauauuguaacagggaugccuucaguauuugauccucugcccgacucaccccccauaauaaaggaagaaaaacaugccauacucccucaccacgcugauggacaucugaauaacucacuucccccuauaaguaacauaccuguucaaccaauuauaccgagugcugcacuuccaacaacaccacacgucuuagauaugaacaaaaauucucagccuccucagcuuccucagacaccaguuuuaccacacuccuuuaagcc

SEQ ID NO: 5046 - RNA, 693 nt, Nezara viridula
gcaggcaacaaucuucuuacaucgcaucaaggcuuggacagauauucagaagguauacaagucuaaaagguuccgugcugguaaagguaagaugcguaauaggaggcgcauucagcguagaggaccucucauuaucuacggccaggaucaaggccuaacucgugcuuuucguaacauuccugguguugaucuuaucaacguuucacgauuaaacuuacuuaaacuggcaccugguggucacguggguagguuuguaaucuggacccaaucagcuuuugaucaacuuaaugcucucuauggcacauggaagaaaaaaucaacuuugaaaaaggacuacaacuugccaaugcccaagauggugaauacugaucugucccgacuuuuuaagucugaagaaaucaagaguguccucaaaccuccaaggaagaccauagucaggaggguaaggaaacugaacccauugaggaauacacgagcaaugcugaagcucaacccauuugcugcuguucugaagaggaaagcuauuuuggcugacaggaaacuuaagcuugagagggcuauugagagaucaaagaaggaaggaguugagcuuaccccucaucaaaagagguauguugcuaugcuugagagaaggaaagcucagaucaaagccgccaaggcugcuaagccuaaaaagguuaagaagccuaaggc

SEQ ID NO: 5047 - RNA, 768 nt, Nezara viridula
ccuuaccucuugaauuggcuaaagaguuuguuucaucgaaauuucaagcaccagaagauguuuugaaagcugcaaaguuuaugguugcgacacaacugagcagggaaccucuuguucggcguuguaugcgggauacguuuuuugaaaaagcaaaaauugauguuaaaccuaccaagaaaggaucaaaggaaguugaugaaaaucauccuuguuacguuaugaaauaugucaaaggaaaaccggugagagauuuaacugcugaccaauauuugaaacugcauauugcccaucaagauaaacuuuuaaauguuucuauuagugaucauauuggaggccauacaacaacuuccuauauugaggaaauuaagcaacucuacuaccgagaugaguucaugcagcauguacaagaguggaauaauauucgucaagaauguguugacguagcgauuaagaagauguuagucccagaacugauaaaagaacuccauacucgucuccuugaagaagcuaaagaauuuguucugagaucaugugccagaaaaguuuacaauuggauuaagguggcuccauuuaauguugaauucggagaugaugaugaagaugacugggauacaagcaaggguauucgugucaugggaaucgcuuauguaccugauuuagcucaggccucuuuugccugcaugguggcuccugauggugaauguacugauuuucuuaggcuacccuaucuuuuaaaaagaaaaaauacuuggcgagaagaugaaagaa

SEQ ID NO: 5048 - RNA, 678 nt, Nezara viridula
caggguguagcucaugaaauucucggacuggaauugguuacuuuauuaguagaaaacccuacagaugauucaauugagguugcaguagcguuuuuaaaagaagcaggccagaaauuaagugaaguaacaagcaaaggcacaaaugcuauauuugauauguuaagaaauauucuucaugaaggaaaguuggagaaaaggguacaauacaugauugaaguuauguuucaaguuaggaaagaugauuuugcuacuuuuccagcaguaccagaagagcuggaucuuguagaugaagaaaaucaguucacucacuuaauuggacuugaugaugcaauagauacccaagauauacuaaauguauucaagcuugauuccgaauaucaggcaaaugaggaacguuacaaagaauugagaagugaaauucuugauacugauucugaagauagugggucugaaggaaguaguacugaagcagaagaggauucugauucugaagaugaagaaaagaaagucacaauuguagauaauacagaaacaaaccugauaucacucagaaaaacuauuuaucuaacaauucaaucaagucuugacuuugaggaaugcgcccauaaguuguugaaaauggaaauuaagccuggacaagagaaggaacuuugucauauguuucuagauugcugugcu

SEQ ID NO: 5049 - RNA, 691 nt, Nezara viridula
uacaaguacgaagcuacagccggagcuccagaaaaagagguguuguuggaugaaaaugaugaacuguggguagaauuacgucaucaacauauugcuguggucucacagaaugucacaaagaauuugaagaaguucacagagucgaaacggaugccucaaggagacaaacaguccaugagggaccuuagucaaaugauuaaaaagaugccacaauaucagaaagaacucagcaaguauucaacucauuuacaccuugcggaagauugcaugaaugccuaucaagggcaugucgauaagcucugcaagguugaacaggauuuggcuauggguaccgaugccgaaggagaacguauaaaggaccacaugagaaauauuguuccuauucuccucgaccaauccgucucaaauuaugacaagaugagaaucauccuccuuuauacucuguccaagaaugguauuucugaagagaacuugaacaaacuuguucaacacgcucagauccagccacaugagaaacaggccauugucaacuuaggaaaucuuggccuaaauguuguaguugaugguacucguauaaagaagccauaugugccuccucgcaaagagcguauuacugagcaaacauaucagaugucucguuggacaccuguaauuaaggaucucauggaagauuccauagaugacaagcucg

SEQ ID NO: 5050 - RNA, 717 nt, Nezara viridula
caagucauggccaaauuuguuuugaauauuuaccacuuaaaacuacagaaacauauuguaagcaaccuuucugacaagucugauacaaauaaauaucuaagaaacuuaauggaauuauauacuaggacuacugaacuaucugcagaauugagcuguuucaaaauggggucugacgauucauaucuucaaaagcuaacucauaauauauuucaaaaauauuuagaaucguauauaagugucgaagucaagggcuuaaaggaaaaauguucaacauuguuacaaaaauauuaugauuccaaagaucaccauaaacgacaaauacagucuggaggauuucaagacuuuagacgugaucuucaagcuguaauuggcacaagagcuaauauuaacauugcucaaauugaagauuauggaggagaaacauuuuuaucugaagaauugguuauuagucuuauacaagagucuaagcaggcguuuuacagauguaaauugcucucuaaaccugcagacuuagcaaguaaugcagugcagcuguuagaaguucuauuaaauuguauuauaauugaucauguugauuaugcuguagaauuagcuuuacaagcaguaccgauuccugaaaguaaaacacagucucagccaauuuauuucuuugauguuguaagacaggcaaauacuauugugcaucugauugaaaaacacuucaacgauucugcucuu

SEQ ID NO: 5051 - RNA, 724 nt, Nezara viridula
auggucagagacaaaucgagaccgaagagagaggcuaaggcaacuagcucucgaaacaauugauauaaacaaagaucccuauuuuaugaaaaaucauuuggguucuuacgaauguaaguuaugucucacccuacauaauaaugagggaaguuauuuagcccacacucaaggaaaaaaacaucaagcaaacuuagcaagaagagcagccaaggaagccaaagauucuccacagcaaccugcuccagauaaaccaagaauagaaccaaaaaaauuugucaaaauugguagaccugguuaucgagucacuaaacaaagagaucccgaaacuggucagcaaagucuucuuuaucaaguagauuauccagaaauugcagaaggaaucuuaccuaggcaucguuucaugucagcuuaugaacaaagaguggaaccuccagauaggaaauggcaauaucuucuauuugcugcugaaccuuaugaaacuauagccuuuaaggugcccagccgugaaguagacaaaucugaaaacaaguuuuggacacauuggaacaaagacacaaaacaauuuuuccuccaguuugcauuuaagaaugaaccucuugcuccuccuaugggugcaccucacuuaggucaaaugagaccuccacauaugcugccaccaccuaugagcguaccuccaccucccauguuuaauccuguuccaccucccccuccaaaucuaaugcuu

SEQ ID NO: 5052 - RNA, 263 nt, Nezara viridula
cguuacaugcgagacaaaaacuggagaagucuacagaggaaaguugaucgaagcugaagauaauaugaauugucaaaugaccgguuuaacuguuaccuaucgcgacggccgaguggcucaguuagaaaauguuuucauuagaggcucaaaaauacguuuucuuauauuaccggacauguugaagaaugcgccgauguucaaaaaacaagggaauaaagguaauacuggugcggggagagguaaaucugcaauucucagagcuc

SEQ ID NO: 5053 - RNA, 659 nt, Nezara viridula
cuugauacucugaggaaggcuguuacuggucaagaauucaggccuugggaauugucugauaauauuucuaggaucaaaauugaauuggcaucauugccuucacaggcaaaaguaauagauuugauucauaaagcagcuuucaggagugggcuuggaaauucuauuuuuguucgagaauucaauauuaagaaacuuaacagugaaacgcugcaacauuaugcugcuaauaauuuaacuggggacaaagcugccauagcugguugugguauaucccaaucugaucugacuuguuucgccgaaucccuugggcucugcccugguaguggcagugcauugccugcaucuaaguauaguggaggagaaaucaggauugaggaaaacauuccacuccagcauaccaucauugcugcugaagcaccaagcuuagacaaaagugaugcccuggccuacgcuguucugcgauaugcccuuggaacugguccuucagucuaccguggcacaggaucuggaccacuuuccaagguugcuggugugcuugucggugcucaggcccuuuccauggcacacucugacgcugggcucuuugguauuuauguugcuucuccaggcuacaacgcuaaagaggcuguugaagcagcagugaaaguuuugaagggugg

SEQ ID NO: 5054 - RNA, 189 nt, Nezara viridula
ucgaagaggaaaaugaccagaugacaaauaaacugaaagauaaaauaacugcuuuaaagcacuugucaaucgauauuggugcagaaguaaaguaccaggauaagaugcuacaugggaugucagaagacuucgaccguaccggaggcuuucuaggaaauacuaugaauagaguauuacgccucaccaaag

SEQ ID NO: 5055 - RNA, 726 nt, Nezara viridula
auuugcagcuauggguguuaacauggaaacugcucgauuuuucaagcaagauuuugaggaaaaugguuccauggagaaugugugcuuguuuuugaacuuggcaaaugacccaacuauugaacguauuaucacgccucgccuugcucucacugcugcagaguuucuugccuaccaaugugagaagcauguuuugguuauauugacagacaugucuucuuaugcagaggcccugcgagagguaucugcugccagggaagaggugcccgguagaagagguuucccagguuauauguacaccgauuuagcaaccauuuaugagagagcuggacguguugaaggcagaaauggcaguauaacucaaauuccaauucuuacuaugccuaacgaugauauuacucacccaauuccugauuugacgggauauauuacugagggccaaaucuauguugaccgucaauuacauaacagacaaauuuacccaccaauuaauguacugccaucauugucccguuuaaugaaaucugccauuggagagggaaugacccgaaaggaucauucagaugucucaaaucaauuguacgccugcuaugcuauugguaaagaugugcaagccaugaaggcuguugugggagaagaggcacuuacacccgacgaucuucucuacuuagaguucuugacaaaauuugaaaagaacuucauuucacaagguaccuacgagaacagaac

SEQ ID NO: 5056 - RNA, 745 nt, Nezara viridula
cagggucucuuggcuauuuucaaaagcgguggcaucccugcucuagugaagcuuuuaaguuccccaguggaaucuguucuuuucuaugcaaucacuaccuugcacaaccuccuucuucaucaagaaggaaguaagaccgcugugcgaguugcuggaggauugcaaaagaugguuguuuuacuacaacgaaauaaugugaaguucuuagccauugugacugacugucuccaaauucuagcuuacggcaaucaagaaaguaagcuuauuauuuuggcaucucaggguccuauugagcuagugcgaaucaugaggaguuacgauuaugagaaacugcuuuggacaacaucaagaguacuuaaaguauuaucugucuguucgaguaacaaacccgcaauaguugaggcuggagguuuaccugcacuggcagugcaccuggggcauccaucgcagcgacuuguucagaauugccuuuggaccuugagaaaucuuucagaugcuggaacaaaaguugguggcuuagaagggcuucuucagucucuuguucaacuccuggauuccucugauaucaauauuguuacuugugcagcugguaucuuaucaaauuugacuuguaacaaucaaaggaauaaagugacugugugccagguugguggugucgaugcucuuguccguacaauuauaucagcuggagacagagaagaaauuacugaaccugcuguuugugcuuugaggcaccuaacuucuc

SEQ ID NO: 5057 - RNA, 651 nt, Nezara viridula
gcugaaaaauggagaaugcaaaucauaagagaaauagcucguaaaguuucucaaauucagaaugcuggucuuggagaguuuagaauucgugauuuaaaugaugaaaucaauaaacuacugcgagaaaaagggcauugggaagcacaaauucgagaacuuggugguccagaccacucaaggucugggccuaaaaugcuggaugcugaaggaaaagaagugccaggaaauagaggcuacaaauacuuuggugcagcaaggcaacuuccuggaguuagagaguuguuugagcaggcuccuccuccaccuccgcauaagacacguggggaacuaaugagagauauugaugccucuuauuaugguuauauggacgacgaagauggaaucauuauaccacuagaagaaauugaggaaacuaaagcuauuaaaaaagcuguagcagaauggacuguaaaaaaggaaaaaucaauggaaauagacgaagaagaaaaagaagaagucgaagaagauaacaucuacaaagcagcaggaaauaaagagggcggagaagaugaugaagaggaagaugcaggggaagacgauggguucgaacugagugcuaaguuacuggaaggguacagagcucauauuccuguuccuucacaaagagaggug

SEQ ID NO: 5058 - RNA, 515 nt, Nezara viridula
ugucaaacgccauuuaacuggugaauuugaaaaaaaguauguugccaccuuagggguagaagugcaucccuuaguuuuccacaccaacagggguccuauucgcuucaauguaugggauacugcaggucaggagaaguuugguggacuuagggauggauacuauauucagggucaaugcgcuaucauuauguuugauguuacuucaaggguaaccuacaaaaguguuccuaauuggcauagagauuuaguacgcgucugugaaaacauucccauaguacuuuguggaaacaaaguagauauuaaagauagaaaagugaaagcuaaaaguaucguuuuccauagaaagaagaaccuucaauacuacgacaucagugcuaagaguaauuauaauuuugaaaagccuuuucugugguuggcucgaaaacugaucggugauccaaaucuagaauuuguugcuaugccugcucuguugccuccugaaguuaacauggauccugaauggaaggaccagauug

SEQ ID NO: 5059 - RNA, 362 nt, Nezara viridula
uuaugcucuaccguuauggcgggaaacaaggauuucugggaguagguggaacguggaacuuguaugaaguaaaaagugcugaugcugaaauuauugcaucuggaguuuuugugggauuuuucaucuacacaucaguuaucuuaauuucauacugcuuuggaacaacaaagcacaaauauagugcaguagauauaauaaugaaugugaguggaacuauauuguucaccgcuguaggaggcauagcauuacauuacuggguugguuuccaggaugaaaaccauuaugugggaauuucucaagaaaaacaaauaggacuugcauuaggcagucuuaguguaguaugugcugcuaucuaccuucuc

SEQ ID NO: 5060 - RNA, 795 nt, Nezara viridula
ugaaaggagguuugaacacaccacuuuauaacucagaguuuaguguucauccaccgucugaucagaucacaacaccgaacacuguacugacuacgccguuuucuaaucgaacucaugaaggaaggacuccagguuuccaaacuccgcaagacguaagaaccagccucaccacuccugucagagauaaauuaaacauuaauccagaggaagguggugauacaccauaugcuccuguaaauaaucaaaaacagguaaaagaggaacuugcugcucgucuuaggucacuaccacagccuaagaacgauuaugaaaucguuguuccugaagaugaaguuucguccgaaacagcugcagaggguucugguaugcuaaguguugaagaucaagcugauaucgaugcuagaaauuugaguuuccuugcucaacaacgcgaaaaagaauuaaagaguagaucacagguaauucaacgagcuuugcccagaccuggagacaucaacauaguacuccgcccggcuaauacagauccaccucuaacagaucuucagaaggcugaagagaugauaaaggaagaaaugauaacaauguuacauuaugaugccauucacagcggugagccuucuucugcaagaaaaauaggaacuguaagucaggcacagcaccuugccuaucucgaacaacacccauaccacacuuacucagaagaccaaauagagaaggccaaagaaaugcugaaagccgaaauggaaguugucaagcaagguaugaaccauggugaucugucgcuggaaacauuua

SEQ ID NO: 5061 - RNA, 347 nt, Nezara viridula
aaugguauguugcacauccagauaaauugaagaaaaaaauuaccagagaacuaauuacuacaauuuuggcaaggaagccaaaaauguguagcuuuuuggaauggaaagauuugaaaauaguauacaaaagguaugcaaguuuauauuuuuguugugccauagagcaaaaugauaaugaacugcuuacauuagaagugauucaucgauauguugaacuucuugacaaauacuuuggaaguguuugugaguuggauauuauauucaacuuugagaaagcauacuucauucuagacgaacuuuuacuuggaggugaaauucaggaaacaagcaaaaagaacguccugaaa

SEQ ID NO: 5062 - RNA, 725 nt, Nezara viridula
aaucagaagcaucgaaagguggugaaguuuucaaggagaaauuggaccacauuaaagauaaagucagugaugugcuggaggaagcagcaaaaucagaaaucgggaaaaaagcaggucagcugggagcagaaauuggaaagacugcgaggggagcugcugaaacauuaucagaaacaggacagcagaucggaaaaaguggagcuuuucaaacuaucagccaaacagcugcagcuguaaaacaagaauuagaucaauccggaauucaugcucauguuuaucagccgccacgaaaacuaagaaaaagauuggaaauaguaccagauaauaaagcuuuaaaaccugacacagaaacauuagguauugaucuccauaaggacucaaaauuuuuccaaaguuggcaacaauucaaagacaauaaugcuuauauuaacaaaguucucgauuggaaaaugaaguaugaugagagugauaaucccgucauccgagcaucucgaguauucacagacaaaguuucaaguguuauggguggccuuuuucagaaaacugaacuuucugaaacacugacggagauaugucgaauagauccgaauuuugaccgagcucacuuuuugaaagauugugagaaagauaucaucccgaauauucuugaagcuaugguccguggagauuuagacauauugcaagacuggugccaugaagguccauauaauguucuugcugcucca

SEQ ID NO: 5063 - RNA, 631 nt, Nezara viridula
ugauucagaaacagaggcaauacaagaagcuuuugccagaggagaucuuaagccaggacuuaacauuccuguuaaagauaaagucaagacaaauaauguuccucuccugaaagacacauuaagugaaaucaaguuggaccuuccguggauugaaagauuggauguaacaaacgaacaagcaccauuggccccugaacucgcuuugcagaucagggaagaagaacaaggacauaauccauuaguuuaugacgaguugaagagagaaagcguauucuauagacaagcucagaacgcagccaugaaaguguuaccaaaauugaaagaacugggccuuagaacugagaggccugacgacuauuuugccgaaauggccaagucagaucagcauaugcagaaggugaaaggugaagccaucaagaaaaaacuaaugauggaaagaauugaaaaacugagagaaauacgagcucagaagaaaguucagaaagcucuucacgcucaagcuaagguugcuaaaguucaaaguaaaaaacaaaugcuagaagaagugaaaaaguacaggaaaggagaaacuaagaguuuagcuuuccuugagccaggauuuaagccaaaagccaaaccaaacaaaucccaa

SEQ ID NO: 5064 - RNA, 677 nt, Nezara viridula; identical to SEQ ID NO: 5039

SEQ ID NO: 5065 - RNA, 754 nt, Nezara viridula
uaauguggucacaacgugauccuucucucagaaaaucuggcgugggcaaugucuuuauuaagaauuuagacaaaaguauugacaauaaggcuauguaugacacuuucucagcuuuuggcaauauucucaguugcaaaguggcacaagaugaaaauggcguuuccaaaggauaugguuuuguccauuuugaaaccgaggaagcugccacuaagucgauagauaaagugaacggcauguugcucaaugguaaaaagguuuuuguugguaaguucauuccacgaaaagaacgugaaaaggaauuaggugaaaaagccaaacuguuuaccaauguauauguuaaaaauuuuggggaagacuuuacugaugacaugcugaaagagauguuugagaaauauggaccaauuaccagucacacuguuguuguaaacaaagauggcaagucucguggcuuugguuuuguugcuuucgaagacccagaagcugcugaaagagcaguugaagaucugaauggaaaagagcuuauugaaggaaaaccacuauauguaggaagagcgcagaaaaaagcugagcgucagcaagaauuaaaacggaaauuugaacaacucaaaauggagcguaugaaccguuaucaaggcgucaacuuauauguuaaaaaucuagaugauacuauagaugaugaaagauugaggaaagaauucucuccuuucggaaccaucacuagugcaaaggucauguuagaggaagggcguaguaa

SEQ ID NO: 5066 - RNA, 794 nt, Nezara viridula
uugugaagaugcuaacccucuuauaagagcucuugcaguaagaacgauggguugcauuagaguugacaaaauaacugaauaucuuugcgaaccacucagaaaaugucugaaagaugaagaucccuaugugaggaaaacagcugcgguaugcguugcaaaauuauaugacaucaauccccagcuuguugaagaucaagguuucuuagaucagcucaaagaacuuuuaucugauuccaacccaaugguuguagcuaaugcuguugcagcacucucugaaaugaacgaagccucaguuaauggggcgccccucauugaaaugucugcugcgacuauaaacaaacuucuuacugcucuuaaugagugcacagaauggggccaaguuuucauauuagauucuuuggccaauuauaguccuaaagaugaaagagaagcucaaaguauuugugaacguauuacuccaagacuagcucaugcuaaugcugcugucguuuuaucugcaguaaagguuuugaugaaguuuuuagaaauguugccaucugaaucugacuuuguaucaacuuugacaaagaagcuugcacccccauugguuacccugcugucauccgaaccugagguucaauaugucgcuuugcgaaauauaaacuuaauuguacaaaaacgaccagauauccugaaacaugaaaugaaagucuucuuugugaaguauaaugacccuauuuauguuaaacuggaaaaacuggauaucaugauuagauuagcuucucaagcuaacauagcucaaguucuuuccgaau

SEQ ID NO: 5067 - RNA, 359 nt, Nezara viridula
aaagauugguccucuuggucuguccccuaagaaagugggugaugacauugcuaaagcuacagcagauuggaagggucugaaaauuacaguuugccuuacuauucaaaacaggcaagcugcuaucucaguuguaccaucagcggcuucucucaucauuaaagcccugaaagaaccaccaagggacaggaagaaagucaaaggaguaaaacauaaugguaaccucaccuucgaugaaauucucaccauugccaggucaaugaggccaagauccaugucuaggaaauuagaggguacuauuaaggaaauucucggcacaugccaaucuguugguuguacaguugaugguaaaacuccuuccg

SEQ ID NO: 5068 - RNA, 654 nt, Nezara viridula
agcuggaguaacugaaguuguauuagcuguaucauacagagcggaacagauggaaaaggaguugagugaugaggcaaaaaaguuggguguuaaauuaauuuuuucgcaugaaacagaaccccuggguacagcuggaccucuggcuuuagccaaagauauuuuaucaucgacuaaugaaccauuuuuuguucugaauucugauauuauuugugaauuuccguucaaagaacuuguuucuuuccauaaaaaucauggaaaagaaggaacaauuguagugacaaaaguggaagaaccaucuaaguaugguguuguuguuuaugaugagaaagguuguauugccaguuucauugaaaaaccacaagaauuuguuucuaauaaaauaaaugcaggcauguacauacuaaacccuucaguuuuaaaaagaauuaaacuggaaccaacaaguauugagaaagaaguauuuccguuuauggcugaggcaggagaauuguaugcuauggagcuuaguggauuuuggauggauguuggacaaccucaagauuuucuuacaggcaugugcuuauaucuuacaucuuugcgucagaaagcaccugaaaaguuguacgcuggcccuggauguauuggaaauguucuaguucauccuacugcucgaau

SEQ ID NO: 5069 - RNA, 670 nt, Nezara viridula
uauauuacauucgccaccgggagaauuuaacgaaguuuuuaaugaugcaaggauauuauuaaacaacgauacucuucugaaagaaggagcucuuggagucuucgggcaguacuguaaagaccagcuuacgccugugaagauuaagaacagugaguauccaguuuuaauuacagaacauaaugaucuaggauccaacagguuuuaugaugcaaggucgaaacagucauuuaaauaugauccauuaaggagagagacaucuaauuaugacucaugggaagcagaaccugguacagaaaaguggagaucagcuuuagagagugaauuagaugcauauauagcuaaacacuuugaaaguggcucugguaguguauuuucuaaaagagaggauggcaaaguaaacuugguugcgugcauagaagcccauuuauuccaaccaaaaaauugcuggaaugguuguuggcgaucucagugguuugugacaauagauucagauaaugcggaugugaaagguguuuuaaaaauucaaguucauuauuaugaagauggcaaugugcagcuugucaguuuaaaagauauuaaccaaacacugccaguuguugaugaagaacaguuaaguaaggcuuuaauuaaaauauucgaagacucugaaacagaguaccaacaagcgaua

SEQ ID NO: 5070 - RNA, 788 nt, Nezara viridula
caggauuggacaauuggguaucaaugauguagaccagagagaaccaggaguguauuuuaggauggaaagggacuugaugacaagaaaagauaaauucggaguugaaaugagagagagggugaaaugggacauacgagaaaguguugucggcuccgauucuuuugaacccaaacaugcugugauuguuaccuggaaaaauguuucguuugcugguggcauugaaaacucaguacaaacaacaaacacguuucaauugguucuagcaacagacgaaguauucacuuaugcuauauucaauuaugcucaaauuaaguggaccacacauacugaagcacgaggggacacaguuaaaggagaaggaggugugccagcauacauaggauuuaaugcuggcaauggcacaagaaguuacgaauauagaccuuauucacagacaucgacaaucagagauuugguuggccgugguugggcuaacgguuucccaggaaggcacauuuuuagaauugaugaaaauauucuuccaggaacuuguaacaaggauauugcugcagcaaguuugccucucgcauucgcuccugaaagugguaacaugcucggugguaccauagugaauauaacaggaccuuguuuugaaccaacuaugaagauuguaugcagauuugacaugaaagcuguauaugguacaguuguggacaggaauagagcaauuuguguucaaccuuucgucauggcagaagguuacauauuguuugacaucgccaucgaugacggaaaauacguuuggaagg

SEQ ID NO: 5071 - RNA, 206 nt, Nezara viridula
aagcucuguuggaauugagucugauucagaacgagugaacaaaguaauuucggagcugaaaggaaaaaacauugaagaagugauagcugcagguaaagagaaguuggcuucagugcccucaggaggugguggugccccugccgcugcugcugcugcacccgcugcagccucaccugccaaagcagccgaagagaagaaggaagcaa

SEQ ID NO: 5072 - RNA, 746 nt, Nezara viridula
agggcccaguaaaaagaaaaagggaaggucaaaacgcgcucauguuuugguugcagcugucgaaaaagccacugaaaauuuuauugaaaaaggugaaaugauagcuuaugaaaauccugauauuaagcaagaaaugcugucagcuguagaagaagugagaaaaacaggggaagcuaugagugcagcugcaagagaauuugcugaugauccaugcucaucaaucaaacgugguaauaugguacgagcagcccgcaacuugcucucugcugugacuagacuacugauucuagccgacaugguagauguacaucugcuguugaagucucuuagaguaguugaagaugaucuggucaaaguuaaaaaugcaucaagccaaccagaacugcuugaaaacauuaaagcauuuggacguaacgcuuccgaguuaaugucucaggcugccaaacggcagcuugagcuaaaggauucacagcugagggacgacuuagcugcagcacgugcuguuuugaagaaacauagcaccauguuacugacugcauccaagguauaugucagacauccagaacuugcugcugcuaaggcaaaucgugauuauguuuuuaaacaaguuugugaagcugucaauacaaucagugauguagcucaggguaaaggaccaucgaucacuaccaauccuuacgaaggcccuggcgagcuugcagcugcuuuggaugauuuugaugaacguauggugauggaaccuuugg

SEQ ID NO: 5073 - RNA, 693 nt, Nezara viridula
uggcuuaucaucaaucggaggaaaugcuccagccaguaccggacugaauuucggaagcacugcuaaaucuacuaaugcuggagccacuuuguucagugcaacuaaaagcgcacuugcgccugucaacacggcugcgacaacuucaucuuuaacauugccaccuucuuccacaacaucucucacuaguucauuaucaaacaaaccuguuacuaguacugguccuucaaucucucagcaacaaaaucuuacauuucaacaauuggaagaauugauuuugaauaaauggacugcagaauuauacgaacaggagaaaguauuuuuaaaucaagcaacacagauuaauauaugggacaagguuauuaaugaaaaugcugaaaaauuaacucaguuacauucuacuauggagaaaguacggaagcaacaaggaaaaauaaaugaugaccuagaaauuauauuuacucaucagaaggacuuggaagcaugucuuguucccauggaaaaggaagacuuacuuucgguccuuaaggcugauccgaauagaaaaaaucuguauauaaaugcuaagaaaauugauucucagauuaaaacuaugucagaggauuugaaggaaacaauugaacauaucaaugaaacgucacgaucacaugauacagaagaucccgucauccagguagggcgaauuuuaaaugcuca

SEQ ID NO: 5074 - RNA, 434 nt, Nezara viridula
gcugguaaaacaacucuucuccauagguuaaaagaugacagauuggcacagcauguaccaacacuacacccaacuucugaagaacuauccauaggaaauaucagauucacaacuuuugaccuuggaggacacacucaagcucgucgaguauggaaagauuacuuuccggcaguugaugcuauuguuuuucuuguugacgcuugugacacaacucgguuaccugaaaguaaagcagaauuagaugcccuuuugacugaugagagucucaucaacuguccuguccuuauucuuggcaauaaaauugaucuuccaggugcagcuucagaagaugaucucaggaauuuuuucaacuuauacgggcaaacaacuggcaagagcaaaguuccacgaagugaauugucuggucguccauuagagcuauucauguguucagu

SEQ ID NO: 5075 - RNA, 702 nt, Nezara viridula
aaaucauacugcugccuucaguaagcauuuugaaacacagcugauggacuaugggagacaaguuauagugaauuugguugaccauucuggcucugagggcaagcuggaaggauucuauagaaaacuagugaaugaagcaaauaaucccaaucugaaguaugaagcuuuugacuuccacagagaauguucuaagcuaagguaugauagauugaagauucucauagaucgccuggccuaugauuuagaacaaaugucggugacuaugauuguuggagauggaacuguuauaucucagcaggaagguguauucaggacaaauuguauugacugccuggacaggacuaaugugguucaaucguuguuggcuagggccaaucuuacauauauuuuacagagacuaacaauauuaaagaaaggacaaacaguugaggaucaaguuggucuugaaaacacauuuaaaauacucuggagugaccaugcagaucuaauaucaauccaguauucagguacaggagcauuaaaaacggauuauacuagaacaggaaaaagaacgaaguccggaauaauucgagaugggauaaacucucuugugcgauacuacaaaaauaauuuucagcaugguuuucguaaagaugcauuggaccuuuggcuuggucauuaccggguuucuucagaagaaggaauagucaucagaagcccucu

SEQ ID NO: 5076 - RNA, 674 nt, Nezara viridula
cagaauuaguuugccgugucaaguacugcaacacuuugccugauauuccguuugauccaaaguuuauucaauauccauuugaauccacucgguuuauccaauauaaucccacaucgcuagaacguaauuauaaauaugaaguucuuacugaacaugaucucgggguuacuauugaucucauuaacaaagauauguaugcugcugaucauaaugcaguacuugauccugcugaugagaaacuacuugaggaagauauccucacaccucaugauucuaaaaggucuagacaucauucucgaucaguuucauggcuucguagaacugaauacauuuccaccgaacaaacacguuuucaaccgcaaguuauggauaaaguugaagccaaaguuggauucagcauuaagaaaagucuuaaggaagaaacucuuuacauggauagagagagccaaauuaaagcuaucgaaaagacauaugacgaugcuaaacuaccuauagagaaacaucauagcaaaccuaaugucguuccgauagagguucuuccuguguuuccagacuuucaguuauggaaguauccuugcgcucagguuauguucgauucugauccugcaccaauaggaaagaccguaccugcucagcuagaacaaaugucucaagcuaugaucaggggugugaug

SEQ ID NO: 5077 - RNA, 662 nt, Nezara viridula
aggcaaaguuggacuaucuguguagcauuggggacaaggaaaaugcuagcgcauuagccaacagcaaguuacaggacaaaacgguuccuaagacucaucguaucgaugcgguuuuugcauuauuuaggauaucguauuuccacgguugcgauaucaaagggaugucugcagcaaucgaaaaagcaaccgaacucaucgaagggcaaggggauuggagcucuaggaauaaauuaaaagccuacgaaggaguguggaguuucgccgugagggauuauuugcgugcugcaaagcuauuuguugauguuguucccacauuugaaucauacgagcuugcugacuuugggacaauuauuaaauacacaguacuuucguguaugauagcguugcccaggugcgaguugaagaagaagcugaugcaccauggcgugauggcccaggcacuucacucucaauauagaaacuugaaggaguauuuccagucacuuuacgauggccacuaugcagaauuccuagucgcgcuagcucagguggaauccgauaugaaacgugauccucuacuucauccucauuaucgccacuaugugcaagaaaugagacuuagagcuuauaagcaaaucuugcaagcauaucguucacucucuuuagauuauauggcggaagcg

SEQ ID NO: 5078 - RNA, 733 nt, Nezara viridula
ucaaacgaaacaggauagcaaaggagguggagguagcgcugguucugcuucuccgcagucuccucuuuugucgccggcugguggaggcaucgguggacaucagucccaccaaccuuccccucaaacaucgucggucuccccaguaagacauagcccagccggaacaccacauucacagaguggugaugacaaaagcgaaggcaguggucuuccaucucccaggccaccccccaugacacccacuccgccuagcccucaucaauuccaucagauaaggcaucccucgauggugucaagguuugccagauccccugaaggaggauuaaggccacguuuggcuccucuccaaacgucugguuucaauucucccaggggaaugucgccucaaccgccaucuccucagacaaugagauugacucaacagcagcaacuucuccuucaaagacaucaacuucagcagcaaaaacagcagauucuagaacagcauccugaagcgggggcuauucugaguagacaacucuugagacaagaaccacagaggcaguacagaacauucccagguccucagaguccugguucucaaggagggucuccauuguauaguccucgugcuccaccuaguccgaugguuuaccaaggacuucagacaccgacaucuccgaugccucaguuuacccagcccacaucuccaaugcagucuccucguuuacaguaugcaccuaguaguccucau

SEQ ID NO: 5079 - RNA, 568 nt, Nezara viridula
ggaaagauuuugauugaaucagcuaauacuuauguaagcuguugugucucuguaaaaaauauugaaaggcguauauuucuccuaccaagagaaaggaaaaugaaucucaagacaaaugaaacauauggugauccugugacaaugacugauguuuaucaggaauucagcucaauuguagcugaaaaguauaaaauaaagcaguucaaaucaagaaaaauuuccaagaaauaugcuuuuggugauaacaguguuccugcagagucugaguaucuggaaauaagauauccgaguacuucuccagcacugcccagugaucucaaaggcgaaaccuuuucucacguauuuggaaccaagacaucauuuuuagaaauucuucuguuggaaagagggaucaaagguccuaguuggauugagaucacaaaugcugaaccuguucuagcuccauuuacuuggugcaaaguagaggcauccuguaugaaagccagcgauguucauguguugaaaccugguuugccgcacauuccuccauuaguuuugguuacucuucauccacaagcuguccauaauc

SEQ ID NO: 5080 - RNA, 785 nt, Nezara viridula
uuggcauccggauaaaagaagaaacugaaaucauugaaggugaaguugucgaaauacagguggaacgaccagcuacaggaguuggugccaaaguuggaaaacucacuuuaaagacuacagaaauggaaacugucuacgaccuuggaacaaagaugauugaugcucuuaccaaagaaaagguucagucgggugauguaauuacuauugacaaggcuacugguaaaauuagccgaaucgguagaucauuuaccagagcaagagauuaugaugcgacugguccucagacuagguuuguccagugcccugagggagaguuacaaaagagaaaggaaguuguacauacuguaucgauacaugaaauugaugucaucaauucuaggacccauggauucuuagcucucuuuucaggugauacuggugaaaucaagccagaagucagagaacaaaucaauacaaaaauugcugaauggagagaagaaggaaaagcagaaaucucaccugguguuuuguucauugaugaaguucauaugcuugauauugaaugcuucucauuuuugaaucgagcucuugaagaugagauggcgcccguuguuauuauggcuacaaaccgagguaucacuaacaucagaggaacuaauuauacaucaccucauggaauuccuauugaucucuuagacaggaugauaaucauuuccaccucgcaauacagggagagugagcuuagagaaauuuugaaaauuaggugugaagaagaagauugugaauugucugaugaugcuuugaca

SEQ ID NO: 5081 - RNA, 728 nt, Nezara viridula
cucauuguuuagccuccaguauaucuuuacuaagagcuucagaagucgaagauaucauugagggaaaugaugaaaaauacaaagcuguuucaguucauucuucugaaacuccuauuacgaguucuucuaaacccaaaaaagcuaugccuuggguaccuucgcuuccaaauaguucacauuuagaugcuguaccacaggcaacaccaauuaacagaaauagaguuguuaguaaaaaaguuagaagcuuuccucuuugcuuugaugacacugauccaucaucuauaauggaaaaugcuucacaaauggaaguacuuguaccaauacgucuugauauggaaauagagggacagaaacuucgugauacauuuacuuggaauaaaaaugaaaguuugauaacaccagagcaguuugcagaaauacuuugugaugaccuagauuugaauccucucaguuuugucccugcuauagcccaagcuauucgucagcaaauugaagguuuuccuacugacaauauuuuagaagaucagacugaucaaagaguuauaguuaaacugaauauacauguugguaauaccucucucguugaucaaaucgaaugggacaugagugaaaaagagaauaguccugaacaguuugcuaugaaauugugugcggaacuuggauuaggaggcgaauuuguuacagcuauugcuuauucuauucgaggacagcuuaguuggcaucagaaa

SEQ ID NO: 5082 - RNA, 515 nt, Nezara viridula
gugauggcugcuauacguaaaaaauuaguuauaguuggcgauggugcuugcggaaagacuuguuuguugauuguauuuaguaaagaucaauuuccagaaguauaugugccuacuguguucgagaauuauguugcugauaucgaaguugauggaaagcaaguggaacuagcauugugggauacugcuggucaagaagacuacgaucggcuaagaccacuuucuuauccugauacggauguuauuuuaaugaguuuuucuauugauucaccagauucauuagaaaacauaccugaaaaauggaccccugaaguaaaacauuuuugcccaaauguaccuaucauucuuguaggaaauaaaaaagauuugcgaaaugauccaaacacaauuaaagaguuggcaaaaaugaaacaagaaccaguuaaaccagaagaagguagagcuauggcugauaaaauuaaugccuuugacuaucuugaauguucugccaaaacaaaagaugggguuagacaaguguu

SEQ ID NO: 5083 - RNA, 714 nt, Nezara viridula
uuuuggaguuguggguguuacagaaaauggaauucgguuauauuuuacuacaggaagcccaccuaggccaucuacauugucucuucuucaugccaggcugccuccuggacaugcuccuaauacaucaaaugugaggauuggcagaguagcuauggcuauucauaaaucagguacauuuauuaugguaucauccaugggugacuauucuccugaccgguuauggugcuucacuauggaugguuuaucugcuuugaaguuacccuuaacagaauuugucuuuacgaauccucaaaaugcuucaauugcuauugcugaaucacgggaaaauaugaguuugacagaucgaggauuacauggacacuuucuaguuuaccagcaaaauuauccccaggauagauuuauuauuuuaagucagcagggcacagauauuuaugaaaagcugagaccuguugacauauuuggugagcuaaugcgagagaaagguggaccagacugugaagaaguaaaacaauucuuugcucagcaugguucagaucaagcaugugcaauggcucuuauacuugccugugacgaaaccaaucaacauauggcagaaugggcaacucgugcuuuuuuucuuuauggaggugacccuaaauauguucuacaaaccauucagcaaccuauacaacagccaaccaugaccaacccucuucagcaaagcauaaugcauca

SEQ ID NO: 5084 - RNA, 665 nt, Nezara viridula
gagcuuuccauccuucaagaagcugcugaucucauucauccuucuaagcaacuugaugaugcucuaaguaucuucuaugaagaagguuuaggaagaaguuuaaauugucuuauagaagaauuagcugugccugaagauuuuaauaaagaugguaccugggaaucguuuuguaguuauaguggcguuggugcugugacaucugcauuucgagauuauguugcugugagguuaaagauuugugaaaaaauguuauugcuuacugagcuugcuaugagagaugaugauggugcugcagauaggacucaacacaggagcuuagcugcccuuuguaaagcguauuauauuuuaaaauggaucuguacauccaaguccacuggaaaugcacccaugauucauguguuuucuuuggucaacccaacaucaauuaugcaaucuucucuugaacaaugugugcuuggccuugcuaauugcuuauggccauuagcaacaaauaguacacuugcucagcauuugcuaucaaccaaacaguaugcacuucuacaaacauuugcaagauuaguuggaauaaauaacuggaguuuacuacuagcagaaucauacauucugacaggacagccuggcaaggcauuugauguuuguuuaaaaaaugcuggaucagauguugu

SEQ ID NO: 5085 - RNA, 669 nt, Nezara viridula
guugguugcaccuucuaguauucagaagcagcuuucugaagcaauuggcacuauuggaaagugugauuucccaaaagauuggccugggcuucugacaaauauggucgagaaguuugccggaggugacuuccacgucauuaauggaauucuacaaacugcccauuccauauucaaaagauacagauaugaauucaaaucucaaaaguuaugggaggaaauaaaguuugucuuggacaccuuugcaaagccuuugacugaucuggcuguggcuacgcaaaaucuaacucaaguacaugcuacaaauccagaugcucuacgagugauuuauucaucacugcuccucauuucaaagauuuuuuacucucuaaauuuucaggaucugccugaguucuuugaagauaauaugaauauuuggaugccacuauuucauacacuccuuacuacugauguuaagugucuucauacugauguugaugacgaggcagguuuacuugagcaacugaggucucaaguguguucgaauauugcauuguacgcacagaaguacgaugaggaauuucaaccauaucuccaggguuuugucacugauaucuggagccuucuuguaucaguuucacuucagccuaaaaaugaucugcuugucagcaaugcacugcaguucuuaucaac

SEQ ID NO: 5086 - RNA, 470 nt, Nezara viridula
gaauccguuucaauucgaacuaacauucgaauguaucgaagaauuaaaagaagauuuagaauggaaaaugauuuauguugguucugcagagagugaagaauaugaucaaguuuuagauacuauuuauguugggccuauuccggaaggaagacacaaauuugucuuucaggcagauccuccugauguaacuaaaauaccuauugaagaugcgcuugguguuacugugguuuuacuaacuuguuguuaccguggccaggaguucgugcgaguaggauauuuuauuaauaaugaauauuccgauccugagcuaagagagaauccuccugcgauaccacaguuugacaagguuguaaggaacauuuuaggcucugaaccgaggguuacaagguucaaaaucaauugggacgacucagagucacaagaucaaccuagucaagaaucggaagaacaacagcaaacgacagaaaaug

SEQ ID NO: 5087 - RNA, 698 nt, Nezara viridula
cuuugcaaaugccaccuuuacuaccaauacaaucuucaauuaaucagccaaaaccaaugaacacuuaugccccuucaauggguuucacaacaccgcaaaguaugaugcauccacaaacaccacaaaaucucaugucaccuaugguaaauagaauggaccagacgccaaauaguauuauuaauccaaccacuccuggaccaaugacaccuaugacaccaucgucugcugacccuggcuuuaugccgcaguuacagaauauagugucuacugucaauuuagguuguaaauuagaucuuaaaaagauugcauugcaugcaagaaacgcugaauauaauccaaaaagauuugcugcuguuaucaugaggauaagagaacccagaacaacagcucuuauuuuuaguucaggaaaaaugguuugcacuggugcaaagagugaggaugauucuagacuagcagcaaggaaauaugcacgaauaauucaaaaauuaggauuccaggcuaaauuucuagacuucaaaguacaaaacaugguugguaguugugauguuaaauuucccauaagauuagaggguuugguuuuaacucauggacaauucagcaguuaugaaccugaacuuuuuccuggacuuauuuaucgaauggugaaaccucgcauuguuuuauuaauauuuguaucaggaaaagucguacucacaggu

SEQ ID NO: 5088 - RNA, 338 nt, Nezara viridula
uaaaacaagcuguuaggggcuaugcggaugagauggcauucacauuugcugcagcuaauaagguuuucuaugccaacuccaaugugaaacaaguugauguucccucuuucaguggagcuuuugguauccucccuaaacacguuccaacucuugcuguuuugaaaccugguguuguuacuguuuuugaacaagauggcuccucuaagaaaguuuuuguuucaaguggaacgguaacaauaaaugaggacucuucaguacaaguauuggcagaggaagcgcacccuguugaagaccuugaugcauccgcagcuagggagcaacucucuaaagcacaaggg

SEQ ID NO: 5089 - RNA, 663 nt, Nezara viridula
uuggcugcugaaaagaaaagaacugaaaguguugaagcugaaaagaaaaggaaagaaaagcuugcugccaaggccacuccuaaaguaauggaaauaacugacgaagaagcaaaaguaauugaagaugaagaaaaaaagagaaaagaagaugaagaaauagcucuaucaaaaccaauuacagaaaccgaaggcgaagaugaggaacaagauaaaggaaaacuuaugcccaaugcgggaaauggugcugaccuugagaauuacagguggacacaaacucuccaagaguuggaaauaagaguuccucugaagacuacuuuuaauguaaagucaagggacuuggugguagaccuugguaagacacaucugaaaauugggcugaaagggcaugaaccaauuguggacggcgaauuagagcaugaaaucaaaauugaagaaucaaccugggucauugaggauggcaagacucuauuucuaacuguugagaagguaaauaaaauggagugguggucaaggcuguuagcaacggauccugaaauagcuacccgaaaaauuaauccugaaccaucaaaguuauccgauuuggauggugaaacuaggggucugguugaaaaaaugauguaugaccaaagacaacgugagcuuggacuuccaaccucugaugag

SEQ ID NO: 5090 - RNA, 285 nt, Nezara viridula
uuugaacagcaaaaagacccgugcugaggguagaauuauugcaaaagauaaagcaauagaaaauccuacauaccaagaaauaagggauguguuaucagcagcugguuugaaaguagguguugaaaacaaacuuuacaguagagaaaaaaguaaagagcuucuuuacagaggucgaauaagaguucaguugaaaaacgacaaugguacuccauuaaauccagauuucgcuaccagagaauccguaauacuucaugcuuguucaaugauuccgaaguugaaaacacg

SEQ ID NO: 5091 - RNA, 665 nt, Nezara viridula
augcucuagaccaucuuccuaaagaacgcacugccgaaauauauaaggccuauacuauucaugagaaaaaauauggagacaggacuggaauugaggauguaaucgugagcaaaaggaaauaccaauauuuagaggaaguaagaacaaacccgaucaauuaugaugcuugguuugacuugcugaggcuugucgaagaagaggguaacguagauacuauuagggaaauguacgagagagcuauugcaaacauaccaccaucaagggaaaaagauauguggaggcguuauaucuauuuguggauuaauuaugcccuauaugaagaauuagaagcagaagaugaagacagaacaaggcaaauuuauaggacaugccucgacaucauuccucauaagacguucacguucaguaaaauauggcuguuauaugcccaguucgaaauaagacauaaaaaccuuucaacagcaagaaaaacucugggaauggcuuuaggagucuguccuagggauaagcucuaccgugguuacauagaucuugaaauacaauuaagagaauuugauagauguagaacauuauaucaaaaauuuuuggagcaugguccugaaaacuguauuacauggaugagguuugcugagcuagaaacacuauuaggugacacagauagagca

SEQ ID NO: 5092 - RNA, 663 nt, Nezara viridula
uuucuccagcuacugucaacacugguaggggaacugaauuugaaggugcugucauugcauuauuccaucuccuggcaacaaggcaagacaaaguccgugcuuugcgugaagcuuucuauagacaaaaucuuccaaauuuaaugaacuuacuggcuaccauccuuguguuugccauagugauuuauuuccagggauucaggguagaccuuccuauuaagucagcucguuaucgaggucaauacagcagcuauccuaucaagcucuucuacacuucaaacauuccuauuauucuucagucagcucuuguaucaaaucuauauguuauaucucagauguuagcugugaaauuccauggaaauguguuuguuaacaugcuuggagugugggcagauguuggagguggugguccagcccgagcuuauccagucggcggucuuuguuauuaucuaucgccuccugaaaaucuuggucauauacuugaagauccuauccaugcuauguuauacaucauuuucaugcuugguucuugugcuuucuucuccaagacuuggauugagguuucuggaucaucggcaaaagauguugcaaagcaacuuaaggaacagcaaaugguaaugcgaggucaucgugacaauuccaugauccaugaacugaacagguaca

SEQ ID NO: 5093 - RNA, 462 nt, Nezara viridula
aaaugaaucuccugaaggcgaugaguccuacuucggugacuccuuccgucgaacucaguaccuacagggaccagcauuuuaagggcucucggacagaacaggaaagacuucuucgcguaucaacuacuuuauauauuggaaauuuaucguuuuauacaacagaagaacaaauauaugaacuguuuucaaaauguggugauauuaagaggauuauuaugggauuggauaaauauaagaaaauuccauguggauucugcuuuguagaguauuaccaacgaccggaugcugagagcgcuaugagguauauuaauggaacaaggcuugacgaucguauuauaagaacagacugggaugcaggguucguugaaggaaggcaguauggaaggggaaagaguggugggcagguucgugaugaauauagaagagaauaugaugcuggacgaggugguuauggaaaaguga

SEQ ID NO: 5094 - RNA, 678 nt, Nezara viridula
ccuacagauaggcagcuuuucuacuacuaaaucauggucaagaggaaagaaagcuuuguauacuucacuugguauuuuaacgggaggaacaggcauguugauauaugcucuugaaaaaagucuucaagcuggagaucuugaacuccauccucccaaacuuccuuggagccacaguggguauuuucaaucacuggaucaugcaagcauucgacgagguuaugaaguuuacaaaaaugugugugcagccugccacaguuuaagauuuguuugcuaucgagaucuuguagguguuucacauacugaagcugaggcuaaagcggaagccgaagaacaacucguuuuggauggaccaaaugaaguuggugaaauguuuaaaaggccuggaaaacuuucugaucauaugccuaguccuuauccaaaugaagaggcugcaagagcagcuaauaauggagcauauccuccugaucuuucauacauaguuccuggacgucauggugaagaagauuauauauuccacuuacugacuggauacugugaugcuccugaagguuugauuuuaagggaaggccaauauuuuaacccuuauuuuccuggaggagccauaaguauggcacaagcauuauauaaugagauuauugaauacucugauggaacuccagccacucaaagucaauuagc

SEQ ID NO: 5095 - RNA, 732 nt, Nezara viridula
guuauguugaagcagcucacaugagcgaauuucaguuugaaaaucagcgaaagacuuuccaaaguuaugguuaugcucuugacccuucaauugauaauaugggucgcacugaagauaguauaccugucgucggggcuguagauguugcaaaagaaacuaaccugaagacaguuuuugaaucuacuucaaaacgaccucuugacaaacggaaaagaaauaaaaacgaugauccggcugauaucaauggcuuccuuggcccauggggguccuacguggaugagaaaaaaguaguuaaaccugacccugaaguugcugcugaacuugaagaauaucuugcuaagagacaaaagcuagguaaaaaaguugaagacaaaccucuggaggaaaagacaguccuucacaucaaagauccaguugauuaccaaggccgcaacuucuuacauccuccucaggauguuggagucaaccuuaagucugauucuccuccggacaaauguuuuaucccgaagucagaaauacauguuuggaaaggacacacaaaagguauuucugcuauacggugguuccccaaauaugcucaucuucuucucucuugcaguauggauugucgugucaaguugugggagguauauaaugaaagacgguguauuagaaccuauuauggacacaggcaagcuguuagagauguuuguuuuaauaaccgaggaacaaaauuccuaucagcugcuuacg

SEQ ID NO: 5096 - RNA, 650 nt, Nezara viridula
agcaagagguucagaaaguugucaauccacuuuuugaaaagcgagccaggaauuuuggaauuggucaggacauccaaccuucccgugauuuaagcagauuugucagauggcccaaauauauucguauccaaaggcagaaaucuguuuuacagaagaggcugaaaauuccuccuucaauucaucaauuuucucaaucuuuagacaagcaaacagcuacucaacuguuuaaaauucuggaaaaacacagacccgaaacugcacuugcuaagaagcagagguugaaggcuagggcagaaggaaaaauaaaacaaaaggaagaaguuccuacaaaaagaccuaauguuaucaggucugguguuaauacuguuacuagacuuguugaacagaaaaaagcucuccucguugugauugcccaugauguugacccaauugagcuggugcuuuuccuaccugcacuuugcagaaagaugaacguuccauauuguauuauuaaaggaaaggcucgucuuggcagguuagucaggagaaaaaccugcacuucaauugcaguaacccagauggaggguaaugaucguacugcuuuaaauaaggucauugaagccgucaagaccaauuacaaugacagauaugaagaaaucaagaggcacugg

SEQ ID NO: 5097 - RNA, 688 nt, Nezara viridula
aagcuggaugaaguugacaagaaagaauuuauugacuucauacuugaauguacugaugagaaaacagguggcauuggugcuuguguuggucaugauccucauauucuauauacuuuaagugcuguucaaauagcuuguaucuuaaggucauuagaccuacuuccuuuagaaaagauuguaaguuuuguggccaguuugcaaaaagaagaugguaguuuuaugggugacaaauggggugaagucgauacgagauuuucauucugugcuauugcuugucugucucuuauuggccgcuuagaugccauaaaucuugaaaaagcaguagauuuugugcuuagcugucaaaacuuugaugguggcuuugguucccaacaaaauucagaaagucaugcuggauuaaucuacuguuguguugguguuuugucaaucacacagaauuuguaucgaauagaugccgaucaacuagguuggugguuaugugagcgccaacugccuucagguggauugaauggaagaccagaaaagcuaccagauguuuguuauucuugguggguguuaucaucuuuaacuauguuaggaagacuacauuggauugauaaacagcuuuugaagaaauauauucuugcuagucaagauucugauggagguuuuagugaucgaccaggagauaugccagaucccuuccaua

SEQ ID NO: 5098 - RNA, 795 nt, Nezara viridula
gucacacauucuucagcauggagguaacuccccaguugcacguauggcagcuaguuuacagcucaaaaauaaccucacuuccaaagaucaaaacaucaaagcacaguaucaagccagguggcucgccuuucccgaggaaacuagaauguauauuaagaaaaauaucuuaggagcuuugggaacagaaaacacaaggccuagcucggcugcucaaugcgucgccuauguugcgguagcugagaucccuguuggucaguggccugauuuaauuccaacauugucugcuaauguaacuggacccacuucgacugaaaucaugaaagaggcuacucuugaagcaauugguuauauuugccaagaaauagaacaugauuguuuagcuagucaaucuaaucaaauuuuaacagcaauaguccauggaaugcggucuggugagagaaguaauuacgucagacuggcagcaacaaccgcgcuucuuaauucacuugaauucacuagggcuaauuuccagcaagauauggagcguaacuacuugauggaaguaguuugugaagcuacacagucaacugauacacaaguccguguugcagcucuacaaugucuuguuaaaauaaugacucuauacuaccaauacauggagaccuauaugggucaggccuuguuuccaauuacauuagaagcaaugaaaucugacauaaaagaaguggcucuucaaggaauugaauuuuggucuaaugucucugaugaagaagucgacuuagcgauagaagaaucagaagcuguagaaauggggaa

SEQ ID NO: 5099 - RNA, 743 nt, Nezara viridula
uaaaaccucugcuugaccucgaccaggaauuaacuaauguucaaaaggacuucacgucacagugggaagcaggaacauucccugguuggccgaaagaaacuggcaguguguuaagcaauguuggugcccaucuugacuuaucugcuuuuucauccccugaagaguuggcuucucucggucuggacagacuuaaaucagcauuaauggcuuuaggauuaaaauguggagggacauuagaagaaagggcccagcguuuauucagcacuaaagggaaaaaaucccuugauccaaauuuacuugccaagucaaagccagguaaaucaaaccgagaacgugaucuugaaagacagcgggacauagcauucuuggaagcacaagcuuauaaguuagcugaauuacuaagugaacaacgagcugcuacuaaagaaaauguucaaaggaaacaagcuagaacaggagaagaaagaggagauucggaaggugaagcaucaucgucaggaagugaaagugagggagaagaugauggaguuccguauaauccaaaaaauuuaccucuugguugggauggaaagcccauuccguauuggcuuuacaaguugcaugggcucaacaucaguuauaauugcgaaauaugugguaauuuuaucuauaaaggaccaaaggcuuuucaaagacauuuugcugaguggaggcaugcucacgguaugcguugccuuggaauuccaaauacagcacauuucgcu

SEQ ID NO: 5100 - RNA, 504 nt, Nezara viridula
cgagaacauuuauuggcacauuuaaagcauuugauaaacacaugaaucucauucuuggagauugugaggaguucagaaaaauuaaaccaaaaaauaccaaacagccagagcgggaagaaaagagaguguuaggauuuguauuguuaagaggcgaaaauauaguuucccuuacagucgaagguccuccaccuccagaagaaggguugccuagggugccccuuccuggagcaggugguggaauugguucagcaagaccugcgggacguggaguuccagcuccugguacaccagcugcaccuggucuccaagguccaguucgugguguagguggcccaucugcacaaguuaugacuccagcggggcguggaggacaaguuucugcuccuccucagaugcgugcuccacccccaggaaugcccccaaugaugggagcuccaccaaugaugaacauggcaccaggaauggcgaugggaagaggugggccaccuccucaaaugggugcuc

SEQ ID NO: 5101 - RNA, 676 nt, Nezara viridula
cccaccaauuuaggaucacaguauuucaauaacaaaggaacuuuauguauagugcuuuuggcaaugguggacuacaacuacaacuucacauuuauugacauuggaaauuaugguaguauugaagacuauggaauauuugcaaaaucaucccuuaugaaagugauugagcaaaaucagaucaauaugccugaaggagcagucauacugggugauucaacuuuuccuucaaagucuuauucaauaaagcaguauccuacagaaaaaaauuugaauguugcucaagaaauagauaaugacagacacuaucaugcaaagcgcuucguugagaauucauuugauaucuucacaucucguuuccggguauuaaggaaaccaauucacuuacuuccugaaacagugguaaaaaugacaaaagcugcaugugcuuugcauaauuggauuagaaaaucuacaaaucugauuaugacagcaaauaaugaagauaauggcugcucugguagaauaauucgagagucuuggcagaaagaugacuacagaguagaugauguagcuaaugucaugccauuacuucaacauaauuaugugccagacacgagagaaaaaagaggugaauuucuaaaauacuccaccaagaaaguagcuguuaguugucagaugacagaggagaaugacuguc

SEQ ID NO: 5102 - RNA, 786 nt, Euschistus heros
gaucaggauagcagaugcaagagcuaaaccaauugaucuucuugcuaaauacaucaauucagaagaagaaguagacgcuguugagaugcaugaaccauauacuuaccugaaugguuuguccauaaaggaccuugaagacuugguggaggauauuaaggucuacaugaaacuugagaaaggaaagaauuuggauuacuggaaugauauuacuguuaucguugaagaugaacuguauaagcuuagaaaacuggggaaaaaaucagacuaugaagcagccguugguaggagagaagguauccacgaaucaguagcuaaagaaguuucuucagucuuuagaggaaaaaccgccucacaacuugcagccaugcaaaaacagauugaaaaaaaaaucagcgauaaaggagaaggcauugauaucggguacugggagucacuucuuucccagcugaaagcccauauggcacgggcucggcuuagagacaaacaucaagaaaaucuaaaacagaaauuagaacuacuuaaagcggagcagaggcaucaagaacaagaaaucaaagaagaaccuauagaugaaucagaagaacagcaagaggcuguaguuagugaugaaaucaaacaggagaaagaugauagugaagaagaagaaggaaguggaggugaagaagaugcuggggagucuaugcugaaagaaagcuuuggagaguaugaagcuggagcguacucaccugucuacguugaucccgcuagccuugaaccaggaacucuuauaaucggugaagaggagga

SEQ ID NO: 5103 - RNA, 678 nt, Euschistus heros
guugguccuguucucucauuuaaauuaguuuaugaucgcgaaacuggaaagccuaaagguuauggauuuugugaauauaaggaucaagaaacagcucuuagugcuaugagaaauuuaaaugguuaugaaauugguggacgaucuuugaggguugauaaugcauguacugaaaaaucaagauuagaaaugcaaagucuuuuagcuggaccaccgauugauaauacauauggggaaucaguagagucugauaaggcuccugaagcuauaagcaaagccguugccucuuuaccaccagaacaaauguuugagcuaaugaagcagaugaagcuuuguauacaaaauaauccaacugaaggcaaagcaaugcuauuacagaauccucaauuagcuuaugcucuuuugcaagcccagguugucaugaggaucguagauccucagauugcuauuacaauguugcacaaggccaacccgagugugccuccucuucaaccaccuccugucgagacaauacgcccagugccugugccucagccugcuccagcaguugcuccuccucccguggugccaccaguugugcaggcgaggccaguugaaccagaguggguaccuccagcuaggccgcaucagccuccucauccaccgacauuuauaccccagccagguggugaucuggauaug

SEQ ID NO: 5104 - RNA, 675 nt, Euschistus heros
uggucagauuguuggagaaguauuaaagcagcuuacugaagaaaaguuuauugucaaggcaacaaaugguccgagauauguuguugguuguagaagacaacuggauaaaucuaaacuuaaaucugguacaaggguagcauuggacaugacuacauuaacaauuaugaggcauuugccuagggaaguagauccauuaguauauaacaugucccaugaagauccaggagaugucacguauucugcuauuggaggucuugcagaacaaauuagagaacuucgagaggugauugaacugccacuuuugaauccugaacuguuucaacguguuggcauuacuccuccgaaaggaugccugcuuuauggaccuccugguacuggaaaaacuuuacuggcuagagcuguagccagccaauuagaugcgaauuuccuuaagguagucuccagugcuauuguugauaaguauauuggugaaagugcucgucucaucagagaaauguuuaacuaugcaagagaucaucaaccuugcauaauuuuuauggaugaaauugaugccauuggaggccgaagauucucugaaggaacaucugcugaucgugaaauacaaagaacucuuauggagcuuuugaaccaaauggauggauuugauucauugggucaggugaaaaugaucauggc

SEQ ID NO: 5105 - RNA, 648 nt, Euschistus heros
ccagguugaauaugcuauggaagcuauuagucaugcuggaaccugucuugguauucuagcgaaugauggcauuauucuuguugcugaaaaaaggaauacuaacaagcuucuugaugaaucaguauacucugaaaaaauuuucaaauugaaugagaacaugauaugcaguuuagcugguauuacagcugaugcaaauguucuaacuaaugaacuaaggcucauuucucaaagauauuuguuacaauauggagaaacuauuccuugugaacaacuuguuucuuggcugugugacauuaaacaagcauauacucaguauggagguaaaaggccauuuggaguaucuauauuauauauggguugggauaagcacuauggauaucaacuuuaccagucugacccuaguggaaauuacucaggcuggaaggcaacuuguauagggcauaacaguggugcagcuguuuccaguuugaagacugauuacaaagaaggagaaaugacagugaaagaugcuuuggccuugggaauuaaaguccuaaguaaaacauuggauaccgccaagcuuucaguugauagaguugaaguugcaacauuaucccagcagaauggaaaguguguuacuugcauucuaccaccugaucaaguucaaga

SEQ ID NO: 5106 - RNA, 748 nt, Euschistus heros
agaaaaucacuggaccagacacccaccuguacguaccugcauuagaaagcaugcgagaucuuauaagaaguucuacaacaaguaugacuucagugccaaugccucugaaguuccucagaucucauuauggcgcucucaaagaagccugugcuguuauggcagauaggaaggcucaggagcuuugugcaagcauagucucuguucuagcaauggggcaggauuuaccaggggcacgagaaugucuuaaguauuguuuacaaucacaucagaaagauguuggugacuggggccaugaauauguaagacaauuagaaggagaaaucgcugaugaaugggcaucuacagaagaaaaagauaagcuacugggauugguugagaguauaaucaaauuugauauggagcauaaugcagagauucaagccugugaucucuuaauggagauugacagacuugauaugcuggacaagcacauggauuuaacuaauuauucaagaguuugucuguaccuaauuaauugugcuguguauguggaagaaccagaaagaggaaacauuguaaguggaguuaugaaacauuauaugcgauuuaaggaauacccgcgagcacucugucuugcgaugcaauugaauaagcaagauauaauguuagacauuuuuaaccaaugccaagauccguugguuagaaaacaguuagccuuuauggucggaaggcaacaauugagccuugaauugagugaugauuuggcaga

SEQ ID NO: 5107 - RNA, 712 nt, Euschistus heros
cuacaucaaggcugagacuccccuaacccccaagaacuucgcccacuucgaucacccggucaccucucauccaacacaacucagugcacagguuacuuaugugacuggaggagguagcagggaguacgugacaacuaaccagccuggcuacugguccagcgaauacguguaccagcagccucagcaggaaauccagcugccuccuggaacaccuuacgucuucuccagcaaugggcaggcuaccugggcuauugaugaguccuacgaucccaguaugcugucggcuagcgacaucaaggagugcgucaacugugcggcaagcgugaccccgcuguggcggcgggacgguaccggacaccaccucugcaacgccugcggccucuacagcaggaucaacggaguacacaggccaccgauugguaacaggagaaauggcguaaguugcgccaacugccagacaaauaacacaacccuguggcgcagaaacaacacaggagagccagucuguaaugccugugggcuguauuuuaaacugcaugguguaaacaggccacauacaaugaagaaggaaggcauccaaacuaggaaacggaaaccuaagaacccucaaguuaauauaccaaguccaaaaaacgacauuaaagcaccaggugaaaaaucaggcaguugggauaaaugugauaaugaccuacucgacaguggcuauacaaug

SEQ ID NO: 5108 - RNA, 667 nt, Euschistus heros
cuuggugacagagcucuaucuuaauuacgauugcucucuuuacugccccaauuuguaugaagaacuaaccaaccuguugucuaagaaugcuuucccuguaacuggugucuauaacacacauuuacuaucuuuggaugcuuuauugacaguuauagacucuauagaaagucauuguaauagccgaauauuaaaugaaaggcaaaauccaucaaaagauggagaaauuaauaaauuagaauuucacgauuuugccagcaauuauauaaaucggacugggacccgucaaaaguugucacugaacauuccaagucaugagcaauuaauggcugugaaaagaaaaaaaaaacuucuggcuacuggaacugaacauuucaauucaaaaccaaaaaaaggaauccaguuuuuacaggaacauaaccuucuuucgacuccuuuagaugcaguugaagucguugccuuuuugagagaaaacccccaccucgauaaaaaaaugauuggagaauauauuaguaauagagccaacaucgcuauacuugaucaauuuguaaaaucauucgacuuuacugagcugcgcaucgaugaagcauuaagguuguauuuagaaacuuucaggcuaccuggagagucuccucucauaucuuuagugauggaacauuuugcugaacac

SEQ ID NO: 5109 - RNA, 512 nt, Euschistus heros
guguugcuauugcuucugacuugagguuugguauucaaggacagacugugucaaccaauuuugaaaaaauuuuugaaauggguccucaucuauuuauuggacuuccugguuuaacuacugauacuuuuacuguucuaaauaagcuucaauuuaggaaaaauauguuugaguuaaaagaagauaggaaaauagcaccagauguauuucuuucuauggucucaaaucuuuuguaugaaagaagguucggaccauuuuucguugaaccaauaauugcugguuugaacccaaaaacuauggaaccuuuuauagcuucgauggauuuacuuggcugcccuaacaaaccggaagauuuuguuguggcagguacagcuucugaacaacuuuauggaaugugugaagcucuuugggaaccagaucuuggcccagaugauuuauuugaaacuauaucucaagcacuuguuaaugcaugugacagagaugcucuuucagguuggggagcuucuguuuucaua

SEQ ID NO: 5110 - RNA, 668 nt, Euschistus heros
gcugcacaaacuaugagaacuaaaauccaacauucuuuccaugaacuuccugcagagucucaucuuccgcuccgagauucucugauggaucauauuagcaaaauuaaugagucaacaaauucugugauugguacucaguuguaccuugcucuagcugaucuugcauuacaaaugguaucuugggaaaaaccugcaauugauuugauugaacgauauucugcgaccucaguuccuccucuucuugaaauguugacauuuuuaccagaagaaguuaauucucgagcauugcgcuuggguucuaaccggaggcgagaacuucucaacaaauuuucucuugcuguuccaaauguuucugaauuuuugaaaaugugucuuaacaauucaggaaauaauccucaaauucaagucaaaguuuucaaauguuuuacaaguugggugucaguucaagcgaugacacuuaaugauguuaccgacaauauaguuguggcuacagcuuuucacguucuugcuaauagaauggcauccucuaauuuacacgaagcagcugcagauuguguuugcucgcuucucgaaugccucgaagauaacaauaaucaacagucgauugagaugcaacuguuuaauggcgucauuucauuagaacaaccauuucauauuucugucgccca

SEQ ID NO: 5111 - RNA, 753 nt, Euschistus heros
aagcuuacauggaccuucuggcauucgagaggaagcuggauucuacaauuaugagaaagagacucgauauucaggaagcguuaaaacgcccaaugaagcaaaaaagaaaauuacguauuuuuauuuccaauacuuucuauccugcgaaagaggcgacggagacugaggaaggcaguguagcauccugggagcugagagucgaaggaaggcuauuagaagauuccaaaaaugauccgaacaagccuccaccguuacaggugaaaaggaaguuuucaucuuucuucaaaagucuugucaucgaguuggacaaagaacuguacgggccagauaaucaccuuguagaauggcauagaacuccuaccacacaagaaacggaugguuuucagguaaaaagaccuggugauaaaaaugucagauguaccauccuacuucuuuuggauuaucagccccuacaguucaagcuugauacccgacuugcucgucucuuagguguucacacucagacgagaccugucauuauaagugcacuuuggcaauauauuaaaacucauaaacugcaagauccacaugaaagagaguauauaaauugugauaaauaccuugagcagacuuucagcugccccaggaugaaguuugcugaaauaccgcagcgucucaacccucuacuucauccuccagacccuauuguuaucaaccauauuauuaguguggaagguaccgaacagaaacaaaccgcuuguuaugacaucgaug

SEQ ID NO: 5112 - RNA, 298 nt, Euschistus heros
gaaccgacucuugaggaauuagaacagaaaaugagagaagcugaaaccgaaccucaugaagguaaaaggaaaguggaaucauuguggccuauuuucaaaauucaccaccagaaaucucgcuacauuuacgauuuauacuacagaagaaaagcuaucaguaaagaauuguaugagcauugccuuaaugagaauauugcugauaaaaacuugauugccaaauggaaaaaacaaggcuaugaaagucuuugcuguuuacgaugcauucagaccagagacacgaauuuuggaacgaguugca

SEQ ID NO: 5113 - RNA, 744 nt, Euschistus heros
cgugauguaugggcucauaauuugaaggaugaauuuaaaguuaucaggaagaucauucauaaauauaauuauguugcaauggauacugaauuuccuggagugguggcaaggccuaucggugaguuccguaguacagcugacuaucaguaucagcuucugagaugcaauguggaucuucuccguaucauccaauuggggcuuacuuuccuugacgaaaauggaaaagcuccugcggguccuuacaguaccuggcaguucaauuucaaauuuaauuuggcagaggauauguaugcucaagacaguauugaucuucuucagaauucagggauucaauuuaagaaacacgaagaagauggaauugauccuguggacuuugcagaacugcucaugaccucaggaauuguacugauggaaaauaucaagugguuauccuuucauagcggcuaugauuucggauaucuauugaaacugcuuacuaaucagaacuuacccaaugaugaaagcgaauucuuugagcuucugaagaucuacuuuccuacuguuuaugauguaaaauaucucaugaaaaguuguaaaaaucugaaaggaggucugcaggagguugccgaccagcuggaacuuacgaggguaggaccacaacaucaagcuggcucagauucauuauugacgggaauggccuuuuucaaaaugagagagauguuuuucgaagacaauauagacgauggcaaauacuguggucacuug

SEQ ID NO: 5114 - RNA, 695 nt, Euschistus heros
auggccaacauguuguaucuggcacaccuggucguguuuuugauaugauuaagcgacgaacacugaggacaagaucaaucaaaguuuuaguucuugaugaagcugaugagauguugaauaaagguuucaaagaacaaauuuaugacguuuaucguuucuuaccuccugcuacccaggugguccuaauuucagcuacacuuccucaugaaauucuugaaaugaccagcaaguuuaugacugacccuaucaggaucuuaguuaaacgugaugaauugacguuagaaggaaucaaacaauuuuuugucgcuguugaaagagaagaauggaaguuugauacacucugugaucuauaugauacauugaccauuacacaagcuguuauuuuuugcaauacaagaaggaagguugauuggcugacugaaaaaaugagggaugcaaauuucacuguuuguucuaugcauggugauaugccacaaaaggaaagagaugcuauaaugaaggaauucagaucaggaaaaagccgaguccuuauaacaacugaugugugggcuagagguauugauguacaacaggucucucuugucauuaacuaugauuuacccaacaaccgugaguuguauauucauaggauugguagaucaggaagauuuggaagaaaggguguugccauuaauuucgugaagagugaugacauc

SEQ ID NO: 5115 - RNA, 702 nt, Euschistus heros
uuuuguauuuccccacccaagacagacauggaucacaaugugguuaucucugacuacgcagcaauggauaggauauugaaagaggagcgagcuuacauacugaauauugcaaaacaaaucaagaaggcugguugcacaauguuauugauacagaaaucuauuuuaagagacgccuuguccgauuuagcuauucacuucuuugacaaguuaaagauuauggucgugaaggacauugaaagagaagauauugauuucgucuguaagacucuugguugccgcccuauugcaucuuuagaucacuuuacaagugaagcacuuguaagcgcugagcuugcagaagaaguaucagcaggaucuucccguaucgucaaagucacaggaauucacaauccugcaaagacugucacaauucuaguccguggauccaauaaucuuguccuggaagaggcagaucguucaauucacgaugcccuuugugucauccgaugucuuaucagggaaagggcacuucugccuggaggaggagcuccugagaucgaguugucucuucgguuaggacagcaugcacagguuuuggcaucaguagaggcuuauuguuuaagagaguaugcaaaagcuuuagaaauuguuccuuauacccuugccgagaaugcuggucucaauccuguagcuacagugacagaacugaggaauaagcacguu

SEQ ID NO: 5116 - RNA, 764 nt, Euschistus heros
auacuggaaucguugguagcacuacagguucuaauuauuauguaaggauuuuaucgacgauugauagagaacuguugaagccuucagcgaguguugcucuccauaagcacagcaaugcccucgucgaugugcuuccaccugaagcagauuccucuauuucaaugcuucaagcagaugaaaaaccagaugugcaauauucagacauuggugguauggacaugcaaaagcaggaaauccgugaagccguugaauugccgcuaacacacuuugaacuauaucgucagauugguaucgaucccccaagaggggugcugauguaugggccucccggcuguggcaaaacuaugcucgcuaaagcuguugcucaucauaccacugcugcguucauucgaguggucggcucugaauucguucagaaauaccuuggagaagggcccagaaugguucgugauguuuuuagacuugcuaaagaaaaugcuccagccaucaucuuuauugaugagauugaugccaucgcaacaaaaagguuugacgcucaaacuggugcagacagagaagugcagaggauucuauuggaacugcuuaaccagauggauggcuuugaccagacaacgaacguaaagguuauaauggcuacgaacagagcagauacauuggaucccgcccugcugcgaccugguaggcuggacagaaagauugaauuuccucuuccugacaggcggcagaagaggcuugucuuuucgacaaucacugccaagaugaac

SEQ ID NO: 5117 - RNA, 406 nt, Euschistus heros
guggaaauugcaaaauguucaguuacuauuaagacuauguuagaagauuuaggcauggaugaagaugaggaagaaguaguuccauugccaaauguuaauucugccauucugaagaaaguaauucaaugggccacauaccacaaggaugauccaccuccaccagaagaugaugaaaauaaggaaaagaggaccgaugauauuuccucuugggaugcugacuuucugaaagucgaucaaggaacucuuuucgaguuaauucuugcugcuaauuaucuugacauuaaaggcuuacuugauguuaccuguaaaacaguagcuaacaugauuaaaggaaaaacccccgaagaaauacguaaaaccuuuaauauuaagaaugauuucucugcugcugaagaggaacaaguac

SEQ ID NO: 5118 - RNA, 685 nt, Euschistus heros
aauguccugucacaguuuguggagauguacauggacaguuccaugauuuaauggaacuguuucgaauaggaggaagaucaccagacaccaauuaucuguuuaugggugacuauguugauagaggauacuauucuguggaaacagugacuuuacuaguugcucuuaagguaagauaucgagaaagaaucaccaucuuaagagguaaccaugaaucgcgccaaaucacacaaguauaugguuuuuacgaugaauguuuacguaaauauggaaaugcgaauguauggaaauauuucacagaucuauuugacuauuugccauugacagcucucguaaauggucaaauauuuugucuucacgguggucuuucaccgucuauagacacucuugaucauauccgugcacuagaucguuuacaagaaguuccgcacgaggguccuaugugcgacuuacuuuggucggaccccgacgauaggggugguuggggcauaucuccaagaggugcugguuacaccuucggucaagauauuucagaaacauuuaaccauucaaauggccucacucucguaucuagggcccaucagcuuguuauggaaggcuauaacuggugucaugaucguaauguuguaacaauauuuucugcaccuaauuauuguuaucguugugguaaucaagcagccauaaugga

SEQ ID NO: 5119 - RNA, 766 nt, Euschistus heros
auaacccuggaaguugaaccuucagauacaauugaaaauguuaaagcuaaaauucaagacaaagagggaauucccccagaucagcaaaggcugaucuuugcuggaaaacaguuagaagauggucguacuuuaucugacuacaacauucaaaaggaaucuacucugcacuugguuuuacguuuacguggugguaugcaaauuuuuguuaagacucugacaggaaagaccauuacuuuagaaguugaacccucugauacuauagaaaauguuaaagcaaaaauucaggauaaggaagguauuccgccagaucagcaaagacugaucuuugcaggaaaacaacuagaagauggccgaacacuuuccgauuacaauauccaaaaagaauccacuuuacaucuagugcuucgucugcgaggugguaugcaaauuuuuguuaaaacucuuacuggcaagaccaucacccuggaaguugagcccucugacacaauugaaaauguuaaagcuaagauacaggauaaagaagguaucccuccagaucagcagcgguugauuuuugcugguaaacaauuggaagauggacguacucugucugacuacaacauucagaaagaaucuaccuuacaucuuguguuaaggcuuaggggaggugcaaagaagcguaagaagaagaauuacuccacuccaaagaaaaucaagcacaagaagaagaagguuaagcuagcugugcuuaaauauuacaagguugaugagaacgguaaaaucagca

SEQ ID NO: 5120 - RNA, 743 nt, Euschistus heros
ucggagaugguacuacaaguguugucuugaucacuagugaaauuuugaaacagcugaaaccauauguugacgaggguguccauccuagaauaaugaugaaagcaguaaggaaggcgacucaauuauguuuagacaaaaucaacagcuuagcuguuaagaucgaaaagaguagugcggagcagcaccgcucucugcuggagaggugugcagcaacagcacucaguuccaaauugauucaucaacagaaagauuucuuuucgaaaauggucguagacgcuguacuauuguuagaugaacuccuuccacucgaucucaucgguaucaagaaaguaccugguggagcuuuggaggaauccuuguuggucucugguguggcuuucaagaaaaccuuuuccuaugcaggcuucgaaaugcaaccuaaaaaguauacaaacccaaaaauagcuauucucaacauugaauuagaauugaaagcggagagagacaaugcugaaaucaggcuugacaacguagaggaguaucaaaaaguuguagauguugaauggcaaauuuuguacgaaaaauuagauacaaucgucaaaucuggagcucaggucguucugucaaaacuucccauaggagauguagcuacucaguauuuugcggacagagauauguucugugcuggacguguugcugaugaagacauaagaaggacacaaaaagcuugcgguggcaccaugaucaccacuaccaaagacaug

SEQ ID NO: 5121 - RNA, 680 nt, Euschistus heros
gcuguugagaaaaaucucggaggaaggcuucaggcaggcauugaugcuuggacugaugcauuagaaggcaagagccaugagcuagaucugaguauggacacugaugcgccagcgagaccaacccaugcaccugguggugacccacaugugcagacagugacucaugaaguucgcauuaccaaucagauuauguaccuuuauccgagcauagaggaagcaagauuccagauaaugcaacaguuguuucaguggcaggcuguuguaacuucccagcaaagacuucagagcucacgauaucagcuuggacuugaaaggcucaugucccagucauauagagacuuguugacuaagcuaccuaaugguucccaagcccucaucaaugcauaugauucaauagacaggaaaaucaaagauguugucaacuauguagaugagugguugagguaccaaucuuugugggaucuccaaucagauacccuguacagucgguugggagaugacauuaccauguggaugagaugucuuucugaugucaagaaaucacgaacuacauuugauacaucugagacucgccgacaauucggcccuauugccauagauuaugcuaaaguucaaaguaaaguagcacugaaauaugauucucuugauaaggaaaucuuggcuaaauuugguggccuuuu

SEQ ID NO: 5122 - RNA, 705 nt, Euschistus heros
ggaaacguuguacuuacccuaaaagcauuaggaaucaaugauuugaucaauuuugauuucuuagauccaccuccccaugaaacauugguacuugcuuuagaacagcuuuacgcauugggggccuugaaucaucauggggaguuaacuaaguugggucgaagaauggcagaauuuccauuagauccaaugauggggaaaauguuacuugcuucugaaaaauauaaauguagugaggaaauaguuacuauugcagcaauguuaucuguaaauggugccauauucuauagaccuaaggacaaaguuguucaugcugauacugccagaaaaaauuucuuccuucccgguggugaucaucuuguucucuggaauguuuauaagcaaugggcagauacugacuucaguacacaauggugcuaugaaaauuauauucaguacagauccaugaaaagagcucgagauguucgagaacaacugguaggucuaaugcaacguguagaaauggacuuuauuucuaauccuacagauacuauugcaauacgaaaaacaauuacuucugguuauuucuaccacauugcaaggcuuucuaagggaggucauuacaaaacuguuaaacauaaucaaacuguaaugauccauccaaacaguugucuauuugaggaucuuccucgcuggguuguguaucaugagcuugucuucacuaccaag

SEQ ID NO: 5123 - RNA, 650 nt, Euschistus heros
aagcuuaaccaaggagaagguugaaguaggagacguuauauacauagaggcaaacagcggugccguuaagaggcaaggaaggagugauaccuaugcuacagaauaugaucuggaggcagaagaauacgucccacuuccuaaaggagauguccacaaaaagaaagaagugauccaagacgugacauuacaugaucuugacguagcuaacgcgaggccgcaaggaggucaagauguacugucuauaaugggacagcugauuaagucaaagaaaacugaaauuaccgauaaauuaagagcugaaauuaacaaagucgucaacagguacaucgaccaagguaucgcugaacuugugccuggcguccuauuuauugaugaaguacacaugcuagauauagagaccuucacuuaccuucaucaggcucuugagagugcaauagcuccuaucguagucuuugcuacaaaucguggucguugucaaguuagaggugcuguggauauuauuucaccccauggauuaccguuggaccuccuggauagguugcucauaauucguaccgcaccuuacagccaaccggaaaugugccaaauucuaaaauugagggcuguaacugaggggcuuagcaucgacgaggaugcauuaucagagcuca

SEQ ID NO: 5124 - RNA, 761 nt, Euschistus heros
gaaaauguggacuuagcugcccuguuuaugcuacuauuccaguuuacaagaugggacaaauguuuauguaugauuuauaccaaucucgcuacaacauggaagacuuuaauguguuuagucuugaugauguugaugcugcauuugauaaaguuguucaauuaaaauauaaccagucaguaacaaugaaggggaagugcuauggacucagcauuguuccaaugccagcuggucauaugauuggaggaacaauguggaaaauuaugaagacaggagaagaagauauuauauaugccauugauuuuaaucauaaaaaggaaagacaucuuaacggcugugaucuagaaagauugcagaggccaucauugcuaauaacugacgcauuuaaugcuacuuaucagcaagaaagaagacgagcaagagaugaaaaacucaugacaacaauucuucaaacauugaguagcaauggaaacauucuuauugcuguugauacugcuggucgccuuuuagaguuggcacauaugcuggaucaacuuuggaggaauaaaaauucugguuuacagauucauccuuugugccuuaucaauaauguuaguuauaauguaguugaguuugcuaaaucucaaauagaauggaugagugauaaauuaaugaaaaguuuugaggcaguucguaauaauccauuucaauucaaacacauacguuuaugucauaguguuucagaacuuaauaaaauaccuucagccaaaguaguacuugccagu

SEQ ID NO: 5125 - RNA, 668 nt, Euschistus heros
cuucacgaaacuucuugagcaauauacaaaggucuugauuccuccaaaagaccuaaugucucgucuaaaagaagaguguucuaauccuacuggaguucuggagcaagucagguaccgugcggacuggcuucacuaucaagaacugcagaagaggaaagaggaacaagcacuggagaaagaaaggguggcuuaugcucagauugauuggcaugacuuuguuguuguugagacuguagacuauauuccgggugagguaggcaacuucccuccuccuaccacuccagaugaaguuggagcuagaguccugaugcaggagagaaucuuggaaaauggaggagaagaucuuacggaaggagccgguagcgaugaagagagggagaaggaagacagugaaagagaggaggcaacuggugacaagggagacaauacucagguucaagacauggaggaagagucaucuagcgauagcgaugaugaugaugaaagagaucaaucucuuggggagaaacaaccagcaacacaagcucagaaacaacaaauguuacaacaaaaucaacagcuggccucagcagauggcaaaaaaccaucuacacagccuucaaugcaaccuccccugccuccggcaccugauaaaguuaucgucaaaaaaggcuauaacccuaagcaga

SEQ ID NO: 5126 - RNA, 702 nt, Euschistus heros
uaguuuugcagugccauuugaugaagaugacaaggauaaaucaguuugguuuuuagaccaugauuauuuagaaaacauguaugggauguuuaagaaaguuaaugcucgagaaaaaguuguuggcugguaccacacugguccaaagcuucaucaaaaugauguugcaauuaaugaacuuauucgucgcuacugcccuaauucuguuuuggugauaauugaugcaaaaccuaaagaccuugguuuaccuacagaagccuacagagcaguugaagaaguucaugaugacggcuccccuaccacaaaaacauuugaacacguucccagugaaauaggagcugaagaggcagaagaaguggguguugaacaucuguugagagauauuaaggacacaacuguaggcucauuaucucaaaggguuacuaaucaauuucugggccucaaaggccuuaaucagcaaauucaagauaucagagauuaccuuaugcagguaguugaaggaaaauuacccaucaaccaucaaauaauauaccaacugcaagacaucuuuaaccuacuuccagacaugaaucauggaaacuuuguugauucauuguacauuaaaacaaaugaucagaugcuugucguuuaccucgcugcucuuguacgagcaauaguugcuuugcauaaucugauuaauaauaaacucaguaaucgugaugcuga

SEQ ID NO: 5127 - RNA, 725 nt, Euschistus heros
gcagaaaccaaauguugucauuacugaaaaggguguuucugaucuagcccaacaucaucuuuucaaggcugguauuacaaccauccguaggguaaagaagacugauaauaacagaauagcucgagcuguagaugcaacuauuguuagucguguugaagaaaucaagcccuaucauauuggauguggugcuggucucuuugaaguuaagaagauuggagaugaguauuucacuuucauuacugaaugcaagaauccaaaagcuuguacaauauuauugcgugguccuaguaaagauguauuaaaugagguucagagaaauuuacaagaugcaaugaauguuguuagaaacuuguacuuggauccuaggauacuuccaggaggaggugcuguagaaauggcccuucauagagcucuaauuaaagcuaauuuuacuguagauauggaugaagacuguuaugcugccauuccaucugcuuuaagaauuauuccgagaacccuuuugcaaaaugcuggugggaaaguaaucaggucuaugaaugaacucgagaaacaacauaauucugguguucuuaaaggaguugaugggauuacuggcgaguuaaagacaguugaugaauuagguguaugggaaccauacucaguuaaaguucagauuuauaaaacugcuauugagucugcaauccuauuguugaagauugaugacauuguuucuggugcgaagaaua

SEQ ID NO: 5128 - RNA, 670 nt, Euschistus heros
aaacguuggucauucuuugggugacuuaguuguuuaucaagaauuagucuuuacaauggcaaugccaagaacuuacggugguuuaucagauuauagaaauguuccugcaccuuccuuuaguccauauucugaaaauggaggaaguguaguugcuguagcaggugaugauuuugcaauuauugcaucugauacacguuuaaguacugguuuucaaauuuacaccaggaaccaguccaaacuguuuaaacuuucugauaaaacaauacuugguaguacuggauguuggugugauguccuuucucugacuaggcugguucagacccgaauaaaaauguaucaguaugaucauaacaaaguuaugucuaccccagcaguugcacaaauguugucuguucuacucuauuacaagcgauuuuucccuuauuauguagcuaauauucuugcuggaauagaugacaaugguaaagguguuguuuauagcuaugacccuauuggucaucaugaaagcucaaaauucagagcugguggaacagcuggagcuuuauugcaaccauuguuggacaaucagcuugguauguugaaucaagaaaauguucaagauaaaacuuauacuuuggagaaagcccaugcaauugugaaagaugucuuuauaucagcugcugaaagagau

SEQ ID NO: 5129 - RNA, 654 nt, Euschistus heros
agcugcauaacucaaagacaaauagaacuucucauagugguguguuagaauuuguugcagaugagggaaaaguguaucucccgcacuggaugaugcggaauuuaaugcuugaagaaggugauguuauugagauagaaaguguuucauuaccuguugccacuuuuucuagguuucagccucagucuccagauuuuuuggauauaucaaacccaaaagcaguguuagaaaacugccuuagaaacuuugcuuguuuaacuacuggugacauaauaaacauuaaguauaaccaaaaagacuaugagcuuucuguuuuagaaacgcaaccaggugcugcugugacaauuauagaaugugauaugaacguagaauuugcaccaccuuuaggguauaaagagccaaauucugaacaggaggcuuuggaugaaucauccgaaagaucugaaaacuuaacaaaugaaggaaguggguucauuccauucuuuggugaaggauaucggcuugaugguaaacagaagaaagcuaucgaagaugagaguguaggauuuaaaauaccuacugugagagggauuccugauuaugacuggaaaguuggugugauuaccuuuaugagaaauguacgccaaccuguaaaggaagcccagaaagaugaugaag

SEQ ID NO: 5130 - RNA, 756 nt, Euschistus heros
agguuuggauaagcuccuuguaucacaagauggugauguuaugguaagcaaugauggagcuaccaucaugaagcaaauggauguggauaaugaaaucgcaaaauuaauggugcaacuuucacaaucucaggaugaugaaaucggugaugggacaacuggaguuguuguucuugcaggugcuuuauuagaacaagcugacauuuuacuggauaaaggaauucauccuaucaggauugcugauggguuugaauuagcugcuagagcugccauacaacauuuagauucaaucgccacaaaauuuccuguugauccuaacaauuuagagccccuuauaaagaccgcuaugacaacucuuggaucaaaaauuguuaacaaaugccaucgucaaauggcagaaauagcuguuaaagcgguauuaucaguggcugaucuugaaaaaagggauguuaacuuugaacugauaaaaguagacggcaaaguugguggaaggcuugaagauucgaugcucguaaaagggguaguaauugauaaggacuucucucauccacaaaugccaaagguauugaaggauguuaaaaucgcaauuuuaaccugcccauuugaaccacccaagccaaaaacaaagcauaaguuggacguaacuuccauugaugauuauagggcauugaggaaguacgaagaagagaaauucaacaccaugguuucucaagucaaagaugcuggugccacucuugcuauuugucaauggggauucga

SEQ ID NO: 5131 - RNA, 238 nt, Euschistus heros
caguaguggaaaaggugaaaaaaagagguucgaaguuaaaaaauggaaugcuguugcacugugggccugggacauaguuguugauaacugugcuauuugucgaaaccauauaauggauuuguguauugaaugccaagcaaaucaagccucugcuacaagcgaagaaugcacaguggccuggggaguuuguaaucaugcauuucauuuucauuguauaucgagaugguugaagacuagg

SEQ ID NO: 5132 - RNA, 735 nt, Euschistus heros
uuuaagcgcgauacagaucauuaaaaaaacagguggcucauuggaugauucauuucuagaugauggcuuccuucuggacaaaaaaguuggccaguuucaaccuaaaagaguugaaaaugcuaaaauucuuauugcaaauacuccucuugauacugauaaaauuaaaguuuuugguucaagaauacgcguugacucuuuagccaagguggccgauuuggaguuggcugaaaaagaaaagaugaaagaaaaaauugauaggauuauaagucauaaauguaauguuuucgucaaccgucagcugaucuauaauuauccugaacaauuguuugcugaugcuggaauaauggcuauugagcaugcagauuuugaugguauugaacguuuagcccuuguuacaggaggugaaauaguuucuacguuugauacaccagaacuaguuaaauuaggagaaugugacuuaaucgaagaaaucaugaucggugaagacaaauuauugagguuuagcggggugaaguugggagaggcuugcaguauugucauuaggggagcaacacagcaaauugucgaugaagcggaacgaucuuuacaugaugcauuaugugugcucguuacuacuguuagggauaagaaaacaguuuuuggugguggcuguucggaaauaauuauggcuagugcuguaagugaugaugcuauuaauguaacuggcaaggaagcaguugcuauggaauccuuugc

SEQ ID NO: 5133 - RNA, 658 nt, Euschistus heros
agcaacaguugguguaaagaauaaacaauuugcaguccuuguugcucuuaaaagagcaucuucugaacuuucagcucaccaaaaaaaaauuauuccucuugauaaucauauaggcaugagcauuucugguuuaacugcugaugcucguauauugagucggcaaaugagaagugaaugccuuucuuauucauauucuuauggaacugaaauacccauuaucaggcuuaugaauaaaauaucuaacaugaugcagaguucaacucagcgcuaugacagaagaccauaugguguuggucuacugguugcuggauaugauggagaugguccucauauuuuucaaauuugcccuucugcuaauuuauaugaaugccgcucaauggccaucggugcuagaucccaaagcgcaaggacauauuuggaaaagcaucugguagacaucucaaacucuccgacucugacagaccuucucaagcacgcacuucgugcucuuagagauucuucacccaaugauacagaacuuagcuccaagaacguagccauagcgguaguugggaaagauaccccgcucaaggaauuaucugaagccgauacccaaacuuaucuggacaugauccucagcgaggagagaagaagcggcgauacagguggagcuagugau

SEQ ID NO: 5134 - RNA, 656 nt, Euschistus heros
agauuaaaggacggugcauuacugauccuucuuuugaacauuuaaauaauacauaugaacguucuuugguauuuaugaauaagaugccucgaauauggauggaauauugucaguuucuugucgaucaauguaaaauuacuaaagcacgacauguuuuugauagauccuuaagagcacugccuaucacccaacaucaccgcauuuggccuuuauauauaaaauucuuaaagaagcacaauauuccagaaacugcgguucguguguuucgaagauaucugaagcuuuguccugaagauacagaagaauacauugauuacuuaacugccaucagucgucuagaugaggcugcuguuagauuggcagauauuguaaauacugaugauuuuguuucaaaacauggaaaaucaaaucaucaauuauggacugaauuaugugauuuaauaucuaaaaauccucaagaaguuaggucucugaauguagaugcgauaauaagaagugguuugaaaaaauauacugaccaguuaggccacuuauggaauuccuuagcugauuauuauaucagaaguggacuuuuugaaaaggcaagggacauuuaugaagaagcgauacaaacuguuacuacugucagagauuuuacucagguuuuugaugcguac

SEQ ID NO: 5135 - RNA, 738 nt, Euschistus heros
acagaguaacacaacagcaucaaggauaugguuuuguugaguuuuugggugaagaagaugcugauuaugcuauaaaaauuaugaacaugauaaaaguucaugggaaaccuauucgugugaauaaggcuucagcucaucagaaaaacuuggauguuggagcuaauguguucauugguaaucuggauccugagguugaugaaaaauuauuguaugacacauuuucagccuuuggaguaauucugcagacaccaaagauuaugagagauccugauacagggaauucgaaagguuuugcauucaucaauuaugcuuccuuugaugcaucagaugcugcuauugaugcuaugaauggucaguuucucugcaaucgcccuguuucuguuuccuaugcuuacaaaaaagaugcuaaaggugaacgacauggaucggcagcugaacgucuccuagccgcacaaaauccauuaucacaagccgauaggccccaucauauguucgccgaugcucccccugcaccucucccaccuccuccaguccugccuccaccuccugucuucaauccuccaccgccuccccauaugccgccuccuccauugccaccccaaaggaugguugcuccuaugccuccaccuccaccugggccuccuccaccaaugccuccuggaaugaugccguggccaccgaugcagccccacuuucccccuccucccccaccuccaccuacaaacaaagcuccuccuc

SEQ ID NO: 5136 - RNA, 635 nt, Euschistus heros
ccacacaaaacaccguaaaggugccccuaaacugaggucauuagauuuugcugaaaggcaugguuacaucaaagguguugugaaagacauuauccaugacccugguagaggagcuccuuuagcaguugugcauuucagagauccuuacagguuuaagacucguaaagaacuuuucauugcuccugaaggaauauacacuggucaguucuuguacugcggaaagaaagcuaacuuacacguuggcaauguuaugcccguuggugguaugccugaagguaccaucaucuguaacuuagaagaaaaaaccggagacaggggucguuuagcuagagccucaggaaauuaugcuauuguuaucgcccauaauccugauucaagaaggacaaggguuaagcuuccaucaggcgcaaagaaaguuauccccuccaauaacagggccaugguugguaucguugcuggagguggucguaucgacaagccaguccuuaaagcuggucgugcguacuauaaauauaaggcaaagagaaacugcuggccuaagguuagggguguugcuaugaacccagucgagcauccccacgguggugguaaucaccagcauauugguaaagcuuccacugucaagagaggaacuu

SEQ ID NO: 5137 - RNA, 264 nt, Euschistus heros
caaagcugccaggaagagcgcuccggcgacuggaggagucaagaaaccucacagauacaggcccgguaccgucgcucucagagaaauuagaagguaccagaagaguaccgaguugcucauuaggaaacucccguuccagagguuggugagggagaucgcccaggacuucaagacagaccugagguuccagagcucggccgucauggcccuccaggaggcuagcgaagccuaccucguaggucucuucgaggauaccaacuugug

SEQ ID NO: 5138 - RNA, 715 nt, Euschistus heros
auuaugacaaugcaaagccggcuugaaucugaaacuaggcugguuagagggcucgucuuagaucauggcucacgucacccuaauaugcccaagaaacucacuaaugcuuuuauucugacauguaauguuagucuugaauuugaaaaaacugaaauaaauagcggauuuuucuacaaaucugcagaggaaagggaaaagcuuguggcaucugaaagagaguuuauugaguuaagagucaagaaaauuauagcuuugaagaaaucuguaugugauggaacugacaaaggauuuguugucauuaaucaaaaagggauugacccugucucuuuagauuuacuggccagagaagguauaauggcucuuaggcgagcuaaaagaaggaauauggagagacuaacuuuagcuuguggugguguagcaaugaauagucucgaugaucucacagaagaaugucuaggucgagcaggucucguauaugaacauguacuuggugaaacuaaguauacauuuguuacugauuguccaaauccacauagcguuacuguacuuguucauggcccuacuucauaugccauuacucaaauccaagaugcgcuucgagaugguuugagagcuguuaaaaaugcaguugaagauggugguguccuuccugguggaggagcaguugaauuaaaaauacgucaugaauugaagaaaguugcugagaccacuaaag

SEQ ID NO: 5139 - RNA, 669 nt, Euschistus heros
agaucaacuucauguggcauuuaaagcucuagaugcuuacaagaaagaauuuggcaaguuaccuucaccauggaacagcaaggaugcuucugauuuucugaacuguuguaagacuguaaugccugauguaagagaaaaucuagaauuaaaugaaaaacuuauggagcaauuuuccaaaacuuguucuggaaauaugaauccuauugaugcauucauuggugguguuguugcccaagaagugaugaaagcuuguaguggaaaguuucauccaauuuuccaguggcuauauuuugauugcauugaauuauugccaaaagaagauuuaaguccuaaugauugugcacccaccaauucucgauaugauggacaaguugcuauuuuuggaaaagaguuucagaaaacuuuaggcgcucucaaauauuuuguuguaggugcuggagccauugggugugaacuucucaagaauuuuucaaugaugggaguaggagcagauggugguaaaguaauuguaacagauauggaucuuauugaaaaaucuaaccuuaacaggcaauuuuuauuuagaccucaugauguacagaaaccuaagucagcuacugcugcuaaagcaauaaagaaaaugaacccauuaaugaaugugauugcucaugaaaauagaguuggcccuga

SEQ ID NO: 5140 - RNA, 783 nt, Euschistus heros
ucugaaguccaacaugagugcauuccucaagcaguucuuggcauggauauucuaugucaagccaagucugggauggguaaaacugcuguauuuguauuagcgacccuucagcagauggaguuaacugaaaaucaaguaacaguuuugguuaugugccauacuagggaauuagcuuuccaaauaagcaaagaauaugaacgauuuucaaaauauaugccaaauaucaagguugcuguauuuuuuggugguuuaccuauucagaaggaugaagaaguuuuaaaaaauaacuguccucauaucguaguugguacuccuggacgaauuuuagcuuuagugaagaauaaaaaacugaauuugaaaaaccuuaaacacuuuguguuagaugagugugacaagaugcuugagcaguuagacaugaggcgugauguucaagaaauuuuuaggaauaccccacauagcaagcaagucaugauguucagugccacucuaaguaaagauauuaggccaguuuguaagaaauucaugcaagauccaauggaaguuuauguagaugacgaagccaagcugacccugcauggccuucagcaacacuauguuaagcuuaaagaaaaugaaaaaaauaagaaacuguuugaucugcuugacaucuuagaauuuaaucagguggugauauuuguaaaaucaguucagagauguauggcuuuggcucaacuguuaugugaccaaaauuucccagcuguagcuauucauagagcuaugagucaagaagagagacuugccaag

SEQ ID NO: 5141 - RNA, 699 nt, Euschistus heros
aaauacgaggguuucugcaugcuaggcugagaacugcuacucucagaaaugauuuugaaggucaggcgguucuaauuaacuguuuauugagaaauuacuugcauuauaaacuguaugaccaagcugacaaguuaguauccaaaucaguauauccagaaucggcaaguaacaaugaaugggcuagauuccuuuauuauuuaggaagaauuaaagcagcacguuuagaauauucagaaucacacaaacaucuaguucaagcuuuaagaaaagcuccucaacaugcugcuguuggauuuaggcagacaguucaaaagcuugcugucacuguugacuugcuucuaggugacauuccagacaggcagaucuuuagacaagcaccucuucgucguucucuugcaccauaucuucaguuaacacaagcuguuagaacuggugauuuacaaagauuuggugaaguguuagaaauguuugggccucaguuucguucugaccauacauuuacauuaauucuucguuuaagacauaauguuauaaaaacagcaauaagauguauugguuuaucuuauucacgcauuacuccuaccagcauagcuucuaagcuuggguuagauucaccggaggaugcagaguucauuguugcuaaagcaauuagggaugguguuauugaagcaaccuuagauccugagcaugguuauaugc

SEQ ID NO: 5142 - RNA, 759 nt, Euschistus heros
agugcuagagguccuacauuaaaacaucagagaauacaagaugaaaguguuaaaaaauacucugguauugaugaaugguacaaacgaggaguugacaauucaaaagugguuacgaaauauagaaaaggggcaugugagaauuguggagcccucacccaucaaaaaaaggacuguauggaaaggccacgaaagauuggugccaaauuuacuggugcuaaaauugcacccgaugaauuuguucaaccugaacucucacgagauuaugauggcaaaagagaucgaugggcaggauaugauccaucacaacauaaaaugguuauugagagauaugccaggaucgaugaagcuaaaaggcaguugagggcagauaagcuuaauucugaacagucugaagaagccgaagaagaagaggcaaaagacaauaucgcugaugaaggaggugaagaugaggauaaauauguggacgaagucgauaugccugguacaaaaguagauucgaaacagagaauuacugugagaaaucucagaaucagagaagacacagccaaauauuugagaaaccuugaucccaauucugcauacuaugauccuaaaaccaggaguaugagggacaacccuuacgcuggaucugccgauacugauguggacuaugcuggagaaaacuuugugcguuucacuggugauacauuggagcaugcgagagugcaguuguuugcaugggaagcacacaacaaaggaguugauguucauccucuuggg

SEQ ID NO: 5143 - RNA, 498 nt, Euschistus heros
uaugaauuaggacgaccagcagccaacacuaaguugggucccaaaaggguucauuugguaagaaccagagguggaaauacuaaguuuagggccuugagguuggacuauggaaauuuuucaugggguucugaaugcuguaccagaaaaacucgucugauugaugucgucuauaacgcuucaaacaaugaacuuguacguaccaaaacccucgugaagaaugccauaguagugauugacgguaccccguucagacagugguaugaagcccacuaugcgcucccauugggaagaaagaagaaugccaaauugucugaagcggaggaagccguacuuuauaagaagaggucuaggaaaacagaaaauagguacaaggcaaggcagaaacucgccaagguugagccugcuuuggaagaacaguuccagacuggucguauucuugcauguuuagccagccgaccugggcaauguggacgagcugaugguuauauccucgagggg

SEQ ID NO: 5144 - RNA, 776 nt, Euschistus heros
gacacagcagaacaagucuacauuucuucucuggcccugcuuaagauguuaaaacauggaagagcugggguucccauggaaguuaugggacuuauguuaggagaauuuguugaugauuacacuguaagaguuauugauguguucgcuaugccacagacaggaacagguguuaguguugaagcuguggauccuguuuuccaagcuaaaauguuagacauguuaaaacaaacuggccgaccagaaauggugguuggaugguaccauucccauccaggauuugguuguugguuaucugguguugauaucaacacucagcaaagcuuugaagcucuuucagaaagagccguagcaguuguaguugauccaauccaaagugucaaagguaaaguuguuauagaugcuuucagauuaauuaaucccaacaugaugguucuuggucaagaaccacgacaaacuacuucuaauuuagggcaucuucagaagccuucuguucaggcguugauacacggauuaaaucgccauuacuauucuaucagcauuaacuacaggaaaaacgaauuggagcaaaaaauguuguugaacuuacauaagaagucauggauggauggucugaugcucuccgauuauucugaaaauuguaaaguaaaugaaacuacaguuggugauaugcuugaauuagcuaagaauuacaacaaggcauuggaagaagaagaaaaaaugacgccugaacaacuugcuauuaagaauguuggaaaacaagacccuaagaggcauuu

SEQ ID NO: 5145 - RNA, 651 nt, Euschistus heros
auucuggagcaaauggauguggaugagaaaaagggggaggguuuucguucuuauuacaucacuaaaauugaagagcuucaguugauaguugcagagaaaagucaaaaccuuaggaggcuccaagcacaaaggaaugaacuuaaugccaaaguaaggauguuaagagaagaauugcaacuacuucaagaacaaggcucuuauguuggugaaguugugaaacccauggacaaaaagaaaguguuaguuaaagugcacccagaaggaaaguuuguuguugauaucgauaaaaauauugauauuaaugaugugacuccuaauucaaggguggcccuucgaaaugagagcuauacucugcacaaaauucuacccaacaaggucgauccuuugguaucauugaugaugguugagaaaguuccugacucgacguacgaaaugguuggaggucuugauaagcagauuaaggaaauuaaagaaguaauugaacuucccguaaaacaucccgagcuauuugaugcguuagggauagcucaacccaagggaguauugcuauauggaccuccuggaacagguaaaacacuucuagcgagggcaguugcccaucacacugaaugcacauucauucgugugucagguucugagcugguacagaaa

SEQ ID NO: 5146 - RNA, 453 nt, Euschistus heros
ugguugaaaacagcuuaugauguucaaaguuuuggguauuuucaaagaggaacugcccaggacacuauggcuuuugccaguaaaacgauaguugaaaggacucaaucugcaaccaggcaaucugucaaagaaggagauuauauaugucauguguaugugagagcugacaauuuagcugggguuguaauaucuaaucaugaauacccucaucgaguggcucauacucuuauaacuaaaguguuagaugaauuuagugcaaaguauccaccuucaacuugggcgucugcuaaugaagccaacauugauuuuccggcauuggcagcucaccuucagaaguuucaaaauccuaaggaagcugaugcuuuaaugaagauucaaagugagcuggaugaaacuaaaaucauucuucacaacaccauuggagcuguuuuagaacguggcgagaaauuagau

SEQ ID NO: 5147 - RNA, 602 nt, Euschistus heros
guuagguuccacggcuauagguguuuguaccccggaaggaguugucaugggagcugaaaaaagaaucaagucaccuuuaauggaaccagaagcaguggaaaagauccuucaaguugaugaucauauugguugugcuguaagugguuugauggcugauuccagaaccuuaguugagcaugcuagaguccaaugccuaaaucauugguuuguauaugaugaaaagaugccaauagagucugcugcucaggcugucuccaauuuagcuaucagauuuggcgaugcugaugaagaugcugguccugcuaugagcaggccuuuuggaguugcugucauguuuggaggauaugacuacagaggaccucagcuguaucauauggauccaucaggcacauuuauuuauuuugacgcuaaagcuaucggcucuggaagugagggagcacaacaaagacuccaagaauuguaucauaaaggaaugagccuuaaggaggcuauccagaugauucugaccauccuaaaagagguaauggaagaaaaguuaacugauaacaauguagaaauagcaguaguaacugcagaagagaaacaguuucgcauguauacca

SEQ ID NO: 5148 - RNA, 652 nt, Euschistus heros
agcagccuucaaaauauggaaaagaaacaaagugcaaguuuguugacccgaaacuuagcagaucugguuaaaaaggaacauuuuauuuuagacucugaauauuugacuacauuacuaguuguuguucccaagucaaacuuuaaugauuggaauuccaguuaugaaaaacugacuaauaugauuguuccucguucuagucaacuuguuuaucaagauucugauuuugguuuguucacuguaucauuguucaagaagguuguaaaugauuuuaaacuaauggcaagagaaaagaaauuuguuguacgugauuuuauuuacaaugaagaagaguuagcugcuggaaaaaaugaaauuacaaaauuggugacugauaagaagaagcaguuuggaccucuuguacguugguugaagguuaauuuuagugagugcuuuugugcuuggauucauguaaaagcauugaggguuuuuguugaaucugucuugagauaugguuuaccaguaaauuuccaggcuauguugauucauccucauaaaaagucuguuaaacguuugagagauuuacugaaucaacuauaugcgccuuuggauaguagugcccagcagcaaggagggcaagguggugguaacgauaguguggacauuccugguuuag

SEQ ID NO: 5149 - RNA, 723 nt, Euschistus heros
gccaucaacauccuuaaagcccaugguggaucagcaaaagaaagcauauugguuaauggauaugcccucaacugcacagucgccucaaugggaaugauuaaacgaguagaaaaugcuaaaauugcuugccuugacuucucuuuacaaaaaaccaaaaugaaauuagguguugaaguccugguagaagacccgaaucaguuagaagcuauuagagauagggaagccgauauaacaaaagauaggauacagaaaauucucagugucggcaccaauguaguucuuuugagcggaggcaucgaugacauuuacaugaaauacuucguggaagccaaugcaaugguuguaaggagggugaaaaaagcagacuugaaacgaaucgcuaaagcaacuggugccuccuuugcaacaucccuaacuaauauggaaggcgaagaagcauuugaugcuaguuuguuaggugaggcugcugaaguaucacaagaaagaauaugugaugaugagcuuauucuugucaaaaguccaaaagcacauucagcugcuuccauaauccuccguggaccaaaugacuauuucugugacgaaauggaacguucaauucaugauucacugugugcagucaaacgaguucuugaaaguaaaacaguuguggccgguggcggagcugucgaagcugcuuuaucgaucuacuuagaaaacuuugcuacuuccuuaaguucacgggaa

SEQ ID NO: 5150 - RNA, 641 nt, Euschistus heros
aauaacacacuugaugaucaucaaguaaaaauuauuaaagcuccggauuuuuuaacuagaacuuuauauccuaugacaacuacagcuucugugguuggaaucaaauuuaguaauggcguagcuauugcugcagauguugguggauauuacggaucauugaaucguuuuaaaucucuugauagguuguacaaaguuaauaacaacauuguaaugacaacaacuggugauuaugcugauuuucaguacaugagagaauuaauacaacaaaaaguuauuagugaagagauucuagaugacaguuucuccuuaaaagcuucuucucuucauacuuggcuuacucgccugauguacaauaggaggucaaaauuugaucccuuauggaacaauguuauuguugcuggauaugauagcaauggacccuuuuugggaauuguggauaaauuagguaugaguuaugaagacaguuguguagcgacagguauggguggauaucuagcuacaccucuuuugagggaugugcaugaacgaaguaaaggaaauuugacuaaacaagaagcccaugcagcucuucagaaguguauggaaauuuuauacuauagagauacucagucacuucccaaguuccaaauugcaacagucac

SEQ ID NO: 5151 - RNA, 777 nt, Euschistus heros
auacagcucuucaucgaacccgugccuuacucuuuucugauauguuuaugaucgcuaccuggauguccgaaaggaaaggacuugccaaguauaaguuugaaagcaauuaugaucuggguagccuagcuguuguaaaugugagggaucuuggucagguuaaacaugcuuuuaaacuucuaguuuuuccugauaccagacuuuuucaaugugugaauaaugaagccagggaggaaugguugaaaaaauuugaugaagcuaagaaagcuagauugaauacagaucagaccaaaaaaaaagaugaaaaugaaaaagaaucucauccuguucaugaacauuugacuaaacccccugauagaacugacucggucgaauuuggaucuaacccauucggguuuguacuggaugaugauggagacagugacgcucugccugaaugguugacugaagcagcugaugaucuugauguauccauugcucagaggcauuuugaagaagcuuaugcaaucauacaaaaagccgaggaguacuuugcaucugcgcaagaugaucagucacuggccgauauaaaguccaaaguggaaaacagaaaagauguauugauaagcguucuucuaucagaguugaaugucagugcugagaaaucauuacaaggaggucuucgagcuagccgaagagcuguuagacuccuuaaccaacuuaacaagucaacccaagcaugugaacuauaucugaaaguuuguacgaaccuacuaaaagcccaaaguaaacgagugaagc

SEQ ID NO: 5152 - RNA, 680 nt, Euschistus heros
uuguugauccaggauucguuaaacagaaaguguacaauucaaagacaggaauggauucucuuguuguuacuccuauuucacaggcucaagcaaagcaaagagcagguagagccgguagaacaggaccagggaaauguuaucgacuauacaccgagcgugccuacagggaugaaauguuaccuacucccguuccugaaauccaaagaacaaacuuagccacuacugugcuacagcugaagacaaugggcauuaaugaucuccuucauuuugauuuuauggacgcuccgccaguugaaaguuuaauaauggcucuugaacaacuucacagucucagcgcucuugacgaugaaggacuccuuacaagacuaggaagaaggauggcggaauuuccuuuagaacccaauuuaucaaaaauguuaauuaugucuguacaucuccagugcucggacgagauacuuacuguggucucgaugcuuucuguccaaaacguauuuuauagaccaaaagauaaacaagcccuugccgaucagaagaaggcgaaauucaaccaagccgaaggagaucaucuaacacuccuugcuguuuauaauucauggaaaaauaauaaauucaguaaugccugguguuaugaaaauuuuguucagauuaggacgcugaagagagcccaagauguuaggaaa

SEQ ID NO: 5153 - RNA, 744 nt, Euschistus heros
uccuaaccucaggcauagaaaaucuuccaaaaaucaccaaaaugguaucagugaaacaacaaaaaacucuuuaaggaagaaauuagcuuucaaauucaacucuggugacaguauacaaucugacuuuagugaaaaagaaccaugccaaaggguaguuacaauaucucguugugguaguuggauggcaacugguggcacugaugguauuguaagaaucuggacguucccuggccuucgauuaauuagagcucuaaaggcccauaccaaagagcuggaugauuuacauuucaguccugauucaaagcagguugccaguguggcgaaagaugggcaagccauuauuugggaaauaaaaucaggaaaacagguucauaaacucaauugggcucacccuacaggaauuaaauauauuuuuaaaagaugucgcuuuggaaugauugaggguaaaggaaguagacuauuuaccacuguuaauccuguggcugguggaaaggaagcccaagguuggauccacgccugggaugaaggccguaucucgaagucuacaucuguaucugaacccacuucagcacuugcuguuagagacgauggaguuuucuuagcuauugguacaauguucacaggaucaguauccauauacauagcauuuucucuucagagaguucugcauguugauggugcucauucaauguuuguuacugguguugaacuguugcccuguucaucuucauggggugcuauaga

SEQ ID NO: 5154 - RNA, 776 nt, Euschistus heros
agaugaacacaggacuuuccuuaggcagucacuggaagcuaggcucauugcucuauauuuugacacaggaauguuuacagaagcucuacagcuuggcucaagucuccuuaaagaauugaagaaguuagaugauaaaaauuugcuuguagaaguacuuuuguuggaaucuaaaacuuaucaugcuuugagcaaucucucaaaagccagggcugcuuugacaucggccaggacaacugcaaauucaauuuauuguccacccaaaaugcaagcagcccuugauuugcaaucugguauacuucaugcugcagaugagcaagauuucaaaacugccuauucauacuuuuacgaagcuuuugaagguuaugauagcguugaaagcccaaaagcuuugguugcucuuaaauacaugcuuuugaguaaaauuauguugaacacaccagaagauguacaacaauuagucagcgguaaacucgcacuuaaacaugcagguaaugacaucgaugcuaugaaaucgguugcucgagcuagccauaagagaucccuugcugauuuucaacaaaccuuaaaaaaauacaagaaagaacuugaagaagauccuauuguucgagcacauuugggaacacuguaugacaauauguuagaacagaacuugugucggauaauugagcccuauuccagaguucagguugauuuuauuuccaaaucgauuaaacuuccucugccucaaguagaaaagaagcuuucucaaaugauucuugauaagaaguucaacggca

SEQ ID NO: 5155 - RNA, 675 nt, Euschistus heros
agcaguuauuggaaacucguaccaaaaagcaaguggaaauuagugaacuugaugguagauuaagccaagaguaugaagaaagauuguaccaaagucuucaagaaauacgugaucaguaugaaugugauuuagagaauaacaaggaagaaauaaaaaaauuauaugaggaaaaaauucgcagucuuggaagucaauugacacggaacagcaaugcugcagcaauggcuauugaagaaaugaaaaauaugcaagcuaaacugaaugagcuuaauaggaaauugcuugacuuagaagcagauagaaauacagcccagcaaaaggcuagagauuuggaaaaaaucuuagaacaagcuaaagcccaauacauggaagaauauagucagagggaagcugaaauaacaacucuucgugaagaaauggcucaucaaguucaagaauaucaagauuuaauggauauuaaaguagcauuagauuuagaaauagcagcuuaucgaaaguugcuugaaggagaagaagcuagguuaaauauaacaccugucaguucuccugcacagacuucuucucgcaaagucuuagguagaaaaaggaaacguacuuucauugaggaaucugaugaaacagauguuucaaauuacucuguuacuucuucaucgaagugugauguugcaaucucag

SEQ ID NO: 5156 - RNA, 776 nt, Euschistus heros
aaacagugguugaaguuccuaauauuacuugggaugauauuggugguuuggauaauguuaaaaaggaguuacaagaauugguucaguauccaguggaacauccagaaaaguuccugaaauuuggaaugcagccgucccgugguguucuauucuauggaccaccugguugugguaagacuuuguuggcuaaagcuauugcuaaugaaugucaggcaaauuucaucucaguaaaggguccagaauuauuaacuaugugguuuggagagucugaagcuaauguccgugauauuuuugauaaggcuagagcagcugcaccuuguguucuauuuuuugaugaacuggauucaauugcuaaaucaagaggggggaguguuggggaugcuggaggugcagcugauagaguuauuaaccaaauccuuacagaaauggaugguaugggagccaagaaaaauguuuuuauuauaggugcuacaaauagaccagacauaauugauccugcuauccugagaccuggucguuuagaucagcugauuuauauaccuuuaccugacgagaaguccagagaagcuauuuucagagcaaacuuaaggaagucaccuguugcaaaggauguugauuuacaauauauugccaaagucacauuugguuacucuggugcugaucuuacugagguaugucaaagagcauguaaacucgcuaucagacagucaauugaagcugaaauuaaaagagaaaaaaguagauuagauggagccacacgaauggagauggaugau

SEQ ID NO: 5157 - RNA, 674 nt, Euschistus heros
guuccaagucuaugugaagaacuauugucuucaguagaccaacccuugaaaauagccauagauaaagggguugguaaagauuauuuauuaugugacuacaacagggauggcgauucauacagaucaccuuggagcaauacuuacgauccaccccuugaagauggcucaaugccuucagaaaggcuaagaaaacuagaaauagaagcaaacgccgcuuuugaucaauauagagagauguauuuugaaggcggagugucauccgucuacuugugggacuuggauaugacugguuuugcuggugcaauuuuaauaaaaaaggccggcgaugguucaaagaagaucaaagguuguugggauuccauccaugucguugaaguucaagaaaagacgacuggacgaaaugcucauuacaaauuaacuucaacuguuaugcuguggcuccaaacuaacaaaacagguucggguacaaugaaccugggggguaguuuaacgaggcagauggaacaagacgcagcuguuucagauucuucaccacacauugccaauauuggccgaaugguugaagauauggaaaauaagauuaggaauauccugaaugauaucuauuuuggaaaaacuaaagacauugucaauggcuuaagaagcacucaggcauuaucggaacagaaagcaca

SEQ ID NO: 5158 - RNA, 734 nt, Euschistus heros
agaaaccuauggaucucggaacuguaaagcaaaaaauggacaaucgagaauacaaaacagcaacugaauuugcugcugaugugagacuaauuuuuacaaauuguuacaaguauaaucccccggaccaugauguuguugcaaugggccgaaaauugcaggauguuuuugaagugagauucgcucaaguaccugaagacuccccuauaucgacuguuccugaaaaggaagaagaauccaccucugggucaucgucuggcucugaauccgaaacagauaauucagaugacgaaagggcccguaaacuuagucaauuacaagagcaguuaagaaucaugcaggaagagaugagaaaacucgucgaagaaggaacuguuaaaaagaagaagaaaaagaaagaagguucagguucugguggaaguucuucuaguaagaaacggaaaucugcugauaggacauuagguaaaacagccgauggugggcuuauagcuggugccggagcacccgcuaucauggaaauaaaggcuacugauggcguaaaggcugucccuccuccaggcaggaaugcagucccuucaccccaggucaaaccaaacaagggcaaagccccuggaagggcaccaggaaaaaccaauucucaggguaagaggccaaagccgaacuccaggucuacuaacucuaagaagaagaauccuguugucacuucagaguuuaacucggaagaugaggauaaugca

SEQ ID NO: 5159 - RNA, 668 nt, Euschistus heros
ugaaucaaaagagguacgcaaugguuuccgccauugcugcuacuggaguuccagcucuugucaugucuaaaggacacauggucaaugaaguuccagaaaucccucuuguaguaacugauaagauucaggaauauacuaaaaccaagcaggcuacaauuuuccugcaucguaucaaggcuuggucugauauucagaaggucuauaagucuaagagauuucgugcugguaaagguaagaugcguaacaggagacgcauucaacguaggggcccucuuaucaucuauggucaagaucaaggccuaacucgugcuuuccguaacauuccugguguugaucuuaucaauguuucacgauugaacuugcuuaagcuggcaccugguggucacguagguagauuuguuaucuggacacaaucagcuuuugaucaacucaaugcucucuauggcacauggaagaaaaaaucaacuuugaaaaaggacuacaacuugcccaugcccaagaugguaaacaccgaccuuucucggcuguucaaaucagacgaaaucaagaguguucuuaaaccuccaaggaagaccauaguuaggaggguaaggaaacugaacccauugagaaauacucgugcaauguugaagcucaacccauucgcugcaguucugaagaggaaagcu

SEQ ID NO: 5160 - RNA, 748 nt, Euschistus heros
auggugacccuauugaaaccgaaguagaagaacaagaggaaacuccuccuccugaaauaccuucuguaaaacauucuauacguucuggaccuuaugcaauuugccgaaaagcuggaauaggugguuuggcaaaacgauuugguuugaaaccugaacaguucgcugaaaaucuuagggauaauuaccagcgccacgauguugaacaggagccauccuuaccucuugaacuggcaaaggaguuuguuucaacgaaauuuguuacaccagaggauguuuuaaaagcagcaaaauuuaugguugcuacacaacugagcagagaaccccuuguucggcguuguaugagggacacuuucuuugaaaaagcuaauauugauguuaaaccaaccaagaaagguucuaaagaaguugaugaaaaccauccuuguuaugucaugaaauaucuuaaagguaaaccagugagagauuuaacugcugaccaguaucuaaaacuacacauugcucaucaagauaaacuauuaaauguuacuauuagugaucauauugguggccauacaacaacaucuuauauugaggaaauuaaacaacucuacuaucgugaugaguucaugcagcaugugcaagaauggaauaauauucgccaagaauguguugauguugcuauuaagaagauguuaauuccagaauugauuaaagaacuccauacucgucugcuugaagaagcuaaagaguuuguuuugaggucaugugc

SEQ ID NO: 5161 - RNA, 720 nt, Euschistus heros
uaacauuggugucguugcuagguuauuauucaaggaaaauauaauucgugggagaggccuucuuugcagaucaauuauacaagcucagucugcuucuauuacauuuaccaauguauaugcuuguuugguggcuauaauuaauucuaaguuuccaaguauaggagaacuuuuacugaagagaguuauuauuagauucaaaagggcuuauaaaaggaaugauaaagcugucuguauuucuucagcaacauuuauagcacaucuuaucaaucaggguguugcucaugaaauucuuggauuggaauuaguuacuuuauuaguugaaaauccuacagaugauucaauagagguagcaguagccuuuuuaaaagaagcaggacagaaauuaagugaaguaaccagcaaaggcacuaaugcuauauuugacauguuaagaaauauucuucaugaaggaaagcucgaaaaaaggguacaauacaugauugaaguuauguuucaaguaaggaaagaugauuuugccacuuuuccaucaguaccagaagagcuugaccuuguugaugaagaagaucaguucacucauuuaauuggacuugaugaugcuauugauacccaagauauauuaaauguguucaagcuugauucagaauaucaggcaaaugaggaacguuauaaagaauugaggagugaaauucuugauacugauucugaagauaguggcucuga

SEQ ID NO: 5162 - RNA, 663 nt, Euschistus heros
aagagguagaguggagaguccuugucguggaucagcuagcgaugcggaugaucucugcuugcuguaaaaugcaugaaauuucugccgagggcuuaacaauuguugaagacauuaauaaaaagagggagccacuuccaucaauggaagcuguuuaucuaauaaccccgagugaaaaauccguacaugccuugaugaacgauuuugccucaccgaaucguaucauguacaaagcugcccaugucuauuucacagaagcaugcccaaauccuuuauuugacacccugugucaugcgagaaucgcuaaauuuauaaagacucugaaggaaauaaauauagcauuuauuccauacgaacagcagguguuuucccuugaugcuccagaaacauuccagugcuucuacaacccaucauuggcuaacagccgacuugcuaauauggagcguauugcagaacagauagccacauugugcgccacgcuuggugaauacccaucugucagauauaggagugauuuugauaaaaauguagaauuagcucagauagugcagcagaaauuggaugccuacaaagcugaugaaccuacaaugggugaagggccugaaaaaucucguucccaauuguugauccuugaucgagguuuugaugcaguuucuccucuucuuc

SEQ ID NO: 5163 - RNA, 674 nt, Euschistus heros
gacugaacuaucugccgaauugaguggcuucaaaaugggaucugaugauucuuaucuucaaaaacuaacucaaaacauauuucaaaaauauuuagaaucuuacauaaguguugaaguuaagggccugaaggaaaagugcucaacguuguuacaaaaauauuaugacucaaaagaucaccauaaacgacaaauacagucuggaggauuccaagauuuuagacgugaucuucaggcuguuauuggcacuagggcuaacaucaauauugcucaaaucgaagauuauggaggagaaacauuuuuaucagaagaauuaguuauuagucuaauacaagagucuaagcaggcauuuuacagauguaaauugcugucuaaaccugcugacuuggcaaguaacacaguccagcuguuagagguacuacugaauuguauuauuaucgaucauguugauuacgcuguagaacuagcuuuacaagcaguaccaauuccugaaaguaaaacacaggcucagccaauauauuucuuugaugucguaaggcaggcaaacaccauugugcaucugauugaaaaacacuucaaugauucugcucuuccuuuaguaaugucaacuucuaaacauggggaaugugucaugaaaaaaaaauucuuauuaaaccauuuggaacagaaacuggaca

SEQ ID NO: 5164 - RNA, 685 nt, Euschistus heros
gcaacuagcucucgaaacuauagauauaaacaaggaucccuauuuuaugaaaaaucauuuagguuccuaugaauguaaguuaugucucaccuuacacaauaaugagggaaguuauuuagcccauacccaaggaaagaaacaucaagcaaauuuagcaagaagagcugcuaaagaagcgaaagauucuccacaacagcccgcaccagauaaaccuagaauagaaccuaaaaaguucguaaaaauugguagaccugguuaucgaguuaccaaacaaagggaucccgaaacuggccaacaaagucuucuuuaccaaguggauuauccagaaauugcagaaggaaucuugccuaggcaucguuuuaugucagcuuaugaacaaagaguugaaccuccagacagaaaauggcaguaucuccuuuuugcagcugagccuuaugaaacaauagccuuuaaggugccaagucgugaaguagacaagucugaaaacaaguuuuggacccauuggaacaaagauaccaaacaauuuuuucuccaguuugcauuuaagaaugaaccucuugcuccuccuaugggcgcaccacaucuaggccagaugaggccuccacacaugcugccuccuccaaugaguguuccuccaccuccuauguuuaauccaguuccaccucccccuccaaaucuaaugcuu

SEQ ID NO: 5165 - RNA, 295 nt, Euschistus heros
ugugaaaccaaaacuggagaagucuacagaggaaaacuaauugaagcggaagauaauaugaauugccaaaugacugguuuaacuguuaccuaccgcgauggcagaguggcacaguuggaaaauguuuucauuagggguuccaaaauacguuuucuuauacugccggacaugcuaaagaacgcgccuauguuuaaaaaacaaggcaauaaaggaaauacgggugcggggagagguaaaucagcaauauuaagagcucaagcugcccgggguagagguucacaaucaagaggaggug

SEQ ID NO: 5166 - RNA, 672 nt, Euschistus heros
gagugggcuuggaaauucuauuuuuguucgagaauucaauauuaagaaaauuaacugugaaacguugcaacauuuuuaugcuagcaauuucacuggugauaaagcugcuguagcugguuguggaauaccucauaguuuucugacuucuuuugcugauucacuggggcuguguucuggaauucccagucaaauacaagcauccaaguauagagguggugaaauaaggauugaggaaaacauuccauuccaucauaccaucauugcugcagaagcaccagguuuagacaaaagcgaugcacuugcuuaugcugucuuacgauaugcccugggcacugguccuucugugcaccguggucaaggaucuggaccucuuuccaagauuccugcuaaggcuauggcgcuuuccauggcccacucugacgcuggucuuuuugguguuuacguuucuucucuugguacagaugcuaaagaggcuguggaaggagcagugaaagcuuuaaaguguggagucacugaacaagaugucgcacgagguaaagcacaguuaaaaucagaauuguuauauuccggcgaaaccugucggggaauaguggaugaccuuguugggcaggcuuuacuugucaaaggggcaccucccaugaccauuguugaauuggccgaaaaaguuucuuc

SEQ ID NO: 5167 - RNA, 195 nt, Euschistus heros
aggaaaaugaccagaugacgaauaaacucaaagauaaaauaacugcuuuaaagcacuuaucuauugauaucggcgcggaagucaaguaucaggauaagaugcugcauggcaugucagaagacuuugaucguacugguggcuucuuaggaaauacaaugaaucgaguuuuacgccugaccaaagggagucacaauu

SEQ ID NO: 5168 - RNA, 710 nt, Euschistus heros
ugaagauaugcuuggacgagucuucaaugggaguggaaaacccauugauaaagguccuccaauucuugccgaagauuauuuggauauucaaggacaacccauaaauccuuggucucguauauacccugaggaaaugauucagacugguaucucugcaauugauguaaugaauucaauugcuagaggacaaaaaauaccaaucuucucugcugcuggauugccucacaaugaaauugcugcucagauuugucgacaggcugguuuaguaaaauuaccuggaaaaucuguucuugaugaucaagaagauaauuuugccauaguauuugcagcuaugggaguuaacauggaaacugcccgguuuuucaagcaagauuuugaggaaaaugguuccauggagaacguuugcuuguuuuugaacuuggcaaaugauccaacuauugaacguauuaucacaccucgucuugcucuuacugcugcugaauuucuugcuuaucaaugugagaaacauguuuuaguuauauugacagauauguccucuuaugcagaggcccuucgagaaguaucagcugccagggaagaggugccugguagaagagguuucccugguuacauguacacugauuuggccaccauuuaugagagagcugggcguguugaaggcagaaauggaaguauuacucaaauuccaauucuuaccaugccuaacgaug

SEQ ID NO: 5169 - RNA, 737 nt, Euschistus heros
gucaaagaccagacacucauguggcaacagagcucauauuuggcugauucaggaauucauuccggugcaacuaccacagcccccucacucucagguaaagaagaagaaauguauggggaucaggacauguuugacuuggaucaagguuuugcccaggguuucacccaagaacaaguugaugaaaugaaucagcagcucucucagacacgaucucagaggguucgggcagcaauguucccugagacauuagaagaagguauugaaauuccaucuacccaguuugaccaagcucaauccacagcaguucaaagacuugcugaacccagccaaaugcuaaaacaugcuguugugaaucucauaaauuaucaggacgaugcagaucuagcuacucgugcuauuccugaauugauaaaauuacucaaugacgaggaccaaguaguagugucacaggcugcuaugaugguacaccagcugucuaaaaaggaagccucucgccaugccaucaugaacaguccucagaugguugaagcuuuggugagagcauuaucaaacaguaaugacuuggaaacaaccaaaggagcuguugggacauuacacaauuugucucaucacaggcagggucuuuuggcuauuuucaaaagugguggcaucccugcucuaguaaaacuuuuaaguucgcccguggaaucuguucuuuucuaugcaaucacgacuuuacacaaccuccuucuucauca

SEQ ID NO: 5170 - RNA, 678 nt, Euschistus heros
gcacaauuaggagaaggugaucaagcuaaacaaagaagaccguauuuagcaucugagugcacugaucuucaacaagcugaaaaauggagaaugcaaauuauaagagaaauagcucguaaaguuucacaaauucaaaaugcuggucuuggugaauucagaauucgugauuuaaaugaugaaaucaauaagcuuuuacgggaaaaagggcauugggaagcccaaauucgagagcuugguggcccagaccacucuaggucugggccgaaaaugcuggaugcugaaggaaaagaaguuccuggaaauagagguuacaaauacuuuggugcagcaaggcaacucccuggagugagagaguuauucgagcaggcuccaccuccuccuccacauaaaacacguggugagcuaaugagagauauugaugcuucuuacuaugguuauauggaugaugaagauggaaucauuauuccccuggaagaaauugaagaaaguaaagcuauuaaaaaagcuguaucggaauggacuguuaaaaaggaaaaaucaauggaaauugaggaagaagagaaagaagaagucgaagaagacaauaucuacaaaauagggaauaaagagggugaggaagaugaugaagaaguagaagaugauggauuugaauuaagugccaaguuacuggaaggguac

SEQ ID NO: 5171 - RNA, 500 nt, Euschistus heros
ugucaaacgccauuuaacuggugaauuugaaaaaaaguauguugcaacuuuagggguagaaguacauccuuuaguuuuccacacaaauagaggcccuauccgguuuaauguuugggauacugcaggccaagagaaguuugguggacuuagagauggauacuauauucagggucagugugccauuauuauguuugauguuacuucaaggguaacauacaaaaguguccccaacuggcaucgagacuuagugcgaguuugugaaaacauuccuauuguacuuuguggaaauaaaguagacauuaaggauaggaaagugaaagccaaaagcauuguuuuccauaggaagaagaacuuacaauacuacgacaucagugcuaaaaguaacuacaacuucgaaaaacccuuccugugguuggcucgaaaacuuauuggugauccaaaucuggaauucguugcuaugccugcuuuguugccuccugaggucaacauggauccugaau

SEQ ID NO: 5172 - RNA, 362 nt, Euschistus heros
ucauuuugaugcuuuaccgcuaugguggaaagcaaggauuuuuggggguagguggaacauggaaccuguaugaaguaaagagugcagaugcugaaauuauugcaucggguguuuuuguuggauuuuuuauauauacaucugucauuuugauuuccuacugcuucggaacaacaaaacacaaauauagugcaguggacauaauaaugaauguguguggaacuauacuguuuacugcaguaggaggaauagcauuacacuauugggucggcuuccaggaugaaaaccauuaugugggaaucucucaagaaaaacaaaucggccuugcacugggcagccuuugcgucgucugugcagcuauuuau

SEQ ID NO: 5173 - RNA, 682 nt, Euschistus heros
cagccuaagaacgauuacgaaauugucguuccugaagaugaaguuucaucugaaacagccgcggaggguucugguaugccaagcaucgaagaucaagcagauaucgaugccagaaauuugagccuucucgcucaacaacgugaaaaagaguugaaaaguagaucgcaaguaauucaacgagguuugccucgaccuggagacaucaauauaguacugcgcccagcuaacacagauccaccucuaacagaucuucagaaggcugaagagaugauaaaagaagaaaugauaacgaugcugcauuaugaugcuaugcacaguggugaaccuccuuccucgaggaaaauuggaacuuugagucaggcacagcaccuugccuaccucgagcaacauccguaucaaacuuacucagaagaucaaauggaaaaggccaaagaaaugcugaaagcugaaauggaaguugucaaacaagguaugaaucauggcgaucucucgcuggaaacuuuuacgcaaguuugggaagaauguuuagcucagguuuuauauuugccaaaucaaaauagauacacuagggcaaauuuagcaaguaaaaaggaccgacuggaguccgucgaaaagaggcuugaacaaaauaggacucauaugacucgagaggcuaaaagagcugcgaaaauggaacgaaaaa

SEQ ID NO: 5174 - RNA, 349 nt, Euschistus heros
aaugguauguugcacauccagauaaauugaagaaaaaaauuacaagggaauuaauuacaacuauuuuggcaagaaaaccuaaaauguguagcuuuuuagaauggaaagauuugaaaauaguuuacaaaagguaugcaaguuuauacuuuuguugugcuauugagcaaaacgauaaugaacuguuaacauuagaagugauucaucgcuauguagaacuucuugacaaauacuuuggaaguguuugugaguuggauaucauauucaacuuugagaaagcauacuuuauccuugaugaacucuuacuuggaggcgagauacaggaaacaaguaaaaagaacguccugaaagc

SEQ ID NO: 5175 - RNA, 654 nt, Euschistus heros
aaacuggaauccaugcucauguuuaucagcccccacaaaaacuaagaagaagguuggaaacaaugcccgauaacaaaacauugaaaccugacacagagacauugggcaucgaucuucauaaggauucaaaauuuuuccagaguuggcagcaauucaaagacaauaaugcuuauaucaacaaaguucuugauuggaaaaugaaguaugaugagagugauaauccuguuauucgggcuucucgaguuuucacugauaagguuucaaguguuauggguggccuuuuucagaaaacugaacuuucugaaacuuuaacagagauauguagaauagaucccaauuuugauagagcucauuucuugaaagauugugagaaagacaucaucccaaauauucuugaagcuaugguccguggugauuuagauauauuacgagacuggugucaugaagguccuuauaauauucuugcugcuccuauuaaacaagcaaaagaugcccauuuuaaguuuuguucuaaaauuuuagauauugauaauguugauuugguaauggguaaaguaauggaucaagggccagucuuaguuauuaguuuccaaucucagcaauuacuauguaucaaagauaaaaaugguaauauuguugaaggugauccaaaca

SEQ ID NO: 5176 - RNA, 674 nt, Euschistus heros
ucagauacugaggcucuucaagaagcuuuuguuaaaggggaacugaagccaggucuuaauauaccaguuaaagaaagaacaaaaacuaauaauguuccucuucuaaaggaaguauuaaaugauaucaaguuggaucugccuuggauugagagauuggauguaacuaaugaucaagcaccucuggcuccagaacuugcccuucagaucagagaugaagaaaaaggccauaauccauuaguuuaugaugagcuuaagagagaaaguguauucuaccgacaagcucagaaugcugcaaugaagauucuuccaaaauugaaacaauuagguuugagaacugagagaccaggggauuauuuugcugaaauggcuaaaucagaucagcacaugcaaaagguuaaaggcgaagcuauaaagaaaaaauuaaugauggaaaggauugagaaauugagagaaauacgagcacagaagaaaguucaaaaagcucuccaugcacaagcuaaaguugccaaaguacaaaauaaaaaagaaaugcuugaugaagugaaaaaguauagaaaaggagagaccaaaaguuuagcuuuucuagaaccaggcuauaaggcaaaaccaaaagccaauaaaucacaaauuaaacggcaacacaagaaugccaaauuuggucaugguggaaagaa

SEQ ID NO: 5177 - RNA, 678 nt, Euschistus heros
ggaggaguagagacagaaguucaagucguaauagaaaucaggugaagaacugggaaagagacaggagagguaaaaaugaucgaagaagcagaagcaaugguaggaagagaaaugaaaggaguagaagcaggagcguugguaaaaggaggaaugauagaaguagaagcaggagcuaugauagaaaaaaaaaugauaagaaaagggaaaacgaugaugagaagaauaagucugaugaaccacucgagccagaaguuggaaaaauauauaaugggaaaguuacgaauauuguaucguuuggauguuuuguucaaaucgaggguuugaagagacgaugggaaggacucguucauauaucgcaacugagaagagaaggaagaguaacgagugccucugaugucguuucucguggaaugaaagucaugaucaaaguauugucgguggcuggacaaaagguaucucugucaaugaaagaugucgaccaagaaacuggaaaagaucugaacccuaccguccgacaugcuaucaauaaggacagggaagaagaagcuucgaugcgaaaucccgaucgcccuacgacacuucuagauuuaggcuccuuugaugaccaugaugacuuucagaguagaaaaaggguuaauaggauaucuucaccugaaaaaugggaaaucaagcagaugu

SEQ ID NO: 5178 - RNA, 729 nt, Euschistus heros
aucguuggaacuaagccuuuguacguugcucuugcccaacguaaagaagaucgcaaagcucauuuagcaucucaauauaugcaaagaauggcuaauaugcguaugcagcagaugggacagaucuuuccuacuggugguacuggaggcuacuuuguuccuacucugccacagccgcaaagauuuuuuggaccagcucaaauggcgcagaugcguccucagccucguuggccagcacaaccucaagucagacccagcacgcaagccacugcaucagguuuucccaauaugcaaggcccauucagaaguggaccacgaggcccaggugcugcaggcgguggugguggcccaggaagugccgccgcugcugcugcggcuaugcgcuccuccaucagugcugcugcugcagcgguggcugcggcuggccgcccgacagccaaugcagcugcugcagccgccgcugcugcugccaacccagcuguugcccggcaauuggcccaaggagcuucucaaggugcuccaguaucugugucugcucaaggucguccugcaaauuacaaauauaccgcaaacaugcgaaaccccccacaaaugggagguggggcuggagcaggugcuggagguccuccgcaacaagcauuacacauccaaggacaagaaccccuuaccgcaaguauguuaucaucagcgaauccccaggaacagaaacaaaugcuuggagaaagacucuuc

SEQ ID NO: 5179 - RNA, 783 nt, Euschistus heros
cagguucaacuucagcuacuuacggcuauuguuaaacuguuuuugaagaggccuacgcauacacaagaacuuguacaacagguguugagccuagcuacucaggauucugacaauccugaccuccgagacagaggauuuaucuacuggaggcugcuaucaacugauccuggugcugcaaaggaaguugucuuagccgagaaaccacuaauuucagaggaaacugaucuucuugaaccaacucucuuagaugagcuuauaugucauauuucuucacuugccucuguuuaucacaagccaccuacugcuuuugucgaagguagagcugguuugaggaaaucccuaccagcaagaucuggaucugcugaagugguucaagaaacuccuggugcucaagucauuccaucacaagauucacugauuggggaccuccuauccauggauauaggcgggguuucagcuccuccuccaccuccaacgacaucugcuccuguugaccucuuggggcuggauucucuucuuggaggggucccugaaccuacaguaucacagaguacuacuggauugcucggugauauauucgguuuaggaucagcuggaccgacaacauauucuccaccaaaaaccauguggcucuccagugaaagggguaaagguugugaaauaucaggaacuuuuucacgaaggaauggacaaauccaaauggauuugacaauuguaaauaaagcuaugcagccaaugaccggcuuugccauacaauugaauaagaacaguuuuggugugacu

SEQ ID NO: 5180 - RNA, 350 nt, Euschistus heros
cuacaucuucucuugcucccaaaauuggaccucuugguuugucuccuaaaaaggugggugaugauauugcuaaagccacagcagauuggaagggucugaaaauuacaguuugucucacaauucaaaacagacaagcugcuauuucuguaguaccuucugcagcuucacuuauaaucaaggcucucaaagaaccaccgagggacaggaagaaagucaaaggaguaaaacauaaugguaaccucacuuuugaugaaauccucagcaucgccagaucaaugagaccaagguccaugucaaggaaacuugaggguaccguaaaagaaauucuugguacaugucagucuguuggu

SEQ ID NO: 5181 - RNA, 682 nt, Euschistus heros
cuagacuuagaccccugacacuaagcaggccuaagccgcuuguugaauuugcaaacaaaccaaugcuaauccaucagauagaagcauuaguugaagccggcgugacugaaguuguuuuagccgugucauauagagcggaacaaauggaaaaagaauugagugaggaagcuaaaaaauuggguguuaaauugauuuuuucccaugaaacagaaccucuugguacagcuggaccucucgcucuugccaaagauauucuaacaucgaguaaugaaccauuuuuuguucucaauuccgauauuauuugugaauucccauucaaagagcuuguuucuuuucauaaaaaccaugggaaagaagguacuauuguagugacaaaaguugaagaaccuucgaaguaugguguuguuguuuaugaugaaaaagguuguauugccaguuuuaucgaaaagccacaagaauuuguuucaaauaagauaaacgcuggcauguacauucucaauccuucggucuuaggaagaaucaaacuagagccaacuaguauugagaaggaaguuuucccguuuauggcugaagaaggggaguuguaugcuauggaguugaaaggauuuuggauggacguaggacagccucaagauuuucucacaggcaugugcuuguaucuuacaucucuacgucagaaagc

SEQ ID NO: 5182 - RNA, 699 nt, Euschistus heros
uauauuacauucgccaccgggagaguuuaacgaaguuuuuaaugaugcaaggauauuauuaaacaacgauacccuuuugaaagaaggagcucucggugucuucgggcaguacugcaaagaccaacuuacgcccgugaagauuaagaacagugaguauccaguuuugauuaccgaacauaaugaucuaggauccaacagguuuuaugaugcaaggaguaaacagucguuuaaauaugauccuuuaaggagagagaccucuaauuaugauuccugggaggcagaaccagguacugaaaaguggcgaucagcauuagagguugaauuagaugcauauauagcuaaacauuuugaaagugguucagguaguguauuuucuaaaagggaagauggaaagguaagcuugguugccuguauagaagcccauuuauuucagccgaaaaacugcuggaaugguuguuggcgaucucaaugguuugucacgauagauucagauaaugcugaugugaaagguguucugaaaauucagguucauuauuacgaagauggcaaugugcagcuugucaguuugaaagauauuaaucaaucacuccagguugcggaugaacaacaguuaaguaaggcuuuaauuaaaauauucgaagacucugaaacagaguaucaacaagcaauaucugaaaacuaccauacgaugucagacac

SEQ ID NO: 5183 - RNA, 704 nt, Euschistus heros
aaggagaguuugugcuacugcacacugauucugaaagguuuaagcuagacguucaagcaagguucgagcaaguaggaaaaaacauuuauggcgauguggcagcaacucaguugacaucuauagcagcaagagauaauacuucaagcaucauugaaguaaggcuuagaccaaaggaggcacaauggagauacagacuagaugucuuugcaaauaagaaaaggauauauuuugacaggccaucucuucguguacagcacuuuacaggugucacaguuuaccaaccuucacauguacuuaaucaguccgaaaucauuaugauguuucaaucagguguuggaguagaaguuguugaaaauaaaggauacauggcugcaaggguuuauuugcccugggaauauauaaacagaacaagaggccuguuuggaaauuggaguuucgauccaucuaaugauuucacucuuccugaugggacuguggucagugcugaaaaccucaaugacuucgagagaauacacaagcaauucgcaauuuacuggagauuagaggacaauguugaacccaauaaaggugaaccucucuuuguuagagaauauggaagaacuucaaguuauuauuugaauagaacauuuguuccaguauggaaaucaacuccucaagaaauuauuccuccuaacaggaccaaagauauacaacaagccuuggca

SEQ ID NO: 5184 - RNA, 223 nt, Euschistus heros
ucagcagcugauauugacaagauauuaagcucuguugggauugagucugauucagaacgagugaacaaaguaauaucagagcuuaaaggcaagaauguugaggaaguuauugcugcagguaaagagaaguuagcuucaguaccaucaggaggugguggagcaccugccgcagcugcugcugcccccgcugcagccucaccugcuaaagcagcugaggaaaaga

SEQ ID NO: 5185 - RNA, 669 nt, Euschistus heros
uaggccuaaaucgaaagucgcacaggaaaacauggauguuuucagagauucgugggagucacaaguucgaguacuaacugaagccguagaugauauaacaacuauugaugacuucuuagcuguuucugagaaccacauccuagaagauguuaacaaauguguuauggccuuacaagaaggagauggagauucuuuagacaggacagcuggugcaauuaggggucguucagcucguguagccaauguuguuacugcugaaauggacaacuaugaaccaggaaucuacacagaaagaguucuagaagcaauuaaaguucuuagggagcaggugaugccaaauuuugcucaaagaguggaaguugcuguagaugcucuuucuucaaauccaccuaaagauguugaugaaaaugaguuuauugaugccucucguuugguguaugaugguguuagagaaauucgaagagcuguucucaugaacaggaguucagaagaguuagacacugauacggaauucgaaccaugugaggacaacaugacuauugauacgaagaauagaccuagugcacauacugccgaucaugguguugaugaguauccugaaaucagugguauuacuacugcuagggaagccaugcguaagaugacugaagaagacaagcagaagauugc

SEQ ID NO: 5186 - RNA, 698 nt, Euschistus heros
gccucuaugccauuagguacugguuuaucaucuacaggaggaaaugcuccaccaacuggccugaauuuuggaucugcuccuaaaucaacuaauucuggaucuacuaucuucaguucaacaaaaaguucacucccagcuucuaaugcuguuacaaccucaucuuuaacauuaacuccuucuucuaccacuucucuuaccaauucauuaucuaacaaaccuguuacuagcacuggggcuacaaccucccagcaacaaagccuuacauuucaacaauuagaagaauugauucuuaauaaauggacugcagaauuguaugaacaggaaaagguauucuuaaaucaagcuacacagauuaauauuugggauaagguuauuaaugaaaaugcugaaaaauuaacucaguugcauucuacuauggaaaaaguacggaagcaacaaacaaaaauaaaugaugaccuagagaucauaucuacacaucaaaaagacuuggaagccugucuugugcccauggagaaggaagacuuguuaucaguucuuaaagcugauccaaauaggaaaaaucuuuauauaaaugccaaaaaaauugauucucagaucaaaacuaugucugaggauuugaaggaaacaauugaacauauuaaugaaacuucacgaucucaugauacagaagauccugucauucagguagggcgaauuuu

SEQ ID NO: 5187 - RNA, 432 nt, Euschistus heros
aggcaaacuguuguuuuuaggauuagauaaugcugguaaaacaacucuucuccauagguuaaaagaugacagauuggcccagcaugugccaacauugcacccaacuucugaagaacuauccauaggaaauaucagauuuacuacuuuugaccuuggagggcacacucaagcucgucgaguauggaaagauuacuuuccggcaguugacgcuauuguuuuucuuguugacgcuugugacacaagucgauugcccgaaaguaaagcagaauuagaugcacucuugacugaugagagucucaucaacuguccaguccucauccuuggcaauaaaauugaucuuccaggugcagcuucagaagaugaucucaggaauuuuuucaaucuauauggacagaccacuggcaagagcaaaguuccacgaagugaauuguc

SEQ ID NO: 5188 - RNA, 783 nt, Euschistus heros
aaaucauacugcugccuucacuaagcacuucaauacccagauaauggauuauggaaggcaaguuauagugaauuugguugaccauucuggaucugagggaaagcuagaagaguuauauagaaaguuaguaaaugaagcaaauauugcagaucuaaaguacgaagcuuucgauuuccauagggaauguucuaaacuacguuaugauagguuaaaaauucucauugaccgccuggccuaugauuuagaacagaugucagugacaaugauuguuggaaaugggacuguuguaucucagcaggaagguguauuuaggacaaauuguauugacugcuuggacaggacuaauguuguccagucaauguuggcuagggucaaucucucuuauguuuuacaaaagcuuucaauauugaagaaaggagaaacaguagaagaucaaguucaacuugagaaaguguuuaaacuacucuggagugaccaugcagaucuaauaucaacccaguauucuggaacuggggcauuaaaaacagauuauacaagaacaggaaaaagaaccacagcuggaauuguucaagaugggauaaacucgcuuguacgauauuacauaaauaauuuucagcaugguuuucguaaggaugcauuagaucuuuggcuuggucauuaucggguuucuucugaagaagggauugugaucaaaagccccauuggugucaaaagagaauucaaguauaaagcuuuuccacucauccuacucguugcuguugcuauauucuucgcaaaccuggu

SEQ ID NO: 5189 - RNA, 777 nt, Euschistus heros
uucuaaaagguccaggcaucauucucgagcaguuucauggcuucguaggacagaauauauuuccacagaacaaacacguuuccaaccucaaguuauggauaaaguugaagccaaaguuggauuuagcauuaagaaaagucuuaaggaagaaacucuguacauggauagggaaagccaaauuaaagcuauugaaaagacauaugaugaugcuaaacuaccuauagagaaacaucauagcaaaccaaauguuguuccaguugaaauucuucccguuuuuccagauuuccaguuguggaaguauccuugugcucagguuauguuugauucagacccugcaccuauaggaaagacuguucccgcucaguuagaacaaaugucacaagcuaugauucggggugucauggaugaaagcggagaacaguuuguagcuuauuucuugccuacugauucaacuuuagaaaagcgcaggagagauuuuacaaacgguauugauuaugaagacgaggaggaauaugauuacaaaauagccagagaguauaauuggaauguaaaaacaaaagcuucaaaaggauacgaagagaauuauuucuuugucauuaggcaugaugguguuuauuacaaugaauuagaaacuagaguacgguugaguaaaaggagacagaaggcuggaacugcuccaaauaauacuagauuaguuguuagacauagaccaauggaugcuaaugaauuuaacauucaccgucuaagggagaaacaacuucaacauccaguggaaga

SEQ ID NO: 5190 - RNA, 698 nt, Euschistus heros
gguggguaauggaugaaaguuugugugcacauauggugaaaaauaaugaacuaaggcuugcagaauuagagaaagaacaugagaauucaguuauugaagaugaagagcaagugaguggucuauggcaggcaaaacuagacuauuuguguaguauuggagacaaagaaaaugcuacuacauuagcaaauaguaagcuacaagauaaaacugugccuaagacucaucguauugaugcuguuuucgcccuguuuaggauaucauauuuccaugguugugacauuaaagggaugucugcagcgauugaaaaagcuacugaauugauagaaggccaaggugauuggaguucaagaaauaaauugaaagcuuaugaaggaguguggaguuuugcaguuagagacuauuugcgggcugccaaacuauuuguugauguaguaccaacauuugaaucuuaugaacuugcugacuuuggaacaauuauuaaauauacuguacuuucauguaugauagcauuaccgaggugugaauuaaagaagaagcuuaugcaccaugguguaauggcucaggcucuucacucucaguaccguaacuuaaaggaguauuuccagucccuuuaugauggucacuaugcagauuuccuagucgcucuggcacaaguagaaucugauaugaaacgggacccucugcuacauccccauuac

SEQ ID NO: 5191 - RNA, 799 nt, Euschistus heros
cuauaccugucgaccaaaggauccaaacuggaggccgagaaggagaggaaauaccagaaaguguuaccgcggaauuagaaaaguuggaagaagaaggagguacaauugguggugaagccgacgagguuucugcaauuuucucuggucuuguggaagaugaugaugaacuucucgcggaaauggguccggauuucaauauucuugaguaugcugauccagaacuugauacuguaucuggaggagaaaagacgaauauccuugacgaucuggaagaugaaguugagaaaaaaaaacaaaugucuuccagaaaagaaaauacugcuagaagaaguucuucagacaguauuaauaaagagcuaacugaaccaagaccugagaguaagccaagcgaagaagugaauaggguaucgguaacauccacuccaccucaucuaccucaacagauuucauuaaguggaaacaguggcauuacacaaccaaaaauuguuggaucagguuaccaaacgcaauuugcgacuccuaguacaccucucccgaggaugcaaguuuugcaaggugcaaaucaagugagucguggaaaugcaagcuuuguuggcaauccuccgccuccuccacccccauauccuggcccucccccaccauauccagggcagcaagcugcgauacgaggaagggguguuagaucgcacaucaucccaggcccagcggcacaggcucaacagagaagaaccuugcuccuucaagagcagccucuacugcuggaagaauuacucgaagaggagaaaagggagcaagagaa

SEQ ID NO: 5192 - RNA, 650 nt, Euschistus heros
uugaaagucgaaggcauguaaagaagcuucugaagucagccgcuucuccugagcagaaaaugcaguaugauauucgucaaauggcuuugaaauugacugcuaacaguauguaugguugcuuaggauuuucaaauuccagauuuugugccaaaggucucgcugcucuuguuacagcuaaaggcagagaaauacuuuuaacuaccaaaagaaugguagaaucuuuuggcuaugaaguuauuuauggagauacugauucaaucaugaucaauacuagaaccaaagacuuugaacaaguacaucaaguugguaagaaguugaaauuugaggugaacaaauguuacaaacaaguugaauuagauauagauggaguuuucaaguauaugcuucuguuaaaaaaaaagaaguaugcugcuguaacaauuaauaagcuuccaaauggugaguucguugaaaaacaagaaaugaaagguuuggauauuguuagaagagauuggucucaacuagcugcugcagcuggaaggcacauuuuaaaugaaauauugucgaacaaaucaagcgaugauagaauugauggaauucacaauuauuuagaaaaaauccgcucugauuuagagacuaauaaaguaccaguuaccuugcuaacagucacc

SEQ ID NO: 5193 - RNA, 787 nt, Euschistus heros
ugaaggugagguuguugaaauucagguagaaagaccagcaacaggaguuggugcuaaagucggaaaacuuacauuaaagacgacugaaauggaaacugucuaugaccuuggaacaaaaaugauugaugcccuuaccaaagaaaagguucaguccggugauguaauuacaauugacaaggcuacugguaaaauuaguaggaucggaagaucauuuacaagagcgagagauuaugaugcgaccgguccucagacaagguuuguccaguguccggagggagaauugcagaagagaaaggaaguuguacauacuguaucuauucaugaaauugauguuaucaacucaaggacacauggguucuuggcucuuuucucaggugauacaggugaaauaaaaccagaaguuagagaacaaaucaacacaaaaauugccgaauggagagaagaaggaaaagccgaaaucucaccagguguucuguucauugacgagguucacaugcuggauauugaauguuucucauuuuuaaaucgagcucuugaagaugagauggcaccuguuguuaucauggccacaaacagaggcauuaccaauaucaggggaacuaauuacacuucgccucauggaauuccgauugaucucuuggacaggaugaucaucauauccacaucucaguauaaggagaaugaacuuagagaaauucuaaaaauuaggugugaagaagaagauugugaauugucugaugaugcuuugacaguccuuacuaggauagcuauggagacaagucuucgg

SEQ ID NO: 5194 - RNA, 772 nt, Euschistus heros
uuuacggauguuucguggaucucuguauaagagauauccuggaauguauagaagaacucuuggaaaugaggaaagaaaaagacuaauagagcuugggcuaagcucucacuguuuggcuuccaguauaucucuguuacgagcaucugagguugaagauauuauugagggcaaugaugaaaaauacaaagcuguuucuguucauucuucugaaacucccauuacaaguucuucuaaaccgaaaaaagcuaugccauggguaccuucucuuccgaauaguucgcauuuagaugcuguaccgcaagcaacaccgauuaauagaaauagaguuguuagcaaaaaaguaagaaguuucccucuuugcuuugaugacacugauccaucaucuaucauggaaaaugcuucgcaaauggaaguacucguaccuauacgucuugacauggaaauagaaggucagaaacuccgugauacuuuuaccuggaauaaaaaugaaaguuugauaacuccugagcaguuugcagaaauucuuugugaugaccuagauuuaaauccccuaaguuuugucccugcuauagcccaggcuauccgacagcaaaucgaagguuucccuacugacaauauuuuggaagaucagacugaucaaagaguuaucguuaaacuaaauauucauguugguaauacuucccuuguugaucaaauagaaugggacaugagugagaaggaaaacaguccugaacaguuugcgaugaaguugugugcagaacuuggauuagga

SEQ ID NO: 5195 - RNA, 571 nt, Euschistus heros
uuaguacuguugggaguugcuccaagugguuauuguuuagugauggcugcuauacguaaaaaauuaguuauaguuggggauggugcuugcggaaagacuuguuuauugauaguauuuaguaaagaucaauuuccagaaguauaugugccuacuguguucgagaauuauguugcugauaucgaaguugauggaaagcaaguggaacuagcauugugggauacugcuggucaagaagacuacgaucggcuaagaccacuuucuuauccugacacugaugucauuuuaaugaguuuuucuauugauucgccagauucauuagaaaacauaccugaaaaauggacuccugaaguuaaacauuuuuguccaaacguacccaucauucuuguaggaaauaaaaaagauuugcgaaaugauccaaauaccauuaaagaguuggcaaaaaugaaacaagagccaguuaaaccagaagaagggcgagcaauggcagauaaaauuaaugccuuugauuaucuugaauguucugccaaaacaaaagaugggguuagacaaguauuugaaacagcaaccagag

SEQ ID NO: 5196 - RNA, 758 nt, Euschistus heros
aaucacgggagaauaugagcuuaacagaucguggauugcauggacacuuucuaguuuaccagcaaaauuacccucaagauagguuuauuauuuuaagccagcagggcacagauauuuaugaaaagcugagaccuguugacauauuuggugagcuaaugcgagagaaagguggaccagauugugaagaaguaaaacaauucuucgcucagcaugguacagaucaagcaugcgcgauggcccuuauacuugccugugaccagacuaaccaacacauggcagaaugggcaacacgugcauuuuuucucuauggaggugaucccaaauauguucuacaaacuauucagcaaccuguacaaccgccaacuauuacuaacccucuucaacagaguauccuucaucauacauuaccucuggguuucaaaccuaacacaguuaguacuccauuaggggagaagcaagcacaaccuucaacaagaaguauugaaaccuaugggguagcaaugucaucaaagcauaauggucuuuaccuauuccugagccguaugcuuagaccaguuuggucaagaagaguuuuagaugucaauuacaauaaaaaaccuauuuaucuaccaaccauuaccugugaagaacuuaguuuaaagacaguacaacuuuaugagcuucguucauuucucaccagauacaccuuaaguucgucagauguugcuaccaguuugcagccugccaacacuaugacuguuguuucuccaaguggucaa

SEQ ID NO: 5197 - RNA, 695 nt, Euschistus heros
augagagaugaugauggugcugcagacaggacucaacacaggagccuagcugcucuuuguaaagccuauuacauauuaaaauggaucuguacaucuaagucuacuggaaaugcaccuuugauccauguguuuucauugguuaacccaacaucaauaaugcagucuucucuugaacaauguguucuuggccuagcuaauugcuuauggccauuagcaacaaauaguacucuugcucaacauuuauuaucaacaaaacaauaugcccuucuacaaacauuagcaagauuaguuggaauaaauagcuggaguuuacuacuagcugaauccuacauucuaacaggucaaccuggcaaggcauuugauguuuguuugaaaaaugcuggaucagauguggugcauuuccuuaaugcuauaagacuuuuugaaaagcauucaaggucugauuuaguuauagcgauggcuacuaaagcauuagaacuucuuauuguuucacauucugauagggaaacacuugaaucugcauuauuuguucaugaauugggaauggaaaauuaugaugcugcuuggaguuggauugaaucguguaguucuuggucccgcaggucugacuuuuugcagcgcuugguagcuaacaugauaucagaaggaaaacucacugaucuuaucuccuuuuccuauacugggcuccuugauga

SEQ ID NO: 5198 - RNA, 678 nt, Euschistus heros
guugguugcaccuucuaguauucagaagcagcuaucugaagcaguugguacuauuggaaaaugugacuucccaaaagacuggccuggacuucugacaaauauggucgagaaauuugguggaggggacuuucauguuauuaauggaauccuucaaacugcccauuccauauucaaaagguauagauaugaauucaaaucucaaaaguuaugggaggaaauuaaguuugugcuugacacguuugcaaaaccuuugacugaucuugcuguggcuacacaaaauuuaacacaaguucaugcuucaaauccagaugcucuaagagugauuuauucaucuuuacuucucauuucaaaaauuuuuuacucuuuaaacuuucaggaucugccugaguucuuugaagacaauaugaaugucuggaugccgcucuuucauacauuacuuacuaccgauguuaagugucuucaaacugaugaugaugaagaggcaggcuuacuugaacaacugaggucucaaguguguucuaauguugcacuguaugcacaaaaauacgaugaagaauuucaaccauaucuccaggguuucgucacggacaucuggagccuucuugugacuguuucacuucagccuaaaaaugaucugcuugucagcaaugcacugcaauucuugucaacuauugcgga

SEQ ID NO: 5199 - RNA, 437 nt, Euschistus heros
ugaaucccuuucaguuugaacuuacauucgaauguaucgaagaauuaaaggaagauuuagaauggaaaaugauuuauguugguucugccgagagcgaagauuaugaucaaguucuagauacuauuuauguuggcccuauuccagaaggacgacacaaauuugucuuucaggcagauccuccugauguaacuaaaauaccuauugaagaugcucuugguguuacuguuguuuuauuaaccuguuguuaccgugggcaggaguuuguacgaguaggauauuuuauuaacaaugaauauucugauccagaacucagagagaauccuccuccaaugccacaguuugacaagguuauaagaaacauuuuagguucugaacccagaguuacaagguuuaaaauuaauugggaugauucagaaucacaagaccaaccuagucaa

SEQ ID NO: 5200 - RNA, 691 nt, Euschistus heros
aauagcacaacagcaacaacaaauacaaccaccuuugcaaaugcccccguuacuaccaauacaaucuucaauuaaucagcaaaagccaaugaauacuuaugccccuucaaugggauuuacuacaccacaaaguaugaugcauccgcaaacaccacaaaaucuaaugucaccuaugguaaauagaauggaacagacaccgaacaauauuauuaauccaacuacuccuggaccaaugacaccuaugacgccaucaucugcagacccuggcuuuaugccacaauugcagaacauaguuucuacugucaauuuagguuguaaacuagaucuuaaaaagauugcuuugcaugcaagaaaugcugaauacaauccaaaacgauucgcugcuguuaucaugaggauaagagaacccagaacaacggcucuuauuuuuaguucaggaaaaaugguuugcacuggugcaaagagugaggaugauucuagacuggcagcaaggaaauaugcacgaauaauucaaaaauuaggauuccaggcaaaauuucuagacuuuaaaguacaaaauaugguugguaguugugauguuaaauuucccaucagguuagaaggauugguuuuaacucauggacaguuuagcaguuaugaaccugaacuuuuuccuggccuuauuuaccgaauggugaaaccucguauuguu

SEQ ID NO: 5201 - RNA, 333 nt, Euschistus heros
cuaugcagaugagauggcuuucacauuugcugcagcgaauaagguuuucuaugccaauucuaauguaaagcaaguagauguucccucuuucaguggagcuuuugguauccuuccaaaacauguuccaacuuuggcuguucugaagccuggugucguuacuguuuuugaacaagaugguagcuccaagaagguuuuuguuucaaguggaacaguuacaauaaaugaggacucaucaguacaaguauuggcugaggaagcccacccaguugaagaucuugaugccuccgcagccagggagcagcuuucuaaggcccaagcagaucuaucuagggc

SEQ ID NO: 5202 - RNA, 659 nt, Euschistus heros
uuggcugcugaaaagaaaaggacagaaagugcugaagcugaaaaaaagaggaaagaaaggcuuaaugccaaauccaccccuaaaguaauggagauaacugaugaagaagcgaaaaaaauugaagaggaagaaaaaaagagaaaagaagaagaaagucuuucaaaaccaauuacagaagccgaaggugaagaugaagaacaagacaaagggaaacuaaugccaaaugcuggaaauggugcagaucucgaaaauuacagguggacccaaacucuucaagaguuagaaguccgaguuccucuuaagacuucuuuuaauguaagguccagagacuugguuguagaccuuggcaagacacaccuaaagauugggcugaaagggcaggaaccaauuguggacggugaauuagagcaugaaaucaaaauugaagaaucaacuugggucauugaggaaggcaaaacucuauuucugacggcugagaaaguaaauaaaauggaguggugguccaagcuguuaacgacagacccugaaauagcuacccggaaaauaaauccagaaccaucgaaacugucugauuuggauggcgaaacaagagguuugguugaaaaaaugauguaugaucaaagacagcgugaauuaggucuuccaaccucugaugaaca

SEQ ID NO: 5203 - RNA, 282 nt, Euschistus heros
gauuugcauuuauccagcguauuuaaacaguaagaagacccgugcagaagguaggauuauuucaaaagaaaaagcaguggagaauccuaccuaccaagaaauaagggaugucuuaucugcagcugguuugaaaguugguguugaaaacaaacuuuacaguagggagaaaaguaaagagcuucuuuauagaggucgaauaaggguucaauugaaaaacgauaaugguacuccacuaaacccagauuuugcuaccagagaaucugucauacuucaugcaugugc

SEQ ID NO: 5204 - RNA, 739 nt, Euschistus heros
gcuuguugaagaagaggguaacauugacacaauuagggaaauguaugagagggcuauugcaaacauuccaccaucaagggaaaaagauauguggaggcgcuauaucuauuuguggauuaauuacgcucuuuaugaagaacuugaagcagaagaugaagauaggacaaggcaaauuuauaggacaagucuugacauaauaccucauaaaacauucacauuuaguaaaauauggcuguuauacgcacaguucgaaauuagacauaaaaaccuuucaacagcccgaaaaaccuugggaauggcauuaggagucuguccaagagauaaacucuaccgggguuauauagaucucgagauacaguuaagagaguucgauagauguagaacauuauaccaaaaauuuuuggaacaugguccugaaaacugcauuacauggaugagguuugcugaguuagaaacacuguuaggugacaucgacagggcaagagcuauuuaugaacuagccguuaaucaaccaaggcuugauaugccugaaauuuuauggaaagcuuacauagauuuugaaaucaacguaggugaagcaagaaaugcuaggcaacuguaugaaaggcuuuuagaaagaacucaccaugucaagguuuggaugaguuacguuaaauuugaaaugacucauagccaagaagaagaaauugaaccuauuucauuggccagaagaauuuaugagagagguaacacugcuuug

SEQ ID NO: 5205 - RNA, 721 nt, Euschistus heros
uuacuugacgaacuucugcagaagggcuacggucuugggucaggaaucucucuguucauagccacaaacauuugugaaacuauuguuuggaaggcauuuucaccugcuacagucaauacagguaggggaacugaguuugaaggugccgucaucgcacuuuuccaucuucuggcaacaagacaagacaaaguucgugcauugcgugaagcuuucuauagacaaaaucuuccuaauuuaaugaacuuauuggcuaccauccuuguguucgcuauaguuauuuauuuucagggauucaggguagaucuuccaaucaagucagcccgcuaucgaggacaauauagcagcuauccuauuaaacucuucuauacuucgaacauuccuaucauucuucagucagcucuuguaucaaaucuguauguuauaucucagaugcuugcuguaaaauuccauggaaauguauuuguuaacaugcuuggagugugggcagauguuggagguggugguccagccagggcuuauccaguuggcggucuuuguuauuaucuuucaccuccugaaaaccuuggucauauacuugaagaucccauucaugcuaugcuuuauaucauuuuuaugcuugguucuugugcuuucuucuccaaaaccuggauugaaguuucuggaucaucagccaaagauguugcaaagcaacuuaaggaacaacaaauggugaugagaggac

SEQ ID NO: 5206 - RNA, 380 nt, Euschistus heros
cuacagggaccagcauuuuaagggcucucggacagaacaggaaagacuucuucgcauaucaacuacauuauauguuggaaauuuaucauuuuauacuacagaagaacaaauauaugaacuuuuuucuaaauguggugauauaaaaagaauuauuaugggguuagauaaauauaagaaaauuccauguggcuucugcuuuguagaauacuaccaacgagcggaugcugagagcucaaugagguauauuaauggcaccaggcuagaugaucguauuauaagaacagacugggaugcagguuucgucgaaggaaggcaguauggaaggggaaagaguggugggcaggugcgugaugaauacagaagagaauacgaugcuggac

SEQ ID NO: 5207 - RNA, 717 nt, Euschistus heros
aaaucauggucacgaggaaagaaagcuuuguauaccucacuugguauuuugacugguggaacaggcauguugauauaugcucuugaaaaaagucuucaagcaggagaucuugaacuccauccucccaaacuuccuuggaaccauaguggguauuuucaaucacuggaucaugcaaguauacggcggggcuaugaaguauacaaaaaugugugugcagccugucauaguuuaagauauguuugcuaucgagaucuugucgguguuucucacacugaagcugaggcuaaagcagaagcugaagaacaacuuguuuuagauggucccaaugaacuuggugaaauguucaaaaggccugggaaacuuucugaucauaugccuaguccuuauccuaaugaagaggcugccagggcagcuaauaauggagcuuauccuccugaucuaucauacauaguuccuggacgucauggagaagaagauuacauauuccacuuauuaacuggcuauugugaugccccugcuggagugguuuuaagggauggccaguacuuuaaucccuauuuuccugguggagccauuaguauggcacaagcacuguauaaugagauuauugaauaugcugauggaacuccagcuacucaaagucaauuagcaaaggauguugcuacuuuccuuaaauggaccucugagcccgagcaugauacacgaaaacaaauggcc

SEQ ID NO: 5208 - RNA, 792 nt, Euschistus heros
aaaaacgacgauccuucugauaucaaugguuuccucgguccuugggguucuuauguugaugagaagaaaguagucaaaccugaaccugaaguugcugcagaacuugaagaauaucuugccaagagacaaaaacuugguaagaaaguugaagauaaaccucuugaagaaaagacuguccuucacauuaaagauccaguugacuaccaaggacgaaacuucuuacacccuccucaggauguaggugucaaccugaaaucagacucuccuccagacaaauguuucauuccgaagucagaaauacacguuuggaaaggacauacaaaaggcauuucugcuauccgaugguuucccaaguaugcccaucuccuucuuucuugcaguauggauugccgugucaaguuaugggaaguauauaaugaaaggcggugcauuagaacuuauuauggccacagacaagcuguaagggauguuuguuuuaacaaccgaggaacuaaauuucuuucagcugcuuaugaucgcuacauaaaauuaugggauacagaaacuggggaguguauaucgcgauucacaaguagaaaaauuccauauugugugaaguuuaauccugacgaagacaaacaaaacuuauuuguugcuggaacuucugacaagaagaucauuuguugggacuuacggucuggugaaauaguacaagaauaugaccgccauuugggagcuguaaauucuauuacuuuuguggaugaaaauagaagauucgucaccacuucugaugacaaaagcuuacguguuugg

SEQ ID NO: 5209 - RNA, 672 nt, Euschistus heros
gcaagagguucagaaaguuguaaacccucuguucgaaaagagaccaaggaauuuuggaaucggucaggauauccagccaucucgugauuuaagcagguuugucagauggccuaaauauauucguauucaaaggcagaaaucuguuuuacagaagaggcugaaaauucccccuucaauucaccaauuuucucaaucuuuggacaagcaaacagcaacucaauuguuuaagauucuugagaaacaccgaccugaaucagcacuugcuaagaagcagagguugaaggcuagggcugaaggaaaaauuaagcaaaaagaagaaguuccaaccaagaggcccaauguuaucaggucugguguaaauacugucacuagguugguugaacaaaagaaagcccuccuuguugugaucgcacaugauguugauccaauugaguuggugcuuuuccuaccugcacuuugcagaaagaugaauguuccauacuguauuaucaaaggcaaggcccgucuaggcagacuuguuagaaggaaaaccugcacaucaauugcaguaacucagauggaggguaaugaucguacugcucugaauaagguuguugaagcagucaggacuaauuacaaugaccgauaugaagaaaucaagcgacacuggggaggugguuuacuuggcucuaa

SEQ ID NO: 5210 - RNA, 788 nt, Euschistus heros
uuugcaugacagaacacuugagaaugucugguauguauuggguucuaaccacauuagcaguuaccaaaaaguuggaugaaguugacaagaaggaauuuauugacuuuauacaugaauguacugaugagaaaacugguggcauuggugcuuguguuggucaugacccucauauuuuauauacuuuaagugcuguucaaauagcauguauuuuaaggucauuagaccagcuuccuuuggaaaagauuguaaguuuuguagcaggacuccaaaaagaagacggcaguuuuaugggugauaaauggggagaaguugacaccagauuuucauuuugugcuauugcuugucuaucacucaucggccgcuuggaugcuaucaaccuugaaaaagcaguagaguuugugcugaguugucaaaacuuugauggugguuucgguucucaacaaaauucggaaagccaugcuggauugaucuauuguugugucggaguuuugucgauuacccagaacuuauaccgaauagaugcugaucaacuagguugguggcuaugugagcgucaacugccuucggguggucuuaauggaagaccagaaaagcuuccagauguuugcuauuccuggugggucuugucgucuuuaacgauguugggaagauuacauuggauugauaagcagcuucugaagaaauauauucuugccagucaagauccugauggagguuucagugaucgaccaggagauaugccagaucccuuucacacuuuguuugguauugcugcucuuucacuuuug

SEQ ID NO: 5211 - RNA, 795 nt, Euschistus heros
aaacacaagaccuagcucugcugcucaaugugucgccuauguugcaguagcugaaauaccaguuggucaguggccggauuuaaucccaacauuaucagcuaauguaacuggacccucuucaacugaaaucaugaaagaggcuacucuagaagcaauugguuauauuugccaagaaauugaacacgauuguuuagcuaaucaaucuaaucaaauuuuaacagcuauuguacauggaaugcggucugcagagagaaguaauuauguuagacuggcugcaacaacagcacuccucaacucacuugaauucacucgggcgaauuuccaacaagauauggagcguaacuacuugauggaaguaguuugugaagcuacacagucaacagauacacaaguccgugucgcagcacuucaaugucuagucaaaauaaugacucuuuacuaccaauauauggaaacauauaugggccaagcuuuguuuccaauuacauuagaagcaaugaaaucugacauuaaagaaguagcucuucaaggaauugaguucuggucuaaugucucugaugaagaaguugauuuagcuauugaagaaucggaagccguagaaaugggaaaaccuccagcuagaacaucacguuauuaugcaaaaggagcucuccaguaucuuguuccuguagugcucaccaaauugaccaaacaggaggaauuugaugaugaagaugauuggaauccaagcaaagcugcuggaguuugcuuaauguugcuagcuacaugcugugaggaagacauuguaccccaugu

SEQ ID NO: 5212 - RNA, 777 nt, Euschistus heros
aauucuaucgcaggauucccaaugaaauuucuguuccuaugucugucgaauucgaagaacuggcaaagcuuagagaaaacccuacugaagaaacuuccaauuuaguagaguuuacagaugaagaaggauauggaaaauaucuugaucuccaugaaugcuaugaaaaauauaucaauuugaaaggagucgagaaaggagauuacauuacauaucuuacuacguuugaccgacuuuaugaaauucccaaagauaggaagaguucugaguacaaaagauauguuauuaugcucuuaaauuaucugugcgauuacauugcuagaauuaaaccucugcuugaccuagaccaggaauuaaauaacguccacaaggauuucacaucacaaugggaagcaggcaccuuucccggcuggccaaaagaaacaggcagcguguuaagcaauguuggugcccaucuugacuuaucugcauuuucaucuccugaagaauuggcuucucuugguuuggacaggcuuaaaucagcauuaauggcucuaggauuaaaauguggcggaacuuuagaagaaagggcucagcguuuauucagcacaaaagggaaaaagucucuugauccaaauuuacuugccaaguccaagccagguaaaucaaaucgagaacgugaucuugaaaggcagcgggacauugcauucuuagaagcacaaguuuauaaguuagcugaauuauugagugaacaacgagcugcuacuaaagaaaauguucaaaggaaacaagcuaggacag

SEQ ID NO: 5213 - RNA, 486 nt, Euschistus heros
ugcaagauucgaggacauuuauuggcacauuuaaagcguuugauaagcacaugaaucucauucuuggagacugugaagaauucaggaaaauuaagccgaagaacacaaaacagccagagcgagaagaaaagagaguguuaggauuuguauuacuaagaggugaaaauauugucucccuuacaguugaaggcccuccuccaccagaagaaggauuaccuaggguaccccuucccggagcaggugguggaauugguacugcaagaccugcuggucgugggguuccagcaccugguacuccagcugccccaggucuucaagggccaguucgugguguagguggcccaucugcccaaguuaugacuccagcuggccgugggggccaaguuucugcaccuccucagaugcgggcaccuccuccaggaaugcccccaaugaugggagccccaccaaugaugaauauggcaccuggaauggcaauggguagag

SEQ ID NO: 5214 - RNA, 656 nt, Euschistus heros
uauucucggauguccaugugcaguuucgaugaauuacuggggcuuauaaaagaucaaauuacaaaaaaugacacuaggaugagaagcugcauaccaccugaagaaaagcucaucauaacauugagguaucuugcaagugguuguucuuuagcugaucugcgcaacaacuuucgcguaggaaaaaguacugcugguguuauuguaagagaaguaugcaacgcauuauggauaugucuucgcgaaaucaccaugccuccuuuaacuaaugauagauggcuugaaauugcuaaaggguuugaaacgugggcaggguucccuaauuguauuggcgccauugaugguaaacauauaagaaugaagcagccauguaacaguggaucaauguuuuacaacuucaaaaauuauuuuucuacuguucuauuugcgaugugugaugcaaauuauugcuucacauacauagagguuggaucguauggaaaauccagugauucaggaauauuuaagaauucguuacuuuacaaaaaaaugugugaugguaguuuacaaauaccugcuccacgcucauucgacaauaauucaagugagcaguuuucauaugucauagucggugacgaugcuuucccuuugucagauaauuugcuuaagccuuauggagg

SEQ ID NO: 5215 - RNA, 789 nt, Piezodorus guildinii
gaucaggauagcugaugcaagagcgaaaccuauugaucuucuugcuaaauacaucaauucugaagaagaaguggaugcuguugagaugcaugaaccauauacuuaucuuaaugguuuaucgauuaaagacuuggaagacuugguugaggauauuaagguauauaugaaacuagaaaaaggaaagaauuuggauuauuggaaugauauaacuguuauuguugaggaugaauuguauaagcugaggaaaauggggaaaaaaucugacuaugaagcagcuguugguaggagagaagguauucaugaaucuguagcuaaagaagucucuucagucuucagaggaaaaacagcuucacaacuugcggccaugcaaaagcagauugagaaaaagauaagugauaaaggagaagguauugauauuggauacugggagucucuucuuucccaacugaaagcucauauggcacgagcucgucucagagacaaacaucaagaaaaccuuaaacagaaauuggaacugcuuaaagcggaacaaagacagcaagaacaagaaauaaaagaagaacccauagaugaaucagaacaucaggagacuaugaguagagaagaaaucaaagaagaaagagaagauagugaugaagagcacaguggaggugaugaagaugcuggggagucuaugcuaaaagagaguuucggagaguaugaagcaggagcuuacuccccuguuuauguugaucccgcaagucuugaaccaggaacucuuaucauuggugaagaagaggaugcucagag

SEQ ID NO: 5216 - RNA, 685 nt, Piezodorus guildinii
acagaagguaaagcgauguuauuacaaaauccgcaguuggcuuaugcucuuuuacaagcacaaguugugaugaggauaguugauccccagauugcuaucacaaugcugcacaaggcuaacccgagcgugcccccucuccagccgccccccguggaagcuauucgcccagugccaguaccucagccugcuccggccguggcuccuccuccaguggugccaccugucguucaggcgaggccugucguggagccagaguggguuccuccugccaggccccaucaaccuccgcauccgccaacguucaucccacaaccagguggugaccuugauaugaggacuuuggacccgaggguuccuccggugcgacugacccaggaccaagacuuaaggaucccgccgauggugcccgccccacagcagccuccgacccagccgccucagcccuacccucaggaacacgugauauccaguaccguacgagauccaaggcaauaucgugauccucgcacaggugcagcaacugugccagugccuccacgaccuauugugacacaggcagugauaccaccgcgacccguagcuccuccgaccagucauaucacaucagcgcuuccuccugcagccucagaccaagagaaggcugccuuaaucaugcaagugcuacagcugucagaggaacagauag

SEQ ID NO: 5217 - RNA, 708 nt, Piezodorus guildinii
gucuugcggaacaaauuagggaacuucgugaggugaucgagcugccucuauugaauccagaacuuuuucaacguguugggaucacuccccccaaaggaugucuacuuuaugggccuccugguacuggaaagacuuuauuggcuagagcuguugccagccaauuagaugcuaauuuccugaagguuguuuccagugccauuguugacaaguauauuggugaaagugcucgucugaucagagaaauguuuaauuaugcaagggaucaucagccuugcauaauuuuuauggaugaaauugaugcuauugguggucgaagauucucagaagguacaucugcugaucgugaaauucaaagaacccuuauggaacuucuuaaccaaauggauggauuugauucauuaggacagguaaaaaugaucauggccacuaaucggcccgacacccuugacccagcucuccuccgucccgguagguuagacaggaagauugaaauaccacugccaaaugaacaggccaggcuagagauccucaagauccacgcuaguccuauuucgaagcauggagauauugauuacgaggcuguugugaaguugucugauaauuucaauggagcugauuugagaaauguuuguacugaagcuggucuuuuugcuauucgagcugaaagggaauauguaaugcaggaagauuuuaugaaagccgugagga

SEQ ID NO: 5218 - RNA, 633 nt, Piezodorus guildinii
uauggaagccaucagucaugcuggaaccugccucggcauccuagcuaaugauggaauuauucuuguagcugagaaaaggaauaccaauaaacuucuugaugaaucaguauauucugaaaaaauuuucaaauugaaugagaacaugauaugcaguuuagcugguauuacugcagaugccaauguucuuaccaaugaacuaagacuuauuucucaaagauauuuauugcaauauggagaaacuauuccuugugaacaauugguuucaugguugugugauaucaaacaagcauacacccaguauggagguaaaagaccauucggaguauccauauuauauauggguugggauaaacacuauggauaucaacuuuaccagucugauccuaguggaaauuacucagguuggaaggcaacauguauugggcauaacaguggggcagcuguuuccaguuugaagacugauuauaaagaaggugaaaugacagugaaagaugcuuuggcuuugggaaucaagguucuaaguaaaacauuagauacagcuaagcuuucaguugauagaguugaaguugcgacauugucucaaaagaauggaaaguguguuacaucuauccugccuccugaugaaguucaaga

SEQ ID NO: 5219 - RNA, 653 nt, Piezodorus guildinii
cauaacucuuuugcugccagugcucucagacucgaggucgacaccagaggugguugcuauggcagcguuggcaugugcucucauuacccuugguacaccucauccugauguaguaucgacgauacugcaaacccuccuugaucuuccuguggcugagaugacugauggccacuacuccaaguuuuugccacuugcccuugguuuauguuacuuaggucagcgagaaggcacugaagcuacaaaggcugcacuugaagcacuuccagagccuuugagaucuuugucgcaacauauguugaagaugugugucuaugcagggacuggggauguacuugucauccaggaacaacuacaagugugcucagaacauuacccuacuccagaagaaaagaaagaaaccgauaagaaggauaaggauaaagacaaagacaaagaugagucgaagagcaguaaagugaaagacaugacauguaugcaggcagucgccgcucugucuguggcagugauugcaaugggugaggagacgggaucugaaauggcaacuaggauauucgcgcaauugggaagguauggugaaccugcaguacggagagcuguacccuuggcuaucgcauuaucaucgauaucaaacccucaguuagcagugaucgaug

SEQ ID NO: 5220 - RNA, 754 nt, Piezodorus guildinii
acgggauacuacaccuacaaggaggaggaggacgucuacaucaaggcugacccuccgcugacgccaaagaacuucgcgcacuucgaccaccccgucaccucccauccgacgcagcucagugcacagguuacuuacguuacgggaggugguagcagagaguacgugacaaccaaccagccuggcuacugguccagugaguacgucuaccagcagccucagcaggaaauccagcuuccuccaggaacaccuuacgucuucuccagcaaugggcaggcaacaugggcuaucgacgagucguacgaccccaguaugcugucuacgagcgacaucaaggagugcgucaacugcgcggcgagcguuaccccgcuguggagaagggacgggaccgggcaccaccucugcaacgccugcggccucuacagcaggaucaacggcguccacaggccaccggugaggacgcaccacaagaaaguacacaauauugguaauagaagaaauggcgugagcugugcaaacugccaaacgaacaauacaacccuguggcguagaaauaacacaggagagccuguguguaaugccuguggacuguauuucaaacuucaugguguuaauaggccgcauaccaugaagaaggaagguauacaaaccagaaaacguaaaccaaagaacccacaaguaaaccuaccgaguccaaaaaacgauauaaagacaacaggugaaaaaucagggaguugggauaaaugcgacaacgauc

SEQ ID NO: 5221 - RNA, 710 nt, Piezodorus guildinii
uaaggacauucguugaagcagcugcuaauacaguugaaaggaaaagcagaaaagccgguagggauacagcuaggcaauccaagaggaaaaauacaaaaagacgagaggaaagaggacugagcccuacggggagugccuaugacgcagaugagagugauccugaggacuccccuggcuaucagcaaguuugcauucagcuuuuggaauugaugcauacacuucacacaaggacggcucagaucuuccgauggugggcugaagagacaggacagaaagaaguguccaaucccucuuacuggacuccagguuggugcccucuucuccaaggcauauccaggcuuuguucacacccuaauagagccguucggaugucggcaauaacuuauuugcaaagagcacuucucaugcaagauuugcaaucuuuaucuggggaagaaugggaagaauguuucacucaaguacuguucccacuccuguccacucuguuagcuguuaauauuccagcgaucgaagaaacaaggauaagggcagcuacuguacuuuccaagguguuccugcaucacuugucuccucugcaaacccuaucuaguuuugcacagcuguggcugaccauacuugauuauauggauaaguauaugcacgcggacaacagugaccugcuuuaugaggcuauuccggaaucauuaaagaaccuguuacuugugauggac

SEQ ID NO: 5222 - RNA, 485 nt, Piezodorus guildinii
ugucgcuauugcuucagauuugagguucgguauucaaggacagacuguuucaacuaauuuugaaaaaguuuuugaaauggguccucauuuauacauuggacuuccuggauuaacaacugauacguuuaccguucuuaacaaacuuaacuuuaggaaaaacauguuugaauugaaggaggauaggaagauagcuccagauguguuucuaucaauggucucaaaucuauuguaugaaaggagguuugggccauuuuuuguugaaccuauaauugcugguuugaaaccaaaaacuauggaacccuuuauagcuucaauggauuuacucgguugcccuaacaaaccagaagauuuuguuguggcaggaacagcuucagaacaacuuuauggaaugugugaagcucuuugggaaccgaaucuagguccugaagauuuauuugaaacuauaucucaagcucuuguuaaugcuugugacagagaugcacuuu

SEQ ID NO: 5223 - RNA, 742 nt, Piezodorus guildinii
guucuugcaaauaggauggcaucuuccaauuuacaugaagccgcugcagacuguguuugcucacuucucgaaugccuagaagauaacaacaaucaacagucgaucgaaaugcaacuguuuaauggugucaucucuuuagagcaaccguuucauauuuccguagcccacgaagagcaugagaaguguguaaauuacuguagaguauuuacagaacuugcugagaguuuucuggaaaaaauaguuagcggaaguaguccuacuaaagcgcauuucgccauuaagauuuuugaccuuguucuuacuuguguuggucaucaugauuaugaaguagcugcuauuacauuuaauuuaugguaucgccuuucagaagaacuguaucaaaagaaaaacucuggacuuacaucguuauuuaaaccauauauagaaaggcucauugaggcguuauguaggcauugucagauggaaccugaucacgaaggaauccucgaagaaggggaugacuuuccagacuucaggaugaaaguugccgaacugauucgugaugucguuuucauaaucgguuccuccaacugcuuuaggcaaauguuccuaucccuccaaggacccaauaccaccugggacaccacagaagccgcauuguucaucaugcaagccguagccaaaaacaucaucccggaagaaaacgauguuguuccaaagguuguugaagcuauuuugaaccuuccuccaaacacacacauag

SEQ ID NO: 5224 - RNA, 658 nt, Piezodorus guildinii
uaagauccuaccccagaaggugcgggaccugguaccggagucgcaagcuuacauggaccuucuggcguucgagaggaaacuggacucaaccauaaugaggaagaggcuugauauccaggaagcauuaaaacgucccaugaagcaaaaaaggaaauuacggauuuuuauuucuaauacauucuauccagcgaaagaggcaaccgagacugaggaaggaaguguagcauccugggagcugagagucgagggaagacuguuggaagauucuaaaaaugauccuaacaagccuccaccguuacagguaaagaggaaguuuuccucuuucuucaaaagucuuguuauugagcuagacaaagaacuuuaugggccagauaaucaccucguugaauggcacagaacuccuaccacacaagaaacagaugguuuucagguuaaaagaccaggugacaaaaaugugagguguacaauucuucucuuguuagauuaucagcccuuacaguucaagcuugauacccgacuugcucgccuucuaggaguucacacucaaacaagaccuguuaucauaagugcgcuuuggcaauauauuaagacucauaaacugcaagauccucacgaaagagaauauauaaauugugacaaauaccucgagcagacauuc

SEQ ID NO: 5225 - RNA, 286 nt, Piezodorus guildinii
cgaaccgacuuuagaagaguuggaacagaaaaugagagaagccgaaacugagccucaugaaggcaagaggaaaguggaauccuuguggccuauuuuuaaaauacaucaccaaaaaucucgguacauuuacgacuuguacuauagaaggaaagcuauaaguaaagaauuguacgagcauugccuuaaugagaacaucgcugauaaaaacuuaaucgccaaauggaaaaaacagggcuaugaaagucuuugcugcuuacgaugcauucaaaccagggauaccaacuuc

SEQ ID NO: 5226 - RNA, 733 nt, Piezodorus guildinii
aacuuagcguugcaauaggagaaccucugguugcgagcucagaugccaguugggcgaaucacauucuccuaggacacccugcuaugcccacagccacaggacacaguggggucaucccaaguaaugaagaaugcggcauucgcgauguaugggcucauaaucugaaggaugaauuuaaaguuaucaggaagaucauacauaaauacaauuauguugcgauggacaccgaauuuccuggagugguugcaaggccuaucggugaguuccgaaguacagccgacuaucaguaccagcuccugaggugcaauguggaccuccuccgcauuauccaauuggggcucaccuuccucgacgagaacggaaaggcucccgcagguccuuacagcaccuggcaguucaauuucaaauucaaucuugcagaagauauguacgcccaggacaguaucgaucuucuucagaauucagggauucaauucaagaaacaugaagaagacggaauagacccuguagacuuugcagaacuucucaugaccucaggaaucguacugauggagaauaucaagugguuauccuuucauaguggcuaugauuucggauaccuauugaaacugcuuacuaaucagaacuuacccaaugaugaaagugaauucuuugagcuucucaagaucuacuuuccaacuguuuaugauguuaaauaucugaugaagaguuguaaaaacuugaaaggagggcu

SEQ ID NO: 5227 - RNA, 659 nt, Piezodorus guildinii
ucaugaacguucagugucaugcauguauagggggcacaagcuugggagaagauauaaggaaacuugauuauggccaacauguuguaucugguacaccuggucguguuuuugauaugauaaagcggcgaacccuaaggacaagaucaaucaaaguuuuaguucuugaugaagcugaugagauguugaauaaagguuucaaagaacaaauuuacgauguuuaucgcuucuuaccuccagcuacucaggugguucuuauuucugccacauuaccucaugaaauucuugaaaugaccagcaaauuuaugacggacccuaucagaauuuuagucaaacgugaugaauugacauuggagggaauaaaacaauuuuucgucgcuguugaaagagaagaauggaaguucgauacucuuugugauuuauaugauacauugacuaucacucaagccguuauuuucugcaauacaagaaggaagguugauuggcuuacugaaaaaaugagggaugcaaauuucacuguuuguucaaugcauggugauaugccacagaaggaaagagaugcuauaaugaaggaauucagggcuggaaaaagccgagugcuuauaacaacagaugugugggcuagaggaauugauguacaacaagucucccuugucaucaac

SEQ ID NO: 5228 - RNA, 706 nt, Piezodorus guildinii
ucaguucugcauuucuccucccaaaacagauauggaucacaaugugguuaucucugacuaugcagcuauggacaggauacucaaagaggaacgagcguacauccucaauauugccaagcagaucaagaaggcaggguguacuauguugcugauccagaagucuauuuugagggaugccuuguccgauuuagccauucacuucuucgacaaguugaagaucaugguugucaaggauaucgaaagggaagauaucgauuucguuuguaagacucucggcugcagaccgaucgcaucucuugaccacuucaccagugaggccuuggucacugcugagcuagcggaagaaguaucagcaggaagcucccguaucgucaaagucaccggaauacacaaucccgcaaagacuguuaccauuuuaguucgaggauccaacaaucuuguucucgaagaggcugaucguuccauucacgaugcccuuugugucauccguugucucaucagggaaagggcacuucuucccggaggaggagcucccgagauugaacuuucccuucgccuagggcagcacgcucaggucuugggcucgguagaggccuacuguuugagggaauaugcuaaagcucuagaaaucguuccuuacacccuagccgagaaugcuggucuuaacccaguagcuaccgugacggaacugaggaauaagcacguu

SEQ ID NO: 5229 - RNA, 693 nt, Piezodorus guildinii
agcuuagcaccauacuaggacagaaucugucagaugacagcgauaguagugauuuauucaccaaguuuaagaaauuacaaaggcagcuugaauuuuuagcaguucaggaagaguacaucaaagaugaacagcguaaucugaagaaggaauauuuacacgcacaggaagaaguaaagcgaauccagaguguucccuuaguuaucggucaguucuuagaagcaguugaucaaaauacugggauuguagguagcacuacaggcucuaauuauuaugugaggaucuuaucuacgaucgauagagaacuauugaagccuucagcuagcgucgcccuucacaagcacagcaaugcucuuguugacguccucccgcccgaagcagauuccucuauuucgaugcuccaagcagacgaaaaaccagauguucaguauucggacaucgguggcauggacaugcagaagcaggagauucgugaggcuguggaauugccuuugacacauuucgaacucuaccgccagauugguaucgauccucccagaggagugcuuauguauggaccuccaggauguggcaagacuaugcuugcuaaagcuguugcucaucacacaacugcugcauucauucgaguaguuggcuccgaauucguucagaaauaccuuggagaaggaccgaggaugguucgugacguuuuuagac

SEQ ID NO: 5230 - RNA, 348 nt, Piezodorus guildinii
auugccaaauguucagugaccauaaaaacuauguuggaagauuuaggcauggaugaagaugaagaagaaguuguaccauugccaaauguuaauucugccauuuugaagaaaguaauccaaugggccacuuaccacaaagaugauccaccuccaccagaggaugaugaaaacaaggaaaagagaaccgaugacauuucuucuugggaugcugauuuucuuaaaguugaucagggaacucuuuuugaauugauacuugcugccaacuaucuugauaucaaaggucuacuugauguuacaugcaaaacuguggcuaacaugauuaaaggaaaaacuccugaagaaauucgu

SEQ ID NO: 5231 - RNA, 651 nt, Piezodorus guildinii
gcaguuccaugauuugauggaacuguuucgaauaggaggaagaucuccagacacuaauuacuuguucaugggugacuauguugauagaggauacuauucuguggaaacagugacauuacuaguugcuuugaagguaagauaucgagaaagaaucacaaucuuaagagguaaucacgaaucacgccaaaucacacaaguauaugguuucuaugacgaauguuuacguaaauauggaaaugcaaauguuuggaaguauuucacagauuuauuugacuauuuaccauuaacggcucuuguaaauggucaaauauuuugucuucaugguggucuuucaccguccauagacacucuugaucauauccgugcauuagaucgccuacaagaaguaccacaugaggguccuaugugugacuuacuuuggucagaucccgaugacagaggugguugggguauuucuccaagaggugcagguuacaccuucggucaagauauuucagaaacuuuuaaccacucaaauggccucacucuugugucaagagcucaucagcucguaauggaaggcuauaacuggugucaugaucguaauguuguaacaauauuuucugcaccuaauuacuguuaucguugugguaaucaagcagccauuaugga

SEQ ID NO: 5232 - RNA, 734 nt, Piezodorus guildinii
aagaaggaauuccaccagaccaacaaaggcuuauuuucgcuggaaaacagcuugaagauggcagaacuuugucugauuauaacauccagaaagaaucaacccuacauuuaguauugcgucugcgaggagguaugcagauuuuugucaaaaccuugacugguaaaaccaucacccuggaaguagagccuucagauacuauugagaauguuaaagcuaaaauucaggauaaagaagguauuccaccagaucagcaaagauugauuuuugcagguaaacaacuugaagauggucgcacccuuucugacuacaauauucaaaaagaaucaacucuucaccucguccuccguuuaagagguggaaugcaaauuuucguuaaaacuuuaacuggaaagaccaucacccuagaagucgaaccaucugacacaauagagaauguuaaggcuaaaauucaagauaaagaaggaauucccccagaucagcagcgauuaauuuuugcaggaaagcagcucgaagauggccguacucuuucagauuacaacauucagaaagaauccaccuugcauuuaguacuucgucugagaggagggaugcagauuuuugucaagacuuuaacagguaaaaccauuaccuuggaaguugagccuucagacacaauugaaaauguuaaagccaaaauucaagacaaagaaggaauuccgccagaccaacagagguugauuuuugcaggaaagcag

SEQ ID NO: 5233 - RNA, 755 nt, Piezodorus guildinii
ucggagaugguacuacaaguguuguccuuaucacuagcgaaauucugaaacaguugaaaccauauguggacgagggugugcauccuagaaucaugaugaaagcaguccgcaaggccacacaguuaugcuuagauaaaauuaacagcuuagcugucaagaucgagaagagcagcgcggagcagcaccgcucccugcuggagaggugcgcugccacggcccucagcuccaagcugauccaccagcagaaggaguucuucuccaagauggucguagacgcuguucucuuguuggacgagcuccuuccucuggaccucaucggaaucaagaagguuccugguggagcuuuagaggaauccuuguuggucucuggaguagccuuuaagaagaccuucuccuacgcaggcuuugaaaugcaacccaaaaaguacacaaauccuaaaauagcuauucucaacauugaauuagaauugaaagccgagagggacaacgcagaaaucaggcucgacaacguggaggaauaucaaaaagucguagauguugaauggcaaauuuuguaugaaaaauuagacacaauuguuaagucuggagcucagguuguucuuucaaaacuucccaucggcgauguagccacucaguauuuugcggacagagauauguucugugcugggcguguugcugaugaagacaucagaaggacucagaaagccugugguggcacgaugauuaccacaaccaaagauaugucugcuuccguc

SEQ ID NO: 5234 - RNA, 791 nt, Piezodorus guildinii
cccuguuauggucauuuggaggagaugcuaaacucaaaguucgcucagacuugggcgauuucauucguucuguuaccaccauaccguugccgccaaacaaucccaacauaccaaucauagauuaugagguaaauauaucuggggaauggagcccaugguccgccaaaguaccucaaaucgaaguggaaacucacaaaguugcagcgccagaugugguugugccuacgcuggacacgguucgccacgagucucuauuguauaccuggcuugcagagcauagaccuuuagugcuuugugguccuccuggaucagguaagacaaugacccuguuuucugcacuaagggcccuuccagauauggaaguggucggccuuaacuucagcucugcuacaacgccagagcuucuccugaagacuuucgaucauuauugugaauauaggaagacucccaaugggguugucuuggcgccaguucaguugggaaaaugguugguucuuuucugugaugaaaucaacuugcccgacauggacucuuacggaacccaacgagucaucuccuucuugagacaacuugucgaacagcggggauucuauaggucuucugaucucgcuuggguuucccuugagaggauccaguuugugggugcuuguaauccucccacagauccuggcaggaagcccuuaucacacagauuccugaggcaugugccggucauuuauguugauuauccgggcgaaacaucucucaaacagauuuacggaacauucucacgagcuaugcugaggcuuauu

SEQ ID NO: 5235 - RNA, 690 nt, Piezodorus guildinii
caugagagaacauugcacacagacauuuuauuuggguuaguuaaagauauugcaagauuuagaucagaucuuaaacuuuuaauauccagugcuacauuggaugcagaaaaauuuucaacauuuuuugaugaugcuccaauuuuuagaauuccaggaagaagguuuccaguugauauauauuauaccaaagcucccgaagcagacuauauugaugcuuguguggucucaauucuacagauacacgcaacucaaccuuuaggcgauauucuaguauuccuuacuggacaggaagaaauugaaaccugccaagaaauuuugcaagauagaguaaggcgucuuggaagcagaaucaaagaguuauuaauacuuccaguuuauucuaaucuaccaucugacaugcaggccaaaaucuuccaaccaacuccaccuaaugcaagaaagguuguuuuagccacaaauauugcugagaccucucucacuauagacaauauaauuuaugucauugauccugguuucuguaaacagaauaacuuuaacucgaggacugguauggaaucauugauaguugugccuguuucaaaggcuucagccaaucagcgugcaggaagagcuggacguguagcugcuggaaaaugcuuuaggcuuuauacagcaugggcguauaaacaugaacuggaagacaacacuguu

SEQ ID NO: 5236 - RNA, 715 nt, Piezodorus guildinii
cagaacuuacaccugucgaaacagaaaauccaaugggaggauauggcaaaacugugucccacguaauaauuggauugaaaacagcaaaagguacaaaacaguuaaaacuagacccaaguauucaugaaaguuuaacgaaggaaaaaguagaaguuggagauguuauauacaucgaggcaaacagcggugcugucaagaggcaaggaaggagugauaccuaugcaacugaauaugaucuugaggcagaagaauacguuccucuuccuaaaggugauguucauaaaaagaaagaaguuauucaagaugugacucuacaugaucuagauguagccaaugcuagaccacaaggagggcaagacguuuugucaauaaugggacaacuuaucaagucaaagaaaacagaaauuacugauaaauuaagagcugaaauuaauaaaguugucaacagguacauagaccaagguauugcugaacuagugccuggugugcuuuuuauugacgaaguucacaugcuugauauagaaaccuucacuuaccuucaccaggcucuugaaagugcaauagcaccuauuguagucuuugcuacaaaucggggucguugucaaguaagaggugcugcagacauuauuucaccacauggacuaccuuuagaucugcuggauagguugcucauaauucguacugcaccuuacagccaaccagaaaugugccaaau

SEQ ID NO: 5237 - RNA, 662 nt, Piezodorus guildinii
gugggccucugauucuaaaaacaguauuguuuuaacaucaagauguugugaagguacauuagcaagagauuuauuggauaacgguguuggaaggaccauccagaucacaguuaaaaaaagaguucgucuugaaggggaagaauuaaaggaauacuuaaaagcacauaaaaaaacaaaugacaaaaaugaagagaaggaaaguucugagucagaagaugaaauucaguugcuuagugucacuaaagguagccaugaucuuguaauuaagcaggaacguaggaaaaaaaaucaaaaguccuuaaagaaauuuuacccuauguuuccuuuuaucgaucguaaaguuaaauuugacgaauauggugaauuugugcggauagaagauuauaaagcuccugauacugcuaaacguccuccugaaaaaaagucuaaaaagaaggaugaugacauuguagauccugcugauauuccaacuaaauguguuucuuaugagaagucgcuaacagugaaugcccagguucaauauauagauuuugagggaagaucagacggagaaucgguacaaaagauaaucacgcaguugaggccgcgaagggugauacuuguccgugguacuucugaaaauacugaagcuuuagaaaagcaucuucaacaauggucugagg

SEQ ID NO: 5238 - RNA, 736 nt, Piezodorus guildinii
caugaacagggaacagagaaauuaucaauuugauuuccuucguccccagcauucucuguuucuguauuucaccaaacuacucgaacaauauacuaaggugcugauuccuccaaaagaccuuaugucccgccugaaggaagagugcuccaacccuaccggaguccuagagcaggugagguaccgugcggacuggcuucacuaccaggagcuucagaagaggaaggaggagcaagcccucgagaaggaaagaguggcuuacgcucagauagauuggcacgacuuuguuguugucgagaccguggacuauaucccgggcgaggugggcaacuuccccccgccuaccacaccagaugaagucggugccagggucuugaugcaggagcgaauauuagaaaauggaggugaagaucuggcggaaggagcuggcagcgaugaagagagggagaaggaagacggugaaagggaagaaggagccggugauaagggagauaacacucagguacaagacauggaagaagagucaucgagcgauagcgaugaagacgacgaacagagagagcagccgccaggagagaagcagcaggcgcagcccggucagaagcagcagccucccgacggcaagaagccuccccuccagccgucgaugcagcccccgcuaccucccgcaccggacaaggucaucgucaagaagggauacaaccccaagcagaaccaaaagauuucgaaaggugcagau

SEQ ID NO: 5239 - RNA, 768 nt, Piezodorus guildinii
auuagguuguuggaaggcaaaagguguuuuggacguaucuaauaguuuugcuguuccuuuugaugaagaugacaaggauaaaucaguuugguuuuuggaccaugauuauuuggaaaacauguauggaauguuuaagaaaguuaaugcaagggaaaagguuguuggcugguaucauacugguccaaagcuucaucagaaugauguugcaauuaaugaacuuauucgccgcuacugccccaauucaguucuuguuauaauugaugccaaaccaaaagaucucgguuuaccuacugaagccuauagagcaguagaagaaguacaugaugauggcucuccuaccacaaaaacauuugagcauguccccagcgaaauuggagccgaagaagcagaagaaguggguguugaacaucugcugagagauauuaaagacacaacuguaggcucacuuucgcaaaggguuacuaaucaauuucugggccucaaaggccuuaaucaacaaauucaagauaucagggauuaucuuaugcagguuguugauggaaaauuaccuaucaaccaucaaauaauauaccagcuacaggacauuuucaaccuucuuccugacaugaaccaugggaacuuuguggauucauuguacauaaaaacaaaugaucagaugcuugucguuuaccucgcugcccucguuagggcgauuguugcuuuacauaaucugauuaauaauaaacucaguaaccgugaugcugaaaaaaaggaaagcaccaagaaaga

SEQ ID NO: 5240 - RNA, 791 nt, Piezodorus guildinii
cacaagaugaagagguuggagaugguacuacaucagucgugauucuuuguggucaaauuauggcugaaauugaaagacauauagaugaaguucauccaacuacaaucauuaaagaauuuaaaagagcuuuggaugauauuuuaagaauacuuccagacauaagcacuucucuugaccuaaaggauaaagcuaaaguaauagaaguaguuagagguuguuuaggaaccaaauuuuuggguacuuggucugaaauggcuugucaaauggcaauugaugcaguagaaacugucagagaucugaagggucuuggaauugacuuaaagaacuuugcaaaaauagaaaagguuccuggugguuuuauugaggauucuaaaguauuggaagguguaaugcuuaacaaggaugugacgcaucccaaaaugucccguuacauuaaaaauccacgaauuuuauuacuagacuguucucuugaauauaagaaaggggaaagucagacuaauguggaaauaguuaaagaaggugauuauacuagacuuuuacaaauugaagaggaguacauugaaaaaaugugcaaucauauuauugagcauaagccaaauguugugauaacagaaaaggguguuucugacuuggcacaacaccaucuuuuuaaggcugguauaacugccauucguaggguuaagaagaccgauaauaacagaauugcucgagcgguagaugcaacuauugucagucguguagaagaaauaaagccccaucacauugguuguggugcuggucucuuugaagua

SEQ ID NO: 5241 - RNA, 635 nt, Piezodorus guildinii
gccuagaacuuauggugguuuaucagauuauagaagcguuccugcaccguccuuuagcccuuauucugaaaauggagggagugugguugcuguagcaggagaugacuucgcgauuauagccucugauacacguuuaaguacugguuuucaaauuuacaccaggaaccagucaaaauuauuuaaacugucugauaaaacaauucuuggaaguacuggauguuggugugauguucuuucucuuacuaggcuuguucaaacccgaauaaaaauguaucaguaugaucauaacaaaguuaugucuacuccagcaguugcccaaaugcuuuccguacuacuuuauuacaaacgcuuuuuuccuuacuaugucgccaauauucuugccggaauagaugauaauggcaaaggaguuguuuacaguuaugauccuauuggucaucaugaaagcucaaaauucagagcuggaggaacugcuggagcauuauuacagccucuguuggacaaucagcuugguauguugaaucaagaaaauguucaagacaaaacauacacuuuggagaaagcgcaugcaaucguaaaagaugucuuuauaucagcugcugaaagagauauauuuacuggugacagaauaucaauca

SEQ ID NO: 5242 - RNA, 744 nt, Piezodorus guildinii
ugggaaugaaagggaagauguugaacguggaggcaaaauuauuaugccuccuucagcacuugaucacuugacaagauuaaauauuaauuaucccaugcuuuuuaaacugcacaacucaaaaacaaauaggacuucucacagugguguguuagaauuuguugcagaugagggaaaaguuuauuuaccacauuggaugaugaggaauuugaugcuugaagaaggugauguuauugaaauugaaaguguuuccuuaccuguugcaacuuuuucaagguuccagccucagucuccagauuuuuuggauauaucgaauccaaaggccguucuagaaaacugccucagaaacuuugcuuguuugacuacuggugacauaaucaauauuaaauauaaucaaaaagacuaugagcuuucgguuuuagaaacgcaaccaggcacagcagugacaaucauagaaugugauaugaauguagaauuugcugcaccuuuaggauauaaagagccgaauucugaacaggaaucauuggaugaaucuucugaaagaucagaaaacuugacaaaugaaggaaguggauucaucccauuuuuuggugaagguuacaggcuagauggaaaacagaagaaaaauauugaagaugaaaauguuggauuuagaauaccagcugugagaggaaucccugauuaugacuggaaaguuggggugauuacuuuuaugagaaaugugcgccaaccugugaaggaaucuca

SEQ ID NO: 5243 - RNA, 707 nt, Piezodorus guildinii
gauggguuugaauuagcugcaagagcugccauacaacauuuagauucaauugccacaaaauuuccuguugauccuaacaauuuggaaccucuuauuaagacugcuaugacaacucuuggaucgaaaauuguuaauaaaugccauaggcaaauggcagaaauagcuguaaaagcaguauuaucaguggcugaucuggaaacacgggaugucaacuuugagcuaauuaaaguugacggaaaagucgguggaagacuggaagauucaaugcuuguuaaaggggugguuauugauaaagauuuuucucauccccaaaugcccaagguguugaaggauguuaaaauagcaauuuuaacuugcccauuugagccacccaagccaaaaacaaaacauaaguuggauguaacaucuauugaugacuauagggcauuaaggaaguacgaagaagagaaauuuaauaccaugguuucucaagucaaagaugcuggugcuacacuugcuauuugucaauggggauuugacgaugaagccaaccaucuucuuuugaagcgagaacuuccugcaguuagaugggucgguggaccagaaauugagcuaaucgccauugcaacugguggacguaucguaccucgauuugaagagcugaguccugaaaaacuuggucgagcuggacuuguuagagaaaucuccuuugguaccacaaaggacaa

SEQ ID NO: 5244 - RNA, 195 nt, Piezodorus guildinii
aguaguggaaaaggugaaaagaaaagauucgaaguuaaaaaauggaaugcuguugcccugugggcuugggacauaguuguugauaacugugcuauuugucgaaaccacauuauggauuuguguauugaaugccaagcgaaccaagcuucugcuacaagugaggagugcacaguggccuggggaguuuguaaucau

SEQ ID NO: 5245 - RNA, 786 nt, Piezodorus guildinii
cgacuucgguuacaguuuuggccgccgaacuucucagagaagcugaaagauugaucgagaggaaaauccacccucagacaauaaucagcggauaucgaaaggccacgaauguagcccuggcugcuuuagauaaaugugcugucgacaauagcagcaaugacaaagaguucgccgaugauuugcucaaaaucgcccguacuucguugaguuccaaaauuuugaauuugcacacugaaaaauucagcaaauuggcaguugaggcaguacuucgccucaaaggaucuggaaauuuaagugcgauacagaucaucaaaaaaacagguggcucauuagaugauucauuuuuggaugauggcuuccucuuggacaagaaagucggucaguuccaaccuaaaagaguugaaaaugcuagaauucucaucgcaaauacuccccuugacaccgauaaaaucaaaguuuucgguuccagaauacgcguugauucuuuagcuaaaguggccgauuuggagcuagcugaaaaagaaaaaaugaaggaaaaaauugaaagaauuauaagccacaaaugcaacguguuugucaaucgccaguugauuuauaauuaucccgaacaacuguuugcugaugcuggaaucauggcgauugagcaugcugauuucgaugguauugagcgucuagcccuugugacaggaggugagaucguuucuacauuugacacaccugagcuugucaaauuaggagaaugugauuuaauugaagaggucaugauuggugaagacaaauuguugc

SEQ ID NO: 5246 - RNA, 653 nt, Piezodorus guildinii
ccgauuacaccagguugaauaugcuauggaagcggugaagcuuggagcagcaaccguugguguaaagaauaagcaauaugcaguccuuguugcucuuaaaagagcuucaucagaacuuucagcucaucaaaagaaaauuauuccucuugauaaucauauaggcaugagcauuucuggccuaacugcugaugcucguauauugagucggcaaaugagaagugaaugccuuucauauucguauucauauggaacugaaauuccuauuaucaggcucaugaacaaaauaucuaauaugaugcagaguucaacucagcgauaugauagaaggccuuauggaguuggucuccugguggcaggauaugaugcugaugguccucauauuuuucaaauuuguccuucugcaaaucuuuaugaaugucguucaauggcuauuggcgcuagaucccagagugcgaggacauauuuggaaaaacaucugguagacaucgguaacucuccgacgcucacagaccuucuuaaacaugcacuucgugcucuuagagauucgucacccaaugauacagaacuuaguucuaagaacguagccaucgcaguuguggggaaagauacgccgcugaaggagcugucagaggcagauacucagacguaccugg

SEQ ID NO: 5247 - RNA, 800 nt, Piezodorus guildinii
gaaaauugccacaccucaaauuauuaucaacuaugggcuuuuucuagaagaacacaauuauuuugaagaagcuuuuaggacuuaugagaaaggaauugcuuuguucaaauggccuaaugucuuugacguauggaauacauauuuaaccaaauuuuuaaagcgcuaugggggaaguaaacuugaaagaacgagagaucuauuugaacaauguuuggaaaauuguccuccaaaguaugcuaaagguuucuaccuauuauaugcaaaauuagaggaagaacauggauuagcuaggcaugcaauggcaguguaugaaagggcuacuucugcuguuuuaccugaagaaauguuugagguuuucaauauuuauaucaaaaaggcugcugaaauuuaugguguuccgaaaacucgucaaauuuaugaaaaagcuauugaaguguugggugaagauaauucaagagaaaugugucuuagguuugcugagauggaaacuaaauuaggagaaauugaucgagccagggcaauuuaugcgcauuguagucaaaugugugauccacggguuacuaguacuuucuggcaaacauggaaagauuuugaagugcgccauggcaaugaggauacuaugagagaaaugcugcgaaucaaaagaagcguacaagcuacauacaacacacaggucaauaugaugucagcacaaauguuaucugcugccaguaauguuucuggaacaguugcugaucuugcuccuggugcuaaagauggaaugcgcauguuggaagcuaaagcagcagaaaugacuguua

SEQ ID NO: 5248 - RNA, 683 nt, Piezodorus guildinii
ugaaacucuuaugugggagcuauucguucaagccggaccaguugucaauguucauaugccgaaagauagagugacacaacaacaucaaggauauggguuugucgaguuuuugggagaagaagaugcugauuaugccauaaaaauuaugaacaugauaaaaguucauggaaaaccuauucgugugaauaaggcuucagcacaucagaaaaauuuggauguuggugcuaauguguucauugguaaucuggauccugagguugaugaaaaguuauuauaugacacauuuucagcuuuuggggucauucugcagacgccuaagauuaugagggauccagauacaggaaauucaaaaggcuuugcauucaucaauuaugccucauuugaugcuuccgaugcugccauugaugcaaugaauggucaguuucugugcaaucgcccaguuucaguuucuuaugcuuacaaaaaagaugccaaaggugaacgacauggaucggcugcugaacgccuguuagcugcacaaaaucccuuaucacaagcugacaggccccaucauauguuugcggaugcuccuccugcaccccugccacccccuccaguauugccuccuccuccugucuucaauccuccacccccuccucauaugccuccuccuccauugccaccacaaaggaugguagcuccua

SEQ ID NO: 5249 - RNA, 640 nt, Piezodorus guildinii
gccccuaaauugaggucuuuggauuucgcugaaaggcaugguuacaucaaaggaguugugaaagauauuauccaugacccugguagaggagcuccauuagcuguuguucacuuuagggauccuuacagguucaagacucgcaaagagcuuuucauugccccugaaggaauuuauacaggucaauuccuguacuguggaaagaaagccaacuuacauguuggaaauguuaugcccguugguacuaugccugaagguaccaucaucuguaauuuggaagaaaaaaccggagauaggggucgucuagccagagcuucaggaaauuacgcuaucguaauugcucacaauccugacuccaggaggaccagggucaagcuuccaucaggagcaaagaaagucauucccuccaacaacagggcuaugguugguauugucgcuggagguggucguaucgacaagccagugcugaaggccggucgugcguacuacaaguacaaggccaagaggaacugcuggccuaagguuagggguguugccaugaacccaguagagcauccccacgguggugguaaucaccagcacauugguaaagcuuccacugucaagaggggaacuucugccgguagaaagguuggucucaucg

SEQ ID NO: 5250 - RNA, 261 nt, Piezodorus guildinii
gagguguaaagaagccucacagguacaggccuggaacagucgcucucagagaaaucaggagguaccagaaaaguaccgagcugcucaucaggaaacucccguuccagagguuggugagggagaucgcccaggacuucaagaccgaccugagguuccagagcucagccgucauggcccuccaggaggccagcgaagccuaucucguaggucucuucgaggauaccaacuugugcgcaauccacgccaagagggucaccauca

SEQ ID NO: 5251 - RNA, 746 nt, Piezodorus guildinii
auaaugacaaugcaaagccgacuugaaucugaaacucggcuaguuaggggacucguccuugaucauggaucacgucauccuaauaugccuaagaagcuaacuaaugcuuauauuuugacauguaauguuaguuuagaauuugaaaaaacagagauuaauaguggguuuuucuauaaaucagccgaggaaagggaaaaacugguggcaucugaaagagaguuuaucgaguugaggguuaagaaaauuauugcuuugaagaagucuguaugugauggaacagacaaaggauuuguugucaucaaucagaaaggaauugaucccgucucuuuggauaugcuagcccgagaagguaucauggcacuuaggcgagcuaaaagaaggaauauggaaagacucacuuuagcuugugguggaguagcuaugaauagucuugaugaucucacagaagauugucuagggcgagcaggucuuguuuaugaacauguucuuggugaaaccaaguauacauuuguaucugauuguccaaacccucauagugucacuguacuaguccaugggccaacuucuuaugccauuacucaaauccaagaugcucuucgggauggucugagagcugucaaaaaugcaguugaagauggagguauacuuccugguggaggagcaguagaauuaaaauuacgucaugaauugaaaaaaguugcugagaacacaaaggaaaaguaccguguuggaaucgaagcuuucug

SEQ ID NO: 5252 - RNA, 792 nt, Piezodorus guildinii
aacaggcucuuaucgaugacagaccgaaaucuauugaagauugcaucgcuugggcuagaaaccacuggcaagaacaguauucaaaucagauccgccagcuucuuuucaauuucccacccgaucagaugacuacgaauggccaaccuuucuggucuggccccaagaggugcccaguuccacuugaguuugaugugaauaacgaccugcauuuggauuauauuuuagcugcugcuaaccugaaggcugaagucuauggaaucccucagguucgugauagaaacuucauugcuaaagugguccagaacguagagguuccugaauucacucccaagucuggugugaaaaucgcuguaacugauucacagauggcuaauggugcuggugggcagguugaucaagauagaauugggcaguugcagaaugaacuuccaucgaaggagauguucaacggcuugaauaucacaccucucgaauuugaaaaggaugacgauaacaaccuccauauggacuucaucguugcugcauccaaucugagagcugcuaauuacaacauaccaccugcagacaggcauaagaguaaguugauagcugguaagauuauacccgcgauagcaaccacaacaucuguuguugcugguuugguauguauugagcucaugaaguuagcuaaggguuacaaagauauagcuuuguucaagaauggcuuugucaacuuggcucuuccauucuuuggauucuccgagccgauuucagccccuaaauugaaguauuaugagaacgaauggacauugu

SEQ ID NO: 5253 - RNA, 713 nt, Piezodorus guildinii
ugaaguacaacaugagugcauuccucaagcaguucuugguauggauauacuuugucaagccaaguccggaauggguaaaacugcuguguuuguauuagccacccuucaacaaauggaguugacugaaaaccaaguaacaguuuuggucaugugccauacccgagaauuggcauuucaaauaagcaaagaauaugagcgauucucaaaauauaugccaaacaucaagguugcuguauuuuuuggugguuuaccuauacagaaggaugaagaaguuuuaaaaaauaacuguccucacauuguaguugguacaccaggacguauuuuagcuuuagugaaaaauaaaaaacuaaauuugaaaaaccuuaaacauuuuguauuagaugagugugacaaaaugcucgagcaguuagacaugaggcgugauguucaggaaauuuuuaggaauacuccucacaguaagcaaguuaugauguucagugcaacucuuaguaaagacauaagaccaguuuguaagaaauuuaugcaagaucccauggaaguauauguugaugaugaagcuaagcucacccugcacgggcuucaacagcauuauguuaagcuaaaagaaaaugaaaaaaauaaaaaauuauuugaucuacucgacaucuuagaguuuaaucagguuguaauauucgugaaaucaguucaaagauguauggcuuuggcacaacuau

SEQ ID NO: 5254 - RNA, 722 nt, Piezodorus guildinii
ugaacucacuaaccaguuggaaaaaaucagaggauuucugcaugcuaggcuccgaacugccacucuuagaaaugauuuugaaggucaagcaguucuaauuaauugucucuugagaaauuacuuacauuauaaguuguaugaccaagcagacaaguuaguauccaaaucaguauacccagaaucagcaaguaauaaugaaugggcuagauuucuuuauuauuuaggaagaauuaaagcagcucguuuagaauauuccgaaucacacaaacaucuaguucaagcuuugagaaaagcuccucagcaugcugcuguuggauuuagacaaacaguucaaaagcuugcugucacuguugacuuacuucuuggugacauuccggacagacagaucuuucgacaagcaccacuucgucguucucucgcaccuuaucuucaguuaacacaagcuguuagaacuggcgauuugcaaagauuuggugagguuuuggaaauguuugggccccaguuucguucugaccauacauuuaccuuaauucuucguuuaaggcauaauguuauaaaaacugcuauaagauguauugguuuaucuuauucgcguaucacuccuaccaacauagcuucaaagcucggauuagauucacccgaggaugcagaauuuauuguugcuaaagcaauuagggauggugucaucgaagcaaccuuagauccugagcaugguuauaugc

SEQ ID NO: 5255 - RNA, 753 nt, Piezodorus guildinii
cuuaugcuggaucugcagaugcugauguggacuaugcuggagaaaacuuugugcgcuucacuggugauacauuagagcaugcgaaagugcaauuguuugcaugggaagcgcauaauaaagguguugauguccauccucuuggagaacccaccaggcuggaaguucucaagaaggaauucgucggaauaaaagaagaguucaaacaaaagggacaagaagaccucauuaaaaaguaugguggagaagaacaccugaaagcuccuccuaaagaacuuuuauuagcacagacagaauauuacgcugaguauacucguuacggcacagucaucaagggccaagaaaaagaaguugugagaucaagguaugaggaagacguguuuauuaauaaccauacgacuguauggggaucguuuuggcauucuggaaaguggggauauaaaugcugucauucuuuuauuaagggaucuuauugcaccggggaggcugguagacuggcaacggcuggagagguggcugucaaaggcccagcuuuuauuccaccgcgucccgcuacaccaacugccucauccuccucgucuucaucuucugauucuucaucgucgucaucuucaucaucugaggaugaagaagagaaggagaggaagaagaagaagcaggaaaagaagaaagcaaagaagaagaagcaaaagguaaagaaacucaagaacaagaacaaaaaaccugaagaaaagacagaagaagaacagcugaagg

SEQ ID NO: 5256 - RNA, 519 nt, Piezodorus guildinii
ccaucaggaagaagaggaaguaugaguuaggaagaccagcagccaacacaaaguugggcccuaaaagaguucauuuaguuagaacucgagguggaaauaccaaguucagggcuuugagguuggacuacgguaacuuuucaugggguucugaauguuguaccaggaaaacucgucuaauugauguagucuauaaugcaucaaacaacgagcuuguacguaccaaaacucuugugaaaaaugccauaguugucaucgacgcaaccccuuucagacaaugguaugaagcccacuacgcucugccauuaggaagaaagaagaaugcuaaauugucugaagcugaggaagcuguccuauauaagaagaggucuaggaaaacugaaaacagguauaaggcgaggcagaaacuggccaaaguugaaccugccuuagaagaacaauuccagacuggucguuugcuugcaugccucgccagccgaccugggcaauguggacgagcugaugguuacauccucgagggua

SEQ ID NO: 5257 - RNA, 734 nt, Piezodorus guildinii
caucagaugcuccuguuguagacacagcagagcaagucuacauuucuucucuagcccuucuuaagauguuaaaacauggaagagcuggugucccuauggaaguuaugggucuuauguugggagaauuuguugaugauuauacagugagaguaauugauguguuugcuaugccacagaccggaacaggugugagugucgaagcuguagacccuguuuuccaagcaaaaauguuagacauguuaaaacaaacuggucgaccagaaaugguuguuggaugguaucacucacauccaggauuugguuguugguuaucagguguugauauuaacacucaacaaagcuuugaagcucuuucagaaagagccguagcuguuguaguugauccaauccagagugucaaaggaaaaguugucauugaugcuuuuagauuaauuaaucccaauaugaugguucuugggcaagaaccacgacaaacuaccucuaauuuggggcaucugcaaaaaccuucugugcaggcauuaauccacgguuuaaaucgccauuacuauuccaucagcauuaacuacaggaaaaaugaguuggagcaaaaaauguuguuaaauuuacacaaaaagucuuggauggauggauugaugcucucugauuauucagaaaauugcaaaguuaaugaaacuacaguuggcgacaugcuugaauuagcuaagaauuauaacaaggcauuggaagaagaagag

SEQ ID NO: 5258 - RNA, 758 nt, Piezodorus guildinii
gcgaaguagugaaaccaauggacaagaagaaaguucuugucaaagugcauccagaaggaaaguuuguuguugauauugauaaaaauauugauauuaaugauguuacuccuaacucccggguggcuuugcgaaaugagaguuauacucuacauaagauccugccuaauaagguugauccccuggugucauugaugaugguugaaaaaguuccagauucuacuuaugaaaugguuggaggucuugacaagcaaauuaaggaaaucaaagaaguaauugaacugccuguaaaacauccagaacuguuugaugcauuagguauagcacaaccuaaaggaguguuacuauacggaccuccuggaacaggcaaaacacuucuggcaagagcggucgcucaucacaccgaauguacauucauucgugugucugguucugagcugguacagaaauucaucggugaaggaucaagaaugguuagagaauuauucgucauggcaagggagcaugcuccguccauaauauuuauggaugaaauugauucaauugguuccucacguauugagucugguagugguggagauucugaaguacagagaacuauguuagaauuauugaaccaauuggaugguuuugaagcuacaaagaauauuaaggugaucauggcgacaaauaggaucgauauucuagacccugcucuccuucgcccuggaaggauugaucguaaaauugaguucccaccaccaaaugaggaggcucgauua

SEQ ID NO: 5259 - RNA, 461 nt, Piezodorus guildinii
auuuucaaagaggaacugcccaagacaccauggcuuuugcuaguaaaacaauaguugaaaggacucagucugcaaccagacagucugucaaagaaggagauuauauaugccauguguauguaagagcugacaauuuagcagggguugugauaucaaaccaugaauacccucaucgaguagcucauacacuaauaaccaaaguauuggaugaauuuagcgcuaaauauccaccuucaacuugggcaucugcaaaugaauccaauauugauuuuccugcauuggcagcucaccuucaaaaguuucaaaauccuaaagaagcugaugcucuuaugaaaauucaaagugagcuugaugaaacuaaaaucauucuucauaacaccauuggagccguuuuagagcguggagagaaauuagaugaucuuaucaugaaaucugaaagucuuagcuaucaguccaaagca

SEQ ID NO: 5260 - RNA, 623 nt, Piezodorus guildinii
gagggaagguuguuucaaguggaauaugcuauagaagcuaucaagcuagguuccacagcaauagguguuugcaccccagaaggaguuguuaugggagcugaaaagagaauaaaguccccuuugauggaaccagaagcuguggagaagauucuccaagucgaugaucauauugguugcgcuguaagugguuugauggcugauuccagaaccuuaguagagcaugcucgaguccagugccuuaaucauugguuuguuuaugaugagaagaugccgauagagucugcugcucaggccgucucuaacuuggcaauaagauuuggugaugcugaugaagaugcuggcccagcgaugaguaggccuuuugguguggcugucauguucggaggauaugauuacagaggaccucagcucuaucauauggacccaucaggaacauuuaucuauuucgaugcuaaggcaauagguuccgguagcgaaggagcgcaacagagacuucaagaauuguaucauaaaggaaugagccucaaagaggccaugcagaugaucuugacaauuuuaaaagaaguaauggaagaaaaauugacugacaauaaugucgaaauagcuguaguaacugcagaaga

SEQ ID NO: 5261 - RNA, 758 nt, Piezodorus guildinii
gaucaggucacucacaaaguagcucaguaucuuggagaaguuuuggaggaccagaaagauaaacuucaggaaaacuugauggcuaauaauacggauuuaucuacguauauuacaaaauuccagugggauauggcuaaauauccuauuaagcaaucucuucguaacauugcugauaucauaagcaagcaaguuaaucagauugaugcugacuugaagacaaaaucuacugcuuacaauaaucucaaaagcagccuccaaaauauggaaaagaagcaaagugcuaguuuguugacccggaacuuagcugaccuuguuaaaaaagaacauuuuauuuuagacucugaauauuugacgacauuacuaguugugguuccgaagucaaacuucaaugauuggaauuccagcuaugaaaaacuuacuaauaugauuguuccacguucaagucagcuuguuuaucaggauucugauuuugguuuguucacagucucguuauuuaagaaagugguaaaugauuucaaauuaauggcuagggaaaaaaaauuuguuguucgugacuuuaucuauaaugaagaggaauuagcugcaggaaaaaaugaaauuacaaaauuaguuacugacaaaaagaaacaauuuggcccucuuguacguuggcugaagguuaauuucagugaauguuuuugugcuuggauucauguaaaagcauugagaguuuuuguugaaucaguuuugagauaugguuuaccaguuaacuuccaggc

SEQ ID NO: 5262 - RNA, 679 nt, Piezodorus guildinii
aacauuuugaaagcccaugggggaucagcuaaagaaaguauauuggucaauggauaugcccucaacugcacagucgcaucaaugggaaugacaaagcgaguagaaaaugcuaaaauugccugccuugauuucucuuuacaaaagacgaaaaugaaauuagguguugaaguucugguagaagauccuaaucaguuggaagcaaucagagauagagaggcugacauaacaaaagacaggauucagaaaauucuuaguguuggcaccaauguaguacuuuugagcggaggcauugaugacauuuacaugaaauauuucgucgaagcaaacgcgauggugguaaggagaguuaaaaaaucagacuugaaacguauugcuaaagcaacuggugccucuuuugcaacaucucuaacuaauauggaaggugaagaagcauuugaugcuaguuuauuaggcgaggcugccgagguaucccaagaaaggauaugugaugaugaacuuauccuuguuaaagguccaaaagcacacucugcugccuccauaauccuucguggaccaaacgauuauuucugugaugaaauggagagaucuauucacgacucgcugugugcaguaaaacguguucuugaaaguaaaaccguuguagcagguggcggagccguugaagcugcucuuucaaucu

SEQ ID NO: 5263 - RNA, 643 nt, Piezodorus guildinii
ugguaacacacucgaugauaaucaaguuaaaauuauuaaagcuccggauuuuuuaaccaggacuuuauaucccaugacaacuacagcaucuguaguuggaaucaaauuuaauaaugguguagcuaucgcugcagaugucgguggauauuauggaucauugaaucguuucaagucucuugauaggcuguacaaaguuaauaacaauauuguaaugacaaccacuggagauuaugcugauuuucaauacaucagagaauuaauacaacaaaaaguuaucagugaggaaauccuggaugacaguuucucuuuaaaagccuuuucucuucauacuuggcucacucgccugauguacaacagaaggucgaaguuugaucccuuauggaacaauguuauuguugcuggauuugauagcaacggacccuucuugggaaucguggauaaacuaggaaugaguuaugaagauagcuguguugcaacugguauggguggguaucuugccacuccacuuuugagggaugucuaugaacgaggcaaaggaaauuugacuaaacaagaagcccaugccgcccuucagaaaugcauggaaauuuuguacuacagggauacucaaucgcuucccaaguuucaaauugcaacagucacc

SEQ ID NO: 5264 - RNA, 742 nt, Piezodorus guildinii
auugcggcuuuaucgucuauuucggaggucauagaaucuugcccggaucuucuugauacuccaggcagagaaauuuugcacgaaggugaccuuguggaacuggacccucuggagaacacagcucuucaucgaacucgggcuuuacuguuuucugauauguuuaugauugcgacuuggaugucugaaaggaaaggacaagcaaaguauaaguuugaaagcaguuacgaucuggguagcauggcuguuguaaaugugagggaucuuggacaaguuaaacaugcuuuuaaacuuuuaguuuuuccugauaccagacuuuuucaaugcguaaauaaugaagccagggaagaauggcugaaaaaguuugaugaagcuaagaaagcacgauugaauucagagcagaccaaaaaaaaaggugaaaaugacaaagaaucuuauacgauucgugagcaaucgacuaaacccccugagagaacugauucuguugaauucggaucuaauccauuuggguuugugcuugaugaugaugcagacagcgaugcucuuccagaaugguugaccgaagcagcggaugauuuugauguuuccauagcucagaggcauuuugaagaagccuaugcaaucauucagaaaacugaggaguauuuugcaucugcgcaagacgaucaagggcuggcugauauaaaauccaaauuggaaaauaggaaagauguauugaucuguguccuccuaucugaguugaacg

SEQ ID NO: 5265 - RNA, 705 nt, Piezodorus guildinii
ggaaucggacuaacgaaucaggaccucccggaauggaaaaagcacguuauuggcgguaagaagaguucauuugguaugaagacgaacaugacacucuuggaacagaggcaaagucuuccuauuuauaaacugaaggaacagcugauuaaggcuguuaccgaaaaucaaauuuugaucgucauuggugaaacaggaucaggaaagaccacccagaugacucaguauuuggcagaagcugguuucacaucgagaggaaaaauugguuguacgcaaccgaggagaguugcggcgaugucaguggcuaagagaguggccgaggaguucgguugucguuuaggucaagaggucggcuacacgauucguuucgaagauuguaccagcccggaaacagucaucaaguacaugacagacgguauguuacuccgagaaugccuuguggacuuggaucugaagagcuauucgguuauaauguuggacgaagcgcacgaaaggacaauacauacugauguacucuuuggacuuuugaaacaagcuguucagaaaaggucagaacuaaaguuaaucgucacaucggcuaccuuagaugcugugaaguucucgcaguauuucuucgaagcuccuauuuucaccauuccuggacguacguucccugucgaaguacucuauacaaaggaaccagagacggauuacuuagacgcaucgcuu

SEQ ID NO: 5266 - RNA, 685 nt, Piezodorus guildinii
ggaguugcaaaugguuuugaaauuuuugaauugucuuaugauggaacccguuuuucugcugaagaaguuauucgucaugaaacugggucuaaaguggugaugaauucugcuuguuacagugacaagaaaaguacguuuuuaguugcuggacaagaaagucacugucaguuauacagaguuggaauuacuguugagaaggagguuucugaagaaccaaugaauggcauucuggaaccuccuaaucuaaggcaccgaaaaccuuccagaaaucaccaaaaugguauaagugaagugaagaauauugucaaaaagaaauuaguuuuuaaauucaacucuggugauagcauacaaucugacuuuagugaaaacgaaccaugccaaaggguaguuacaauaucucguugugguggcuggauggcaacugguggaacugauggaaucguaagaaucuggucauucccuagccuucgauugauuagagcucuuaaggcccacacgaaagaacuagaugauuuacauuuuagcccugauucaaagcagauagccaguguggcaaaagauggacaagcaauuauuugggagcugaagucaggaaaacagguucauaaacuugauuggacucauccugcaggaaucaaauaucucuucaaaagaugucgcuuuggcauuguugaaggcaaagguu

SEQ ID NO: 5267 - RNA, 654 nt, Piezodorus guildinii
gaucuugaagcugggauaggaauagaaguucaacuuuguaaagaguguauagaaugggcaaaagaugaacacaggacuuuccucaggcagucacuggaagccaggcuuauugcucuauauuucgacacuggaauguucacagaagcacuccagcucggcucaagucuccuuaaggaauugaagaaguuagaugauaaaaauuugcuuguugaaguucuuuuguuggaauccaaaacuuaucaugcuuugaguaaucuuucuaaagcccgggcugcucugacaucggccaggacaacugcuaauucaauuuauuguccaccuaaaaugcaagcagcccucgauuugcagucugguauauuacacgcagcugacgaacaggauuucaaaacagcuuacucauacuuuuaugaagcauuugaagguuaugauaguguugacagcccgaaggcuuugguagcucuuaaguacaugcuuuugaguaaaaucauguugaauacgccagaagaugugcagcaacuaguuaguggaaaacuugcucuuaaacacgcugguaaagauaucgaugcaaugaaaucaguugcucaagcuagccauaagagaucccuugccgauuuucagauaacuuuaaagaauuacaagaaagagcuggaagag

SEQ ID NO: 5268 - RNA, 708 nt, Piezodorus guildinii
aggagaaaggaagaagcuugcagaugaaaacaaggcuuuggaaaaugaaagaaauaaacuugcaguccagcuaucagauacacgaaaacauuuggaggaagaaacucuccagagaguagaucuagaaaaugcugugcaaacauuacgugaagauuuuucauuuaaagaacagcuacaugaacagcaguuauuggaaacucguacuaaaaagcaaguggaaauuagugaacuugaugguagauuaagccaagaguaugaagaaagauuauaccagagucuucaagaaauacgcgaucaauaugaaugcgauuuagaaaauaacaaggaagaaauuaaaaaacuguacgaggaaaaaauucgaagucuuggaagucaauugacacgaaacagcaaugcugcugcaauggcuauugaagaaaugaaaaacaugcaagcuaaacucaaugagcuuaauagaaaauuacuagacuuggaagcagacaggaaugcagcccagcaaaaggcuagagaucuggaaaagauuuuggaacaggcuaaagcucaauauauggaagaauauagucagagggaagcugaaaucacuacucuucgugaagagauggcucaucaaguucaagaauaucaagauuuaauggacaucaaaguugcauuagauuuagaaauagcugccuaccgaaaguugcuugagggagaagaagccagguuaaa

SEQ ID NO: 5269 - RNA, 787 nt, Piezodorus guildinii
aacuggacguuuagagguucuucgaauucauacaaaaaauaugaaacuagcugaugaugucaauuuagaacagauugcugcugaaacacauggucauguuggagcagauuuggcaucucucuguucagaagcagcacuucagcagauccgugaaaaaauggaucuaauugauuuagaagaagagcaaauugaugcagaaguucuaaacuccuuggcuguuacuauggauaacuuccgguaugcuaugggcaaaaguagcccaagugcccuucgugaaacugugguugaaguuccaaauauuacuugggaugauauugguggucuggauaauguuaaaaaggaauugcaagaauugguucaguacccuguugaacauccagaaaaauucuugaaauuuggaaugcaaccuucccgugguguuuuauuuuauggaccaccagguugugguaagacauuguuagcuaaagcuauugcuaaugaaugucaggcaaacuucauuucagucaaggggccagaauuauuaacuaugugguuuggagaaucagaagcuaauguucgugauauuuuugauaaggcuagagcugcugcaccauguguucuauuuuuugaugaacuggauuccauugcuaaaucaagagguggaaguguuggagaugcuggaggugcagcugauagaguuaucaaccaaauccuuacugaaauggauggaaugggagccaagaaaaauguuuuuauaauuggggcuacuaauagaccagacauaauugauccugcuauucugagaccu

SEQ ID NO: 5270 - RNA, 651 nt, Piezodorus guildinii
uugucuucaguugaccaaccuuuaaaaauugccauugauaaagggguugguaaggauuauuuauuaugugacuacaaucgggauggugauucauacagaucaccuuggagcaauacuuaugauccaccucuggaggaugguucaaugcccucugaaaggcuaagaaaacuagaaguagaagcaaacgcugccuucgaccaguauagagaaauguauuuugaaggaggugugucaucuguuuacuugugggauuuggauaugacugguuuugcaggugcuauuuuaauaaaaaaggcuggggaugguucaaaaaaaauuaaagguuguugggauucaauacacgugguugaaguucaagaaaaaacaacuggacgaaaugcucauuauaaauuaacuucaacuguuaugcuuugguugcaaacaaauaaaacagguucaggaacgaugaacuugggagguaguuuaacuagacagauggagcaagaugcagcuguaucagaugcuucuccacacauugcuaauauuggccgaaugguugaagauauggaaaacaaaauuaggaacauccugaaugauauuuauuuuggaaaaacuaaagacauagucaauggguugcgaaguacacaagcuuuaucagaacagaaagcccag

SEQ ID NO: 5271 - RNA, 709 nt, Piezodorus guildinii
accauuagcaagcaccaauaagccuacuguaccuccugucucuucaguugcucagccugaacccgugaaaccuguggugguggcaucucauauccucccuccccaaccugcaaggccgaccgcuacagcagccccgcugacuaccgcaaagagggcaucgaucccuacaccaggcacaaccuuagguauaccaccuaccgcuccgaccgcccuugagacagguccuauugagaucaaacaagaauuggacguuccugugucauuagcuccugugccugaccauuuggauuucaaaaaccuuuuggaagugaagccugagcugaaugauaucguaacagggaugccuucuguuuuugauccauugccugacucaccucccaucauuaaggaagaaaaacuucccauauuaccucaucacacugauggacacuugaauaacucucuuccccccgugaguaacgugccuggcccgccaguuauaccuagugcugcacuuccuacaacaccucacaucuuagauaugaacaaaaauucucagccuccccagcuuccucagacgccaguuaugcaacacaacuucaagccuaagaguguugaacaaaaccugaaaaaugccaguucauggucuucauuggcccaaucgccgacaccagcucuaacuccuacuccacccacugcagcagcacugaaaucaucaauggcugacagu

SEQ ID NO: 5272 - RNA, 705 nt, Piezodorus guildinii
uaucaaggccuggucugauauucagaaggucuacaaaucuaaaagauuccgugcugguaaagguaagaugcguaauaggagacgcauucagcguagaggaccacucaucaucuaugggcaagaucaaggucuaacucgugcuuuccguaacauuccugguguugaucuuaucaacguuucacgguugaacuugcuuaagcuggcaccugguggucauguuggaagguuugugaucuggacccaaucagcuuuugaucaacuuaacgcucucuauggcacauggaagaaaaaaucaacuuugaaaaaggacuacaacuugccuaugcccaagaugguuaauacugaccugucuaggcuguucaagucugaagaaaucaagaguguccuuaaagcaccaaggaagaccauaguuaggaggguuaggaaacuaaacccauugaggaacacucgagcaaugcucaagcucaauccauucgcugcaguucugaagaggaaagccauacuugcugauaggaaacuuaagcuugagagggcuauugagagaucaaagaaggaaggaauugagcuuaccccucaucaaaagagguauguugcuaugcucgagcgaaggaaagcucagaucaaagcugcuaaggcugcuaagccuaaaaaggucaagaaaccaaaagcugaaaaaacugaagcugcugaagcaaagaaagcuag

SEQ ID NO: 5273 - RNA, 715 nt, Piezodorus guildinii
caagaguuaaggaacgggaagcagcuaaagcaaaagcuaggcaagagaagcagguagaugaaaauggugauccaaucgaaacagaaguagaggaacaagaggaaccuccuccuccugaaauaccagcaguaaaacauucuauacguucuggaccguaugcuauaugccguaaagcuggaauaggugguuuggcuaaacgauuugguuugaaaccugaacaguuugcugaaaaccuuagggauaauuaucagcgccaugauguugaacaggaaccaucuuuaccuauugaauuggccaaagaauuuguuucaucaaaauuucaaucaccagaagauguuuuaaaagcugcaaaguuuaugguugcuacacaacugaguagagaaccucuuguucggcguuguaugcgggauacauuuuuugaaaaagcaaaaauugauguuaaaccuaccaaaaagggaucaaaggaaguugaugaaaaucauccuuguuaugucaugaaauacaugaaaggaaagccuguaagagauuuaaccgcugaccaauaucugaagcugcauauagcucaucaagauaagcuuuugaacguuagcaucagugaucauauuggaggucauacaacgacauccuauauugaggaaauuaagcaacucuacuaccgggaugaguuuaugcaacauguacaagaauggaauaauauccgucaagaauguguuga

SEQ ID NO: 5274 - RNA, 781 nt, Piezodorus guildinii
caugaaauccuuggacuggaauuggucaccuuauuaguagaaaacccuacagaugauucgaucgaagucgcagucgcuuuuuuaaaagaagcaggucaaaaauuaagugaaguaaccagcaaaggcacuaacgcaauauucgauauguuaagaaauauucuucaugaaggcaaauuggaaaaaaggguacaauacaugauugaaguuauguuucaagugaggaaagaugauuuugcaacuuuuccaucgguaccggaagagcuagaccuuguugaugaagaagaucaguucacucacuugauuggucucgaugaugccauagauacccaagacauacuuaauguauucaagcuugauucggaauaucaagcgaacgaggaacguuauaaagaauugaggagcgaaauccucgauacugauuccgaggagagcgguucugaaggcgauagcaguggagaaggagaagacgaugauucugaugaggaagaugaagaaaagaaagucacaaucgucgauaacacagaaacgaacuugauaucgcugagaaaaacuauuuaccugacgauucaaucaagucuugacuuugaagaaugugcucauaagcuguugaaaauggaaaucaagccugggcaagagaaggaacucugucacauguuucuagauugcugcgcugagcagaggacuuacgaaaaguuuuuuggucuccuugcucaaagguucugccaaguuaauaauacuuacauagcacccuucgaacagauauucgcugacacauauucga

SEQ ID NO: 5275 - RNA, 727 nt, Piezodorus guildinii
augccuauaaagcugacgagccuacgaugggggaagggccagagaagucucgcucgcagcugcugauccuggaccgaggcuucgacgcugucuccccacuccuccacgagcucacccuccaggcgauggccuacgaucuccuuccuaucgagaacgauguuuacaaguaugaagcuacagcuggagcuccagaaaaagaaguguuguuggaugaaaaugacgaacuguggguagagcuacgccaucaacauauugcuguaguaucacagaaugucacaaagaaucuaaagaaguucacagagucuaagcggaugccacaaggagacaagcagucgaugagggaccugagccagaugaucaaaaagaugccgcaauaucaaaaagagcucagcaaauauuccacucauuugcaccucgcggaagauugcaugaacgcuuaccaaggccauguugauaagcucugcaagguugaacaggaccuagcgauggguaccgaugcugaaggagagcguaucaaggaccacaugaggaacaucgucccgauccuccucgaccagucggucuccaacuacgacaagaugaggaucauccuccucuacacccucuccaagaacgguauuuccgaggagaacuugaacaagcucguccagcaugcucagauucagccgcacgagaagcaggccauugucaaccuuggcaaucuuggucucaauguugucguugaugg

SEQ ID NO: 5276 - RNA, 709 nt, Piezodorus guildinii
auguucccagaucuagagcuguugaggcacaaaggcugaugacauauuuuagugaauuucuuagcccuggaccuguucucgcuaguguuuuuucaaauaaagaagagguauuugaagcugcugauauuauacagaagcuucauaugaucucacaagaacuuccuucugauaaauuuaaagaugcaagaucaaaaauaaguuuaaaauaugaugaaauugaaagaucguuaauugaagaauucgugaagucacauaggguucaugaaacaagcagaaugaaagaaauugcaaauauucuuaugcauuucaagucuuacucacaguguauugaugcauuuauugaagaaagucaaaugggaacauuugcuggaaaagauauuuuuaaggaaauauuaccucuuacaaaaaaaaauuuuaacaucaugaaagaaguuuuuagcaacccugaacaaguuauggcuaaauuuguuuugaauauuuaccacuuaaaacugcagaaacauauuguaagcaaccuuucugacaagucugauucuaauaaauaucuaagaaacuuaauggaauuauauacuaggacuacugagcuaucuguugaauugaguuguuuuaaaauggggucugaugauucauaucuucaaaagcuaacucauaccauauuucaaaaauauuuagaaucauacauuaguguagaaguuaagggcuugaagga

SEQ ID NO: 5277 - RNA, 670 nt, Piezodorus guildinii
ucauggucagagacaaaucgggaccgaagagagaggcugaggcaacuagcucuugagacuaucgauauaaacaaggauccguauuuuaugaaaaaucauuuagguucuuaugaauguaagcuaugucucacccugcauaauaaugagggaaguuauuuagcccacacucaaggaaagaaacaucaagcaaacuuagcgagaagagcagcgaaagaagcuaaagauucuccacaacaaccagcaccagauaaaccaagaauagaaccaaaaaaguuuguaaaaauugguagaccugguuaucgaguuacuaaacaaagagauccugaaacaggccagcaaagucuucuuuaucaaguagauuauccagaaauugcagaaggaaucuuaccuaggcaucguuuuaugucagcuuaugaacaaagaguggaaccuccagacaggaaauggcaauaucuucuguuugcugcugaaccuuaugaaacgauagccuuuaaggugccuagccgugaaguagacaagucugaaaacaaguuuuggacucauuggaacaaggacacaaaacaauuuuuccuccaguuugcauuuaagaaugaaccacuugcuccuccuaugggugcaccccacuuaggucaaaugagaccuccgcacauguuaccaccaccuaugagug

SEQ ID NO: 5278 - RNA, 351 nt, Piezodorus guildinii
accucuuguuguuuucgaguuguguuuucaucauguccaucgguguuccuaucaaaguuuugcacgaggccgaagggcacaucgucaccugcgagaccaagacuggagaagucuacaggggaaagcucauagaagcggaggauaauaugaacugccagaugaccgguuugacuguuaccuaccgcgauggacgaguagcucaauuggaaaacgucuucaucagaggguccaaaauacgcuuucugauauuaccggacauguugaaaaacgcgccuauguucaaaaaacaagggaauaaaggcaauacgggcgcugguagagguaaaucggcgauacugagagcucaagcag

SEQ ID NO: 5279 - RNA, 659 nt, Piezodorus guildinii
caaguguuucaaaagucccccuucugcagacauuagcgaagagaacauucgcagcugcugcggcuccuaaagcugcuggauguaaagcuacuguugaaguuucuacucuuccgaauaaggcuauugucacuucuuugggguguggaccuaaacccuuuguacaaguagcuguagcauucagagcuggaagucguaaugaauguucugaaaacuauggagcaagucaccuucugaggagcucugcuggucuuagcacuuguggugcaucuucauucuacauuugucgcaguuugcaacaaauuggugcuagccuaacugccacuucugaccgugaaacgauuguuuauguccuggaaucuucugcuagcaagauaaaugaaggccuugauauuuugaagaaggcuauuacuggucaagaguucaggcccugggaacuuuccgacaauguuucucgaaucaaaguagaauuggcaucacuaccuccacaagcuaaagugaucgauuugauucauacagcugcauuuaggaguggacucggaaauucuauuuuuguuaaagaauucaacauaaaaaaacuuagcagugaaacgcuuaaacauuaugcugcuaccuauuuaacuggagacaaagcaguuauuggugguuguggauuaccucau

SEQ ID NO: 5280 - RNA, 194 nt, Piezodorus guildinii
aggaaaaugaucagaugaccaacaaacugaaagauaaaauaacugcuuugaagcaccugucgaucgacaucggugcggaagugaaguaucaggauaagaugcuucauggcaugucggaagacuuugaucguaccggaggcuuuuuaggaaauaccaugaauagaguuuuacgucugaccaaaggaagucacaau

SEQ ID NO: 5281 - RNA, 781 nt, Piezodorus guildinii
uacagacugguaucucugcaauagauguuaugaacucaauugcuagaggacaaaaaauucccaucuuuucagcugcugguuugccucacaaugaaauugcagcucagauuugucgacaagcugguuuaguaaaauugccugguaaaucuguucuugaugaucaagaagauaauuuugccauaguguuugcagcuaugggaguuaacauggaaacugcccgauuuuucaagcaagauuuugaggaaaauggcuccauggagaauguuuguuuguuuuugaacuuggcuaaugacccuacuauugaacguauuaucacaccucgucucgcucugacugcugcugaauuucuugcuuaucaaugugagaaacacguuuugguuauauuaacggauaugucuucuuaugcagaggcccuucgagagguaucggcugccagggaagagguaccugguagaagagguuucccagguuacauguacacugaucuggccaccauuuaugagagggcugggcguguugaaggcagaaauggaaguauuacucaaauuccaauucuuacuaugcccaacgaugauaucacucacccuauuccugauuugacggguuauauuacugagggccaaaucuacguugaccgucaauugcacaacagacagauuuacccgccaauuaauguacuaccaucacugucccguuugaugaaaucggccauuggcgagggaaugacccgaaaggaccauucagaugucucaaaucaauuguaugccugcuaugcuauugg

SEQ ID NO: 5282 - RNA, 782 nt, Piezodorus guildinii
gucaggcaaagaagaagagauguauggcgaucaagacauguuugaccuggaucaaggauuuacucaggguuuuacccaagagcaagucgaugaaaugaaucaacaacucucucagacaaggucccagagaguucgagcugcaauguuuccugagacauuagaagaagguauagaaauuccaucuacacaguuugaccaggcucaagccacggcaguucaaagacuagcugaaccaagccaaaugcuaaaacaugcuguuguuaaucucaucaauuaucaggacgaugcugaccuagccacccgugcuauuccugaauugauuaagcugcucaaugaugaggaucaaguagugguuucacaggcugcuaugaugguacaccagcugucgaaaaaggaagccucucgccaugccaucaugaauaguccucaaaugguugaagcuuuggugagagcauuaucaaacaguaacgacuuggaaacuaccaaaggagcuguaggaacauuacacaauuugucucaucacaggcaaggucucuuggcuauuuucaaaagugguggaauuccagcucuggugaagcuuuugaguuccccaguagaaucgguucuuuucuaugcaauuaccacuuugcacaaccuccuucuucaucaagaaggaaguaagacggcugugcgaguugcuggaggauugcaaaagaugguuguuuugcuccaacgaaauaaugugaaguucuuagccauugugaccgacugucuccaaauucuagcuuauggcaaucaggaaa

SEQ ID NO: 5283 - RNA, 588 nt, Piezodorus guildinii
cgaucaagccaaacaaagaagacccuacuuagcaucugaauguacugaucuucaacaagcugagaaauggagaaugcaaaucauuagagaaauagcucguaaaguuucucaaauucagaaugcuggucuuggugaauuuagaauucgugauuugaaugaugaaaucaauaaacuacugcgagaaaaaggacauugggaagcucaaauucgagaacuugguggcccagaccacuccaggucugggccaaaaaugcuggaugcugaagggaaagaagugccaggcaauagggguuacaaauacuuuggugcagcaagacaacuuccuggagucagagaguuguucgagcaggcuccaccuccaccuccacauaaaacgcguggcgagcuaaugagagauauugaugcuucuuauuaugguuauauggaugaugaagacggaaucauuauaccacuugaagaaauugaggaaaccaaagcuauuaaaaaagcuguagcagaauggacuguuaagaaagaaaagucaauggaaauggaugaagaugagaaagaagaagucgaagaggauaacaucuacaaagcugcaggaaa

SEQ ID NO: 5284 - RNA, 502 nt, Piezodorus guildinii
acauuugucaaacgccauuuaacuggugaauuugaaaagaaguauguugcuacauuagggguugaagugcauccuuuaguuuuccacacaaaccgaggcccuauccguuuuaauguuugggacacagcagggcaggaaaaguuugguggacuuagggauggauacuacauucagggucaaugugcuauuauuauguuugauguuacuucaaggguaacuuacaagagugucccuaacuggcaucgagauuuagugcgugugugugaaaacauucccauuguacuuuguggaaauaaaguagacauuaaggauagaaaagugaaagccaaaagcauuguuuuccacaggaagaagaaccuucaauacuaugacaucagugcuaagaguaacuacaacuucgaaaagccuuuccuguggcuggcuaggaaacucaucggugauccaaaucuugaauuuguugcuaugccugcauuguugcccccugaagucaacauggauccug

SEQ ID NO: 5285 - RNA, 386 nt, Piezodorus guildinii
uggauauccaaaccauugcaacgauauuuauuaaaguuuuaaaacuuguaaucaauuuuaucauuuugaugcucuaccgcuaugguggaaaacaaggauuucucggaguugguggaacauggaacuuguaugaaguuaaaagugcugaugcugaaauuauugcaucuggaguuuuugugggauuuuuuauauauacaucuguaauccuuauuucauacugcuuuggaacaaccaaacacaaauauagugcaguagauauuauaaugaacgugagcggaaccauauuguucacagcaguuggagggauagcuuuacacuauuggguuggcuuccaggaugaaaaucauuacgugggaaucucucaagaaaagcaaauaggacuugcg

SEQ ID NO: 5286 - RNA, 701 nt, Piezodorus guildinii
ggauacuucaagaagcccaaaauaugauggcauugagccacguagauacuccgcuaaaaggagguuugaauacaccucuuuacaacucagaguuuaguguucauccaccagcagagcagaucacaacaccaaacacuguucuaacuacuccguuuuccaaucgaacucaugaaggaaggacuccaggcuuucaaaccccgcaggacgugaggaacagccugaccacuccugucagagauaaguuaaacaucaacccagaggaagguggugauacacccuaugcaccuguaaauaaucaaaaacaggcgaaggaggaacuugcugcucgccucaggucacuaccccagccgaagaacgauuaugaaauugugguucccgaagaugaaguuucaucggaaacgacugcagagggugcugguuugccaaguguugaagaucaagcugauauugaugcuagaaauuugaguauucucgcucaacaacgugaaaaagaauugaagaguagaucgcagguaauucagcgagcuuugccccgaccuggagauaucaacauaguauuacguccagcuaauacagauccaccuuuaacagaacuucagaaggcugaagagaugauaaaagaagaaaugauaacgaugcuacauuacgaugcggugcauagcggugaaccuccuuccucgaggaaaauaggaaccgugagu

SEQ ID NO: 5287 - RNA, 344 nt, Piezodorus guildinii
gguauguugcacauccugauaaacugaagaaaaaaauuacaagagaguuaauuacaaccauuuuggcuaggaaaccuaaaauguguagcuuuuuggaauggaaagauuuaaaaauaguguauaaaagguaugcuaguuuauauuuuuguugugcuauagagcaaaacgauaaugaacugcuuacauuagaagugauucaucguuauguugaacuucuugacaaauacuucggaaguguuugugaguuggauauuauauucaacuuugagaaagcauacuucauucuagaugaacuguuacucggaggagagauucaggaaacaagcaaaaagaacguccugaaa

SEQ ID NO: 5288 - RNA, 751 nt, Piezodorus guildinii
cauuagucaaacugcagcagcugugaaacaggaauuagaucaaacuggaauccacgcucauguuuaccagccuccacgaaaacuaaggagaaggguggaaauaaugccagauaacaaagcauugaaaccugacacagaaacauuggguauugaucuucauaaagacucaaaauuuuuccaaaguuggcaacaauuuaaagacaauaaugcuuauaucaacaaaguucuugauuggaaaaugaaauaugaugagagugauaauccugucauucgggcaucucgaguauucacugauaaaguuucaaguguuauggguggccuuuuucagaaaacagaacuuuccgaaacucugacugagauauguagaauagauccgaauuucgacagagcucaguuuuugaaagauugugagaaagauaucaucccaaauauucuugaagcaaugguucguggagauuuagacauauuacaagauuggugucaugaagguccauauaauguucuugcugcuccaauuaaacaagcaaaagaagcccacuuucaauuuuguucuaaaauuuuagauauugauaauguugaucugguaauggguaaaguuauggaccaaggaccaguguuaguuauuaguuuccaaucucagcaauuacuguguaucaaagauaaaaaugguaauauaguugaaggugauccaaacaaaguuuuaagaguuaauuauguuuggguucuuuguagagauccaucugaacuggac

SEQ ID NO: 5289 - RNA, 650 nt, Piezodorus guildinii
auacugaggcauugcaagaagcuuuugcccgaggggaucucaagcccggucuuaauauaccagucaaagauagacccaggacaaacaauguuccucuucugauggaagcauuaagugaaauuaagcaggaacuaccuuggaucgaaagauuagauguuacgaaugaucaggcacccuuggccccagaacuugcccuccagaucagggaugaagaaaaaggucauaauccguugguguacgaugaguugaagagagaaaguguauucuacaggcaggcucagaaugcugcuuuaaaaguccuaccgcagcugaaacaguuaggccuuagaacugaaagaccaggagacuauuucgccgaaauggcuaagucagaucaacauaugcaaaagguuaaaggugaagcuaucaagaagaaacuuaugauggaaaggauugaaaaauugagagaaauacgagcgcagaagaaaguccaaaaagcucuccaugcucaagcuaaagucgccaaaguacagaguaagaagcaaaugcuagaugaggugaagaaguacaggaaaggggagaccaaaagcuuagcuuuccucgaaccuggcuacaagccaaaacccaaagccaauaaaucccaaauaaaacgacaacacaagaaugccaaa

SEQ ID NO: 5290 - RNA, 705 nt, Piezodorus guildinii; identical to SEQ ID NO: 5265

SEQ ID NO: 5291 - RNA, 697 nt, Piezodorus guildinii
gaauggccaauaugcguaugcaacaaaugggacagaucuuuccuacugguggaacuggaggcuacuuuguuccuacauuaccccagccgcaaagauuuuucgguccagcccaaauggcccagaugcgcccucaaccucguuggccagcacagccacaagucagacccagcacacaagccacugcaucaggcuuccccaauaugcaagguccuuucagaagcgggccacgaggcccuggcgccgccgguggugguggugguccaggaagugcugcagcugccgcggcagcaaugcgcuccucuaucagugcugccgcagcugcgguggcugccgccgggcgacccacagccaacgcagcugcugcugccgcugcagcugcugccaacccagcuguugcccgccaauuggcccaaggagcuucucagggugcuccaguaucugugucugcucaaggccguccugcaaauuacaaauauaccgcaaacaugcgcaacccgcccccgauuggagguggcgcuggagcaggugcaggagguccuccacaacaagcauugcacauccaaggacaggaaccgcucaccgcaaguauguugucaucagcaaacgcucaagaacagaagcaaaugcucggagagaggcuauucccacuuaucaggagcauguaucccgaucuugcugggaagaucacaggaauguu

SEQ ID NO: 5292 - RNA, 715 nt, Piezodorus guildinii
uucuauggauauugguggcguuucagcuccuccuccaccuccaacgacaucugcuccuguugaucuuuugggucuggauucacuucuuggagggguaccugaacccguugucucucagaguacaaccgguuugcuuggagauaucuuugguuugggaacagccgccgggccuacagcauauucuccacccaaaaccauuuggcucuccagcgauagggguaaagguugcgaaauaucuggaacguuuucucggagaaaugggcaaauccaaauggauaugacuuuuguaaacaaagcuaugcagccgaugacuggcuucgccauucaguugaauaagaacaguuucggugugacuccagccggaacucuccaaguuuugaacccacuaccgccugguacuucgcaugacugcucauugcccuuaguuacgacuggagcaguacaaagaauggaaccuuuaacaaaucuccagguugcugugaaaaacaacauugauguuuucuacuuugcuugcauuaucccgaugcauguauuuuucacugaagauggacaaauggauaagcguguauuccucgccacuuggaaggacauuccagcucaaaacgaaguacaauacacacugacaaauguucagucuaaugcugauacugucguucaaaaaaugcaagaaaauaauguuuuuaccauugcuaagcgaaauguugagggacaggau

SEQ ID NO: 5293 - RNA, 377 nt, Piezodorus guildinii
uggugaaguaggagcuacauccucccuugcucccaagaucgguccucuugguuugucccccaaaaaagugggugaugauauugccaaagcuacugcagauuggaaaggucugaaaauuacaguuugccucacaauucaaaacaggcaagcugcuaucucaguugugccaucugcagcuucccucaucauuaaagcccuuaaagaaccaccaagagacaggaagaaggugaaaggaguuaaacacaaugguaaccucaccuucgaugaaauccucacuauugccaggucaaugaggccaagguccaugucuaggaaacuagaggguacuguuaaggaaauucuuggcacaugccaguccguugguuguacaguugaug

SEQ ID NO: 5294 - RNA, 777 nt, Piezodorus guildinii
aaacagaaccacuuggaacugcagguccucuggcucuagcaaaagauauucuuucaucggguaaugagccauuuuuuguucuuaauuccgauauuauuugcgaauuuccuuucaaagaacuuguuucuuuccauaaaaaucacgggaaagaagguacgauuguagugacaaagguagaagagccuucgaaguaugguguuguuguuuauaaugaaaaggguugcauugcuaguuucauugaaaaaccucaagaauuuguuucaaauaaaauuaaugccgguauguacauucucaauccuucuguauuaagaagaaucaaacuggaaccgacaaguauugagaaagaaguuuuuccguucauggcugaggaaggagaauuguaugcaauggaguugaauggauuuuggauggauguugggcaaccccaagauuuucuuacaggaaugugcuuguaucucacaucucugcgccagaagucucccgagaaguuguacucuggcccuggaugcaucggaaacguccugguccacccuacagcaaggauaggcacgggcuguuccaucggaccgaacguuacgcucgguccuggagucauuguggaagacgguguaugcauaaaaagguguacagucuuggaaaaugccacaaucaaaucucauucuuggcuuuccgggugcaucgucggguggaaaucuguugucggacaauggguucgaauggagaacaccaccguucucggugagaauguaaauaucaaagacgaacucuacaucaacg

SEQ ID NO: 5295 - RNA, 670 nt, Piezodorus guildinii
uauauuacauucgccaccgggagaguuuaacgaaguuuuuaacgaugcaaggauauuauuaaacaacgauacccuuuugaaagaaggagcucucggagucuucgggcaguacuguaaagaccagcuaacgccugugaagauuaagaacagugaguauccaguuuuaauuacagaacauaaugaucuuggauccaacagguuuuaugaugcaaggucgaaacagucauuuaaauaugauccauuaaggagggagacaucuaauuaugacacaugggaugcugaaccugguacugaaaaguggagaucagcuuuagagguugaauuagaugcauauauagcuaaacacuucgaaaguggaucugguaguguauuuucuaaaaaagaagaugguaaaguaagcuugguugcgugcauagaagcccauuuauuucagccaaaaaauugcuggaaugguuguuggcgaucucagugguuugugacaauagauucugauaaugcagacgugaaagguguuuugaaaauucaaguucauuauuaugaagaugguaauguacagcuaguaaguuugaaagauauuaaucaaucacucccaguugucgacgaagagcaguuaaguaaggcuuuaauuaaaauauucgaagacucugaaacagaguaccaacaagcgaua

SEQ ID NO: 5296 - RNA, 741 nt, Piezodorus guildinii
ucguaaaaacgacccuucauucaucggaauauuuuacaguaaguguaggauuggacaguugggucucaaugauguugaccaaagagaaccaggaguuuauuucaggauggaaagagauuugauaucaagaaaagacaaauucggcgucgaaaugagggagcggcugaaaugggacauccgagagaguguuguuggcucagauucuuuugaaccaaagcauucgguuauugugacuuggaaaaauguaucguuugcugguggaauugaaaacucaguacaaacaacaaacacauuucaacugguucuugcaacagacgaaguguucacuuaugccauguuuaauuauguucaaauuaaguggacuacacacacggaagcaagaggagacacaguaaaaggggaaggcgguguaccagcuuacauuggauuuaaugccggcaaugguacgagaaguuaugaauaucgaccauauucucagacaucaacaaucagagauuugguuaugcguggcugggcuaaugguuucccugguagacauauuuuuagaauugaugaaaauauccuaccuggaacuugcaacaaggauauugcuggagcaaguuugccccucgcauuugcuccugaaaguggcaauaugcuaggugguaccauugucaauaucacaggaccuuguuuugaaccuaauaugaagauaguaugcagauuugacaugaaagcuguuuauggaacaguuguggacag

SEQ ID NO: 5297 - RNA, 194 nt, Piezodorus guildinii
aucgagucugauucagaacgaguaaacaaaguaauuucugaacuuaaaggcaaaaauaucgaagaggugaucgcugcaggaaaagagaaguuggcuucaguuccuucuggagguggcggagcucccgccgcugcugcugccgcaccugcagcagccuccccugccaaagcagcagaggagaagaaggaagcaaa

SEQ ID NO: 5298 - RNA, 765 nt, Piezodorus guildinii
cguuccucuccugguuuuaauugaagcugcgagagcugguaaugagaaggaugucgaagaguacgcacuuguauuucaggagcaugcuaauaaacucguugagguugccaacuuggcuugcuccauguccgggaaugaggacggagugaagauggugcgcuacgcggcagcucagaucgacgcccucugcccgcaggucaucaacgcagcccgcauccucggggccaggcccaaguccaaaguggcucaggagaacauggacgucuucagggacuccugggagucgcagguccgagugcucacggaggcugucgacgacauuaccacuauugaugauuucuuagcugucucugagaaccauaucuuggaagacguuaacaagugugugauggcguugcaagagggagacggagacucauuggacaggacggcuggcgccaucaggggccgcucugcccgcguggcuaacguggucacugcggagauggacaacuaugagccuggcaucuacacagagaggguucucgaggccaucaagguccucagggagcaagugaugccaaauuuugcucaaagaguagaaguugcaguagaugcucuuucuucaaacccuccuaaagaugucgaugagaaugaauucauugaugccucccguuuggucuacgauggcgucagagaaauuagaagggcaguucucaugaacaggacggaugaggaacucgauccugaagaaguugaguuagacgaacacuacacguucgaaac

SEQ ID NO: 5299 - RNA, 751 nt, Piezodorus guildinii
ucaaguuggaaccucuaagcagucuacaauguucaugccaccuacagcauugucugguacaaguacuccaaaaacuacagcaacagguacugcaacauuguuuaauauuacaacuacaacagcuucugcucccauuuccaguaguucagcaacaacaucaggguuuucacuugguucuucaucagcagcuagcucucagcaguucaaaccaccuucuacaucucagccgaugcaguuaaaaacaacuguaucaggugcuucuaugccauuaacuacugguuuaucauccacuggaggaaauacccaggcaacugccggcuugaauuuuggaaguaccgcuaaaucuaccccuggauccacugucuucaguccugcuaaaaguucacucccagcugcgaguucuacuacaaccucauccuuaacauugccaccuucuucuacaacuucucucacuaauucauuaucgaacaaaccuguuacuaguacuggugcuucgacuucucaacaaccaaauaaccuuacuuuucaacaauuagaagaauugauucuuaauaaauggacagccgaauuguacgaacaggaaaaaguguuuuuaaaucaagcuacacagaucaauauaugggacaaaguuauuaaugaaaaugcugaaaaauuaacucaauuacauucuaccauggagaaaguuaggaagcaacaagccaaaauaaaugaugaucuugagaucauauuuacucaccagaaagacuuggaa

SEQ ID NO: 5300 - RNA, 438 nt, Piezodorus guildinii
gcugguaaaacaacucuucuccauagguuaaaagaugacagauuggcacagcacguaccaacacuccauccaacuucugaagaacuauccauaggaaauaucagauuuacuacuuuugaccuugguggacacacucaagcucgccgaguauggaaagauuacuuuccggcaguugacgcuauuguuuuucuuguugaugcuugugacacgagucgauuaccagaaaguaaagcagaauuagaugcucuuuuaaccgaugagagucucaucaacuguccaguucucauucucggcaacaaaauugaucuuccaggugcagcuucugaagaugaucucaggaauuuuuucaaucuguauggacaaacaacuggcaagagcaaaguuccacgaagugaauuaucuggucguccauuagaacuauucauguguucaguucug

SEQ ID NO: 5301 - RNA, 688 nt, Piezodorus guildinii
acacuguucagagauugcauaauauaucgccagacuucuuaaaaaugccaauguaucaaagggcagagcagaaguuuguuuggaaugaauaucuuuuaucugaauuugcgcaaaacucuggugucucuaaauucugucuuccuaucauccauggguaucucucaauuacaucuugcauuuuaaauggaaaaaccuuuagucuuaucuuggucuccagaagauccaaggaaagagcugggaccagauuauuuacuagaggaauagauucaaauggaaacguugccaacuucgucgaaacugaacagauaguugaggcuaaauuugaacgugcuagcuuuguccagacacgagguucuaugccauucuucuggcagcaguauccuaaucugaagcugaaaccacgaccugccauaauucaagaugaaaaucauucugcugccuucaguaagcauuuugaaacacagcugauggauuacggaagacaagucauugugaauuuggucgaccauucuggcucugaggggaaguuggaagaguuuuauagaaagcuagugaacgaagcaaauaaugcugaucugaaauaugaagcauuugacuuccacagggaaugcucaaagcuacgguacgauagauugaagauucuuauagaucgucuggccuaugauuuagagcagaugucaguaacgau

SEQ ID NO: 5302 - RNA, 733 nt, Piezodorus guildinii
cguguaaaguacugcaacacuuugccugauauuccauuugauccaaaguuuauucaauauccauuugaaucuacucgauucauucaauauaaucccacuucacuggaacgaaauuauaaauaugaaguucuuacugaacaugaucuugggguuacuauugaucucauuaacaaagacauguaugcugcugaucacaaugcaguucuugauccugcugaugagaaacuacuugaagaagauauccuuacaccucacgauucuaaaaggucuagacaucauucucgaucaguuucauggcuucguagaacugaauauauuuccacugaacaaacacguuuccagccacaaguuauggauaaaguugaggcuaaaguuggauuuaguauuaagaaaagucucaaggaagaaacccuuuacauggauagagaaagccaaauuaaagcaauugaaaagacauaugaugaugcuaaacuaccuauagagaaacaucauaguaaaccuaauguuguuccaauugaaauucuuccugucuuuccagauuuccaguuauggaaguacccuugugcucagguuauguuugauucagacccugcaccuauaggaaagacaguacccgcucaguuagaacaaaugucucaagcuaugaucagaggugucauggaugaaaguggugaacaauucguagcuuauuucuugccuacugauucaacuuuagaaaaacgcaggagagauu

SEQ ID NO: 5303 - RNA, 733 nt, Piezodorus guildinii
aagagcacgagaauucaguuauugaagaugaagagcaagugagugggcuauggcaggcaaaguuagacuacuuguguagcauuggggacaaggaaaaugccaguacauuagccaauagcaagcuucaagacaaaacagugccuaagacucaucguaucgaugcaguuuuugcauuauuuagguuaucauauuuccacgguugcgauaucaaaggcaugucuucagcuauugagaaagcuaccgaacugauugaagggcaaggcgauuggaguucaaggaauaaauugaaagcauaugagggaguguggaguuuugcuguaagagauuaucuacgggcugcaaagcuuuucguugaugucguacccacuuucgaaucuuacgagcuugcugacuucggaacuaucauuaaauacaccguacucucguguaugauagcauugccgaggugugaauugaagaaaaaacucaugcaccacgguguuauggcccaagcacuucacucucaauaucgaaacuugaaggaguacuuccagucccuuuacgauggucacuacgcagacuuccuugucgcuuuggcacagguggaaucugauaugaaacgcgacccucuccuucauccgcauuaucgccacuauguacaggaaaugaggcuuagggccuacaagcagaucuugcaagccuaucgcucacucucuuuggacuauauggcagaagcauuugguguuucuuguga

SEQ ID NO: 5304 - RNA, 683 nt, Piezodorus guildinii
gguauguuuugggccucuaaagaaaacggcccgauucccaguccaccugaaggcuuuacauuauacacuagggaaaguggaauaguuguccugaaaagaauaaaaaagagaaaucuucaaaggcuuggcauuggugguuucacuacugucaaaaugagaagcuccagauuaaaagaagaugaugaacaucuauacccugaagaaaaacccaggaggaaaccucgaguuccaaagaagaaaagcaaaauugcugaaaguuauccuaggcaucuucaggaagcuuuuuuuggcaaagaauuacuagauacaacuaaagaaacuucgcaagaguuagagagcacuggugaugaaucagaugauggcaaaaugagggaggaagaagguagcgauggugaaacguugaaggauauucuacaucucccugaaaaucuucuccacaaugaucuagucaacacaaucaugaaugaaagugcagauaguaucaaaucagaaaaucuuaugucagagagugggcacgaagguagcagcagccaaaaagacgaacuaugugauauucuuggaccucauuucaauauagaaucuauggugagggaaacaggucuuccaaauauggauuccaaagauguugaagaaauuuucaaaggaguucuuacugaugaggcucguaaucaggcccaucauaa

SEQ ID NO: 5305 - RNA, 700 nt, Piezodorus guildinii
ugguugauguaccaguugagacuucuccuauuaagauuaaagaggaaccaauagaugucgaugagauucaagauuacaguugugauauguucagugacgacuuugaucaagaaguuauugaaauuucugauacuaaagauaaugaaguaugcucaagagauauuaaaguagaaccugcuucuccuguaaaagaugcaucuccaguuaaaauggaaauuguuaaagaugaaguaagugaagagugggacaagcaaauugaauuugauucuccuguaacuuaugucaaugucgauaaaucuaaauuaccccuggugaaaaaugaaaguggucaagagguuuuaagauucuacuauugggaugcugcagaggaaauguacucacaaccagggacuguauuuuucuuuggaaaaauucuaauugaaucagcuaauacuuauguaagcuguugugucucaguaaaaaauauugaaagacguauauuucuucugccaagagaaaggaaaaugaaucuuaagacuaaugaagcauauggugauccugugacaaugacagauguuuaucaagaauucagcucaacuguagcagagaaguauaaaauaaagcaguucaaaucccgaaaaauuuccaagaaauaugcuuuuggugauaguaacguuccuucagagucugaguaucuggaaauaagguauccgugcacuuc

SEQ ID NO: 5306 - RNA, 740 nt, Piezodorus guildinii
auggcuggcucugaaauuuacagucucgaaaugaguaaaacugaagcccuuacacaagccauacguaagucuauugguauccggauaaaagaagaaacagaaaucauugaaggugagguuguugagauacagguagagcgaccugcuacaggggucggugccaagguuggaaaacuuacauuaaagacaacagaaauggaaacuguuuacgaccuuggaaauaagaugauagaugcucuuacuaaagagaagguucagucgggugacguaauuacaauugauaaagcuaccgguaaaauuaguagaauuggaagaucauuuacuagagcuagagauuaugaugccacuggcccccagacgagguuuguccaaugcccagaaggagaguuacaaaaaagaaaagaagugguacauacuguaucuauucaugaaauugauguaaucaauucucggacccauggauucuuagcucuuuucucaggugauacuggugaaaucaaaccagaaguuagggaacaaaucaacacaaaaauugcugaauggagagaagaaggaaaagcugaaauuucaccugguguauuguucauugaugaaguucacauguuggauauagaauguuuuucauuuuuaaaucgagcccuugaagaugagauggcucccguuguuauuauggcuacaaacagagggaucaccaauaucagaggaacuaauuacacaucaccgcauggaauaccuauuga

SEQ ID NO: 5307 - RNA, 735 nt, Piezodorus guildinii
acucagagcuucagaaguugaagauaucauugaggguaaugaugaaaaauacaaagcuguuucaguccauucuucugagacgccuauuacaaguucuucuaaacccaagaaagcuaugccauggguaccuucgcuuccaaacaguucucauuuagaugcuguuccacaggcaacuccuaucaauaggaauagaguuguuagcaagaaaguuagaaguuucccucucuguuucgaugacacugauccaucaucuaucauggaaaaugcuucccaaauggaaguucucguaccuauucgucucgacauggaaauagaagggcagaaacuucgugauacuuuuaccuggaacaaaaaugagaguuugauaacuccagaacaguuugcugaaauucuuugugaugauuuagauuuaaacccucucaguuuugucccugccauagcacaagcgauucgccagcaaaucgaagguuuucccacugauaauauuuuagaagauucgagugaccaaagaguuaucaucaaacugaauauacacgucggaaacacgucucuggucgaucaaaucgaaugggacaugagugaaaaagagaacaguccugagcaguuugcgaugaaguugugcgcugaacuuggauuaggaggagaguuuguuacggccauugcuuauucgauucgaggacagcucaguuggcaucagaaaacguacgcuuucagcgaaucuccccuucaaacugu

SEQ ID NO: 5308 - RNA, 534 nt, Piezodorus guildinii
gugauggcugcuauacguaaaaaacuaguuauaguuggggauggugcuugcggaaagacuuguuuguugauaguauuuaguaaagaucaauucccagaaguauaugugccuacuguguucgagaauuauguugcugauaucgaaguugauggaaagcaaguggagcuagcauugugggauacugcuggacaagaagauuacgaucggcuaagaccacuuucuuauccugauacagauguuauuuuaaugaguuuuucuauugauucaccagauucauuagaaaacauaccugaaaaauggacuccugaaguaaaacauuuuugcccaaauguaccuaucauucuuguaggaaauaaaaaagauuugcgaaaugauccaaauaccaucaaagaguuggcaaaaaugaaacaagaaccaguuaaaccugaagaagguagagcuauggcugauaaaauuaaugccuuugacuaucuugaauguucugccaaaacaaaagaugggguuagacaaguauuugaaacagcaacuagagcu

SEQ ID NO: 5309 - RNA, 683 nt, Piezodorus guildinii
agugucgaugucaucuaagcauaauggucuuuauauuuuccuuagccgaaugcuuagaccaguuugguuaagaagaguuuuagaugucaauuacaauaaaaaaccuauuuaucuaccaaccauuacuugugaagaacucaguuuaaagacaguucaacuuuuugagcuucguucauuucuugcaagauacaccuuaagcucaucagacguuggcuccaguuugcagccagccaacaauacaacugugguuucuccaaguggucagcgcacucgccuucaagaagcacucauucaagaaaaagcaucgcuugaugccuuaaggaauuucguugagcgaaucacccaaguuuucucucuuuggaaauuauuaugugaucaugaauugccucugauuguagaaucucuuucuccggaaagucaagaccaauuaauacauauuacauuuagagaacuaauucuuaaaggagaagauuuaugucaugagcucauuucaaaauuagucaguuuauauuugaaugacaaugcuuccgucgauccaaucaguucaaagcugagagaaguuuguccucuucuuuauaaaaaugaagaugcaacuuguacaaaagucaaugaaauucuucaaauggcauuggaggaaauugaugaagaagccaaguugaaccuguuacgauccgcaauugauc

SEQ ID NO: 5310 - RNA, 661 nt, Piezodorus guildinii
gcuuuuagguguuggaaucgauuauauucauguugcagucaguauauuauuucaaguaugcuuccacuaggaaugguuuggcuuggagauuacuuaguuuuaauucaagaaugcgguuucucaauaguuguugauauugagccauuagaacuuuuuaugacaacugguguaaaguccucacaauuuccacaaguuggauauggcugguugguggaaagacugagggauauuaauuuagauccagguauugagaaguuagaauugagucuucauaccggagaaucaauugaugaacuuucuguucuucaagaagcugcugaucucauuucaccuucuaaacagcuugaugaugcucuaagcauguuuuaugaggaaggcuuaagcagaaguuuaaacagucuuauugaagaauuagcugugccugaagauuuuaauaaagauggaucuugggaaucauuuuguaguuauagugguguuggugcuguaacaucugcauuucgagacuauguugcugugagauuaaagauuugugaaaaaauauuauuaauuacugaacucgcuaugagggaugaugauggugcugcagauaggacucaacauaggagcuuagcugcccuuuguaaagccuauuauauuuuaaaauggaucugcacaucaaagu

SEQ ID NO: 5311 - RNA, 696 nt, Piezodorus guildinii
acgcagaucuugaacucuuugaagauaacccggaggaguacauuagaagagauauugaagguuccgauguugagucaaggagacggucaucgucagagcuugucaaagugcucgcaggucacuucccagaaacugucaggacuauuuuuggugcuagguuacaggaaaugcucgcugaauacaauagugauccagcuaaauggagguugaaaaacacagcuguauacauugugaccucucuggcugaaagggguucaacggcaaagcacgggguaacaaaauccucugaccuuguggaccuucaugauuuugcagggcaauauauuauuccugagcucaaaaaagauuugaauacguugccuguuaucaaagcagauucuaucaaguaucuuaucaccuuuagaagccuccuugcuccacaggugcugauaacugcuuuaccugauauagugaagcaccuugcaucucccagccuuguuguucacucauaugcugcaucggcuaucgacaaguuguugacacugaaacagaacaaucaaccauuaauaacacagacccuacugcagccgauugcuggagauauccucacuggucuuuuuaauauucuaaacuucaagggcucagaagagaaugaauacguuaugaaagcuauaaugagaucuuucaacacccuggacgaguccguuauuccauucu

SEQ ID NO: 5312 - RNA, 465 nt, Piezodorus guildinii
gaauccguuucaauucgaacuuacauucgaauguaucgaagaauugaaagaagauuuagaauggaaaaugaucuacguuggcucugccgaaagugaagaauaugaucaaguuuuagacacaauuuauguggguccuauuccagaaggaagacauaaauuugucuuucaggcagauccuccugauguuacuaaaauaccuauugaagaugcccuagguguuacugugguuuuacuaacuuguuguuaucguggacaggaauuugugcgaguaggauauuuuauuaauaaugaauauucugauccagaguugagagagaauccuccuccagugccgcaguuugacaagguugucagaaacauuuuaggcucugaaccgaggguuacaagguuuaaaaucaauugggaugauucagaaucacaagaucaaccuagucaagaaucagaagaacaacaacagacaacaga

SEQ ID NO: 5313 - RNA, 772 nt, Piezodorus guildinii
uguccaucaaccugaagaagaucaacaaauauugccuauagcacaacagcagcaacaacaacaaauacaaccaccuuugcaaaugcccccuuuacuaccaauacaaucuucaauuaaucaaccaaaaccuaugaacacuuaugccccuucaauggguuuuacaacaccacagaguaugaugcauccacaaacaccacaaaaucucaugucaccaauggugaauagaauggaacagacgccgaacaauauuauaaaucccaccacuccuggaccaaugacacccaugacaccaucaucggcagacccuggcuuuaugccgcaguuacagaauauaguaucuacuguuaauuuagguuguaaauuagaucuuaaaaagauugcccuacaugcaagaaaugcugaauauaauccuaaacgauuugcugcuguuaucaugaggauaagagaacccagaacaacggcacugauuuuuaguucaggaaaaaugguuugcaccggugcuaagagugaggaugauucuaggcuagcagcaagaaaauaugcccgaauaauacaaaaguugggauuccaggcaaaauuccuugacuucaaaguacaaaauaugguugguaguugugauguaaaauuuccuauaagguuagaaggauugguuuuaacucauggacaguuuagcaguuacgaaccugaacuguuuccuggacuuauuuaucgaauggugaaaccucguauuguuuuauugauauuuguaucaggaaaagucguacucacaggu

SEQ ID NO: 5314 - RNA, 343 nt, Piezodorus guildinii
gagauggcauucacauuugcugcagcaaauaagguuuucuaugccaauuccaaugugaagcaaguugacgugcccucuuucaguggagcauuugguauccuuccgaagcacguuccaacucuugcuguuuugaaaccuggcgucguuacaguuuuugaacaagacgguucauccaagaaaguuuuuguuuccaguggaacagucacaauuaaugaagacuccucaguccaagugcuggcugaggaagcccacccaguggaggaccuggacgccuccgcggcgagggagcagcucuccaaggcccaggcagaucugucgagggcgaccucugagaucgagaagg

SEQ ID NO: 5315 - RNA, 696 nt, Piezodorus guildinii
agaugcugcuagaucuuugguuauagauucauuugagaaauaucagucaaaagcgaauuuggccgcagaaaggaaaagaacagaaaaugccgaagcugaaaagaaaaggaaagaaaggcucgcugcuaaagccacuccuaaagugauggaaauaagcgaugaagaagcacaaaaaauugaagaugaagaaaaaaagaggaaagaagaagaggaaaaagcuuugucgaaaccaauuacagaaacagaaggugaagaugaugaacaggacaaaggaaaacuaaugccaaaugcuggaaacggugcagaucuugagaauuacagguggacccaaacacuucaagaguuggaaauacggguuccucuuaagaccacauucacuguaaggucaagagacuuaauaguagaucugggcaagacacaucugaagauaggauugaaagggcacgaaccacuuguggauggcgaauuagagcaugaaaucaaaauugaagaaucuacuugggucauugaagacggcaagacgcuguuucugacaguugaaaaaguuaacaaaauggaguggugguccaagcuguuugcuacagauccugaaauugccacccgaaaaauuaauccugaaccgucaaaguuaucugauuuagauggugaaacacgggguuuggucgaaaaaaugauguaugaucaaaggcaacguga

SEQ ID NO: 5316 - RNA, 289 nt, Piezodorus guildinii
acccagcuuauuugaacaguaaaaagacucgugcugaagguagaauugucgcaaaagaaaaagcuguagaaaauccaaccuaccaagaaauaagggauguguuaucagcagcugguuugaaaguugguguugaaaacaaacuuuauugucgagagaagaguaaagagcuucucuauagagguagaauacggguucaguuaaaaaaugauaaugguacuccucucaacccagauuucgcuaccagagaaucuguaauacuucaugcaugugcaaugauuccaaagcugaa

SEQ ID NO: 5317 - RNA, 700 nt, Piezodorus guildinii
caucgaaacaucacccuuugguuaaaauacacugaaauggaaaugaggaaucgucaaaucaaucaugcaagaaaccuuugggauagagcuguuacaauacuuccuagagcgaaccaauuuugguauaaauauacuuauauggaggaaaugcuuggaaauguugcugguugcagacaaguuuucgaaagauggauggaaugggagccagaagaacaggcuuggcuaacuuacauuaaauuugaauuacguuauaaagaaauagaaagagcuagggaaauuuacacuagguuuguuaugguucaucccgauguucaaaauuggaaacgauuugcaaguuuugaagaaaggcauggauucauuucuggugccagaaaaguuuaugaaagagcuguugaauuuuuuggagaggauauuauggaugaacgucuauacauugcuuuugccaaauucgaagaaggacaaagagagcaugauagggcaagggucauuuauaaauaugcucuugaucaucuucccaaagaacgaacugcugaaauauacaaggccuacacuauucaugagaaaaaguauggggacagaacuggcauugaagauguaauugugagcaaaaggaaauaccaauacuuggaggaaguaagaacaaacccgaacaauuaugaugccugguuugacuuauugaggcuuguugaagaagagggua

SEQ ID NO: 5318 - RNA, 685 nt, Piezodorus guildinii
uuacuugacgaacuucugcagaaggguuauggucuuggcucuggaaucucucucuucauugccacaaacaucugugaaacuauuguguggaaggcauuuucuccugcuacugucaacacugguagaggcacagaguucgaaggugcugucauugcacuuuuccaucuuuuggcuacaagacaagacaaaguccgugcucugcgugaagcuuucuauagacaaaaucuuccaaauuuaaugaacuugcuggcuaccauucuuguguucgccauaguuauauauuuccagggauucaggguagaucuuccaaucaaaucagcucguuaccguggccaauacagcagcuauccuaucaagcucuucuauacuucgaacauuccuaucauccuucaaucagcucuuguaucaaaucuuuacguuauaucucagaugcuggcugugaaauuucauggaaauguauuuguuaacaugcucggagugugggccgauguuggaggugguggcccugcccgagcuuauccugucgggggucuuuguuauuaucucucgccuccugaaaaucuuggucacauccuggaagaucccauucacgcuaugcucuacauuauuuuuaugcuugguucuugugcuuucuucuccaagacuuggauugagguuucuggcucaucagccaaagauguugcua

SEQ ID NO: 5319 - RNA, 372 nt, Piezodorus guildinii
caagagcgaacaggaagagacccugcugcacuccuccacgcucuaugucggcaaccucuccuucuacacgacggaggagcaaaucuucgagcucuucuccaagugcggggacgugaagaagaucgugaugggacugcacaaguucaagaagauacccugcggcuucugcuucguggaguacuacgagaggcagagcgccgagggggcgaugagguacgucaacggcacgcguuuagacgaccggaucgugcggacggauugggacgcaggguucguggaggggaggcaguucggacgaggccgcagcggaggccaggugagggacgaguucaggagggacuacgacgcggggcgaggaggauacgggaagau

SEQ ID NO: 5320 - RNA, 682 nt, Piezodorus guildinii
aacauuuucagauuggcagcuuuucuacuacuaaaucauggucaagagggaagaaagcuuuguauaccucacucgguauuuuaacuggagguacaggcauguugauauaugcccuugaaaaaagucuucaagcaggagaucuugaacuccauccucccaaacuuccuuggaaccauaguggguauuuucaagcacuggaucaugcaaguauaaggcgagguuaugagguguacaagaaugugugugcagccugucacagcuuaagauauguuugcuaucgagaucuuguagguguuucacacacugaagcggaggcuaaagcagaagcugaagaacaacuuguauuagaugguccaaaugaacuuggugaaauguucaaaaggccaggaaaacuuucugaucauaugccuaguccauauccaaacgaagaggcugcuagagcagcuaauaauggagcauaucccccugaucuuucauauauaguuccuggacgucauggagaagaagauuacauauuccacuuauuaacuggcuacugugaugcuccagcaggucugguuuuaagggauggccaguauuucaauccuuauuuuccuggaggugccauuaguauggcacaagcuuuauauaaugagauuauugaauacucugauggaacgccagccacucaaagucaauuagc

SEQ ID NO: 5321 - RNA, 704 nt, Piezodorus guildinii
gcuuuaccaccuguugaguacaauccgcugaaauucauuaaaccugguugcacugagaugacuguaaaucuuaaauaugaagaacuguuugcugcugauguugggccugagaauccauaucuuacagaucaacaaaaggcucccaaaaauauucucucagguuauguugaagcagcucauaugagcgaauuucaguuugaaaaucagaggaaaacuuuucaaaguuucggauaugcucuugauccuucgauugauaauaugggucgcagcgaagacgguauacccguuguaggagcaguagaaguugcgaaggaaaccaaucucaagacaguuuuugaaucuacuuccaagcgaccucuugauagaaggaaaagaaacaaaaacgacgauccgucugauaucaauggcuuccucggcccgugggggucuuacguugaugagaagaaaguuguuaaaccagauccugaaguugcugcugaacuugaagaauaccucgcuaagaggcaaaagcucgguaaaaaaguugaagauaaaccucuggaagagaagacuguccuucauaucaaagacccaguggauuaccagggccgcaacuucuugcacccuccucaggaugucggcgucaaccucaagucagacucuccuccggacaaauguuucauccccaagucagaaauacacguuuggaaaggacauaccaaagg

SEQ ID NO: 5322 - RNA, 681 nt, Piezodorus guildinii
aaaagcaggagguucagaaaguugugaauccucuguuugagaagagacccaggaauuuuggcauuggucaggauauucaaccuucuagagaucuaagucgauuuguuagauggcccaaauauauucguauucagcgacagaaaucuguauuacagaagaggcugaaaauuccuccuucaauucaucaauuuucucaaucauuagauaaacaaacagcuacccaguuguucaagauucuugaaaaacaucgaccugaaacugcacuggccaagaaacagagguugaaggccagagcagaaggaaaaauuaaacaaaaggaagagguuccaaccaaaaagacuaauguuauuaggucagguguuaauacuguuaccagauugguugaacagaagaaagcucugcuuguugugauagcucaugauguugauccuaucgagcuggugcuuuuccuuccugcacuaugcagaaagaugaaugugccauacugcauuauuaaagguaaggcacgccuuggcagguugguuaggaggaaaaccuguucuucaauugcaguaacccagauggaggguaaugaucguacugcuuuaaauaaggucauugaagcuguuaggacuaacuacaaugaccgauaugaagaaauuaagcgacacuggggaggugguuugcuuggcucuaagucag

SEQ ID NO: 5323 - RNA, 790 nt, Piezodorus guildinii
guacaacagagcacuugagaaugucugguauguacuggauuuuaacaacuuuagcaguuaccaagaaguuagaugaaguugacaagaagcaguuuauugacuuuauacuugaaugcacugaugagaaaacgggugguauuggugcuuguguuggacaugauccucauaucuuguauacucugagugcuguucaaauugcuuguauuuuaaggucauuagaccaacuuccccuagaaaagauuguuaguuuugugucaaguuuacagaaagaagauggcaguuuuaugggugauaaguggggagaaguugauaccagauuuucuuucugugcuguugcuuguuuaucuuugaucggucgcuuagaugcuaucaaucuugaaaaagcagucaauuuuguguuaagcugucaaaacuuugauggcgguuuugguucucaacaaaauucugaaagccaugcuggauuaaucuacugcuguguugguguucugucaauuacccagaacuuguauagaauagaugcugaucaacuggguuggugguuaugugagcgucaacugccuucaggugggcugaauggaagaccagaaaagcuaccggauguuugcuauuccuggugggucuugucuucauuaacaauguuaggaagacuacauuggauugauaaacagcuuuugaaaaaauauauucuugcuagccaagauucugaaggagguuuuagugaucggccuggagauaugccagaucccuuccauacucuuuuuggaauugcugcuuugucacuguuaggaga

SEQ ID NO: 5324 - RNA, 689 nt, Piezodorus guildinii
cguuuaaaucagguucuggccauggagcaacagauucaaagccacucagauagagcgcaguuuaaugaucuccagucacuccucugugccacucuccagaguguucuaaggaaaaugaccccagaagaugcaccccaaauaucugauacaauuaugaaugcucuucuucaaauguucaauuccaauucaugcaaaucagguucagugcaagaagaugcgauaauggcagucucaacacuaguugaaguucuuggugauggcuuuauaaaguauaugccagcauuccaaccguuucugugcaugggccucaaaaaucaugcugaauaucagguuuguugugcugccgugggucucacuggagauauaugucgggcauugaaaaacaaaguucuuccauauugcgaugauauuaugcggcuucuccuugaaaaucucagugauaacaguguucaccguucuguaaaaccacaaauccuaucaacuuuuggagauguugcauuaagcauuggugcugauuuuaaaaaguacuuggauguaguacuucacacacuuaugcaggcuucucaggcacaaguugauacgagugacuucgacaugguugauugguuaaaugaauuaagggaaggaauuguugaagccuacuccgguauuauucagggauugaaaggggaagauaacaacacagcugc

SEQ ID NO: 5325 - RNA, 718 nt, Piezodorus guildinii
gauggaugcaauggucaaagagauguugcauaaaaaaucaaguuaucgugagcaaauuaacucagaucacagacucaagaugcuucuugaucaguauauggagagcacucacaaacucaaggaacuguaugaagacaaggaugguauaaggaaagaugaaguugcugcacuuucagguccaaaugaauuuucugaauuuuauucaagguugaagaccauuaaagaauucuaucguagaauuccuaaugaaauuucgguuccuaugucuguugaauucgaggaguuagcgaaacuucgagaaaauccuacugaagaaacaucaaauuuaguagaauuuacugacgaagaaggauauggaaaauaucucgaucuucaugaauguuaugagaaauauaucaauuugaaaggaguugagaaaguggauuauaucacauaucuuacuacauuugaucgacuuuaugaaaucccaaaagauagaaagaguucugaguacaaacgauauguuauaaugcuccugaauuaucuuugugauuacaucgcuaggaucaagccacuacuugaccucgaccaggaauuaacuaauguucaaaaggacuucacaucacagugggaagcuggaacuuucccugguuggccuaaagaaacaggcaguguguuaagcaauguuggugcccaucuugacuugagugcauuuucaucuccugaagaauuggcuucu

SEQ ID NO: 5326 - RNA, 487 nt, Piezodorus guildinii
uugcaagauucaaggacauucauaggcaccuuuaaagcauuugauaaacacaugaaucuuauucuuggagauugugaagaguuuagaaaaauuaaaccaaaaaauaccaaacagccagagcgagaagaaaagaggguauuaggauuuguauuacuaagaggugaaaauauuguuucacuuacgguugaagggcccccaccuccagaagaaggauugccuagaguaccucuuccuggagcagguggaggaaucgguacggcaagaccugcuggacguggaguuccagccccugguacuccagcugcaccuggucuucaaggaccaguucgugguguuggaggcccaucugcacaaguuaugacuccagcugggcgaggcggacaaguuucagcaccuccucaaaugcgugcuccaccuccaggaaugcccccaaugaugggagcucccccaaugaugaauauggcaccuggaauggcaauggguagag

SEQ ID NO: 5327 - RNA, 736 nt, Piezodorus guildinii
uuugggccaaagauuuguuccuccaacgucccaggguuagagaaaccggaauuuccgaaguauuagaaagugaugauuuuaaacuuaugaggauuacgccugaugcauuuuauaaguuacuuaagauggugcggccuuuaauuaagaaaaauaauacuguuaugagagaagcagucacugaggaggaacgguuaauuauuacucuuaggcauuuagcuaccgguaagagcuaugcugauuugcaaaacaguacugcaguuucuccaucgcuuaugacuucaguuauuagagaaacuugugacgcuauuuaucucagucucaaaaguggaauaaagaugccuacuacagaacagcaauggcuugaggucgcugaugguuuugaaaagaaguggaacuucccgcauugccugggcucuuuugaugggauacacguggcgauaaauaaaccagcgcauagcggugcaaucuuucucaacuacaaaggauauccaagugucguuuuguuggcacuuguugaugccaauuaucaguuuauguauuuaaacacuggugcaaaugggagugcaucagguucaacuguguucgaaaacacuauuuuuuaccaaaaauaucugucaggaaagcuaaacuuaccuaaggacaguccacuaccugguauggaagaaaaaguccccuauguuuuucugggagauugugcauuuucccuugaugaaaauuguaugaacacauuuccggu

SEQ ID NO: 5328 - RNA, 737 nt, Leptinotarsa decemlineata
uuuugucaacauucguguggaauaaaaaauuaucaaaggaaggacuaauaggugucagccacgaagaaauagaagcaagaaacagauucaagcaagaagaaaauaaaagagaacuugagaaggucaagaagagaagacaagaaagagaauuagaaagacaaaagagggaagaagaaacacaacuuuuacagaggaguaaagaagcggcacaauuugaggagugggagcgucacgaagaucaguuucaucuagaacaagcucgauugcguucucacauucgaauucaggauggaagagcgaaaccuaucgaccuccucgccaaauauauaagugcugaagaagaaguggaugcgguagaaaugcaugagcccuauacauaucuuaaugggcuacauauuaaagaucucgaggaucucguagaagauauaaaaguuuauaaagagcuggagagaggaaaaaauuuggauuacuggaaugacauuacugucauuguggaagaugaauuacaaaaauugcgaaaacuagaaaaacaagacgauuuugauauggguuugaacagacgugaaggaauucaucaagcaguugcaucggauguuacuuccauauucaaagggaaaacagcaguucaguuggcagcuuuggagaaacaaaucgaggccaaaaucaguaguagagcagauggaauugauauuggauauugggaguccuuguuaucucaguugaaagcucauauggca

SEQ ID NO: 5329 - RNA, 686 nt, Leptinotarsa decemlineata
ggugagguuggucaaguauuaucauucaaacuugucuuugaucgugaaaccgguaaaccaaaagguuauggauucugugaauauagggaucaagaaaccgccuugagugcaaugagaaauuugaauggguaugaaauaggaggucguaacuugagaguugauaaugcuuguacagaaaaaucuagaauggaaaugcaaaaucugcucaaucagccaccuguagaaaauccuuauggggagccuauucaagcagaaaaagcaccugaagcaauaaguaaagcuguagcuucucuaccuccagaacagauguucgaguuaaugaagcagaugaagacaacaauucagaauaauccaacagaagcaaggcagaugcuuuugcagaauccucaacuggcuuacgcucuucuucaggcucaaguuguaaugaaaguuaucgauccgcaaacagcagcuagccuauugcaucccaucaaucaaguuccagcgacucugaugccuggugauaagaauguuccaguucagguuccaauuagcaaucaauauagagaaccuccugcaccaguacagccgcccaggcaagaauuucagccaguaccagcgccaguuuuacauccaagugcccagccuucaguguuugcaggucaagacauagaucuaagaucuauuggaggcucaacagaucuaag

SEQ ID NO: 5330 - RNA, 523 nt, Leptinotarsa decemlineata
guuuccagugcaauuguugauaaauacauuggagaaucugcuagauugauaagagaaauguuuaauuacgcuaaagaucaccaaccuuguaucauuuuuauggaugaaauugaugccauagguggccgcagguuuucugagggaacuucagcugacagagaaauucaaagaacccugauggaacuucuaaaucagauggacggauuugauucauugggacagguaaaaaugauaauggccacuaauaggccugauacauuggauccugcuuugcuccgcccaggucguuuggauagaaaaauugagauaccucuaccaaacgagcaagcaagacuugaaauucuuaaaauucaugcuuugcccaucgccaaacauggugaaauugacuacgaggcaauugucaagcuaucugacuccuucaauggagcagauuugagaaauguguguacagaagcaggguuguuugcaauccgggcagaaagagaauauguaauucaggaagauuucaugaaggcagugagaa

SEQ ID NO: 5331 - RNA, 634 nt, Leptinotarsa decemlineata
gcaauggaagcuauaucccaugcugguaccugucucgguauuuuagcuaaugaugggauuuuauuagcagcagaaagacgcaauacaaauaaauuauuggaugagguguuugcuucugaaaaaauauauaaacugaaugaagauaugguguguaguguugcuggcauaacaucugaugccaauguuuuaacuaaugaauugcguuugauuggacagcgauauuuauuccaguauggagaaucuaucccuugugaacaguuaguaucaugguuaugugaugucaaacaggccuacacucaauauggaggaaaacguccauuugguguuucaauauuauauauggggugggauaaacauuauggauaucagcucuaucaaucugaucccaguggcaauuauagugguuggaaagcaacuuguauuggaaacaauaguucggcugccauuuccaacuugaaacaggaguauaaagaaggagaaaugacacuaaaggaugcaaaaucucuggcuauaaaaguucuugucaaaacuuuggauauggcuaaacuuacuucagaaaaaguggaaauggcuacuuuaucacgugugaauaauaaaacaguaaucaacauuuugagcaguacagaaguggaaa

SEQ ID NO: 5332 - RNA, 677 nt, Leptinotarsa decemlineata
auuugggaaaacaggaagguauagauacuauuauugccacuuuggaagucauaccugaaccuuuccggucgauggcuacaacaaugguggacauuugugccuacgcuggaacgggaaacguucucaaaguucagaauuugcugcacauuuguucagagcauuaugaaggcucugauagcaccgacaaaagcuccaaagauaaggacaaaaaggaaacuguuaaagaaaaagaucuaucuaccaggcaggcuguagccguacuugguauugcauugauuagcaugggggaagauauuggcagugaaauggcuuucaggacauuugggcauuuacuucguuauugugaaccagcgauucggcgagcuguaccucuggcuuugggacucaucuccguguccaauccaaaguugggcauucucgacacccucagcaaguuuucacaugacagugaugcagaggucgcccacaaugcuauuuucgccaugggauuggucggagcugguacuaauaaugccagacuggcagccauguugaggcaguuggcacaauuucaugccaaggacccaaacaauuuguucaugguucgcaucgcucaagggcucacucaucugggcaaaggaacacuuaccuuaaguccuuaucacagcgauaggcaacugaugaguccuguagcugua

SEQ ID NO: 5333 - RNA, 682 nt, Leptinotarsa decemlineata
ugacuuggaacaucaaggagacuacacuaacuugcagacugcucaguacaauaacggauacaccgaugcuucgcaguauauggaacagcaucaguaccagacccuguacacugagagaggagccguggauaguucuccaccgguuuuguauaggaacgaucccaauuuggggucuucuagguaucaaggcgacuacgaaccguccacgcaaacccaagucagccuccucaacccguccagcgaaaccgucuacuccacauuucccuccacgagcagcgccaccuaccaccaguucuaccagaauaaccccaacguccugcacccagcggacagcacccaggcguaugggggggcguacgugaauacggccugguccaguggcggcggcuuggacgacgggcaccgggccagucaagagaucggaaacagacgaaacggaguucagugugccaacugcaagacaaauacaacaacucuuuggcgacgaaauaaucaaggggaaccaguauguaaugcauguggacuauacuucaaauuacacaauguuaacaggccgaucaguaugaaaaaagaaggcauccagacacguaaacgaagaccaaagaauucuuccagcguuucuagcgcaggagcaucgaaucaaguuagauuggcaccuuauauggguuaccuacaaguuucg

SEQ ID NO: 5334 - RNA, 691 nt, Leptinotarsa decemlineata
uuacacuuugaagaggcucccaauuuggaaaaacaagauacaggucucuuaagcucauuauauuccuacaugguuucagcugaaaaucucucgaaaguaccaacaccugaggaacaauauuuuauugaaauaaccaaagaauguauaaaagauuguaauuuggaucaguugauaaccgacucuaaauuucuccaugaaaaugcucuucuggaaaugguuaaaacuuugauagaguuauccagaggaccugacauucaagaaagccugggguacaacuauaaucagaauguaacaguguuuuucuuggaacuccuuauaaaaauuguuaugcaaaauagagaucgaguaaugucaauauggcagaauguacgagaccacauauauacuauuguaaugaaugcaucucuguuugauuaccaguuccuucuggagaggucaguaauaggauuauuacgaauagcuauacguuugaugagaaacgaagaaaugagucauauaguucugcagucacuucgaaugcuucuucuguugaaaaguaguacauuaagcagaauaucccgacagaucucguuuggauuauuugaauuauugaaaacuucugcccagaauauacauacuaauacugacuggacgauuauuuucacacuucuugaaugugucggagcaggagcccaaccaccuaagccuauuu

SEQ ID NO: 5335 - RNA, 286 nt, Leptinotarsa decemlineata
ggagcagauacacgucuaagcgccggcuucuccaucuacacuagagaccaaaauaaguuguuuccucuuucaaaaacaacgguucucggaugcucagguugcuggugugacacgcuaacguuaacucguauuuugaagucucgcaugcagauguacgagcaagagcauaauaaagugaugucgaccacugcuugcgcgcagaugcucuccaccaugcucuacuacaaacgcuuuuuuccuuauuacaucucuaacguucucgugggucucgacaacgaaggaaaag

SEQ ID NO: 5336 - RNA, 665 nt, Leptinotarsa decemlineata
gcucuaccagaagaacaacaaggaacugacggaacuauucaggccguauguugaacgacugauaacagcgcucugcaggcacugucagauggagccagacugcgagggccugcuugaggagggagacgaguucaaagauuuccgauugaagguaucugaucugauuagagacgucgucuucauugucggcagcagcaguugcuucaggcagauguucaucaaucugcaggcacccggcgugacgugggauuccagugaagccgcccuuuucgugaugcaggccguggcgaaaaacguuuuaccgacugauaacgaaguaauuccgaaugugguggaagccauccugaacguccccgagaacacucacaucgcugucaaauauacgucaguguugcugcucggcgagcuaugcgaguggaucgaaaagcacccgaacacgcuggaccccauccugaacuuccucgugugcuguuuaccccaagcagguauuggcgcugcagcugcuguagcccugcagaacaucugcgcuagcugcaaugaucauaugccgaggcacguucccauuuuacuacagcuacuguaccaagucgacacguucgccauaacgaacaacgccgucauuggucuccugaaaggcgucgccucuauaguagguaggaugccgg

SEQ ID NO: 5337 - RNA, 674 nt, Leptinotarsa decemlineata
aggacuuauauggcccugauaaucaccuaguagaguggcacaggacucuuacaacacaagaaacugauggguuccaaguaaagcguccaggugauaaaaaugucaggugcacaauucuccuauuauuggacuaucagccuuuacaauucaaacuagauccuagacuagcucgccuucuaggaguucauacucaaacuagaccaguuauuauaucugccuuguggcaguauauaaaaacccauagacuucaagaugcucaugaacgugaauacauuguaugugaaaaauaucuugaacaaauuuuuaauuguucucguaugaaguuugcugaaaucccucagcgucugaauccuuuguuacauccaccagacccgauuguuaucaaucacguaauaucuguugaagguggcgcagaaagcaaacaaacugcuuguuaugauauugauguagagguggaugauacucugaagaaucaaaugaauaauuuucuuuugaguacagcgagucaacaagaaauacaaggauuagauucaaaaauucaugaaacuguggacacuaucaaccaacuaaaaacaaauagagaauuuuuccugaguuuugcuaaggauccacaacaauuuauucauaaauggauuguaucucaaacuagagaccucaagacaaugaccgauguu

SEQ ID NO: 5338 - RNA, 302 nt, Leptinotarsa decemlineata
acgaauuggagcagaaaaugcgagaagccgagacugaaucccacgaagggaaaagaaagaacgaaucuuuguggccaauuuucaagauccaccaucagaagucccgguauauuuucgaccuguuuuauagacggaaagccaucagcagagaacuguacgaguauugcuugauggaaaacaucgcugacaaaaaccucaucgccaaguggaagaaacaaggguaugaaagucuuugcuguuuacgaugcauccagacgagagacacaaauuuuggaacaaacuguauaugcagagucccgaag

SEQ ID NO: 5339 - RNA, 753 nt, Leptinotarsa decemlineata
ggauaagagauguuugggcacacaauuuggaagaugaauuucgaacaaucagacaaauuguucaaaaauaccaauacguagcaauggauacagaguuuccuggaguuguugcgagaccgauuggggaguuccguaguucagcagauuaucaguaccagauguugagguguaauguggauuuacucagaauaauacaacuuggacuaacauucuuggaugauaauggaaagacaccaggaggaucauauaccaccuggcaguucaauuucaaguuuaauuuacaggaagacauguaugcccaggacaguauagaucugcuucagaauucuggcauucaauucaaaaaacacgaagaugaaggaauugagccucucgaguuugccgaguugcuaaugucuucugguauugucuugauggagaacauaaaaugguuauccuuucauucuggcuaugauuucggauaucucauaaaacuauuaacggauaacaacuugccacaagaugaaaaugaauuuuucgauuuauugaaguuauauuucccaacuauauacgaugucaaguaccucaugaaaucuugcaagaaucugaagggaggacuacaggagguugcggaacagcuagaacuugagagaauuggaccacaacaucaggccgguucggauucauuacuaacaggaauggcauuuuucaaaaugaaggagauguuuuucgaagacaccaucgaugacuccaaguuuucuggccaucuuuacg

SEQ ID NO: 5340 - RNA, 793 nt, Leptinotarsa decemlineata
ucugguacugguaaaacugcaacguuuucaaucuccauucuacaaucucuagaucuuacaaugagagaaacucaaguuuuaugcuuguccccaacuagggaauuggcaguucaaauucaaaaaguaauucuagcuuuaggagauuuuaugaauguucaaugucaugcuuguauugguggcacaaauuuaggagaagacauaagaaaacuagauuauggacaacaugucgucaguggaacaccaggaagaguguaugauaugauucguagacgagcacuacgaacuagaucugugaaaauguugguauuagaugaagccgaugaaauguugaacaaaggauucaaagaacaaauuuaugauguuuaucgauuucucccacccucuacacagguuguuuugauuucugcaacuuuaccucaugaaauuuuggagauaacuucuaaauuuaugacagauccaauucguauacugguaaaacgugaugaauugacucuggaagguaucaaacaguucuucguagcuguggaacgugaagaguggaaauuugacacucucugugaccuuuaugauacucuuacuauaacucaagcuguuauauucuguaauacaaaaaggaagguggacuggcugacagaaaaaaugagagaaaacaacuucacugugagcgccaugcauggagauaugccccaaaaggagagggacaacaucaugaaggaguucaggucaggacagagcagaguucuuauuaccaccgauguuugggcccgaggaauagacguucagcaaguuaguu

SEQ ID NO: 5341 - RNA, 787 nt, Leptinotarsa decemlineata
agcuggagaugguacuacauccguugucguuauugcuggagcauuauuagaugccgcagagaaguugcuacaucguggaauccaucccacugcaauuucugagucauuccaaagagcagcagugcuagcucuugagauauugaaugaaauuucaacuccuguugagauuacaaacagagaagaacugauaaagagugccucaacuucucucaacuccaaaguugugucacaacaguccagccauuuagggccuuuggcaguagaugcaguacucagaauaguggaaccuggacgcgagcaggcuuguaaucuuaacgauaucaaaguuaucaagcaauuagggggaacuguagaagacacagaguuagucgaaggaaucguguucccucagagaucuucaaauguuucugggccaaaacguauugaaaaagcuaagauuggauucauccaguucugcauuucaccucccaaaacagacauggaccacaacguuauugugucagacuacgcugcaauggauagaguucugaaagaagaaagagcuuacauucugaauaucguuaaacaaauuaagaaagcuggaugcaacguucuucugauccaaaaaucuauacugagagaugccguauccgauuuagcacuacacuuuuuggacaagauaaaaugcaugguaaucaaagacaucgagagagaagauguggaauuuguuuguaaaucucuagggugucgcccuauugcgucguuggaucauuuuguagcugaaaaucuggugucagcugaucuagua

SEQ ID NO: 5342 - RNA, 772 nt, Leptinotarsa decemlineata
guccacuacagguuccaauuacuuuguucguauucucuccacaaucgaucgggaacuuuugaaaccuucagcaaguguugcucuucacaagcacaguaaugcacuugucgaugugcuuccuccagaagcagauuccuccauaaguaugcugcaagcugaugaaaaaccagauguacaguauagugauauuggaggaauggauaugcagaaacaagaaauuagagaggcaguugaauuaccacuuacucauuuugagcuauacaaacaaauugguauugauccaccuagagggguguugauguauggaccuccuggauguggaaaaaccauguuggcaaaggcuguugcccaucauacaacagcugcuuuuauccgaguagugggaucugaauuuguucaaaaguaccuuggagaaggaccccguaugguacgagauguguuucguuuggccaaagaaaauucuccugccauuauauucauugaugaaauugaugcuauagcaacuaagagauuugaugcucaaacuggggcagaucgugaaguucaaagaauuuuacuagaguugcucaaucaaauggaugguuuugaccaaacuacaaauguuaaaguuauaauggcaacaaauagagcagacaccuuagauccugcucugcucagaccuggucguuuggauaggaaaauugaauuuccucugccggaccguagacaaaaacguuugauauucagcacuaucacaucaaaaaugaauuuaucugaagagguggauuuggaa

SEQ ID NO: 5343 - RNA, 352 nt, Leptinotarsa decemlineata
gcaaaaugcucaguaaccaucaaaacaauguuggaagaucucggcauggacgacgaggacgaagaaguugugccuuuacccaaugucaacucugccauuuugagaaaagugauucagugggcuaccuaccacaaagaugauccuccaccaccagaagaugaugaaaacaaagagaagcgaacagaugacauaucuucuugggacgcagacuuccugaaaguggaccaagggacuuuguucgagcucauuuuagcugcgaacuaucuggauaucaagggacuucuggacguuacaugcaaaacuguugccaauaugaucaaaggcaaagcuccggaggaaauucgcaaaacuu

SEQ ID NO: 5344 - RNA, 745 nt, Leptinotarsa decemlineata
ugauaaggcguccuguaaagaacuggaucaguggauagaacaguuaaaugacugcaagcagcuaacagaaaaucaagucaaaacacuaugugauaaggcaaaagaaauauuaucaaaggagucuaauguacaagaaguaaaaugcccggugacgguguguggagacguccaugggcaguuccaugauuuaauggaacuauuuaggauaggugggcgaaguccggauaccaacuacuuguuuaugggggauuauguugaucguggauauuacucugucgaaacagugacuuuguuaguagcccucaaagugagauauaaagagagaaucacaauuuugagaggcaaccacgaaucucgacaaauuacucaaguguauggcuuuuaugaugaaugcuuaagaaaauauggaaaugcuaauguuuggaaguucuucacugauuuguuugauuauuuaccccugacugcacuuguugacagccagauuuucugucuacauggugguuugaguccuagcaucgauacuuuggaucacauuagagcccuagaccguuuacaagagguuccccaugaaggcccuaugugugaucugcuauggucugauccugaugaucguggagguuggggcauuuccccaagaggcgcugguuacacuuuuggacaggacauuucugaaaccuucaaucauagcaauggucucacccuuguuucucgagcacaucaguuggucauggaggguuacaauugg

SEQ ID NO: 5345 - RNA, 206 nt, Leptinotarsa decemlineata
cuucacuugguucuucgacuccguggugguaugcagaucuuugucaaaacucuaacuggaaagacaauuacuuuggaaguugaaccaucugacaccaucgagaauguuaaagccaagauccaagauaaggaaggaauucccccagaccaacaaaggcuuaucuucgcuggaaaacaacuggaagauggccgaaccuuaucagauua

SEQ ID NO: 5346 - RNA, 692 nt, Leptinotarsa decemlineata
cuagauauuguccacccagcugcuaaaacucuaguagauaucgccaaaucucaagacgcugagguaggugauggaacuacaaguguaguacuauuagcaggggaauuuuugaagcaaauaaagcaguacguagaagaaggugugcauccuagaaucauaaucaaagcugugcgccagucgcugcaaaucugucucgauaaaauaucugaauuaucuguaaaaguaaacaaguccagugcugaggaguucagaucauuacuggaaaaaugugcagcaacggcaaugaguuccaaguugaucaaucagcagcgugccuucuucucuaaaauggucguagaugcaguuuuacuguuggaugacuuacugccacuaaacaugauugguaucaaaaaaguucaggguggggcauuagaagauucaauguuaguugcaggcguugcuuucaaaaaaaccuuuucauaugcuggauuugagaugcaacccaaaguuuacaaaaauuguaaaauugcucuucucaauauugaacuugaacucaaagcugaaagggauaaugcagaaguaagaguggauaauguuaaggaauaccagaagauuguggaugcugaauggaauauauuguacaauaaacuacaaaaaauucaugaaucuggagccaauguuguacuaucuaaacuaccuauuggagauguggc

SEQ ID NO: 5347 - RNA, 678 nt, Leptinotarsa decemlineata
caugcuguugaugacuuguccuugaaacaauauucaaaucuucauauuugggucagcaggcuggaugaggagguugagaaaaauuuagcucgccgccuucaagcugguauugaagcauggacugaugcuuugaguggucagaagaaagauauagaucacagcauggacaccgaugccccagugcaaccuacacacaaacccgggggcgauccacaaauacaaauugugauucaugaaguucgaauaaccaaucagaccauguaccuauauccgagcauagaagaagcucgauuccagauuaugcaacagcuguuugcuuggcaagcuauuguaacuucacagcaacgacuucaaagcagucgauaucaagugggaguugauaaaccagugacugaaaccuaccggaauaucuugacaaaacuucccggaggaccacaaccucugaauaaugcuuauagugccaucgcuuccaaaauaaaagaggugcaaaaauauguuaaugaaugguuaaccuaccaaucuuugugggaucuucaagcugaaaaccuuuauggcaaacuaggugaagacaucaguaaauggauggagugucugaaugauaucaagaaaacccgaacuaccuuugacacaucagauacucgacgugaauuuggacccauugugauagacuucgccaaa

SEQ ID NO: 5348 - RNA, 735 nt, Leptinotarsa decemlineata
uggaaaugaagugggguaugcuaucagauuugaagacugcacuuccuccagaacuguuauuaaauauaugacugaugguacguuacacagagaauuuuuaucagagcccgauuuacagucauauaguguuaugaucauugaugaggcccacgagagaacacuacauacagauauuuuauuuggccuuguuaaggauauugccagauuucgaccagauuugaaguuguugauuucaagugcuacacuagauguugcuaaauucucagaauuuuuugaugaugcaccuauguuucaaauuccaggaagaagauuuccuguagauauauauuacacuaaagcaccagaggcagauuauguagaugcauguguuauaucaguguugcaaauacauguuacacaaccucugggggauguuuuaguauuuuugacuggucaagaugaaauagaaucaugucaagaacuacuucaggaucgaguucgaagauuagguucgaaaguuaaggagaugauuauuuuaccuguauaugcuaauuuaccgagugacaugcaggcaaaaauuuuugaaccuacuccuccaggauccagaaaaguuauacuggcuacaaauauagcagaaacuucuuuaacaaucgauaacauaauuuauguuauagauccaggauuugcuaagcaaaaccauuuuaacucacgaacaggaauggaaaguuuaaugguagugccaauauccaaagcuuc

SEQ ID NO: 5349 - RNA, 655 nt, Leptinotarsa decemlineata
ggaugaaucaggauuugccauacaaucagcagcagguuuggucggccaagaacaagcaagagaggcagcaggaguaguaguggacaugauaaaaaguaaaaaaauggcugguagagcagugcuccuagccggaccaccaggaacaggcaaaacugcuauagcuuuggccauugcacaggaacuuggaaauaaaguuccuuucuguccaaugguagguucugaaguuuacaguucagaaauuaagaaaaccgaaguccuuauggaaaacuucaggagagcgauuggguuacggauuagagaaacuaaagagguuuaugaaggagaaguuagcgagcuaacaccaguugaaacagaaaauccuucaggagguuauggcaaaaccgucagucaugucauuauuggguugagaacagccaaagguaguaaacaauugaaacuugauccuagcauuuaugaggcacuucaaaaagagaaaguagaaguuggagauguuaucuauauugaagccacaaguggagcuguuaaaagacaaggaagaucugaugcauuugcuacugaauuugaucuggaagcugaagaguaugucccccuuccgaagggagauguacauaaaaaaaaggaagucguucaggaugucaccuugcaugauuuggau

SEQ ID NO: 5350 - RNA, 674 nt, Leptinotarsa decemlineata
uacaguugugucacacucagggagaguugagcaaaguuuccaguccaaagguugugcuugcuaguucagcagauauggaaaguggcuacuccagggaacuguuccuacagugguguucaaauccugccaacaguguuauuuugaccacaaggacaucuccugguacucuagcuagagacuuaguggauaauggaggagagaggaccguagauuuaacaguagaaaagagagucagguuggaaggagcagaacuugaagaauacgagaaacgacagagagaaagaugugaagacgaugaaaccaaagaagaaggugauucagauucugaugaugacauugagaugucagucauuucgaaaggcaggcacgacauugucauaaaacaggaaggcaaaauuucuacaggguuuuucaaaguaacaaaaaaaauguauccgauguacccauuccacgaggaaaaagucaagucugaugaauauggagagaucaucaggccagaagauuauaaauuagcagaugugccuuuagaaggagaagauaauaaagaaaacuugguaguuaaaaaagaagaagaggaaauaacugagaucccggagaugccaaccaagugcauuguucuucaaaggacuguccaggucaauugucaagugcauuauaucgacuuugaaggucgg

SEQ ID NO: 5351 - RNA, 725 nt, Leptinotarsa decemlineata
agauguuaggaaggacgagaaaguaauuugggauggacacacgaguaguguggaaacugcuacuagagcugcuagagcuaacauaacacuggaagaacagauacaccaaauccauaaggucaaaggauuacucccugaugaagaaaaagaaaaaauuggccccaaaaauauagggucaaaaucuggcaagaucaacauucagaguguaauaacuacaaaaccaccaaaucaaccaccgccaccuaagccucagguuucucucauucagacgcaaccggcuccuccaauggcuauaccuguaccuccccaaccuacuaugauggcuacgcaaccaccaauaaugaugaugacugcuccuccuaugccuccaaugagaccuccuccuauaaugauggcagcaccaccuccuauggccagcuuuguuacuccaaugccuccuccuaugggacagccaaugggaaugccaaugaaacauccaaacgaugguauguuagaugaugaaccaaguaauaaaaaguugaggaaugaagauucucuuguacccgaagaaguauucaugacaagaaauccagguccagugucuaucaagguaacaauaccacuuuugccugagaagucugaauggaaauuaaccggacaggugaugagccucacauuacccuugggagaaaguguggcuaauuugaaggcaaaggugcaggaagaaacaaauaugccaccagcua

SEQ ID NO: 5352 - RNA, 720 nt, Leptinotarsa decemlineata
gcuuugcaguuccuuuugaugaagaugacaaagauaaauccgugugguuucuggaccacgacuaccuggaaaauauguauggaauguucaaaaaaguaaaugcuagggagcgagugguagguugguaccacacagguccaaaauuagaccagaaugacauagcaauaaacgaacuaauuaggagauacugucccaauucuguguugguaauaauugaugccaaaccgaaggaucuaggccucccaaccgaggcauaucaagcuguggaggaaguccacgaugauggaucgcccacuuccaaaacauuugagcauguaccuagcgaaauaggggcggaagaagcagaggaggugggaguggagcaccuucugagggauaucaaagauaccacaguuggcacguugucucaacgaauaaccaaucaacucuuagguuugaaaggucugcaccugcaacugcgggaaauccgagacuacuugauacaagucuccgagaacaaacuaccaauuaaccaucaaaucauuuaccagcugcaggauaucuucaauuugcuucccgauauuaaccaagccacuuucaacucauccuucuauauaaaaaacaaugaccaaauguugguugucuaucuugcugcuuugguuaggucuaucguggcuuugcacaauuugaucaacaacaaacuuaccaauaaagaugcagaggagggaaagaaagaagagg

SEQ ID NO: 5353 - RNA, 744 nt, Leptinotarsa decemlineata
uugaaaggugugauggucaacaaggacgugacacauccaaaaaugaggagauauaucaaagauccacggaucauucuuuuggacugugcacuggaauacaaaaaaggagaaucucaaaccaauguugaaauuacuuccaacauggauuucucaagacuacuggagcucgaagaggaacacgucaaacgucagugcgaugacauuaucgcccucaaaccugauguagucuucacagagaaagguguuuccgaccuugcccaacauuuccuucucaaagcuggcaucacugccauacgacgaguucgcaaaucagacaauaauagaaucgcaagagcuugcggagcuaccaucgucaacagaacggaagaauuacaggaauccgauuuaggauugggagcugggcucuuugaaaucaagaagauuggagaugaauacuucuguuucauugucgaauguaaggaucccaaggcuugcaccauauugcuacguggcgcuagcaaagauauccugaacgaaacugaaaggaaucuccaagacgccuugcaaguagcgagaaauauaguucuguccccaaggcugguuccuggaggaggugccaucgaaauggcgguagcccagcgauuauugcaaaaggcuagucaugguccuuacagggcuuuagcgcaugcuuuagagauaaucccucguacguuggcccaaaacuguggugcuaacacaauacguacguuaacgacucuaagagca

SEQ ID NO: 5354 - RNA, 286 nt, Leptinotarsa decemlineata; identical to SEQ ID NO: 5335

SEQ ID NO: 5355 - RNA, 719 nt, Leptinotarsa decemlineata
augaaagacaggacguugaaagaggaggaaaaauuaucaugccaccuuccgcgcuugagaagcugaccaggcugaacauaaauuaccccauguuauuuaaacuuguuaacaaaaaaacuaauagagucacucacugugguguuuuggaguuuguggcugaugaaggcaaaguuuaucuaccacucuggaugaugcacaauuugguacuugaagaaggagauuugguacaaauggaaaguguuucucugcccguuggaaccuucucaaaguuccaacccuugaauccagauuuucuugacaucacaaauccaaaggcaguguuggaaaauuguuugaggucuuuugcuugccucacuacaggggaugucaucgcaguuaaauacaaucagaaagccuaugagcuguguguacuggaaacuaaaccuggagacgcuauuagcauuauagaaugugacaugaacguugaauucgcugcucccguggguuauaaagagccugaacaaaggaagaaagaagaagaagaagccgcaguggauccugccgagcugaugccggagccuucuggguuuguugcuuuucguggaacuggaaaucguuuggacgggaagaaacgaaaagauuccacaucuagugauuucgcaucagccaaacccgucuaugucagagguauaccagauuaugacuaccaaaucgggacuuugaaauuuaucaggcgacca

SEQ ID NO: 5356 - RNA, 793 nt, Leptinotarsa decemlineata
aaauggaaggaaagguugguggaaaguuggaagacaguacacucguuaaaggaguggucauugacaagacaaugucucauccacaaaugccgaaagaauugaagaauguaaaguuagcuauccucaccugcccauuugaaccaccaaaaccaaagaccaaacauaaguuggauguuaccaauguugaugaauauaaggaacuacgacaguaugaacaagacaaauucaaagaaauaguuggauugguaaaaaauguuggagccacuuuggcuaucugucagugggguuucgaugaugaagcaaaucauuuauuacuucaacaggagcuuccagcagucagaugggugggaggaccagaaauagaacucauagcuaucgcaacuggaggacgcauuguaccuagauuugaagaguugagcccagagaaacuuggcacugcuggucuaguuagggaaauaucuuuugguaccacaaaagacaggaugcuggucauugaagagugcucaaauucucgagcugucacuauucucguacguggcggcaaucagaugcugguagcugaggcaaagaggaguuuacacgaugccuuguguguuguucgaaguuugguucaggaacccagaguuguuuauggagguggugcagcugaaauuucgugcagucuggcugucucugcccaagcagaucagcuugcuacucuagagcaauacgcuuuccgugcauucgcugaagccuuagaaagcauuccguuggcuuuggcagaaaacaguggauugucauccguucauguucu

SEQ ID NO: 5357 - RNA, 192 nt, Leptinotarsa decemlineata
uaaaaaguggaaugcuguggcauugugggcaugggauauugucguggauaauugugcuauuugucguaaucauauuauggacuuguguauugaaugucaagcaaaucaagcuucagcuaccagugaagaguguaccguagcuugggguguauguaaucacgccuuucauuuccacugcauuucaagaugguu

SEQ ID NO: 5358 - RNA, 668 nt, Leptinotarsa decemlineata
gcccaaaggaauggauaagauucuaguauccagcggaagaaaugcaggaucuguagaaguaacuaacgauggugccaccauucucaaaucugucgguguggauaauccugcugcaaaaauucucguugacaugucgaaagugcaagaugaugaaguaggugauggaaccacaucugucacaguuuuagcugcugaacuucuuagagaagcagaaagacugaucgaacagaaaauucauccccaaacgauuauugcugguuggaggaaagcuguugauguagccagaaaagcccugcgggaugcuucaauggauaacagcgauaaucucgaaaaauuccgugaagaucuguugaacauugccaggacaacucugagcucgaaaauucucucacaacacaaggaacauuuugcaaaacuauccguugaugcgguacucagguuaaagggaucaggagauuuacaagcuauccagcuuaucaagaaaacuggugguacucuggaagacucauuucuagacgaagguuucuuauuggacaaaaaaccaggaguccaucaacccaaaacaguggagaacgccaaaauacucaucgcaaacacucccauggacucugacaaaauuaaaguauucggcucccacaucaaaguugacucaauggccaaaauagcug

SEQ ID NO: 5359 - RNA, 676 nt, Leptinotarsa decemlineata
gcgucuucaucagguagaauaugcaauggaagccguuaaucuagguucagcgacuguagguuugaaaaguaaaacucaugcagugcucauugcucuuaaaagagccucuucggagcucucugccuaucagaaaaagaucaucaacaucgacgagcauauuggaauaacuauuucaggacucacugcagaugcuaggauccuuagucgauauaugaggaaugaguguuugaauuacaaauauucuuuagaugcccauaugccucugaauagacucauaagcacguuagguaauaaaaugcagcacuguacucagcgcuaugaccguagaccauuuggaguuggucuucuaguugcuggcuaugaugagucagguucucauaucuaucaaacauguccgucagccaacuuuuaugacugcaaagcuaugucaauaggugcuaggucccaaagugcgagaacuuaccucgaaaaacaccuagaugaacuuccuuccuguucccuggagcaacucgucaaacacgguuuacgugccuuaagagauaccuugcccccagagguagacuugacuacaaaaaauguugcgauugguuauguugguaagggacagccuuuccaaauauuggaagaaaaugaaacggcuccauauuuggcccugauugagggagaggaaagaaga

SEQ ID NO: 5360 - RNA, 718 nt, Leptinotarsa decemlineata
gcagcaugauauuccugagacugcuguccggguauucaggagguacuggaaacuguguccagaaaaugcugaggaauauguggacuaccucacagaaauaggucggcuugacgaagcugcccaaguauuggcaaaaauugucaaugaugaaaauuuugcuucccagaaaggaaaauccaagcaucaacucuggaacgagcuuugcgaacucauaucaaaaaauccugacaagauucguuccuuaaauguggaugcuaucaucagaggaggccugagacgcuauacugaucaacugggccaccucuggaacuccuuagcaaacuacuauguacgcaguggccuauucgaaagagcaagagauauuuaugaggaagcuauucaaacagucacuaccguucgugauuucacccaaguuuuugauucuuacgcacaguuugaggaauugagucucagcaagaaaauggaagagguugcuaaucaggcuaauccuacagaagaugaugauacagaucuggaaaugaggcuauccagguuugaaaaucucauggaaaggagauuacuguugcuuaacuccguacuucugagacagaacccgcauaacguccaagaauggcauaaaaggguccaacuguaugaagauaaaccacuggaaauaaucaacacuuacacagaagcagugcaaacuguggauccaaaacuagcuguggguaaacuucac

SEQ ID NO: 5361 - RNA, 743 nt, Leptinotarsa decemlineata
cggguaacuaugaugcaucagggauauggauucguugaauucaugggcgaagaagaugcugacuaugcuauuaaaauaaugaauaugauuaaguuauauggaaagccuauucgagucaauaaagccuccgcacaccaaaaaaauuuagauguuggggcuaauaucuucauaggaaauuuggauccugaaguugaugaaaaauuguuauaugacacauuuucugcauucggagucauuuugcaaacuccuaagauuaugagagauccagaaacagguaacuccaaaggauuugcauucauaaauuucgccaguuuugaagcuucagaugcauccauugaagcaaugaacggccaguaucucugcaaucgaccuauuucuguaucguaugcuuucaaaaaggacuccaagggugaaaggcacgguucugcugcagaacguuuacuugcugcucagaauccucucucacaagcagacaggccucaucagcucuuugccgaugcuccuccaauugguaugaugcccaugacgauagcuccaccaccuccuccuguuauuuuaacagggaugaugccaccucccacucccgcaaacaugcacccuccuccgccaccaccaguuccuccuccaaguggauuuccuucagguauaccgccuccuccauuaccaccaucccaaccaccguuaccuccgggagcuccuccuccacccccaauuucggccuccacuggaucuacaccuagacc

SEQ ID NO: 5362 - RNA, 641 nt, Leptinotarsa decemlineata
gagcaccaaaauugcguuauuuggacuuuucugagcgacauggauauauuaaaggugucguuaaggaaauaaugcacgaucccggccguggcgcuccauuagcuaugguucauuucagggaucccuauaaauuccaaacaagaaaagaguuauucauugcucccgaagggauguauacaggacaauuucuguauugcggaaagaaggcuaguuugcagauuggaaauguuuugccuguuggaaccaugccagaagguacaaucguauguaacuuagaagaaaagacuggcgaucguggucgucuugcaagggcaucuggaaacuaugcaacaguuauugcccacaaucaugacacaaaaaaaaccagggucaaguuaccaucuggugccaaaaaagucauuccuuccaacaauagggccaugguugguauuguugcaggggguggucguaucgacaaaccaauucuuaaagcuggacgugccuaucacaaauacaagguuaagcguaacugcuggcccaagguacgugguguugcuaugaaucccgucgaacauccccaugguggugguaaccaucaacacauugguaaagcauccacuguuaaaagagguaccucugcuggucguaagguuggucucauu

SEQ ID NO: 5363 - RNA, 269 nt, Leptinotarsa decemlineata
uacuaaagcagcucgcaaaagugcaccggcuacgggagguguuaaaaaaccucaucguuacagacccgguacuguugcucuccgagaaauucgacguuaucagaagaguacugaauuguugauuaggaaauuacccuuucaacguuuaguucgagaaaucgcucaagauuucaaaaccgauuuacgauuccaaaguucagccgucauggcuuugcaagaagcuagcgaggcguauuugguaggacucuucgaagauacgaauuugugcg

SEQ ID NO: 5364 - RNA, 660 nt, Leptinotarsa decemlineata
uggcugucaauauuucugcugcuaaaggaauccaggauguaaugaaaaccaauuugggccccaagggaacuguaaaaauguugguaucuggagcuggugauaucaaaauaaccaaggauggaaacgugcuguuacaugaaaugcaaauccaacacccaacagccucucuuauugcccgagccucaacugcucaagaugacaugacuggugacggaacaacaucuacuauucuugucauaggugaacuucucaaacaggccgauauuuauguugcugaagguuugcaucccaggauacuuacagaaggauuugauaaagcucgggcuaaagcguuagaaguguuggaaaaaaucaaaauuccuguugaaaucaacaaggaaaguuugaccgacguuugcaggacuaguuugagaaccaagguucaucaaaaacuugcugauguauugacagauguuuguguugaugcaguacuagcaaucaaacaaggcgauaaaccuguagaucuucauaugguugaauugauggaaaugcaacauaaaacagaaacagacacccaacucguuaaaggucugguucuugaucauggugcucgucauccugacaugccgaagagccuuaagaauuguuacauucuaacuuguaacgugagcauggaguaug

SEQ ID NO: 5365 - RNA, 767 nt, Leptinotarsa decemlineata
caguacucgaaccagaucaggcaguuguuguucaacuuuccuccggaucagcucacaaccaccggccaguuguucuggucggggccaaaacguugcccggaagcgcucacuuucgauaucaauaauccucuccauuuggauuacguccuugcggcugcuaauuugaaagcgcagguguaugguauuccgaccaacagggacagggcauauauugcugaaguggucagcaagguugagguaccagaguuugugccgaagucuggcgucaaaauagcuguuacagacucccaaauggccaugaacgguaacaacgucgacuuggaucgaguaacucaaauuaaagaggagcuacccuccgucgaagaacugaacgggcuccgucuuacuccgcuagaauucgaaaaggaugacgacaccaauuuccacauggauuucauuguugcugcuucuaaccuccgagcagcaaacuauaaaauaccucccgcagacagacacaagucuaagcucauugcagguaaaaucaucccggcuauugcuaccacgacauccgucguaggggggcucgucugcuucgagcuguacaaacugacacgaagcaugaagaguuuagaaccauucaaaaacggcuuugucaaccucgcgcugccuuucuuuggcuucuccgagccgaucgcggcccccaagauggaguacuguggcaacgaguggacacugugggaucgcuucgagguccaaggagagaugacgcucagcgaguucuuaacgua

SEQ ID NO: 5366 - RNA, 646 nt, Leptinotarsa decemlineata
gacuaccacugagacaacagcuaaugaagcacaaaagaaaggggucaagggcacuuacguauccauacacaguucaggcuucagagauuuuuuauugaaaccagaaauucuaagagcuauaguugacugcgguuuugaacacccuucagaaguucaacacgaauguauuccucaagcugucauuggcauggacauuuuaugucaagccaaaucugguaugggcaaaacggcaguguuuguucuggcgacacugcaacaauuggaaccagcggacaauguuguuuacguuuuggugaugugucacacucgugaacuggccuuccaaaucagcaaagaguacgagagguucaguaaauauaugcccagugucaaggugggcgucuuuuucggaggaaugccuauugcuaacgaugaagaaguauugaaaaacaaauguccacacauuguuguggggacgccugggcguauuuuggcgcuuguuaagucuaggaagcuaguccucaagaaccugaaacacuucauucuugaugagugcgauaaaauguuagaacuguuggauaugaggagagacguccaggaaaucuacagaaacaccccucacaccaagcaagugaugauguucagugccacacucagcaaagaaauc

SEQ ID NO: 5367 - RNA, 683 nt, Leptinotarsa decemlineata
aguguuuuggagauucgugagcaugccaggcaaauagagaaguccgucacuaguaaagaaaaccguuuuauucuaagaguucuacgguguuuacccaauacaagaagaaaacugaauggugucguucugagaagucuuaucaaucaaaucuauccagucuccgaacgugaagcucugcugaauuucacugaagaagcuguuggagauuuagacaccacccaggcaagggccagaucugccaccaaaucgccauuaccagagguugauacauauauaaauuuauugauuuugguucgucucaucgauaccaauaaacuacaagaagcagaaagguguucucaggcacuaaugaacaaaauaacaacucaaaaucgacguaccauagaucacauagcugccaaguguuacuuuuaucacucuagaguugcugaacuuucaaauaaacuugauacgaucagagcuuucuugcacucacgucuucguacugcuacgcuucgaaaugauuuugaaggucaagcaguucuugucaauuguuuacuaagaaauuaccugcauuacucguuauaugaucaagcagauaaacuggugagcaaauguguauuuccagagacggccagcaacaaugaaugggcaagauuuuuauacuauuuaggucguaucaaagcggcucgauuagaguauag

SEQ ID NO: 5368 - RNA, 669 nt, Leptinotarsa decemlineata
ugccaaagcccaauuauuugcuugggaagcauaugaaaaaggagucgacguccauuuacuggcugaaccgacaaaacuugagcuacuuaaaaaagaguaugagaaaaaaaaagaacaaaucaagaccaaaauucagagcaauguucuggaaagauacggaggugaggagcacuuagaagaaccuccuagaagucugcugcuugcucaaacagaagauuauauugaauacucaagaucaggcaaaauuauuaaaggagcugagaaggaggugaucaaauccaaguaugaggaggauguuuacauaaauaaucauacuucuguuuggggaucguauuggcguggaggccaguggggcuauaaguguugucauucauuuaucaaaaauuccuucugccuuggagaagccgguagaaauucggagauuguuaagccucacgagcugccagaaaguagaggugaugugaacgaagauauaccugaugauaagaaagggaauagugaucgagaugagagcagcuccaguucaucggacgaaaaaucuaagaagaagaaacagaaaagagaaaagaaaaaacucaagaaaaugaagaagaaacugaggcaagaaaaacacauaaccaacaaaauggaagaaacagaagaaaucauggaugagagaaaacgaccgua

SEQ ID NO: 5369 - RNA, 496 nt, Leptinotarsa decemlineata
gaaguuugaauuaggucgccccgcagcuaguacuaaacuaggaccucgcaggauccacuauguucguaccagaggugguaauuugaaauauagggcucuaaggcucgacacuggaaauuuugccugggguagugaaggaacugcgagaaaaacccguauuauugauguugucuacaaugcuagcaacaaugaguuggugcguaccaaaacauuagugaagaaugcaauaguuguuguagaugccacuccauucagaaugugguaugagaaucauuacauccugccuuugggucgcaagaagggagccaaacugacugccgaagaagaggcucuuuuagcgaagaaacguaguaagaaaguacaaaagaaguacgaaacucgucagaagacuucuaaaguagaaccugcuaucgaagagcaauucacaacuggaagguuguuggcuugcuuggcgucucgaccaggacaguguggaagggcagauggcuacauuuua

SEQ ID NO: 5370 - RNA, 702 nt, Leptinotarsa decemlineata
aauggggcuuauguuaggugaauuuguagacgauuacacagucagaguuauugauguauuugcgaugccacagacagguacagguguuaguguagaggcuguagauccaguuuuccaagcuaagauguuggacauguuacggcagacugguagaccagaaaugguggugggcugguaccauucccauccaggauucgguuguuggcugucgggugucgauaucaauacccagcaaaguuuugaagcccuuuccgaaagggcaguugcuguuguaguagacccaauucagucuguuaaaggcaaaguuguaauugaugccuucagguugauaaacccuaacaugaugguuuugggucaggaaccucgacaaacaaccuccaacuuaggacaccuccagaagccuucagugcaagcucucauucacgguuugaauaggcauuauuacucgauaaguaucaauuaucgaaaaaaugaacuggaacagaaaaugcuucucaacuuacacaaaaaguccuggauggauggccuuaccuuagcggacuaugcagagaacuguaguguaaaugaaaaaaccgugucugacaugcuggauuuggcuaaaaauuauaacaaagcucuggaagacgaggaaaagaugacaccggagcaacuagcgaucaagaacgucggcaaacaggauccgaaaaggcauuuggaggagaa

SEQ ID NO: 5371 - RNA, 677 nt, Leptinotarsa decemlineata
ucgucuacaagcacaaagaaaugaacuaaaugcaaaaguucgaauguugagagaagaauuaaugcugcuucaagaacaggggaguuauguuggugaaguaguuaaaccaauggacaaaaagaaaguccucguuaaggugcauccugaaggaaaauuuguaguagacauugacaaaaacauugacauuaaugaugugacaccaaacugccgaguugcauugaggaacgagaguuauacuuuacauaaaauuuuaccuaauaaagucgauccccuuguaucuuugaugaugguugaaaaaguaccugauucaacuuacgaaauggugggaggcuuagauaaacaaauaaaagaaaucaaagagguuaucgaauuaccugugaaacauccugaacuauucgaugcccuugguauagcacagcccaaaggggugcuucuuuauggaccaccaggaacugggaaaacucuucuugcuagagcuguugcucaccauacggaauguacuuuuauucguguaucugguuccgaguuaguucaaaaauucauuggagaagguucucgcauggugcgugaacuauucguuauggccagggaacaugcuccuucuaucauauucauggaugaaauugauucuauuggaucaucucgaauugaaucagguucugguggugauucugaag

SEQ ID NO: 5372 - RNA, 513 nt, Leptinotarsa decemlineata
uauacaagggcccuacuucagcuacaugguuaaaaucugcauucgaauugcaaacauuuaauuuuuuccaaagagggucuguccaagaguuuaugacuuuuuuuuguaaaaccaucguggaaagaaccauaccugcuucuagacagucagucaaggaaggagaauaucuguguaauguguauguccguucagauaauuuggcuggggucguaauaucggaccaugaguauccauccaggguaucacacacuuuaauaacaaagcuuuuagacgaguuugcagaaagaauaucaccugcaaauuggccuaaccuucaagagaaagauguggcauuuccacaaguuacuacuuauuuagcaaaauaccaaaacccucgagaggcugaugcauuaacuaaaauacaagaagacuuagaugaaacuaaaauaauuuuacauaauacaauucaggcgguguuggaaagaggggagaaguuggaugauuugguaucuaaaucagaaggauugagcaugc

SEQ ID NO: 5373 - RNA, 668 nt, Leptinotarsa decemlineata
aggacguuuauuccaaguggaauaugcuauugaagccauuaaauuggguucuacagcuauuggaauaugcaccagcgaaggagucguuuuagcuguugagaaacguauaacauccccguugauggaacccacuacaaucgagaaaauagucgaagucgacaagcacaucgguugcgcagugucuggccuuauggcagauucucgaacaaugauagacagagcccguguagaaugccagaaccauugguuugucuacaaugagaacaugaguguagagucaugcgcccaagguguguccaacuuggcuauucaguuuggggauucugaugaugacggagcggcuaugucuagaccauuugguguugccauuuuauucgcugguauugaugagaagggaccucagcuguaccacauggacccaucuggcacauuuguccaauucgaugcaaaagccauugguucuggcuccgagggggcucagcagagucugcaagaaguguaucaccgcaguaugacacuggaagaagcuaugacugcagccuugacaauucucaaacaaguuauggaagaaaaguugaacgcuucgaauguugaaguugccacgaugacuucaaaagauuuauuccacauguucacgaaagagcaaguggaagaggugcugaaaugua

SEQ ID NO: 5374 - RNA, 747 nt, Leptinotarsa decemlineata
aucucaccagcaaacagaauaauuugugcacaaauuauaaguuccacauuccugauuugaagguuggcacacuggaucaguugguaggucugucggaugauuuggguaaacuggauggguucguggaacaaguuacccgaaagguagcucaguacuugggggaaguauuagaggaucaaagagauaaacugcaagaaaaccugauggccaauaacaccgauuugccaaauuaucuaacgagauuccagugggacauugccaaauauccgauaaagcagucucuccguaacauugccgauauuaucagcaagcaggucggucagaucgacgccgaucucaaaaccaagucuucggcguacaacaacuugaaaggcagccuccagaauuuggaaaagaagcaaacagggaguuuauuaucucgcaacuuggcagacuuggugaagaaagaacacuuuauauuggauucggaauauuugcaaacacuccuaguuaucgugccaaaacagcaguucucggaguggaacgccacuuaugaaaagaucaccgacaugaucguaccccguucgacgcagcucaucacccaggacaacgaguacggacucuauaccgugacauuguucaagaaagucguggaggaguucaaacugcacgccagagaaaagaaguucaucgugcgcgacuuuauuuauaaugaggaagaguuggcugcgggcaagaaugaaaucacgaaacucgucacggauaaga

SEQ ID NO: 5375 - RNA, 767 nt, Leptinotarsa decemlineata
gauguuggagaaguaacggugacaaacgauggggccaccaucuuaagacuccuggaggucgaacacccugcugcuaggguguuagucgaauuggcacaacuucaagaugaagaaguuggcgacgguacuacuucuguuguugucauugcagcugaauugcugaagaaugcagaugagcuggucaagcaaaaaauucaccccacuuccaucauaagugguuacagacuggcuugcaaagaagccugcagguauauacaggaccgucuuaccauaccagucgaggaucugggaaaugauugcauuauaaauguugcgaaaacgucgaugagcucaaaaauuaucggagcagaugcagaccuauuuucauccauaguaguagacgcagcaaaugccaucaaaguaacggacucgagagguaaugcgauguaccccaucaaggcuguuaauguucucaaggcccaugguaaaagugccagagagagcuuccucauccaaggauaugcuuugaacuguacaguagccagucaagccaugccaaaaaaaaucguaaaugccaaguuggcgugcuuggacuucucccugcagaaggccaagaugaagaugggaguccagguguugaucacggaccccgaccaguuggaaggcauccgcagccgagaguuggacauaacgaaggaacgcauccagaagauccucucuacaggcgugaacgugguccucgucucgggcggcauugacgaccucugccugaaguacuucguggagag

SEQ ID NO: 5376 - RNA, 637 nt, Leptinotarsa decemlineata
accaagugaaacccaaugauuauuucacacauacucagucuccaguuacaacggcaacuucuaucgucgcaauugcguacgacaaagggguuuugauagcaggagaucuuuuggcuucuuauggaucuuuggcacgauauagaaauugucccagagugauugaagucaacuccaauauuauacugggagcugguggugauuacgcugauuuccaauaugucaaaucauucauagaucagaaaauaaucgaugaagaauguuuggacgaugguuugaaauucaaacccaagucaauguauuguuggcuuacaaggauuauguaccagagaaggagcaaauuugauccuuucuggaauaaucuugugauugguggaauucaggauggugaacccuuccuugggacuguagacaaacuaggaacagccuaugucgauaaggcaauuuguacuggauauggagcacauauugcacuuccaaugcuucgugacgcaauggauaaaaaaccaaaccucaaucaagcugaagccagagcccucguagaaaaguguuuggaaguuuuguucuacagagaugccaggagcuuucccaaauaucaguugggcaucauugauaaagaugaagguguuaagaucgaggg

SEQ ID NO: 5377 - RNA, 653 nt, Leptinotarsa decemlineata
agauuagcacaagagcaacaaaaaagagaaucaguuguagaaaaauccccgucucguucagcuucgauggaaucaccaaguuucaauccauucgaugagguagaagaggauacaggacugguucauccagaaugguuuauagauuuaccagaagaacuugauguauguguugcacaaagacacuuugaagaagcguugguuuuauuacagaaagccaaagauuauauuaaugagugucuuaccacgaaugaccaauuagaucacguaaugauugauauccaaaggaagguggaacaaagacaaaauaaucucacagaaguuuucaugaaggaacuugaaguuaaucccgauaaaucuuugcaaggugguuuacgagcagcaagaagagcagugagauuacuaaaucaguuaggaaggucaacgcagucuugcaaccuguuccucaaacuauguagcaguauguuaaaaaaucaauguaagaggguuaaaagagagggaucuacugcaaccuaugucagacaucuuucaaguguaguguuuacaaacaugugucacaugucugaagaauuuuugagagcauuucaagauucacccacuugugcuucagcauauguuaugugggccagcagugaauugucucuuuucacaaccca

SEQ ID NO: 5378 - RNA, 777 nt, Leptinotarsa decemlineata
guacuguuugggcuacucaagcaagcuguucugaaacgaaaggaguuaaaacugauugucacuucugcuacacuggaugcagucaaguuuucugaguauuuuuucaaagcuccuauuuuuaccauuccugguaggacuuuuccgguugaaguuuuauauacaaaagagccagagacugauuauuuggacgcuagcuuggugacuguuaugcagauucauuugagggagccgccuggugauauucuuuuguuuuugacuggacaagaagaaauugacacugcuugugagauuuuauacgagcgaaugaaaucuuuagguccugauguuccugaucuaaucauucuuccuguuuacuccgcacuuccuucugaaaugcagacacgaauuuuugaaccugcaccaccaggcagcaggaagguuguaauugcuacuaacauugcagaaacaucacuuaccauagauggaauuuucuacguuguagaccccggauucgugaagcaaaaaguuuauaauucuaaaacuggaauggauucuuuagucgugacacccauaucucaggcacaagccaagcaaagggcaggacgagcuggacgaaccggcccuggaaaauguuacaggcuuuauacagaacgggcauauagggacgaaauguugccaaccccgguuccagaaauucagcgaacgaaucuaacaaccaccguacuccaacucaaaacaauggguaucaacgacuugcugaauuuugauuucauggaugcaccaccaguugaaucacua

SEQ ID NO: 5379 - RNA, 798 nt, Leptinotarsa decemlineata
auugcugaggaaguuaccaggcaugaaacugggggaaacguugugauguauuguuccacuuucacugauaacaaacguucauauguaguagcaggucaggaagaucacugucaacuauaucaugugaauagugaacuugucagcgaagaaguugaaaauauugaucauaacucgcccgagacucgacaaagaaaaccgcaaaaaacugauaggaacaaaaauuugaaaaagaguuugaaguuugucaugaaacccagugauaguauacaaacugauuucauugguccagaaccucuaucuagaguagcuaggauacaucauaaugguaaacucauggccacaggaggaacugauggacacauaagauuauggaaauuuccgaguuugcaacccuuaaccguguugaaggcgcacgagaaagaaauugaugacauugacuuuagccaguuuggaaauuuucugauuacuguagcgaaggauggcuuggggauucuuugggacuguauuaaaggaaaagaauacaguagguugaauuggaaacagccugaagguuccaaauauuuguacaaacgauguagauuugguguaaucgaaggggaagauaaaaagucugcguuauauacaauauccaauccuacuggcguugcaaaaaaacagaaaucuuaucuucaacaguggcucccugaagauggacuacuaaaaaaaguugcagaauucgacgaaugucuuuccgcuuuggcaguuagagaugaugguagauuuguagcuguggguaccauguucagcggaucaguuuua

SEQ ID NO: 5380 - RNA, 672 nt, Leptinotarsa decemlineata
gauucuggaauccaccuuguugaaagaauugaaaaaguuggaugacaaaaauuuacugguagaaguacaguugcuugaaaguaagacauaucacgccuugaguaaccugcccaaggcucgugccgcauuaacuucagcucguacaacagccaauuccaucuauugcccuccuaagaugcaagcugcgcuugaccuucagucuggaguucugcaugcagcugaugaaaaagacuucaaaacugccuauucauacuuuuaugaggcauuugaaggguuugacagcguagaaucaccaaaagcguugacagcuuugaaauauaugcuucuuucaaaaauuaugaucaacaguccggaagauguacaacaaauuguaagcgggaaauuagccaucagauaugcuggucaagacauagaagcaaugaaagcuguugcacgagcuucucacaagagauccuuggcagauuuucaguuagcggugaagcaguucaaacaugaacuagaggaugauguuaucgucagagcccauuuaggaacuuuguaugauaauauguuggaacaaaaucugugcaggauuauagaaccauauuccagaguacagguggacuauguugcaaaaacaaucaaacuuccaauguuacaaguggaaaagaagcucucgcagaugauucuuga

SEQ ID NO: 5381 - RNA, 668 nt, Leptinotarsa decemlineata
acgccagaaaguuguuagaugaaacucaccgagagaaagcccguuuggaaauugauguuaaacgucuguuagaugaaaacgaagagcuaaaagcugauuuagccaaaaaaagcaaagauuugguucuggcugagaauucugccagaauuuaugaaacuaggugcaaugaauuacaacucaaagcuaaucaggcagcugcagaugcuaaaaaagcugcuacagaugcuagagaccuugaaaaggaaagggauaagcuaagaaagcuccuugaugaacaucguaagcaacuggaggaagaauccuuagcuagaguugaaguagagaacuccaaccagagucucagagaagaacuauccuucaaagaccaaguguaccaacaacagcuuaccgagacgcgcacucgucgccagguggagaucagcgaaaucgacggucgucucgcugaaaaguaugaagccaagcuccaggaugcucuacaggaacuccgagaucaguaugaaucccagauggcaaccaaucgucaugagaucgaauugcucuacgagcagaagauuaaaaaccugcaggcggccaacgauagacaccagucgucugcuguaggcgcucuugaugaacugagacaggucaggaccaggaucgauacucugacuucgaggaucucagacuug

SEQ ID NO: 5382 - RNA, 676 nt, Leptinotarsa decemlineata
aagagcucacaugucauugucauggcugccacaaacagaccaaauuccaucgauccggcucugagacguuucggcagguucgacagggagauugauaucgguauuccggaugcaacaggcagauuggaaguuuuacguauccacacaaagaauaugaaacuggccgacgacguggauuuggagcaaauugccgccgagacacacggucaugugggugcugauuuggcuucgcugugcucugaaucugcucuccagcaaauccgagaaaaaauggaccucaucgacuuggaagacgaccaaauugacgccgagguacugaacucucuugcuguaacgauggaaaacuuccgcuacgccaugacaaagagcagccccagugcucucagggaaacaguuguugaaguaccaaaugucucuugggaggacauugguggucucgaaaacguuaaacaugaacugcaagaacugguucaguaccccguugagcauccugacaaguuccucaaguucgguaugcaaccuucucggggugugcucuucuacgggccgccugguugcgguaagacgcugcuggcuaaggccaucgccaaugagugucaggccaauuuuauauccgucaaggggccagagcugcucaccaugugguuuggugagucugaggcuaaugucagggaua

SEQ ID NO: 5383 - RNA, 654 nt, Leptinotarsa decemlineata
caguagaccagccuuugaaaauugccaaggacaaagaaacuggaaaggauuaccuucuaugcgacuacaaccgagauggagacucauacagauccccauggucuaauaccuauuauccuccauuagaugacgguuccaugccuucugaacguuugagaaaacuugaauuagaugcaaaucaugcuuuugaucaguauagggagauguacuuugaagggggaguuucgucuguuuacuuuugggauuuggaucaugguuuugcuggaguaauuuuaaucaagaaaacuggcgauggaaguaagaaaaucaaagguuguugggacucuuuacauguuguagaaguucaggaaaagaguucgggucggaauucacauuacaaaaugacuucaacugccaugcuguggcuucaaacuaauaaacaggguucuggaacaaugaaucuuggcgguagucuaaccaggcagauagaacaagaugccacaguaaaugaaaucaacccacacauugccaauauuggcaggaugguagaggacauggaaaauaaaauucguaacacucuuaaugaaaucuacuucagcaaaacuaaagauauuguaaauaguuugaggucuguccaaucgcugacugagagccgucaacagcaggcucuaagag

SEQ ID NO: 5384 - RNA, 761 nt, Leptinotarsa decemlineata
acguuuacaauaaaccgggagaagauguugucguaauggcacaaacuuuagaaaaaguguucuugacuaaaguagcggacaugcccaaagacgaauuuguaguggaaacaccuacgaaaggacucaagggaaagaagggaagaacaaguacaggcccugcugguccuguuucaagugugggaagggguagaccaccugcgacaguaucuucaaccagugcuacaccaguggcuacuacuacagguuccuccggccugccuuugggaacucaggcuccggcaacugucccugguagcaccgccaccacaacgauagcuccugcuaccacuaauagcucucuuccuucucaaccuccagcacaaccuuccaauuuucauggugcacccuccauaguuaauucuuuagauucgaaugugaauccgggggugcuaccgggaaguguuguaccuccuucacaaccagcuaaggugaaaaaaggggugaagagaaaggccgacacuacgacacccacggcuacugcauaugauuaugcaccaccguuggagucaaagucggcaaaaauaucaacaagacgugaaucagguagacagaucaagaaaccgguaaggccagaauuggauggccauguuccccagccagcaucacagaaacugaaagagaaacuuucugaaucuuugaaagcguguaaugaaauuuugauggaauuguucuccaagaagcaugcuaauuaugcuuggccauuuuaucagccuguugaugcu

SEQ ID NO: 5385 - RNA, 787 nt, Leptinotarsa decemlineata
agaagucgucaaagaaacgagcauugcccuuccggcaguauucaaagcccccaucaggccugauguagucaacuuuguucaucaacaaguaucgaugaaccaucgucaacccuacagugucagcgacaaagcuggucaccaaacuuccgcggagucuugggguaccggucgugcugucgcccguauuccccgugucaggggcggcgguacccaccguuccggucagggugcuuucggcaacaugugucgcggaggucgcauguucgcucccacaaagccauggcgcagguggcaccgcagggucaacgucaaucagcgccgauacgcccuggcuucggcagucgccgcuagcggagugcccgcccuugugaugagcaaagggcacgucgucgaccagaucccugagcugccucuggugguguccgacaaagugcaggagaugagcaagaccaaggaggcugugcaguucuugaggaggaucaaggcauggucugauauccaaaagguauacaagagccagagauuccgggcuggaaaagguaagaugcguaauagaagacgcauccaaaggaaaggaccucucgucguuuaccacaaagaucaaggccuccgccgugccuuccguaacauuccuggcaucgaucuggucagcguggagaagcucagcuuguugaaacucgcucccgguggucacguuggacguuucgucaucuggaccgaaucugccuuccaacgauuggacaaacuguucggcagcuggaagaccccuuccuuggaaaagaagggu

SEQ ID NO: 5386 - RNA, 739 nt, Leptinotarsa decemlineata
guaugacauaagggcggaauugaacugcagauacaaagauuugaggcaaccguuucguucagcuaauccugaggaguuguucgauauacucacgaagcagacucccgaaacuuucuauauagguaaaauggucacggcuucaguuaucgguaucgcuagaagaaaacccaaaccggaucaacuagaucaagcgaauccugucagaaaugaugaaacuggccucuggcaauguccuuucuguuugaagaaugauuuuccugaguugucugauguguggaaucauuuugaugcuggcucuugucuaggacaagcgacugguguaagguuaaggcuugauaacgguguauuagguuauauuuauauaaaaaauaucagugacaaaccaguaucgaaucccgaagaaagaguuaaaguaggccaacucauucauugcagaauacaaaagauugauguagaacgguucagcguugacuguacuucaaaauccagugaucuuuuggauaaaaaccaugaauggaggcccccucgagauccuuauuacgaucaagaacaagaagauaaagacaaaggcauagaagcggagagaaaaaaagacuuacaacguaaaacguacgugaagcgaaucauaguucaucccgccuuccacaauauuuccuaugcugaaacagaaaaaugcauggccaauauggaucaaggggaagucauuauaaggccuucaaguaaaggcuucgaccauuug

SEQ ID NO: 5387 - RNA, 656 nt, Leptinotarsa decemlineata
auguuuaugcugcccuuguagcaguuauaaauucuaaauuuccaaauauaggugaacucuuauugaagagguuaguacuucaauucaaaagaggauuuaaacaaaauaacaaggucaucuguauaucagccacaacauuuguugcccauuugguaaaucagaaaguggcucaugaaauuuuagcauuggagauucucacucugcugguugaaucaccaaccgacgauucuguugaaguggcaauuucuuucuugaaggaaugcggacaaaaacucacagagguauccaguaaagguauaacagcuauauuugaaauguuaagaaauauucuucaugagggaaaguuggaaaaacgaauucaguauaugauagaaguuauguuccaaauucggaaagauggcuucaaagaucaugcagcugucuuggaagaacuggacauaguggaagaggaagaucaguucacccacuugauuaccuuggaagaugugaagcaaguugauacugaagauauuuugaaugucuucaaguuugaugacaaguaugaagaaaaugaaggaaaguacaagacacucagcaaagagauacugggaagugauagcgagucagggucuggaucugaagguucugaagacgguuccgaagacgaugaagaagau

SEQ ID NO: 5388 - RNA, 707 nt, Leptinotarsa decemlineata
ugucaagaagaaugguccuguugcacaacaacagucucauggcguugaauggaggaucuuagugguggaucaacuugccaugagaauggugucugcauguuguaagaugcacgacauaucggcugagggaauuacuuuggucgaagauauaaauaaaaaaagggaaccccuaacaacuauggaagcuguuuacuugaucacgccuucugaaaaaucuguucgugcccugaugaaugauuuugaaucgccucgauacauguauaaggcugcucacgucuuuuucacagaagcauguccagaccaauuguucaaugaguuaugccaucacccaauagcaaaacacaucaaaaccuuaaaagaaaucaacauagcauuuauuccaucugagucacagguguuuucuuuagauucgccagauacauuccagugcaguuacgauccuaccuuugcugcagcucguaacggcaacauggaaagaauggcggagcagauugcuacacugugugcaacccucggagaguauccccacgugagauaucguagugauugggaaagaaacguugagcuugcucaguugauucagcagaaauuggacgcauauaaagcagaugagcccacuaugggagaaggucccgaaaaagcuagaucucaguugaucauuuuggaucgcggcuucgauuguguuucccccuuguuacacgaacuaa

SEQ ID NO: 5389 - RNA, 694 nt, Leptinotarsa decemlineata
cucaaagaaagauguuccgccaauuuacaaaaguauuaugaauccaaacaccaccagaaaaaacagauccagucuggaggauuccaagaccugcgaagggacuuacaagccgucauagguaccagagccaauauaaacauugcgcaaauagaaaacuauggaggcgagacuuuuuugucagaagaaguugccaucaugauacuccaagauaccaagcaagccuuccaacguugucaguuguuaucaaaaccuaaagagaaagaaucaaaugcuacgcagauuuuggacagacuuaucaacagccuuuugaucgaacacguagauuacgccguagaauuaggacuccaagcugucccaguugucgaaggcgcuaaaaguccuccaguucucuauuuuuuuaacguaguucaucagaguaacaauauuacgcacuugauggagaagcaguucacggaucuggucgugccucuagucgagaauacaccgaaauauaaugacugcauacagaagaaaaaguuuguuuuggaagacauugaaaggaaaauaaauacaggcuuggacagaugucucaaugccguugcuacuugggcaaaacuguaccugcagucggaacagaagaagagugacuucaaaccugagacugacgauuuugacacaguagcgucuccagccugcaaaaccguucugaacuacg

SEQ ID NO: 5390 - RNA, 318 nt, Leptinotarsa decemlineata
cuuggucagaaacaaaucgggaccgaagagaaaggcugagacagcuagcuuuggagaccaucgacuugcaaaaggauccuuauuuuaugaaaaaucacuugggaucuuaugaauguaaacuuuguuuaacacuacauaacaacgagggaagcuauuuggcccauacucagggcaaaaaacaucaagccaauuuggcaagacgagcagccaaagaagcuaaagauucgccgucucuuuuacaaccugaaaaaccaagaguugaacccaagaaauuugugaagauuggaagaccugguuaucggguuacaaaacagagag

SEQ ID NO: 5391 - RNA, 356 nt, Leptinotarsa decemlineata
ccugugaaacuauuaccggugaagucuacagaggaaaacuaauagaagcugaagauaauaugaauugucaaaugacacaaaucacuguuacauaccgagauggcaggguagcccaguuagaaaauguuuauaucagaggaucaaaaaucagauuucuuauucuaccggauauguugaagaaugcuccaauguuuaaaaagcagacgaaagcgggaacugcagggagaggaaaaucugcaauacuuagagcacaagcucggggaagaggacgggggcagcagccucagaugcgugguggucggggagguacuuggcagaaccagcaagguggugcaccuaccggucguggaagauaa

SEQ ID NO: 5392 - RNA, 775 nt, Leptinotarsa decemlineata
uugguucgaguuucgguuauauucagggcagguagccgauaugaguccagugauaauuuaggagucacacacguauugcguacugcagcagggcugucaacaaaaaaugcuucccaguuugccauuauucguaacauucagcaaguuggugcuaacuugacagcuacaucugaucgugaaacuauuucauauacucuagaagguacaagacaagcaguugaaaaaguucucccauuccuuacugaagucgcaacccagcaaauauucaaacccugggagguuucagauaucacuuccaggcuccaauuagauauugcaacgagaucucuaccguugagagcaauugaucuacuccacaaugcugcauuucguacugguuugggcaauucaauguucaucccuaaaucacagauugggaaaauauccagugagacucugcagcacuauguugccagcaauuuucuauccgggcgugccgcuguaauuggauuugguaucgaucagucugaacucauucauuaugcacaaacuuuaaacauugagucuggggagggauguaauaauuccucuaguuauaaagguggugaauugagaucaaacaaagguggagauguagcuuuugucacuguagcuggagaaggcgccucuuugaaagaccccaaggaagcucuagcuuuugcaauucuucaaaaagcaauugguguuggaccucaagugaagugggguaauaauaauggaauuuuuagcagaguuguagguacuggagagcauacau

SEQ ID NO: 5393 - RNA, 185 nt, Leptinotarsa decemlineata
ucgaaugacucaagaacuacaagagaaaauugguguucugaaaucuuuaucuauugauauuggcaaugaagugaaauaucaagacagauuacuuggagauguugaugaugacauggauagaacuaguggauucuugggaacaacuaugaaaaagguguugaggcuauccagaggaucucacaacu

SEQ ID NO: 5394 - RNA, 765 nt, Leptinotarsa decemlineata
uugacgugaugaacuccauugcucguggucagaagauccccauuuucucugcagcuggucugccucacaaugaaauugcugcccagaucuguagacaggcugguuuagucaagauuccugguaaaucuguacuugaugaucaugaagauaacuuugcuauuguuuucgcugcuauggguguuaacauggaaacagcuagguucuucaaacaggauuucgaagagaacgguucuauggagaacgucugccuguucuugaauuuggccaacgauccuaccauugaaagaauuauuacaccccgucuugcguugacagcugcggaauucuuggcuuaccaaugugagaagcacgucuuggucaucuugacagauaugucuucguaugcagaagcuuugcgugagguaucggcugccagagaagaagugccuggucgucgugguuucccagguuacauguacaccgauuuagcuaccaucuaugaacgugccggccguguugaaggacguaacggauccaucacccagauuccuauauugacuaugcccaacgacgacaucacccauccuauuccugauuugacugguuacauuacugagggacagauauacgucgaccgucagcuccacaacaggcaaaucuacccuccgauuaauguguuaccaucucuuucucgucucaugaaguccgcuauuggugaaggcaugaccaggaaggaucacucugaugugucuaaucaacuguaugcuuguuacgcuaucgguaagg

SEQ ID NO: 5395 - RNA, 748 nt, Leptinotarsa decemlineata
aaauucuggccuacggaaaucaagaaaguaagcuuauuauuuuggcuucgcaaggacccaucgaauugguaaggauuaugagauccuaugauuaugagaagcuuuuguggaccacuucaagagucuuaaagguuuugucaguuuguuccaguaacaaaccugcugugguugaggcagguggcaugcaggcuuuggccaugcacuuaacuaauuccagcucaagguuggugcagaauugucuuuggacacuccggaauuugucagaugcagcaacaaaaguugaugguuuggagaguuuacuccagucuuugguccaaguacuugcuucuucagaugugaauguugugacgugugcagcuggaauucuuucuaaucucacaugcaacaaucaacgcaauaaagugacagucugucagguuggugggguagaugcccugguucgcaccauagugagugcuggggaucgugaagaaaucaccgagccagcugucugugcuuugcgccacuugacuucaaggcauguugagucagaaauggcccagaacgcuguuagacuaaacuauggaguucaggucauuguaaaacuauugaacccaccaucucguuggccauugguuaaggcuguaauugguuugauaagaaaccucgcucuauguccagcaaaucaugcuccucugagagaacauggagcuauacaccaucugguacaguuauugaugagagcauuccaagauacacagaggagagc

SEQ ID NO: 5396 - RNA, 366 nt, Leptinotarsa decemlineata
guugggagaaacagaaaagcacaaaaaaaggaggccuuaccuagcaucggaauguaaaaguuuauaugcuugugaaaaguggcgaaugcagaucauuagagaaauugccaagaaaguugcucaaauccaaaacgcgggucuuggagaauuccgaauaagagaccugaaugaugaaauuaacaaacuucuucgagagaagcaccauugggaggaucagauugaagagcugggaggaccagauuaucagagaguggggccucguaugcuggaucaugaaggaaaagagguuccagggaauagggguuacaaguauuucggugcugcgaaagaauugccagggguucgcgaguuguuugaacaagagcc

SEQ ID NO: 5397 - RNA, 520 nt, Leptinotarsa decemlineata
cgacauuugugaaacgucauaugacuggugaauuugaaaaaagauauguagccacuuugggaguugaaguccauccucuggucuuccauacaaacaggggcccuauucgguucaauguaugggacacugccggucaggagaaguuugguggucuccgugauggauauuacauucagggacagugugcuauuaucauguuugauguaacuuccagaguuacauacaagaauguaccaaauuggcacagagaucuugucagagucugugaaaauaucccgauaguacuuugcgggaacaagguugacaucaaagauagaaaaguaaaagcgaaaaguauugucuuucauaggaagaagaauuugcaguacuaugauaucucugccaaaucuaacuacaacuuugagaagccuuuccuauggcuagcuaggaagcucauuggugaucccaaucuagaauuuguagccaugccugccuuggugcccccagaaguucaaauggauccacaauggcagaaacaaau

SEQ ID NO: 5398 - RNA, 332 nt, Leptinotarsa decemlineata
gggaauuuuugggaguagguggaacauggaauuugaacgaagagaagaauccggaugcagaaaucguggccuccgguguuuuuguugguuauauaauauauaacauugucaguaugaucagcuuuugcuucgccacuuuggaucacaaauacaacuucacagauauccugaugaauauaauuggucuuuugcuguggguagcaguaggagcaacugcuauccacuauuggcacgguuauuuggccgaacauaaauauacccacgucgacucggagagaucgguuggauuggccauggggucccuuugcguccugaauggugcagcauauuug

SEQ ID NO: 5399 - RNA, 695 nt, Leptinotarsa decemlineata
caguacuguuggguucaugacucccagaagcggcgcaguugugccaguaggugcucagggugcuuauguaccaucugucagagauaaauugaauauaaacccggaagacggaacaguugacgugaccacuacuccagcaacccagaaaauguaucaaaauucugugaggagucacguaaaaguaggucucaguaguuuaccgcagccaaaaaaugacuaugaaauuguuguucccgagcaugaagaccaggagaugccagaacaagcccaagagcaguugguugaagaucaggcagacaucgacaaaaaaauccaagaggaacugaaagcuaaagcagcacgggagcuugcaagucgaucgcaaguaauccaaagaggcuuccccagaccucaagaaguuaacaugucuguguuacguccuccccaugagagcuauucuuugacagaucuccagaaauccgaggaacugauaaaaugugaaauggugacaaugcugcuacacgacaaucugaaaaacccgguaccaaacucgaauaagaggucuaauuuaucacaagcugaacaacuggcuuuccuggaacaacauccguaugaaaacuuccgagacgaagacauagccaucgcaaaaaauauguugaaacgcgagauggauauuguaaaagucggcaugagccacggagaacuucccuuagaug

SEQ ID NO: 5400 - RNA, 348 nt, Leptinotarsa decemlineata
uguggcucauccugauaaacucaagaaaaaaauaacuagagaauuaaucaccacgaucuuggcgaggaaacccaaaauguguaguuucuuagaguggagagauuugaaaguuguauauaagagauaugccagcuuauacuucuguugugcgauugaacaaagcgacaaugaacugcuaacuuuggagaucauucaccguuacguggaacuucucgacaaguauuuuggcaguguaugugaacuggauaucauuuucaauuucgagaaagcauacuucauccuggacgaacuuuuguuggguggggagguccaggagaccagcaagaaaaauguucucaaagccauugc

SEQ ID NO: 5401 - RNA, 689 nt, Leptinotarsa decemlineata
ggaaccauuaaagacaggguuaaggguguuauagaugaagccaguaaaucagauauagcgaaaaaagcuggcaaauucacugaagaaguaggaaaacagacucauagaauaagugaaaaggcccaagaaauaaguaaaacuggugcuuuucaaaguauuucucaggcuacacaagcuguuaaaaaggaaauugacaccacaagcauggaagguagaguuuaccagagucccacaaaauuacgaaagcgaaccgaaacuggugcaguagugcaccaaaaauauuaugagccaaacguagaugcuacuggaguugaacuucacaaggauucaaaguucuacgagucguggcaaaacuucaaagauaacaaccccuauguccacaaagugauggacuggaaauugaaguucgaugaaagugagaaucccgucauucgugcaucaagagcccucacugaaaaagugggugauaucauggguggucuguuccagaaaacagaacuuucagaaacucucacggaaaucuguaagauugauacgacuuucgaaacgaaacgcuuuuuaaaacagugcgagaccgacauuauuccuaauguacuugaagcaaugacgcgaggcgauuuagaaauucucaaagacuggugucaugaaggccccuucaaccuguucgcuguucccaucaaagaggcuua

SEQ ID NO: 5402 - RNA, 488 nt, Leptinotarsa decemlineata
gcugcaguaucagaagcuauucccaaauugaaaggcuugggauuguugacaaaaaggccugaugauuacuuugcagagauggcgaagacagacgaacacaugcaaaaaauucgggaacauuugaugaagaagcaggaacagcaaaagagaagugaaagggucaaacaacuucggcaacagaggaaagaggggaaaaugguucaaauucaaacgaaacuacaaagacaggaagaaaagaaagaaauguugaaucagguuaagaaaguucgaaaggggaugucuaaagaucuugauuuucuugaugguaaaaaaaauaaaucuauuggaagaaaaucuauggaaaagaggaaaaugaaagauaaaaaguuuggcuuugguggaaaaaaaagcggcaugaaaaguaauacaaaggauagugcugcugauauuagugaauucagaaauccuggaaaaucugguaaaaaauuccccaaaagaaacagcaaaca

SEQ ID NO: 5403 - RNA, 651 nt, Leptinotarsa decemlineata
uaggguuaaacgacaaggacguagcugaauucauaauacauuuaucugaagaaaacaauacucuugagaguuuuacaaaaguaaucaaagauaaugacauugaauugucggauucuuucauugcugaucugcuucauauuauucaagacaauaaugguagaaucgcuaaaaugagugagaaagcuccuacuacugaaaagaugaaugaaguagaaaaauuggaauaccugucucuuguaucgaaaguguguacagaauuagaaaaucaucuuggacucaaugauaaagacguagcugaauucaucauacauuuaucugaaaaaaacaauacgcuugaaacauucaccaaagcacucguggacugugggucuggauuuucugauucuuuuauugcuaaucuacuacgaauuauucaacacaugaaacccccaaaaaaucagucgaaggaagaggcugccauuacucaaaaggaaguauuagccaagaaauuuccaggauuauccauuccuaaugagccucagaaaccacuugaucuugaagggaaugaaaaugacagcauugauacagauauuguagcagauaugaugaaacaguuugaagcagaugcaccuucaaaaaaagauaacauugaaaaggauucaagccgaagua

SEQ ID NO: 5404 - RNA, 798 nt, Leptinotarsa decemlineata
acaucugccaaagucaugauggaagagggccgaagcaagggauucgguuuugucugcuucucuucaccagaagaagccaccaaggccgucaccgaaaugaacggcagaauuguaggguccaagccuuuauauguagccuuagcgcagcguaaagaagaccgaaaagcucaucugacuucccaguauaugcaacgcauggcaaauaugcguaugcaccagaugggacaauuuauccagccgggagcuucaagcgguuacuucguacccaccauucccaccucccagcgcuucuacgguccagcucaaauggcacagauccguacaaguccaagauggccugcccagacaccggugagacccgcuggucaaggaggcacugccgcuuacacaggcaugcccaacacauacagagcagcagcuaggccuccaaaucaauccacugccaugcgcggaaauauuagcgugccaagacccauuacaggccaacaaccacaaaccaugcagggacguccauuagcuggacaagguguuguaccugcuacgggaagucgaacaaacuucaaauacaccucuaacaugagaaauccaccacaagccuuaacuuugcaaggagcugcugcuccuguucaacaagcuguccauauccaaggccaggaaccacugaccucaacuauguuggccucagcuccuccacaagagcaaaagcagauguugggcgaaagauuguucccucucauccaacgcauguaugcugauauggcuggaaagauuacuggaauguugcuggaaauugacaac

SEQ ID NO: 5405 - RNA, 761 nt, Leptinotarsa decemlineata
gcuguuuguguugcuaaacuuuaugauauuuccucaggauuaguugaagaucaaggauuucuggaacaguugaaagaauuauugagugauucuaauccaauggugguugcuaaugcaguugcagcacugucugaaauuaaugaaagcagcccaacuggucaaccucuuguugaacucagcaccaacacaauaaacaaacugcugacagcucucaacgaauguacugaauggggucaaguuuucauuuuggauucccuuuccaacuauacuccaagagacgaccgugaggcccaaaguauuugcgaacguauaacaccacguuuggcacaugcgaaugcugcaguuguacugucagcugucaaaguucugaucaaaaugauggagauucuagcaggggauacugaauucugcaccacuaugagcaagaagcuugcaccaccucugguuacgcuacuuaguucugaaccugaaguccaguauguugcauugagaaauauaaauuugauugugcaaaaaaaaccggauauucugaaacaugaaaugaagguuuucuuugucaaguauaaugacccuaucuaugucaaacuagagaagcuugauaucaugauucgucuagccucucaaguuaacauugcacaaguucugagcgaacugaaagaauacgcaacugaaguggauguggacuuugugagaaaagccgugagagccauuggaagaugugccauuaagguagaaccuuccgcagaaagauguguugcuac

SEQ ID NO: 5406 - RNA, 348 nt, Leptinotarsa decemlineata
gaagugggagcuacaucuuccuuggcuccuaaaaucgguccucuaggauuguccccaaaaaaaauuggagaugauauagccaagaauacagccgacuggaaaggucugaaaaucacuguccagcugaagauccaaaacagacaggccaccauuuccguuguaccuucugcugccucucucaucaucaaggccuugaaagagccuccaagagauaggaagaagcaaaagaauauuaaacacagugggaauaucaguuuugaugaaauuauuuccauugccaagcagaugagaccucgaucgauggcaaagcaacugucuggaacagugaaggaaguuuuaggaacugcc

SEQ ID NO: 5407 - RNA, 664 nt, Leptinotarsa decemlineata
uugguagaagcugguguaaccgaaguaauucuugcuguguccuacagggccgaacagauggaacaggagcugacggcagaggcagcuaaacuuggaauaacuguaguguucucccaugagacugaaccauugggaacagcaggacccauagcuuuagcuagagaacaccucucaaaaagcacaaagccauuuuuugugcucaauucugaugucauuugugauuuuccuuuuagagauuuggcucguuuccacgaggcacauggaaaagaggguacaauuguugugacaaagguagaagagccuucaaaauauggagugguuguauacgguaaggacaacuguauacaaaguuucguagaaaaaccacaagaguucauuucuaauaaaaucaaugcuggccuuuacguucucaaucccagcguaauagaucggaucgagcugcgaccuacuucuauagaaaaagagguuuuuccuggcauggcagcugauaagcaguuguuugcuuuugaccuacagggcuuuuggauggaugugggacagcccaaggauuuucucacuggaaugugcuuguauuugaagcauuugagauccaccaauggaagcaaauuauauaaagggccagguguuguuggaaauguucuaguggauccaucugccaaaauug

SEQ ID NO: 5408 - RNA, 701 nt, Leptinotarsa decemlineata
gauuucauucuccauucgccgccuggcgaauuuaaugaagucuuuaacgacguacgaaaacuccucaauaaugacgaccuacuaaaggagggcgccagcggggcauucgcccaguacaacaaagaccaacugaccccagugaaaauagaaaacuccgauaacuuagugcucaucaccgaauacaacgaucagggaaacaacagauuuuucgacccgcgaagcaggcagagcuuuaaguaugaccaccugcgaaaagaggccuccgacuaccagacguacaccccggauccagcggcggagcccuggcgcuccgcucucgacgcugaguucauccaguacaccaggaaucauuaccgggacggggugugcaguguggugggcaggaaccaagggggcaacguggucuugacagcuugcaucgaagaccaccaguuccagccaaagaacuucuggaacggcagguggaggucgcaguggucgaucucucugaauggaggauccguggcagaaguuagagguguguugaaggugcagguacacuacuacgaggaaggcaauguccagcugguuagcacgaaggaaaucaaagagucaguggugguaacgaacgaggcucaaacggcgaaggaaauaguccaggucaucgaaacggcggagaaccucuaucagacggcgauuucggagaacuaccagacgauguc

SEQ ID NO: 5409 - RNA, 722 nt, Leptinotarsa decemlineata
cuugaccacuaacgaaaacgcuaacauucgcaucuccuuaugggguuacagagaaacaacaauaaggccaacguucguuuacaucacugauaucgcagacagucuccaaaauacuggagaguauaccaucguaccgucccaauauagaacaaaaguuaaugaguuucucacggauaucaaauuugguuucuugcaaauuaacuugacugaaucuaucaaagugaacacuuauacaucuguacaaagaucgguggaaauaguuccuguuguauggagucgacccauuccccuaggaugguacuuucaguuccaaugggaaaauauguauggacgaagcuggcccaaagcacucugcgaugacuggcuaagaacagacagauaccugaaaaacuuugcucaugaguuaccucaaugcccuugcacuguagaacaggcuuuggcagacaaagggagguauaugcccgacuuugauugcgacaaggacucaaaucccguaugcuacuacaauaaccaagcucugcacugugugaaaacaggaucaccaacguuggagggaucagaacagcagugcugcuaugacaaaaacggguaucucauguuaucauacgaucagcagugggguucaaguccacggcguugccacaaucugggaaaaaugcccuacaacgaagcaacaaaaguuccaaccuuaucgcaaugguucaacgauaugguaccgaagu

SEQ ID NO: 5410 - RNA, 177 nt, Leptinotarsa decemlineata
ucuuucuuuucuucggcggcugcuggugcugcagaagcugcugcagcagcaggagcagcuccuccagcuggcauggagcucaauuucucacguccuugggcgaugaguucaucaauagauuuuccaccuaguucagcaaugaccuuuuucagccguucuccuucagcuucaauuccu

SEQ ID NO: 5411 - RNA, 790 nt, Leptinotarsa decemlineata
ggagaccaauguaccauuguugguucucauuaaggcugcucaaaauggaaaugaaaaagaaguggaggaauaugcaguugucuucacugaacauuccaauaaauugguugaagucgccaaccucguuugcagcaugucuaauaaugaggauggcgugaaaaugguccguuacgcagcagcucaaauagaaaaucucugcccugaaguaauaaacgcugcucguaucuuggcagccagaccucguagcaaaguugcucaagaaaauauggcugcuuucaaacagucuugggagaaucaugucagaauucucacggaagcugucgaugauauaacgacuauugaugacuuuuuggcugucucggagaaucauauuuuagaggaugucaauaaauguguuuuggcauuacaagaaggggaugcugacacauuggaccguacagccagugguauucguggaagaucgaacaggguuugcaauguuguuucugcugagauggacaauuaugagccguguauauacacgaagcgcguacuggaagcugucaaagugcucaacgaucaaguaaugccaaaauucacucaaagaguucagguugcggugcaagcauuaggaaacaauccaccaaaagaaguugaugaaaaugacuucauagaugcgucucgcuugguuuaugauggagugagggaaauacguagagccguguugaugaauagagcugacgaagauuuggacccagaggauguugaacuggaugaaaacuauacauuggagaacagaagcaaaucgagu

SEQ ID NO: 5412 - RNA, 727 nt, Leptinotarsa decemlineata
accuaccacuacuacaggacuuucuuugggcgucccuucugucaccaguacggcugcugguauuacaacuacuucugcaaccaaauugaguuucggacuaucaucaggaucaucuacuacuacagcuguugugacaacaucaggaacaucuucaaccauuguuccagcugcaaccacgguaacaucgucaacuucgauaauuccagcaacuggguuacuaacuuuuagccaacuagaagacucuauaaauaaauggacaauagauuuagaagaacaaggaaaauuuuucauaaaucaggcaaaacaguuaaaugcuugggauucuuuauugauuucaaauggugaacaaauauugaauuugaauggcaguguagagcgugucaaacagcaacaacaacaacuagaucaagaacuggacuuuguacuugcucagcaaaaagaauuggaagagcuuauagcucccuuagagaaggaauuaugggacauaccuguuacugauauugauagaaaucaaauguaccaguuuucagaaaugauugauucucagcuaaaacaaaugucggaagacuugaaggaaaucaucgaacacauaaaugagucuaauagaaaugaagcggcaucuaauccaauugcccaaaucagccgcauccugaaugcucauaugaacucccuacaguggauagauagaaacacuucgcaaauaaguucucauuuggagcaaaucacc

SEQ ID NO: 5413 - RNA, 447 nt, Leptinotarsa decemlineata
ggacaaugcuggaaaaacaacuuuacugcauaugcucaaagaugauaggcuggcacagcaucuucccacuuuacauccuacaucagaagaauugucaaucggcagcaugagguucacgacuuuugauuugggaggccauucacaagcaaggcgaguguggaaggacuacuucccugcuguugacgccauugucuuuuuaguagaugccaaugauaggaacagauucaaagagaguaaacaagaauuggauucgcuacucacagacgagacucuuucgaauuguccgguucuuauauuagguaacaaaauugauuugccucaagcagcuucggaagacgaacuaagaaauuacuaugccuuguauggccaaacaacuggaaagggaaagguggcaagguccgauuugccaggacguccccucgagcucuucaugugcuccauucugaa

SEQ ID NO: 5414 - RNA, 494 nt, Leptinotarsa decemlineata
uuguguuacuuuauugcguguaauuuuucugauggauccaauaaacuuguuagagagccguauugaaaaucuggaaauucagauuuucggagauaaauuaccaacuacaaauacuaaaaauguuacuaguuuacuuuuggaaacucaugcaaugauuacuucagcuuuaaguugcagagaaguaauuaguuccaugcuucaccauuugucuauuauaaaugaauaucuagauccaaaccuuggaguagaugagcuagaagcugaagcuaagagguaucacuuacuccaauuauacucggaauugaaagauacuguacagaagauuggaacuuuagagucacuguuacccuucauugauucugagaacauagcgaaaguaacugaacuaucaggaaauauagagcagcuggcaguugguaauaugaauacauauucugaaugccaagaaguuacucagaauguauugaaaucuuugcgaaauuacaaugagauca

SEQ ID NO: 5415 - RNA, 730 nt, Leptinotarsa decemlineata
cagagcagauaguggaguuccuaggcgaccgcgcuagcuucguacagauaagaggauccauaccccuguucuggcaucagaacccggauuuacgguacaaaccaccgccuacacuucuggauguggacccccaggagcagcaggcugcgugucuacgucacuuggaggaaaugacugcuauauacggcaagcaaguucuggugaaucucaucgaucagacugguagagaagguggaauugagaaggccuucagggauaccaucaguauuuuaggguuugcuucugcaagauacgagccuuucgauuuccaccacgaguguagaaagaugcgcugggauaggcucucaauccucaucgacagaauugcucuggaccaggaugaaaugggcuucuuccugauucuucgggacggcucuuugagcucucuucaggacggaguguucagaacgaacugcaucgacugccuggauaggacgaacgugguacaaaguaugcucgcccacagaaauuuggaugugguguugaagaaacugaauauucugcauccgaaucagagguuggacgagcagucaucguucgagaugcuauacaagaacgugugggccgacaacgcggauuucaucagcauucaguacuccggaacuggagcucugaaaacggacuucacuaggacaggaaagcgcacacagcugggauugauucgggacgggaucaacucucucgugaggua

SEQ ID NO: 5416 - RNA, 737 nt, Leptinotarsa decemlineata
gaugagaguggugaacaguuuguugccuacuuucuuccuacggaggaaaccuugcagaagcgaagggaagauuuugcaaaugaaauacccuaucaagaugaugaggaguaugaauauaaaauggcuagagaauacaauuggaaugucaagaguaaagcaagcaaaggauacgaagagaauuacuucuuuguuguuagacaagacgguauuuauuauaacgaauuggaaacuaggguaagacugaguaagaggagacagaagauuggccaggcacccagcaauacgaggcucauuguuaagcacagaccaauggaugccaaugaguuuaggaugcaacgcuacagagagaaacaacuugaaccuccgggugaagaagacgaagaaauggagguagaggaaacccaggaggagacucaggaagagacucaggaagggcaaggcaaugacagucaagcagaaucugaucaggaaaaccgagaaaaagcaggaagcggaaaggaagaagguucacgagccucuucgagaucuuccaggaaaucaaaaucccguucaagaucccgauccaauucaucagcaaagucacguucaagaucuagaucgaaaucagcuuccaaaucgaggucccaaucuagaucaagguccaggucaaaaucuaagucaaggucacguucuguaucuaggucucgaucaagaucaaagucuggcucaaaaucuccgucgaggucuagauccagauc

SEQ ID NO: 5417 - RNA, 757 nt, Leptinotarsa decemlineata
auuuguaaggacucuggcuggaaaguggaucagaacuuauugaaagccaugaaaaugaaaaaugaugaacaaauaaaacuuuuggaugaggccauugaagaugcugaaaaaaacuuaggagaaauggaaguuagggaagcauauuugagaaaggcagaguacuucagucgaauuggugauaaagauaaugccgugagcacauuuaggcaaacuuaugauaagacaguuucgcuugggcacagacuggauauuauuuuccauuuaauaagaauaggcuuauucuucauggaucaugaucucaucacuagaaauauugaaaaagcaaaaacuuuaauagaggaagguggugauugggauaggagaaaucgcuugaaaguauaucagggugcuuacuguauggcaguaagagauuuuaagacugcagcaaacuuguuuauagacacagucaguacuuucacaucuuaugaguugauggauuauaaagcauuuguccgcuacacaguuuauacaucuaucauuagucuuccaaggaaccaacuucgagauaagguuguuaaagggucagaaauucuggagguucuucauucugaaccauucguuaaggauuauuuauuuucacuguacaauugccaguaugcagaauucuucucaaauuuagcggaaguagaaaccacucucagaaaagacuacuucaugaauccucauuaucgcuauuauguucgagaaaugaagauuuuggccuacacacaguuacuag

SEQ ID NO: 5418 - RNA, 314 nt, Leptinotarsa decemlineata
aaccuacaaucagcguucuucugaaaaaaugaaagccgacgaaggguugggaaaaggagcuaccauuucugcaguccuguaugcuaauguuaaucauccugaguggaaaaaagaguucccuaguuggucagauagguacaaacagauaaucaaaaaauggaggacuuugagucaggaucagaaggcuccauuuuugcagcucgcgagggauaauaggagccaauugaggaugaagaagucccaacaagaucaggacaagauggcccuacagcaaaaaucugcucgagaggcggaacaagagaggcaguggaaac

SEQ ID NO: 5419 - RNA, 795 nt, Leptinotarsa decemlineata
guccugccuuacacaaacuaaauaugcuguugacaaaaaaccuccaaauccuccauuccagcaacauuuuuguguuuuuucauguccugcacagcaaguucuaccucuuaacauucaugaggcucugggaaauuauaggguaacgaaaguacaaaaaauggacucugaacgagcgcuccucaacuauuucauuacacaguuuuccaaaaucgauccagaccuuauaguagggcaugaucugcaaggauaucaaaucaauauuuuagcugaucgucuuacaaaacaggacaacaaaacuuucaguaaauugggaagaauaaaaagauccgaaaagaaaagacuggaaaagcauuuauuugcugguagacucguaugugauaucaaaauaucagccaaagaacuaauaaaaucgcgaucauacgaccuagaugcucuuugucaagucauucuuaaacucaaagaaaaucaaagaauugaacuagaaccugaagacauucccaaaauguaucagucaaccaaggaucuacugaaacugauaucauuuacagugcaagauacaucguacauucucaaaaugauguacgacuugaauguuauuccucuugccuuacaaaucacaaacauagcugguaauauaaugucgaggacuuugaugggugguagaucagaacgaaacgaguuuuuacuauuacaugcauuuucagaaaagaauuauauaguuccugauaaggaauauaagagaaaagauaccacacugucgaguucagcaagaaagaagccaacuuauucaggagg

SEQ ID NO: 5420 - RNA, 758 nt, Leptinotarsa decemlineata
agacugaagcuauaacgcaggccauuagaaagaguauuggcguuagaauaaaggaagagagcgagaucaucgagggugaaguaguugagguacagauugaacgaccagcuacuggggucgguacgaaaguagggaaacucauuuugaaaaccaccgauauggaaaccgucuaugaucuuggugggaagaugaucgacaguauuuugaaggagaaaguucagucuggagauguaaucacuauagauaaagcuacaggaaaaaucacuagguuaggcagguccuuugcaagagcuagagauuacgaugcuacugggcaacaaacgagguucguacaaugcccugaaggugaacuccagaagagaaaagaagugguccauacuguuacauugcacgaaaucgaugucauaaacagcagaacgcaugguuucuuagcuuuguuuucaggugauaccggagaaaucaaagcugagguccgcgagcaaaucaacggcaaaguagcggaauggcgagaggaggguaaagccgaaauuauuccagggguuuuguucaucgacgaaguccacaugcucgacaucgaguguuucucguuccugaacagggcucuggaaaacgaaauguccccgaucguuaugauggcaacgaacaggggcaucaccaagaucagagggacgaccuacaagucaccucacggcaucccauuagaucugcuggacaggacgauaauagugccuacucagccauacgaggagaaggaguug

SEQ ID NO: 5421 - RNA, 792 nt, Leptinotarsa decemlineata
ucuuccgagggucucuuuauaaaaaauauccuggaauguucagaagaucuauaaccaaugaagaaagaagacgauugauagaucuuggcuugagccaacauguuuuagcuaguagcguuucuuuguugaaagcaacagaaguugaagauaucauagaaggcaaugacgagaaguacaaagcuguaucaguucacacgucugaaccuccugcucccagagagagcaagucaaagaagaacaugcaauggguaccuuccuuaccaaauuccagucacuuagaugcaguuccccaagcuacaccuauuaauagaaauagaguugcaucuaagaagguuagaacuuuuccauuauguuuugacgauacagauccacaaauuaauguugaaaaugcuugccaaggagaaguauugguaccuauaagacucgacauggaaauugaaggacaaaaauugagagauaccuucacauggaauaaaaaugaaaguuugauuaccccagagcaguuugcugagguucuuugugaugaccuugauuugaauccucugacguuuguaccagcuauugcacaagcaaucagacaacaacuggaggcuuuuccagcugaaccuucaagcauuauugaggaaacuugugaucagagaguuauuaucaaacucaauauccaugucggaaauacuucuuuaguugaccagauugaaugggauaugagugaaaaacaaaauaaugcugaggaauuugcacugaaacuuugcgcagaacuuggccuagguggcgaauucguaacggcuauug

SEQ ID NO: 5422 - RNA, 479 nt, Leptinotarsa decemlineata
uugguuauugucggugauggagccuguggaaaaacaugucuguuaauuguauucaguaaggaucaguuuccagagguguacguaccaaccguguuugaaaauuauguagcagacauugaagucgauggaaagcaaguugaacucgccuuaugggauaccgcugggcaagaggauuaugaucgucuacggcccuuaucguauccagacaccgaugugauuuuaaugugcuucucgguagauucgcccgauuccuuggagaauauaccugaaaaauggacuccagaggugaaacauuucugcccaaaugugccaauuauucuggugggcaacaaaaaggaccugagaaacgauccuaguaccauuaaugaacuaaagaaaaugaaacaagaaccagucaaaccucaggauggucgaucuauggcagaaaaaaucaaugcuuuugcuuauuuagaauguucugcuaaaaguaaggaaggugu

SEQ ID NO: 5423 - RNA, 728 nt, Leptinotarsa decemlineata
aggggugcuuauucgaaauuucuuaucaggccgaaagcggcugguuuggcaaacgauguaagaaagucaauuuauccacuaguucuuucuccuucuuaguuccuuccuucuugaacgccgcccucagcgaagaugauggcaucacccaaauuucuauagacaacagcagacauauucuguacacucucaccgaaaaaggaaccaucgaaguaugcgaucugggagaaaaaggaaauucauuuucgaggauagcgaaaaugacucaaaacacucuggucaaccaggccaugaacacaguuaagacuuuggacagucaaaacuuccgucccaucaucagcaucuccgccauagaaucguucgagucugcaaaucugaaccuugucgcaguaucccaaacgggaaucagauucuacaugucgguggugagccuuuccaacuuucugccgaaucagagaccauacacuuugacucucguucacgugaggaugccuccuggauauucugccaacguaacggugagacccagggcgguccacgugucucaauacagggauaggaauucauuguugaucucaacuguuaaugagaaagacguuuugugguguauaaguucggauuuauuuccuuucagucaaacgcugauggaagccuauacuacggugaauuuggauggaccugcucuggcuguggcugagguucaucaauccguaccuuuauuguccacgcaa

SEQ ID NO: 5424 - RNA, 694 nt, Leptinotarsa decemlineata
ugaggaagccuucuuuguacuagcuuauccgucuacagaacucuuacuuaucaaacagaacccugaugauggacaaguugucgccacagaauugaaaggcgaaucucugaugcccagauuuuugucgggacuugcagagaaauuucgacagaaaaauucagauggaagcaauauagucagucucuuauucuacgugguggauuaugaaacauauguguuaacucuaagcagggacggacauuugaaauucuggucuugugcuaaaggacaguguguggcaguaguugauauucucgaaaaaucaggggaggucucaagaaccaggauccaaucagcaaguuuaaggaaagcugucgacggaaacagcagcgaaagucuguuggcuguguuuuugaguuuugcuaauggaugucaguuucaaauuuugagccccguuauaagaggacaggaaauuacaguggaucguuuggauacgagacauucuccagagagugaccucaucgauuuugcucuccaaacaaaucguuuguggacagcauggagaugugaagauggcgaaugugugguauacacuacuucucuucaaccaggaaugagccaaucuucucgccacucggguuuguuacaaucuaguaacugggcccccguugucuuggaaacaauaccagacgcaaaucaagcaccugucaaugau

SEQ ID NO: 5425 - RNA, 722 nt, Leptinotarsa decemlineata
gagucagaucgagcagaaauuaaaaauucaauuguaacucuaauguugaguucaccagaaaugauacagaaacaauugagugaagcaauaaguauuauugggaagauugauuuucgcauggaauggccaaacuugauuccacaaaugguugaaauguuugccacaggcaacuucaaugugauuaauggugugcuucgaacagcacauucucuuuucaaaaaguauagauacgaguucaaaucucaaaaacuguggauggaaauaaaauauguacuugagaaaauagcgcaaccucuuaccgaucuuuucauugcaacaauaaaccuuucccaaacucaugccaaugauguaaaugcauugaaaguaaucuauaguucuuuaguucucauaugcaaaguguuuuauucuuuaaauuuccaagacuuaccagaauucuuugaagauaauauucaaguuuggaugucaaauuuucacacuuugcuuacuguggagguaaaaagucuucaaaauaauaacagugaagaagcuggaguuauugaacaacugaaaucucaaguaugugauaacauugcucuguaugcucaaaaauaugaugaagaauuucaaccuuuucugcaacaguuugugacugauacuuggagccuucuaguuggaaccggucucgaaccuaaauacgaucugauaguuucaaaugcccuacaauuuuugucgucaguagcaga

SEQ ID NO: 5426 - RNA, 477 nt, Leptinotarsa decemlineata
ucgaaugcauagaagaacugaaagaagaucuagaguggaaaaugauauauguaggcucugcugaaagugaagaguaugaucaaguauuggauucaguauuuguuggccccauuccagaaggaaaacauauguuuguauuucaggcggauccuccaaauguaucucgaauucccgagaaugaugccauaggagucacugucgugcuauuaacauguucauacagaagucaagaauuuauuagaguaggauauuuuauuaauaaugaauacagugacccagaauugagagaaaaucuucccagcccaccacaguuugauaagguuguaagaaauauuuuagcaucggaaccaaggguaacuagauuuaaaauaaacugggaagagacaaacccacaagaaaaugugacacauacggaacaaacugcgacagggucgucaguuaauguagaaaauaacagcaguacuccagcugauguac

SEQ ID NO: 5427 - RNA, 735 nt, Leptinotarsa decemlineata
caaccuagcacuucucaaguuccacccuuggcaccaauggguggucuaacgccaacuuugggucucggcaugggccaugccaugucuaugaccccaacuaaguauguuacuggauucgcucuuccaaugaguaccauuacccagcaaacuccacaacauacuaugaugaguccucugguuaacuuggggggaucaguaguuaccggaucaacacccaccauggcuccagcaaccccuucuccauugacuccaaugacuccacauucugcugauccaggaauaauuccucaacuacaaaauaucguaucaacaguuaaucugaacuguaaauuggacuugaaaaaaaucgcccuccacgcaagaaaugcugaauacaauccaaaacguuuugcugccgucauaaugaggauacgagaaccccguaccacugcauuaaucuucuccuccgguaaaaugguguguacaggcgcuaaaagcgaggaagacuccagguuggcugcaagaaaauaugccaggaucauacaaaaacuugguuucaaugcgaaauuccuugauuucaaaauccaaaacauggucggcagcugcgacguuaaauuucccauuagauuagaggggcucgugcucacucacaguucuuucaguaguuacgaaccugaauuguuccccggauugaucuaccgaauggugaaaccuaggauaguucuguugauuuucguuuccggaaagguuguguua

SEQ ID NO: 5428 - RNA, 354 nt, Leptinotarsa decemlineata
acaacugcgaagagaaguuaugcugauaugagcuucacuuuugcugcuggaaaucaggucuauuacgaugcuaaaucaguuaaacaaguugaugucccaucauuuucuggcaguuuugguauuuuaccagcucacguacccacacuagcaguccuuaaaccgggaguagugacagucuaugaagaaggaggcaaugucaacaaaauuuuugugucuaguggaacuguuaccaucaaugaggauucuucaguacaaauucuagcagaagaagcacacccuguuggaaaccuagaugcuucagcagccagagaaguucuuagcaaagcacaaagugaauuaucgucagccacaacu

SEQ ID NO: 5429 - RNA, 729 nt, Leptinotarsa decemlineata
auucgucaguuuucucggaaggaaaacagauuucuucacuggaggaaaagagggggaaugggagaagcuaguuaugaauacauucagaaagcaugaaaaacaaaguagagaaaagcaagaagcugagcugaaagagaaacgugagagggaagcucgagcaaaagcagcugcagcaaaaaaagcugaagcugaaagaguugagccugccaaaauaacagaacuaacugaugcugaagccgaacagcuucaggccgaaauaaacgcaaagaaaaauccgucaucguccaguucacaaccugcugccccuaucggagauaaaaucaaggaagacgaagaugaaucagaaaaggggaagauuuugccgaacaaaggaaauggcugugauuuggacaaguacaaguggacucagacuuugggcgauauugagcuucgagugccacuaaacgucaacuucagagucaagcagaaagaucuugugguuaaccuuacgaagaaacauuugacaugcggaaucaaaggucaaccgccuaucauaaacgacgauuuuccuuaugaaaucaagcuagaagaauccacuugggucauagaagauggaaaaucacuguuguucaauuuagaaaaggugaauaaaaugaacugguggaacaaacuaguuaacucagauccggaaaucagcacaaagaaaauaaacccagagccgucuaaguugagcgaucuagauggugaaac

SEQ ID NO: 5430 - RNA, 362 nt, Leptinotarsa decemlineata
gccccgauaagaaacauagugauagagaaagguggauauguauuuacccagcuuauaucaauaauaagaaaacguuagcucaaggaagaaagauaaauaaggauaaaugcguugaaaacccaacacaccaagaaauuagagauguauuaguggcagcaaaucuuaaaauaggaguugaaaauaaauuauauagcagagaaaaaagcaaggaaccucuuuaucgaggcagaauuagaguucaauugaggaaugaugacggaaguuuguucaauagcgcuuucccaaccagagagagcauaauguaucaucuuggugaaaugauuccuaaauuaaaaucuagacaaaauaaaggugcaggggaa

SEQ ID NO: 5431 - RNA, 676 nt, Leptinotarsa decemlineata
accaugcaagaaauuugugggaucgagcuguuacgauauuaccuaggauugauacuuuuugguacaaauacacuuauauggaggaaauguuggaaaauguaccuggagcccgugcugucuuugaacgauggauggaguggcagccugaugagcaggcauggcaaacuuacaucaauuuugaacuucgguauaaagaaauugauagagcuagacaaauauaugaaagguuuguuaugacucacccagaaguuaaacacuggauuaaguaugcaaaauuugaggaaaaacaugguuucauucauucugcucgcaaaaucuuugaacgugcuguuaauuuuuuuggugacgaucauuuggacgaaaauuuguacauugcuuuugcuaaauucgaagaaaaucagaaagagcaugaaagagcaaggguaaucuacaaauaugcgcuugaucacauacccaaagaccagacuaaagaacucuauaagucauacacaauacaugaaaaaaaauauggagacaaaagugacauagaugaggugauugaaucgaagcgaaaauuucaguacgaacaggaaauuuugcaaaauccaacuaauuacgaugcuugguuugauuauauuagguuaguagaaggugaaggagacuuagaauuuaucagagagacguaugaaagagccau

SEQ ID NO: 5432 - RNA, 732 nt, Leptinotarsa decemlineata
agggagaagguacuauggaccgcaauaacucuauucaucuucuuaguuugcugccagaucccucuauuugguauaaugaguucagauucugcagaucccuucuacuggauucgaguaauucuagcaucgaauagagguacucuuauggaauugggcauaucuccaaucgugacaucuggauuaauaaugcaacuuuuggcuggagccaaaauuauagaaguaggcgacacuccuaaagacagggcucuguuuaauggugcacaaaaauuguuugguaugguuaucacugucggucaagcgaucguuuauguaaugaccggcauguauggagacccugcagaaaucggagcgggagucugucuucugaucaucauccagcucuuuguggccggucucauagugcugcugcuagacgaacuucuucaaaaaggcuacgggcucgguucgggaauuucccucuuuaucgccacuaacaucugcgagaccaucauuuggaaggcuuucucuccagcaacugucaacacuggacgcggaaccgaguucgagggagcagucaucgcucuuuuccacuugcuuaccacccgacaggacaaaaucagaggacucagggaggcguuuuaccgucaaaaucuacccaaucugaugaaucuucuagcuacagucuuuguauuugcuauagugauauacuuccagggauucagaguagauuuacccaucaagagugcuagguac

SEQ ID NO: 5433 - RNA, 361 nt, Leptinotarsa decemlineata
guacuagagcugagcaagacaaacuauugagaguuacuucuacuuuguauguaggaaaucuuucuuuuuauacaacugaggaacaaauuuaugaacuauucucgaaauguggggauauaagacggauagugauggguuuggauaaguacaaaaaaacuccaugugguuuuugcuuuguagaguauuauacucgaauugaugcagagaacugcuuaagguauauuaauggcacccgucuggacgauagaauaguacgaacugacugggaugcugguuucauagagggacgacaauaugguagaggaaaaacgggugggcagguaagagaugaauauaggacagacuuugacucuggaagagg

SEQ ID NO: 5434 - RNA, 292 nt, Leptinotarsa decemlineata
acuacaucuucgcccuacuaacaggcuacugcgauccucccgcgggcguggugcugcgagaaggccaguacuucaaccccuacuucccaggaggggcuauuucaauggcgcaagcccuguacaacgaagccaucgaguauuccgaugggacgccugcaacggccagccaguuggccaaagauauauccacuuuccugaaauggaccgcggaacccgagcacgacgacaggaagaaaaugcucaucaaauguauaggcauauucgcgaugcuggcaggucuuugcuacuacau

SEQ ID NO: 5435 - RNA, 657 nt, Leptinotarsa decemlineata
cguaaaagaaaugcugacccuagcgacauugaugguuuuuugggaccguggggugguuuugucgaugaacaaaaaauugcuaagccuagugaagaagaacaagcagaauuagaugaacuaauaucuaaaaagaacaaaagagguaaaccuacagaagauaaaccuguugaagagaaaucuguucuucacaucaaggacgcuguugauuaucaaggucggucauucuugcaugcuccacaagauguagguguuaaucuuaaaucagacacaccaccagaaaaaugcuuuuugccaaaaucucauauucacaccuggucaggucauuccaaaggaauugcagccauacgaugguuuccaagaacagcacauuuauuuuuaucagcuaguauggauugucguauuaaacuuugggaaguguauaaugaaagaagauguguaaggacauauuauggucaucgacaagccguaagggauaucaauuucaauaacuccggaaaacacuuccucucugcugguuaugacagauauaucaaauuaugggauacagaaacagggcagguucucucaagauucaccagcaggaaaauuccuuacugugucaaguucaauccugauaagaauaagcagcacuuauuuguugcgggaacuucagauaaa

SEQ ID NO: 5436 - RNA, 657 nt, Leptinotarsa decemlineata
uggcagucaagaaaguagaguccaagaaggagguuaacccucuuuucgaaaagaggguaaggaacuuuggaaucggucaggauauucaaccuccacgugauuuaucgagguucgucaaauggcccaaauacauucgaauucaaaggcagaaggccguuuugcagaagagauugaagguuccuccgccaaucaaucaguuuacucaaaccguugacaaacaaacagccacccaguuguucaaacuccuagagaaauacagaccagagacggcucuccaaaaaaggaauaggcugaaggcuaaagccgaagcuaaaguggccaagaaagaggaagccccuaccaagaggccaaacacccucagggcuggaacuaacacuguuacuaaacucauugaacagaagaaagcucagcugguagugauugcccacgacguggacccuauugaguugguguuauucuuacccgcccucugcaggaaaauggguguaccauauugcauagugaaaggaaaagcuagacugggacuuuuggugaggcgcaaaacuugcacugcaguagcucuuacccagguugauucuggugacagguccaacuucaacaagguuguggaggucaucaaaaccaacuucaaugaccgcucagacgaaaucaggagac

SEQ ID NO: 5437 - RNA, 679 nt, Leptinotarsa decemlineata
gaaguacaucaaaagcugccaagacccggaaaguggaggaauuagugcuugucagaaacaugauccucauauccuccacaccuugagugcugugcagauucuuugcauuuaugacaacuuggaugcuguagacauugaagccgucguuucuuauguagccagucuucagcuaccugaugguaguuucaugggcgauaaauggggagaaguugauacgagauuuuccuuuugugcaguugcgauucuguccuuguugaauaagauggauguaauugaugugaacaaagcaguggauuucauugcuucgugcaggaauuucgacggugguuucgguucaagacccuuaucagaaagucaugcuggucuuauuuauugcuguguuggauuuuuaucuaucaccaauagguuagauaucguuaaccgugauacuuuagccugguggcuuugcgagcgucaacuuccuuccgguggguugaauggucgcccugagaaacucccagacguuugcuauucauggugggucuuaucaacccucacuauacuuggaagacuacauuggaucgaugcaagugcacuaaagaacuucauuuuggcaugccaagacucugaaacaggaggauuugcugauaggccuggcgauauugcugauccguuccauacuuuguuugguuuagcagca

SEQ ID NO: 5438 - RNA, 650 nt, Leptinotarsa decemlineata
auagcaaaucuggucagcaauguaugccaaggaaacucuacagaaaugcagaaagaagcuacccuggaggccaucggcuacauuugccaggagauugauucugauguacucguaacccagucgaaugauauauuaacugccaucguucacggaaugagagccaccgaaccaagcaaucacguacguuuggccgcaacgcaagcucugcucaacucucuggaauucaccaaagccaacuuugaccaaccuaccgagaggaauuauauaauggaaguugugugugaggcaacucagucucccgagucucaaauaaaagucgccgcccuccaaugcuugguuaagauaaugucguuguacuaucagcacauggaaccauacauggcuccggcgcucuuuccgaucacgcuggaagcgaugaaauccgaaaacgaugccguggccuuacagggcauugaauucuggucgaacgugagugacgaggaaguagaucucgcgauugaagauuccgaggcuacugaagcgggaaggccuccagcuagaguuuccagacauuaugcaaagggagcccuacaguacaucguucccauccugcuucagaaacucaccaaacaagaagaacucgaugaugaagacgauuggaauccgaguaa

SEQ ID NO: 5439 - RNA, 713 nt, Leptinotarsa decemlineata
uccaaaugaaauaagcgugcccaugucuguagaguuugaugaauuugcuaaggcaagggaaaauccaaacgaugauauggccaauuuuguggaauucacagaugaggagggauacggaaaguauuuggaucugcacgaguguuaugaaaaauacauaaaucuaaaaggaauugagaaaguagauuacaucacguaccuuggaauguuugaucaacuuuaugacauucccaaagaaagaaaaaguggugaauaccgaaaauauuuauuaugucuuauagaguauuugaugugguuuguccaaaggaucaagccauuaauggauuuagaaagugguuuacaggaagaaguugauagaguuauugcuacaugggaaaguggcacaguaccuggauggccuaaagaaacggguucugcuuuagccaauguuggugcacauuuggaucuuucugcauuuuccagcugggaagaauuggcuucuuuaggucuggaucgucuuaaaucugcucuuauggcauuagggcugaaaugcggagggacuuuggaagaacgagcucaaagauuguuuucaaccaaaggaaaagguucuuuggauccuucucuuaugacuaaaaccaauaaaggaaaagcuagcaaagaaaaggaacaacuucgucaaagggagcuagcuacauuggaggcacagguuuacagauuggcagaauuaguugcuguuc

SEQ ID NO: 5440 - RNA, 528 nt, Leptinotarsa decemlineata
caggacucccgaacauuuauuggaacuuucaaagcuuucgauaaacauaugaacaugauccuaggugauugugaagaauuucguaaaaucaaacccaagaauucaaaaguggaaagggaagagaaacgaguuuuaggguuuguuuuggugagaggggagaguauugucucauuaacuguggaaggcccgccaccuccugaagagggcuugcccagaguuccuauuccaggagcagcaccuggaccaggaauagguagagcuuccggaagaggcaugcccccaggaaugggaggaguacccguugguuugcagggaccgguaagaggggucgguggaccaucgcagcaagucaugacaccagguggaagaggacaggugucugccccaccccaaaugaaucaaggucccccaaggaugggugguccaccaccagguguaauggggcccccuccaggaaugaugggaaugccuccucaaaugggcaugggacgaggaggcccuccaccuccgaugggaaugagaggaccu

SEQ ID NO: 5441 - RNA, 772 nt, Leptinotarsa decemlineata
gcucaaaagccgauaucaacagaggaaaaacuugcaguuuucuugagauauuuggcuucuggagacagcuacaaaaguauugcuuauaacuaccuguugggagaucgaacagugucuaauauuguccaagaaguagcuaccgcuauauggaauaauaugcaaccagucuauuuagccgaacccaaaacagaaacauggaaaucuauagcuuuacgguuugaggauagauggcaauuuccacacugcgucggugcugucgacggaaaacauauuguuauuaaaaaaccaggcaaaaguggaucaucauacuuuaacuauaaacauacauucucuauuauuuuaauggcaacaguggacgcggauuauaaauuuaucacaauagauauuggagcgaugggaagauuuagcgauggaaauguauuugcaaguaguggauugggcaagaaaaugaucaaacacacuauacuacuucccaauccugaacaaauaccuacgauugccgagccucugccguauguuuuuguuggagacgaggcuuuuccuuuaucggaaaaucuaaugagaccauauccaagaaggcaaauaacuggaaauuaucaacaccaaguuuucaaugcacgacuuucucgagcucggcaaacaguggaaugugccuucgguauacugucuucgcgguuucgcguauuccgaagaccauuugaaaguaaaguggacacugugagagauguaguaaaagccgcuuguguuuugcacaacuacuuacgacccucag

SEQ ID NO: 5442 - RNA, 789 nt, Leptinotarsa decemlineata
ccauacuggcgaacuauugaacaugcacggcgcgccggaaucgccggaucaagaagagaugacugcagaaccaucuccugaagcaaucgaugaagaaggcuugaauaauuaugacgguucugaguugcugauuauugaucaaaauaacaagucucccgaagauucgauuucgacaaaagaagauuucgaggaacuuauugacgaaggauccagaaaaaauaacuugucuaaaagagaaauuaccacuaaacacuugaacgacuuucacaaguaugcuaauauuuucaauuauaccaaaaacguucaaaccauacaaacuccaccgcaaaauacugguagaguuaccaauguaccacagaaaaugacuccaaaaauuucucucaucggcaauucuguaguacauagcgccaagacgguugcagacaaacuuauccuaacaccuucagcgacaacgguuauaaacacaacgcaagcaucaaaaguuacaagcaucauuuuaacucacaacucugcuguuaggggaaauguuaucaaugucacaaagguugugagcaccguaucaccagcuauaacuauaguuacugcuagcacuucacaaauagccucaauuuugccuuccaaauucacggugcccgucauaagugcuagcgcugugcgacaccuaucgaacguuaaaguaauagauaagccaucguccucucuaucgcucacuucccacgacagugccuugcccaacaagauauuugaagaugacuccguuucuccagauaguuccaauuucgaagacga

SEQ ID NO: 5443 - RNA, 2061 nt, Sitophilus oryzae
  misc_feature (1650)..(1650): n is a, c, g, or u
augccaagaucacgaucuagagaugguaaagaacauucuucacgaucaaaacacagucauaaaaaggcaucuaggucuccaagcuacgagaggaaaaaaucuaagagcaaaagacgcucgaguucgucuagaaguucuaaaagacgagauuuuaaauauguaaguaagaaucguaagcgacaugauacagacagugauucuucaaacaguaguaguucuucagacaguucuaguaguucacaaaauucauuaaaacuauuagagaagcuugagaaagauagaauaagaaaucuugaagagaaaaagagacaaaaggaacuauuaaaagcaacugagacagcagaggagaaacguuugcguagauuaaagaagaaggaagagaaagaacgcaagagaaaggaaagaaugggcugggauaaugaauauuuacauuauaccaauagugacaauccuuucggugaugguaacuuauuaucaagcuuuguuuggacaaaaaaguuagcuaaagaaggccugacaaaugcuagucaugaagaauuggaggcaagaaauagauucaaacaagaggaaaacaaaagagaacuggaaaaggugaagaaaagaaggcaagagcgugaauuagauagacaaagaagagaugaagagaaccagcucuugcaaaggagcaaagaggcagcccaguuugaagaaugggaaagacaagaagaucaauuucauuuagaacaagccagauuaagaagucauauucggauccaggaugguagagcaaagccuauugaucuucuugcaaaauauaucagugcagaggaagaaguagaugcuguggaaaugcacgaaccguacacauaucuuaauggacuucauauaaaagauuuggaggaucuuguugaggauauuaaagucuauaaagaacuggaaagaggaaagaauuuagauuauuggaacgauauuacaguuauuguugaagaugaguuacaaaaaaugagaaagauucaaaaggaacaggacuuugaugcugggguugguagaagagaagguauaaaucaagcaguagcucaagauguuacaucaguuuuuaaaggcaaaacagccauucaguuggcagcccuucaaaaacaaauugaaaguaaaauuucugguaaagcagauggaaucgauaucgguuauugggaaucuuuauugucccaacuuaaagcucacauggccagggcaagacuuagagacaggcaucaggaaaguuugaaaaggaaacuacaaguuuuaaaagccgaacaggcgguugcuuugccugaaaacaaccagaauauugaaaguacuaaacauagcgauaaugagaaacccaguaccucccaagagucuacagaagauagccaaagugauacagaagcuaaugagaaugcagcaaaugauauuuugaaugaaugcuuuauuuuauaucaaaauggaggguacaguccuaaauuauuaaguccugacgagauugaaccaggcacuauaguagugacagaagaggaugacacaaacagacuggaguuugcaagaaugcagguaacagccaaaggcaaaaaaguugagaauguuauaacgaaagaagaacuucuacuacaaaaagaggcaagaaaaggaaugggagaagaugaggcccaguungcaagaaaaggaaugggagaagaugaggcccaguuuaguguggaacaagcuuuagauaaucaaguauaucuuuggucagacaaguacagaccgcguaaacccagguacuucaacagaguacacacagguuuugaauggaacaaguacaaucaaacucauuaugacauggauaauccaccuccaaaaauuguacaaggcuacaaguuuaauauauuuuauccagacuugauugauaagaauuguacuccagaauauuuuuugacuccuuguccagauaauaaagaauuugccauuuugaaauuccaugccggaccgcccuaugaggacauugcauuuaagauaguuaauagggagugggaauauucauauaaaagagguuuuagaugucaguuucauaauaauauauuucag

SEQ ID NO: 5444 - RNA, 1266 nt, Sitophilus oryzae
auggacaaucuagaagccaauaucauggacaagucuaugagauccguuuucgugggaaauauucccuaugaagccaccgaagaaaaacucaaagauaucuuuggugaggucggucaaguuuugucguucaaacuuguuuuugaucgagagacuggcaaacccaaaggauauggauucugcgaguaucgugaccaggaaacggcacuuagugccaugaggaacuuaaacagcuacgaaauaggcgguagaaacuuaagaguugauaaugcuuguacagagaagucaagaauggaaaugcagaaucuucucaaucagccaccaguggaaaauccuuauggagagccuauucaagcugaaaaagcuccagaggcuaucagcaaagcuguggcuucacuaccuccugaacaaauguuugaacuuaugaagcaaaugaaaagcacaauucaaaauaauccuacagaggcuagacagaugcuauuacaaaauccacaacuugcauaugcuuugcuacaagcucaggugguuaugaaaauuauugacccucauacagcagcuucacuucugcauccaguaaaccaagugccagcuacucugaugccuggagacaagaauguuccuguucagguaccaauuagugcucaguuccaacagccuccaacuccaguugcaccucccagacaagaguuccaacccguuccugcuccaauuaugcacccaaauucccauaacgcccccguauuuacaggccaagauguugacuuaagaucucuagauccucgugguaccucagauccaagacugggcagaauggcagaucaggauaugagacaguuaccuccacccucucagcuuacuaauccuuuaccuccaccuguggcugaaaguuuuucgcgagaaccaagagauccacgcgauccaagagcaguuggucagucauuuccugcugauccuagacaagcagcaagagcugauccuagacagaaaacuaugguuccgccuccaacggccgugccuccuccaucugucagaccgccuccugucaccucgauuacgucaucgcccacgucaaaccagccuucgagagccagcguagcgucagcugucagcggggccaccaauccggguacuucugaucaagaaaaagcugcucuuauuaugcaaguucuucaauuauccgaugagcagaucgcuauguuaccucuggaacaaaggaauagcauuuuggugcugaaggaacagauugcgaagagugcacagggucguuaa

SEQ ID NO: 5445 - RNA, 1209 nt, Sitophilus oryzae
  misc_feature (664)..(664): n is a, c, g, or u
auggaagccgaacgugaaaaagcucuacaagauuauaggaaaaaacugauggagcauaaggaaguggagucccguuuaaaagaaaugcgagagcaacuuaaagaucuaacaaagcaguaugauaaaucagaaaaugauuuaaaggcucuacaaaguaugggacaaauugucggugaaguacuaaagcagcucacagaagagaaguuuauuguaaaagcaacaaacggaccccgcuaugucgugggcugucgcaggcaauuggacaaggccaaauuaaaagcagguacucgaguagccuuagauaugacuacuuuaacuauuaugagguaucuuccucgugaaguugauccucuaguauacaacaugagucaugaggauccaggugaugugaccuauucugcuauuggaggauuaucagaacaaauccgugaacuaagagaaguuauugaacugccacuccucaauccagaacuuuuuaugagaguugguauuacaccuccaaaaggcugucuuuuauaugggccuccuggcacugguaaaacauuacuugccagggcgguggccucccaacucgaugcaaauuucuugaaaguugucucuagugcuauugucgauaaguauauuggugaaucggccaggcugauuagagaaauguuuaacuaunucgauaaguauauuggugaaucggccaggcugauuagagaaauguuuaacuaugcuaaagaucaucaacccuguaucauauuuauggaugaaauugaugcuauuggaggucgacguuuuucugaagguacaucugcugauagagagauucaacguacguuaauggagcuucugaaucagauggacgguuuugauucacuuggacaaguaaaaaugauaauggccacaaacagaccugacacauuagauccugcacuucuuagaccuggcagauuagaucguaaaauugaaauuccucugccuaaugaacaggcuagguuagaaauuuuaaaaauucaugcaggccccauagcuaaacauggugaaauugauuaugaagcaauuguaaaacucucugauaacuuuaacggagcugacuugagaaauguguguacugaagcaggauuauuugcuauaagaucugaaagggaauauguuauacaagaagauuuuaugaaggcaguuagaaaaguagcagauaacaagaaacuugaaagcaaguuagau

SEQ ID NO: 5446 - RNA, 780 nt, Sitophilus oryzae
auggcccgaagauacgauacuagaacaacuaucuuuucuccugaagggagauuauaucaaguagaauaugccauggaggccauuucuuuagcaggaaccugccuaggaauuuuagccaacgauggcauuuuauuagccgcugaaagaagaaauacuaauaagcuuuuagaugaaguauucacuucugaaaaaauuuacaaauuaaaugaugacaugguauguaguguugcugguauaacaucggaugccaauguucuaacuaacgaacuaagauugauuggucagagauacauuuuccaauauggagaaucaauuccaugugaacaguugguuucuugguugugugauguuaaacaagcuuauacacaauaugguggcaagaggccauuugguguaucuauucuuuauauggguugggauaaacacuauggcuaccaguuguaucagucugacccuagcggaaacuauaguggauggaaagcuacauguauugggaacaauaguucugcugcuauuucaagcuuaaaacaagaauauaaggagggagaaaugacacugaaugaugcaaaaaguuuggcugugaaaguauugaguaaaacuuuagauaugacaaagcuaacaucagaaaaaguugaaauggcaacacuaacuagagugaauaauaaaacaguuauucauauucuuacugcuaaagaaguggaagaguugaucucacaguuugagaagagcgaagcagcauuggaagcuucaaagaaagaacaacaaaaaguaacugcuuga

SEQ ID NO: 5447 - RNA, 2673 nt, Sitophilus oryzae
auggccgaagcaaaggcagaagcacccacuaaaguagaagcaaaaaaggauacugaagaagauaaaaaugaauuaucagaagaagauaaacaacugcaagacgagcuaaaccuuuguguugaaaggcugacugaaaacgaugaaaaucuauaucuuucugcucugaaugugcucgguacaaaaauaagagccucaacuacaucuaugacguccgucccaaagccucuuaaauuuaugaagccacauuaugauacaaugaaacaaguuuacgauaaaauuaacaaucccaauguaaagaagguuugugcugauguaguuucuguucuagccaugacuaugggcgaagcacgugaguguuuaaaguauagacuucuaucagauuuagaucaaauacgagaaugggggcacgaguauguaagacauuuagcuggcgaaauugcuggagagugggcagacaaagaaguagaugauaaagauauggaaguuaaacuuauacagcuagccaagcaaauagugccuuauaacauggcacacaaugcugaagccgaagcuugugacuuguugauggagauugaacgucuugauuugcuugaagaauauguugaugacaauauuuauccuagaguuugcuuauaucuuacaaguuguguaccauauguagcugacccagagaauacaacuuuacuucagacagcucuguuauuauuuaggaaguuuaaucaguauccucaguccuuaagacuagcuuugcaguuaaaugaccaugcacuuauagaagaaauauuuuugucgugcaaagauacgacaauccaaaaacagcuugcauucauguuggggcgucaacagauuuauauugaaauuccugaaacuacuccagaauaugaggaccuugcugaaauaauggcuaacugucauuugaauaaccauuucuugaauuuagcaagagaacuugauauuauggaacccaaaacucccgaggauguguauaaaucccacuuagaaaacaccagacccucuuuugguggaagccaaguugauucugccagacagaaucuagcugccaguuuuguuaaugguuuugucaaugcugcuuuuggccaagacaaacuguuaauggaagaugguaauaaauggcuuuacaagaacaaagaacaugggaugcuuagugcuacugcaucucuugguuuggugcuuuuaugggaugucgauggagguuuaacaccuauugauaaauacuuguauucuucugaagaucacaucaaaucaggagcacuucuagcuugugguauuguaaacugugguguuaggaaugagugugacccugcucuggcucuucucagugauuauguccugcauaaugcuccaauuaugagaacuggagcgauuuuaggucuagguuuagccuauguugguucuaaccgugaagcuguguuaaguuuauuguucccaguauuuucugauccuaaaucuaacauggagguaauuggaauggcggcauuagccuguggaaugauugcaguaggaucaggcaauucacaaguuacaaccaccauuaugcagacucuaauggagaagagugagacugaauugaaagacacuuaugcuagauucuugccuuuggcuauaggauugugccauuugggcaagcaagaaagcauugauaccauuauugcugcuuugcaaguuauuccagagcccuucaggucuauggcaacaacaaugguugauauuugugcuuaugcuggcacaggaaacguucuaaagguucagcacuuacuccacaucuguucugaacauuaugaacccccugagccuguagaaaaagauaaaaaggacaaggaaaaagauaagaaagagaaaccugaagaaaaggaaaaggauuugucagcucgccaagccauugcaguccuuggaauagcguuaaucaguaugggagaagauauuggcagugaaauggccuucagaacauuuggacauuuacucagauacugugaaccaguuauuagaagagcagugccucuugcuuugggucucauaucaguuuccaauccgaaauugagcauucuagauacacugagcaaguuuucucaugacagugaugcugagguagcucacaaugccaucuuugcuaugggauugguuggugcuggaacaaacaaugcaagauuagcugcaauguugagacaguuggcacaguaccacgcaaaggauccaaacaauuuguuuauggucagaauugcacagggucuaugucacuuaggaaaaggaacacuuacuuugagcccauaucacagugacagacagcugaugaguccuguagcuguagcuggcuugauggcaaccuuggugggauuuuuagaugucaaaacaauuaucuugggaaaaucucauuaccuccuguauacuuuggcagcagcuaugcagccaaggaugcuggucaccuuugaugaagaucucaaugcauuaccuguaccugucaggguugguuuggcuguugauguaguaggacaagcgggcaaaccaaaaacaauuacaggcuuucagacucacacaacuccaguccuuuuggcucauggugagagagcagaacuggcaacugaggaauauauuucccucacgcccauuauggaaggauuuguaauauugaggaagaauccagacuuuaauccguag

SEQ ID NO: 5448 - RNA, 435 nt, Sitophilus oryzae
gacagcacgggcggcccaucccagcaguacuacaucaccacccaguggccugccccgggaaacaauauggaagaugguggugcuagcgugggcacuucuggcggccaacaccagcagcgaucuggcacagagacuggcaacagaagaacaggaguuucaugugcgaacuguaaaacagugaacacgacacuuuggagaagaaauaaucaaggugaacccguaugcaaugcuugcggacuauacuucaaguuacacaacgugaacagaccaauuagcaugaagaaagaggggauccaaacgagaaaaaggaggccaaaaaauuccaacagcaaucagcaacaucccaacaguccaaccacauccggcaugcaccaacaaagaaugaaauugauccucccagacaguagcacagagcuaagacuuauggcgguuuag

SEQ ID NO: 5449 - RNA, 3918 nt, Sitophilus oryzae
auggcuuuaccaggcaacgggauauuuguuguaaagggcgagaugacuauauugauggcugccaugaaaagaggcacaagauggucaucccacucauauuuagacgaagaacuagauuuacuaaugaaaaguuuccaagaacucaaagaauuacugagcagaaucgaugaucuuagacuuaucgaaccagaaguguuccuaaccccauuucuugaaguuauucguagugaggauacuacagggccuguuaccaguuuagcccuagcugcuguaaauaaauucuugucauauggcuugauagauccuacacauuccucuguuccacaaaccguacacaacauagccgaugcugugacucaugcuagguuugugggaacagaccaauccucugauggggugguuuugaugaggauuuuacaaguuuuaaggacacuaacuuugacuccugagggagcaauguuaaccaaugaaaguuugugugagauuaugcugaguuguuuuaggauauguuuugaaacacgcauucaugaauugcuaaaaaagacugcagaauacuacuuaaaagacauggugcaauuaguuuucaugagauuaccucaguuuuccgaugaugucagaucauugaguaucaagaauuugaagaugagagcugguacagguguggaacagacaaaauugaagaaaaagaguaggcauucguucaggaaaaaaagccaaacagaagacagagaugcuguugaagagaauguaucaauuaguagaucagugucgguagaaacaaauucacuaaauaauguggauaacguuguggauguacagaaucaucugauuucaacagaugcagcguuagaagguaaugaacaagaaaauaucgagaacauaaguauagaaagugauaaaauucagacagaaaaugaagaaguuacaggagaacaaccugagauaaaugaaguuaaaaauucagaaucggucucugugaauuuagaaacuguucaaaaacaagugucagacucaccagagucauugaauguaccagaucaaucagugaauucaagugauucgaauaaagaguauguuaaucagagagggauaagauuuacaccacaaaugauucagccagaugacuuaguucugauuccuuacgguuuggcaugugucagggaauugcuuagauuuuuaaucagucuauguaauccaaacgacaagcaaaacaaugagguuaugauccacuuaggguugacguuauugacaguugcauucgaggugggagcugacaguauaggcaaacaugcagcacuacugucacuggucaaagaugaucuaugucgaaauuuguuuucucuucugaauucggagagaauaucuauuuuugcggcagauuugcaagugucguuuuugauguuugagucacugagaacuaaccucaaauuccagauggaaaaauacuugacaaaguugauagaaaucguaguuagugaaaaucaaaaagugacauaugagcacaaggaaaucgcccuggauaacauuuuacaacuuuggagaauaccaggauuugugaaugaacuguauuugaauuaugauugcgacauguacuguacaaaucucuaugaagauuugacgaaacuuuuggcaaaaaaugcuuauucugcgucgaaugguguauggcacacacaucuccugucauuggacgcucuuuugacaguuauagaagguauagaaaugcauugcucagauaguaaaaguucucaggauuugccucauaguaagaagucaacuagugaaagcaaugaaacuauugaaaguauaggaaauauuauaggaaaacauaaucgcguuaaguauagugaaucuguaccuccacuggaugauuugcuggccaaaaaaaguaucaaaaagcgguuaccucaaggcacugaacacuucaacaucaaaccgaaaaaagguauacaauucuuccaagagcauggcguuuugaagagcgauucugacaaucaagagaucgccuuauuuuugagggaaaauccugcuuuagauaagaaaaugaucggcgaauauauuaguaacaggaacaaccugcauauuuuagacgcuuuugugaagacuuuuaguuucacuggugucaggauagacgaagcuuugagaaguuuuuuggagacuuucagguuacccggggaagcaccgacuauaucgcugauuuuggaacaauuugccgaacacuggcauaaaagcaauggagagccuuuugccgauguagauuccgccuuuacccuagccuacgcugugauuauguugaacguugaucaacacaacgaaaacgccaaaaaacagacuauaccuaugacgccauuggcuuuuaaaaagaauuuaaaaggugugaauggaggugacgauuucgaugaacaaauguuagaugagaucuacaacacuaucaaaaacgaugaaaucguuaugcccgcagaacaaacagguuugguuagagaaaacuaucuguggaaggugcuauugagaaaaggagcuucaaaagagggugucuacuugcauaucccccaaggcacuuacgauuccgagcuuuuuaaguuaaucuaugguccgguggucacugcccuaugcgcaguuuacgaaaaaucggaagauucgggcauuuucaagcgcaucaugcucggguucgaaaaaugcgcguuuguggcugcgcauuucaacaugacagagaaucuggacacuuugauacucuccuugugcaaauacaccgucuuuuucaaucaaaaaagacaaaauaacauugcgauaucguuuggauccaaccaaaaagcucaacuagcacuaaaaacuguauuuuccuugguucaucuucauggagacaauauucgugauaguuggaaacauauuuuugauuuaauucuagcucuauacaguaacaauuuguuaccuaaaaguuacauugaaguggaagauuuuaucgaucccaguggaagaauaguuuugaguuauaaagaaaucgaaaauuuacagaaacaggauacaaguuuguugaguucgcuguauucuuauaugguaucggcagaaaaucucucaaaaguaccaucgccagaagaacaacaauucauagccauagccaaagaaugucugaaggauuguaacuuagaucagcuaaucacagauucgaaauucuugcacgaagaggcucugcuggaacuggcaaaggccuugauugaacuguccagagguccagauggacagagaagcguagaguauggcuauaacgagagcgagacuguguuuuuuauggaauuacuuuucaaaaucgucauucagaacagggaucguguuaugacaguuuggcaaccugucagagaccacaucuacacccuaaugaugaacgcaucacuguuugacuaccaguuccuccucgaaagaucgguaauaggcuuacugcgcauagcgauucgccugaugcgcaacgaagacauguguccaauaguaauacagucgcugcgcauguugcugcugcucaaaggcacgacuuugugcaggauuuccaagcagauuucuuucggguuauaugaacuacucaagacuucugcgcagaacauccauaccacuaccgauuggacgauuauuuuuacuuugcuugaguguguuggagcuggagcucagccuccuaagcccauuguggacgauggagucagucauguugauccugguacaaagucagaaggcgagaaccaaauaaacagcgacgacgaaaguaucguuucggacagaggcuacaccucugauaccgaacugacuaaagccgcucggaccaaucagagagcucccagcccgauuuuaguaccaaauucaccaauaggaacgcccaauacuggaggauggauacuaguugguaacgaaggagaaauacagccaguuauaggucgu

SEQ ID NO: 5450 - RNA, 618 nt, Sitophilus oryzae
augucuauauuagcguauaacgguggggccauggucgccaugaaaggcgagaacugcguaucuaucgcugcggacagaagauuugguauccaggcccaaacugucgcgacaaacuuugagaaaaucuucgaaauggguccccaauuauacguaggccuuccugguuuagccacugauacgcagacgguuauggagaaacuccguuuccgaaagaaccucuacgaacugaaagagaaucgaucaauuucaccuaagguauuuagcgcuaugguaucucauauguuguaugaaaagcguuuuggcccauucuucgucgaaccggucauagcugguuuggauccgaaaacuuaugagccuuuuaucuguaauauggacuugauugggugcauaaaucaaccaaaagauuuuguugugggaggaacagccagugcacaacuuuacgguaugugugaagcuuugugggaaccaaacuuagguccagaugauuuauuugagaucacuucucaagcccucauuaaugcuuucgauagagaugcuaugucugguuggggugccacaguuuauauaauugaaaaggacaagguuacaauuagaaacuugaagacuaggauggauuaa

SEQ ID NO: 5451 - RNA, 1911 nt, Sitophilus oryzae
auggaguauuguagauuauuuacagaauuggcugaaucauuuuuagauaaaauugugucgucgagcgcaccuaauaauaugcaucacucugugaaaauuuuagauuuaguguugaugugcgugggacaucacgauuaugaaguugccgagauuacuuuuaaucugugguaucuucucagcgaacagcucuaccaguugagcaacaauaacauaagugaccuuuuuagaccguauauugaaagauugauuacugcgcuguguaggcauugccagauggaacccgauugugaaggaauauuagaggauggagaugaauuuaaggacuuuagaauaaaaguaucugagcuaauuagggacguugcauuuauaguaggaagcaccaguuguuuuaggcagauguuucucaauuugcaaaauccgggugugaccugggaucagacugaagcggcucuuuauauuaugagggcuguugguaaauauguauuaaguucugaaaaugaggucguuccaaauguaauagaagcaaucauaaauauuccagaaaccacucauaucgcagugcguuacacuucaguuuuacuacuaggagaauuaugcgaauggauugaaucccauucucaagucuuagauccaguuuuaaauuuucuaauucaugcucuugcccaaccugguuuaggugcugcagcugcuaaugcauuacagaacauuugcgcaacgugcagugacaauuugucuagacaugugccgauucuuuugcaauuguugcaccaaauugacacuuucggaaucagugaugaggcuguagugggacuuuuuaaaggugucaguacaauaauagcacuuaugccacugaaugaaauaacgcccgcaaugcgugaauugugcuuaaugcagguaaauccucuuugccaucuuauugaccaaaauguuagccccaccaaggguaccaagacugauccgguuaugugguuugacagacucagcuccauuuuaagacacguuauuguaaauaauauuccagaaggggaaguucauccauguaagccagugauuuuggaaauauggccaguuuuauccagggcauuugacaaauaccaaaacgacauuaggauaauggagagguguuguaggagcgucagauuuaugcuuaggugugcuagucaucaaauucacgaaguccuagaaacguuaguuggccaaauaguaaggauuuauagcguccacaagcauucguguuuucuauauguuggcagcauacuaguggaugaguacgcuaccgacccgcgauguauaggcggucuuaucgacauguuacagauguuuauagaacccacauuccagauguuacaagaagaacacggacuuagaaaccauccagauacaguggaugauuuuuucagauuauguggccgauuuauacgccgcgcccccauguccuuccuccaguguuccgcccucguuccgaucauccagugcgcccugcuggccucccagcuggaccacaaggaggccaacguguccgugaugaaguucuuuugcgaccugaucaaccagggccagacuggacagucccagcccgacuacgccgaacgacacaagcuggucaaggacauucuggaccaguucgggcagcaauuggugaccagucugcugcaggcgugcguguucuauuugcagauguaccuguugccugaaguaagugacguauuuguccagcuccuagacuucaacagaacaacaacgaguaagugguuaaugaauggauuggauacgcuuccgaaaagaaauaauggcgguaucauggcggccaccccagaacaauugaaugaccuucaugugacauuuauaagagccaccucuucuagaucgguaacuuacguacugaaagaucuuauccgguauuaccgauaa

SEQ ID NO: 5452 - RNA, 1506 nt, Sitophilus oryzae
  misc_feature (1220)..(1220): n is a, c, g, or u
auggcucagagauuuccgggaccuggggcugcuccaguucccagugcaccuccuccacaacgguaccaacaaccccaaaauccaggcaugcgccaauacaaccaacaaaauuuuccgcaacgugcgggauauaauaauccgccgccaaauaugaauacuaguggcggaaccaugauacaaagaccguccggagcaccauacuccccuaugcgaggagcucaaauucccacccagcccacaggaaagagaccggcugauaaucguagcaccauacaacaaaaaagugauuacagucacaguacaagcaagaaaaagaagaaauuggcggacaaaauucugccucagaaaguucgugauuuagugccggagagucaggcuuauauggaucuguuggcuuucgaaaggaaacucgaugcgacaauaaugcggaaacguuuagauauacaggaggcauugaagagacccaugaaacaaaaaagaaaauugagaauuuuuauuuccaacacauucuauccagcuaaggaaccguguccugauagcccagauggaucugcacaagaaggaucuguagccucuugggaacuacgcgucgaaggaagauuauuggacgaugccaagaaugaucccaauaaggucaaaagaaaauucucuucauucuuuaaaucacuagugauagaauuggauaaggaauuauaugggccagauaaucaccugguggaauggcaucgcaccuuaacuacccaagagacagauggguuucaagucaaacgaccaggagauaaaaauguccguuguaccauacuacuccuucuagacuaccaaccguugcaauuuaaauuggauccuagacuggcacgguugcugggcguucacacucaaaccagaccugucauuauaucagcucuguggcaauacaucaaaacccauaagcugcaagauucacaugagagggaguauauuguuugugauaaauaucuggaacagauuuuuaacuguucaaagaugaaauuugcugaaauaccgcagagauuaaauccauuguugcacccaccagauccgauaguaauuaaucacgugaucucggucgagggcggagcugagagcaaacagacugccuguuacgauauugacguugaaguugaugauacguuaaagacccagaugaacaauuuccuguugagcacugcuagccagcaagagauucagggauuggauucganuucgaaaauucacgaaaccgucgauacaaucaaucaacugaaaaccaacagagaauuuuuccugagcuuugccaaagauccucagcaauuuauucauaaauggauugucucucaaacuagagaccuaaagaccaugacugaugugguuggcaacccugaagaggagcgucgcucagacuucuuuuaccagcccugggcccaggaagcggugugcagauauuucuacacuaaaguccaacagaaaagggccgaauuggaacaagcccucgguauacguaauaacuaa

SEQ ID NO: 5453 - RNA, 435 nt, Sitophilus oryzae
augccuaaaguucgaagaagcaaaaaagcaccaccagaaggaugggagcuaauagaaccaaccuuagaugagcuagaacagaaaaugagagaagcugaaacugaaucgcacgaggguaaacgaaaaaacgagucguuauggccuauuuucaaaauccaccaucagaaauccagauacauuuacgaccuguuuuauagaagaaaggcaauuuccagagaacuguacgaguauuguuuaaaugaaaauauagcggacaagaaccuuauagcgaaauggaaaaaacaaggauacgaaaacuuauguuguuuaagguguauucaaacgagggacaccaauuuugggacuaauugcauuugucgaguaccuaagggcaaauuagaagagggcagaauaguugaauguguccauuguggaugucgaggauguucagguuga

SEQ ID NO: 5454 - RNA, 915 nt, Sitophilus oryzae
  misc_feature (676)..(676): n is a, c, g, or u
augccaacagcuacaguugguagcuuacaacuaccaaauaaugaagauuguggaaucagagauguuugggcucauaacuuagaagaugaauuucgcacuaucagacagaucguucagaaauaccaguauguugccauggauacugaauuuccaggaguuguggcucggccuauaggggaauuuagaaguucggcugauuaucaguaucaaauguuaagauguaauguugauuuguuaagaauaauacaacuuggucuuacauucuuagacgauaauggcaagacaccugguggaucauacacuacauggcaauuuaacuuuaaauuuaauuuacaagaagauauguaugcacaagacaguauagaccuguuaaccaacuccggaauccaauuuaaaaaacaugaagaugaggguauugagccauuagaauuugccgaacuacuuaugucuucuggcauuguuuuaauggauaauaucaaaugguuaagcuuucauucgggguacgauuuuggauaucugaucaaauuacuuaccgauaauaacuugccucaagaugaaaacgaauuuuuugacuuguugaaauuguacuuuccaacaauauaugauguuaaguaccucaugaagucuugcaaaacuuuaaaaggggguuuacaggagguagcugagcaacuugagngggguuuacaggagguagcugagcaacuugaguuggaacguguaggaccccaacaucaagcuggaucugauucucuacuuacuggaauggccuuuuucaagaugaaggagauguuuuuugaggauacuauugacgauucuaaauuuucuggucaccuguauggucuuggaacaucauucgcugugaauggaacaaauaauuacccaccugauaauggagauaaugcaaacucagcauaa

SEQ ID NO: 5455 - RNA, 1212 nt, Sitophilus oryzae
augucggaagcggggaagagccguaauaauauuuacgaagauuuaucgaauguugaauucgaaaccagugaagauguggacguuaucgauaaauucucuaaaaugaaccuuaaagaagaacuaacuagaggaauauacgcauacgguuucgagaagcccucggcuauucagcagcgagcuaucaagcccauuaucaaaggcagagacguuaucgcacaggcccaguccgguacaggaaaaacagcaacauuuuccauuucaaucuugcaaacacucgaccugaccguucgugaaacucaagucuugugcuugucucccaccagagagcuggcaguacaaauucaaaagguaauucucgcucugggcgauuuuaugaacgugcagugccaugcuugcauuggggggacuaauuuaggggaggauauuagaaagcuugauuacggacagcaugugguuaguggaacgccagggagaguuuacgauaugauaagaagaagagcacuucguacucggucaguuaggaugcuuguccuugacgaagccgaugagauguugaauaagggauucaaagaacagauuuacgauguauacagauuccuaccccccucaacucaagugguccuaauuucggcaacacuaccccacgaaauccuggaaauaaccucaaaauucaugacggauccuaucaggauccuggucaaacgugaugaauugacucuggaagguaucaaacaguucuuuguggccguggaaagggaagaauggaaguuugacacucuuugugaccuguacgauacacugacaauaacacaggcgguuauuuucuguaauacaaagaggaagguggauugguugacugagaaaaugcgagaaaguaauuuuacggugagcuguaugcauggugacaugccccagaaggagagagauaauauuaugaaggaguuuaggucgggacagagucggguuuugaucaccacagauguaugggccagaggcauugacgugcagcaagucaguuugguaauaaacuacgacuugcccaacaaucgugaauuguacauccacagaauagguagaucgggaagguucggcagaaaagguguggcaauuaauuuugucaaaucggaugacaucaggauuuugcgggauaucgaacaauauuauucgacacaaaucgacgaaaugccuaugaacguggcggaucuuauuuaa

SEQ ID NO: 5456 - RNA, 1608 nt, Sitophilus oryzae
augacagcccccaaggcgucaggagaugcaaaucguaauaauagaaaugccgcauacaaggauaaaagcaaaccuaccgauguaagaacuagcaauauaaaugcugcaaaagccguuugugaugcgauucgaacaaguuugggacccaggggaauggauaaaaugauccaagccaguaauggggaaguaacaauuacaaaugauggagcuaccauuuuaaagcaaaugaauguaauucauccggcugcaaaaaugcugguagaauugucaagggcucaagauguugaagccggcgaugguacuacuucaguuguuguuauugcuggagcauuauuagauacugcugaaaaacuauugaacagaggcauucauccaacggcaauaucagagucuuuucaaaaggcugcuucucaugcuguagagaucuuaaacaacauugcuacuccaguugaauuaaauaauagagaacaguuaauuaagagugcaucuacuucgcuuaauucaaaaguugucucacagcaaucaacucaguuggcaccuuuagcuguugaugcaguauuaaaaguacuugaaccaggucgagaaagcgcauguaauuugacagauauuaaaguuuuaaagcaauuaggcgguacaguggaggacacugaacuaauuaauggucuuguguuuccaagaacucuggcaaauguuguuggcccuaaacgauuagaaaaagugaaaauuggucuuauccaguucugcauuucuccaccaaaaacugacauggaucauaauguuaucguuucugacuaugccgcuauggauagaguuuugaaagaagaacgagcauauauuuuaaacauuguuaagcaagugaagaaagcuggcuguaauguguuacuuguacaaaaaucuaucuuaagagaugccaucucugacuuggcuuuacacuuuuuggauaaaauuaaauguauggugguuaaggauauugagagggaagauauagaguuuguuugcaaaacuuuaggcugcaggccuauugcaucuuuggaucauuuuguagcugagaauuuagugucggcagauuuagccgaagaaguuggauuuggagcaaacagaauggucaaaauaucagggauucagaauccuggacguaccaucacccucuuggugcgggguucaaacaagcugguccuugaagaagcagagcgaucuuugcaugacgccuuauguguaguuagaugucuuguucguaaaagagcgguaauagcagggggcggggcccccgaaacugaacuggcucugcgauuggcugcucuugcagauaaaauggaaggagucgacgcuaucugccuuagggcauaugcuggagcccuggagauuauuccauuuacuuuggcagaaaaugcugguuugaacccaauucagacuguaacugaauuaagaaauaggcacgcaaagggagagauuucugcaggaaucaacguacgcaaagguuguauuucugauauauuagaagagaauguaauucaaccauugcuggugaccacaucugcuuugucuuuugcuacagaaacagugagaucaaucuuaaaaauugaugauauugugaacacaaugacauga

SEQ ID NO: 5457 - RNA, 1335 nt, Sitophilus oryzae
  misc_feature (699)..(699): n is a, c, g, or u
auggaagcaauggauguuguuuuacccgaaaaagaagaagguagcccuucggauacaacgaaaccaaaucuucaggaucuagacacugaagauuuauacacaaaguauaaaaaacugcaacaaaugcucgaguuuuuggaaguucaagaggaguauauuaaagacgaacaaaggaauuuaaaaaaagaguaucugcacgcucaagaagaagucaagaggauucagucuguuccuuugguuauugggcaguuuuuagaagcugucgaucaaaauacagguauuguuggaucaacaacugguucaaacuacuauguaagaaucuuaucaaccauugacagagaguuacuaaaaccuagugcuaguguagcauuacauaaacacagcaaugccuuaguugauguauugccucccgaagcugauucaucaaucagcaugcuucaagcagaugagaagccugauguuagcuacagugauauuggugguauggauaugcaaaagcaggaaauucgugaagcaguagagcuaccccuaacucacuuugaauuauauaaacaaauugguauugauccuccaagggguguguuaauguauggaccaccaggguguggcaagacuauguuagcuaaagcuguugcucaucauacuacagcugccuuuauccgaguuguugguuccgaguuugugcaaaaauacuugggnggcaagacuauguuagcuaaagcuguugcucaucauacuacagcugccuuuauccgaguuguugguuccgaguuugugcaaaaauacuugggugaaggucccagaaugguaagagacguuuuucgucuagccaaggaaaacucuccagccauuauuuuuauugaugaaaucgaugccaucgcuacaaaacguuucgacgcucaaacgggcgccgaucgugaaguucagagaauucuuuuggaguuguugaaucaaauggacggauuugaucaaacuacuaauguuaagguuauuauggcuacaaacagagcugacacccucgauccugcccuucuuagaccuggucguuuagauaggaagauagaauucccgcuaccugacagaagacaaaagcguuuaguuuuuagcacuauuaccucaaggaugaacuuaucugaagagguugauuuggaagacuauguagccaggccagauaaaauuucuggagccgacauaaacgccauuugucaagaggcagguaugcaugcagugagagaaaaccguuauauugugcugccaaaagauuuugagaagggcuacaaaaacaacauuaagaaggacgagagcgaacaugaauucuacaaaaacaacauuaag

SEQ ID NO: 5458 - RNA, 585 nt, Sitophilus oryzae
  misc_feature (380)..(380): n is a, c, g, or u
augccgaaaaucaaacugcagucguccgauggcgaaauauucgacguugaaguggagaccgcuaaaugcucgguuaccaucaaaaccauguuggaagaucuagguauggaugacgaagaggaagaaauagugccucugcccaauguuaauucagccauucuucgaaaaguccuacaaugggcuaccuuccacaaagaugauccaccgccacccgaagaugacgaaaguaaagaaaaaaggacugacgacauuucaucgugggaugcugauuuccugaaagucgaucaaggaacacuguucgaacugauuuuagccgccaauuaucuggacauuaaaggccugcuagaugucaccugcaaaacuguugccaauaugaucanucaaggaacacuguucgaacugauuuuagccgccaauuaucuggacauuaaaggccugcuagaugucaccugcaaaacuguugccaauaugaucaagggcaaagcgccugacgaaauucgcaaaacguucaauauuaagaaugauuuuacagccuccgaggaggaucagguucgaaaagaaaaugaauggugugaagagaaauag

SEQ ID NO: 5459 - RNA, 1035 nt, Sitophilus oryzae
augaaagcaacaaccucuccaaaguuaaauaaacuguucauuucuaagcaaaaugaauuucaggauauucaaaguaaagcugagcaggggcuuauuaauauggcgauugacgaaaaggcaucauguaaggaguuggaccaguggauugaacaacuaaacgauugcaaccaauuaacggaaaaucaagugaagacccuaugugauaaggcuaaagaaauauuguccaaggaauccaauguacaggaaguaaaauguccagucacaguauguggagauguacauggucaauuccaugacuugauggaauuguucagaauaggcggacgaaguccugacacaaacuaccuguuuaugggagauuaugucgaucguggauauuauucaguagagacagucacauuguuaguagcuuuaaagguucgguauaaggagagaauuacaauucuaaggggcaaucaugaguccagacaaauuacucaaguauauggcuucuacgaugaaugucuccgaaaauauggaaaugcaaauguuuggaaauuuuucacugauuuguucgacuacuugccacugacagcucuaguugauggucaaauauucuguuugcaugguggguuaagucccagcauugacacuuuggaccauauucgugcauuggaucguuuacaagagguaccucaugaaggaccaaugugugaccuuuugugguccgauccugaugaccgcgguggauggggcaucaguccucgaggugcgggauacacuuuuggacaagacaucucugaaaccuuuaaucauucuaauggauuaaccuuaguuucgagggcccaucagcugguuauggaagguuauaauuggugucacgauaggaacgucguuacuauuuuuagugcuccaaauuauuguuaucguugcggaaaucaagcugcuauuauggaauuagacgacgcccucaaguauucuuucuuacaguucgauccagcaccgagacgcggggaaccccacgugacucgccgaacucccgacuauuuccuguaa

SEQ ID NO: 5460 - RNA, 3882 nt, Sitophilus oryzae
augcagauuuucguaaaaaccuugacugguaagacuauuacccuagagguagaaccuucagauaccauugaaaacgugaaggcuaagauucaagacaaagaggguauuccuccagaccaacagcguuugaucuucgcugguaaacaguuggaagauggacgcacuuuguccgacuacaacauccagaaggaauccacucuucauuuaguacugagauugagaggaggaaugcagauuuuugugaagacuuugaccggcaagaccaucacuuuggaagucgaaccaucugauaccauugaaaauguaaaagccaaaauccaagauaaggagggcauucccccagaccaacagcguuugaucuuugcuggaaaacaguuggaagaugguaggacucuuucugauuacaacauucagaaggaaucuacccuucacuuaguauugagauuaagaggagguaugcagauuuucguaaaaacauuaacuggaaagaccauuaccuuggaaguggaaccaucagauaccauugaaaacgucaaggcaaaaauucaagacaaagaaggaauuccuccagaccagcaacguuugaucuuugcugguaaacaacuagaagaugguaggacucuuucugacuacaauauucagaaggaaucaacccuacauuuggugcuuagacugagaggugguaugcagauuuuugucaaaacuuuaaccggcaaaacuauuacguuggagguagaaccuucagacacaauugaaaaugugaaagcuaaaauucaggacaaagaagguauuccuccagaccagcaacguuugaucuuugcugguaaacaacuagaagaugguagaacucuuucugacuacaacauccaaaaggaaucuacccuucacuugguacugagguuaagaggugguaugcagauuuuuguaaaaaccuugacagggaaaaccaucacuuuggaaguggaaccaucagacaccauugaaaaugucaaagcuaaaauucaggacaaggaaggaauuccuccagaucaacaacguuuaaucuuugccggcaaacaguuagaagaugguagaacucuuucugauuacaacauccagaaagaaucuacucuucacuugguccugagguuaagaggugguaugcagaucuuuguuaaaaccuuaacaggaaaaacuauuacccuagaaguagaacccuccgacacuauugaaaaugucaaggccaaaauccaagacaaggaaggaauuccuccagaucagcaacguuugaucuuugcugguaaacaacuugaagauggacgaacuuugucugacuacaauauccaaaaagaaucuacucuucacuugguacugagguuaagaggagguaugcagauauuuguaaaaacauuaacuggaaaaaccauuacauuggaaguagaaccauccgacaccauugaaaauguuaaggcuaaaauucaagacaaagaaggaauuccuccagaccagcaacguuugauuuucgccggcaaacaauuagaagaugguaggacccuuucugacuacaauauucagaaggaaucuacccuucacuugguauugagauuaagaggagguaugcagauuuuuguaaaaacauuaacuggcaagaccaucacuuuggaagucgaaccuucugauaccaucgaaaauguaaaggcuaagauccaagauaaggaaggaauuccuccagaccaacagcguuugaucuuugcuggaaaacagcucgaagaugguaggacccuuucugacuacaauauucagaaggaauccacccuacauuuggugcuuagacugagaggugguaugcaaauuuucgucaaaacuuuaacaggcaaaacuauuaccuuggaaguagagccaucagacacaauugaaaaugugaaagcuaaaauucaggacaaagaagguauuccuccagaccagcaacguuugaucuucgccggcaaacaacuagaagaugguagaacucuuucugacuacaacauccagaaggagucuacccuccauuugguacugagauuaagaggagguaugcaaaucuuugugaaaacuuuaacuggaaaaacuaucaccuuagaaguggaaccaucagauacuaucgaaaacgucaaagccaaaauucaagacaaagaaggaauaccuccagaccagcaacguuugaucuucgccggcaaacaacuagaggaugguagaacccuuucugauuacaacauccagaaggaaucuacccuucacuugguacugagguuaagaggaggaaugcagaucuuugugaaaacuuuaacuggaaaaaccauuacuuuagaaguagaacccucagauaccauugaaaacgucaaggcuaaaauccaagauaaggaaggcauuccuccagaccaacagcguuugaucuucgccggcaagcaguuggaagaugguagaacccuaucagacuacaacauccagaaagagucuacccuucacuugguacucagguuaagaggagguaugcaaauuuuuguaaaaaccuuaacuggaaaaacaaucacccuagaagucgaaccuucugauaccauugaaaacgucaaagccaaaauucaagacaaggaaggaauuccuccagaucagcaacguuugaucuucgccgguaaacaacuggaagauggcagaacucuuucagacuacaacauccagaaagaaucuacccuucacuugguacucagguuaaggggagguaugcaaauuuuuguaaaaaccuugacuggcaaaaccaucacuuuggaaguagaagccucugauaccauugaaaacgucaaggcuaaaauccaagacaaagaagguauuccaccagaccaacagcguuugaucuucgccggcaaacaguuggaagaugguagaacccuaucagacuacaacauccagaaagagucuacccuucacuugguacucagguuaagaggagguaugcaaaucuuuguaaaaaccuugacuggaaaaacaaucacccuagaaguagaacccucugauaccauugaaaaugucaaagccaaaauucaagacaaggaaggaauuccuccagaucagcaacguuugaucuucgccgguaaacaacuggaagauggcagaacucuuucagacuacaacauccagaaagagucuacucuucacuugguacucagguuaagaggagguaugcaaaucuuuguaaaaaccuugacuggaaaaacaaucacccuagaaguagaacccucugauaccauugaaaaugucaaagccaaaauucaagacaaggaaggaauuccuccagaucagcaacguuugaucuucgccgguaaacaacuggaagauggcagaacucuuucagacuacaacauccagaaagaaucuacccuucacuugguacucagguuaagaggagguaugcaaaucuuuguaaaaaccuugacuggcaaaaccaucacuuuggaaguagaagccucugauaccauugaaaacgucaaggcuaaaauccaagacaaagaagguauuccaccagaccaacagcguuugaucuucgccggcaaacaacuagaagacgguagaacccuuucugacuacaacauccagaaggaaucuacccuucacuugguauugagguugagaggugguaugcagaucuucguaaaaaccuugacaggaaagaccaucaccuuggaaguggaaccauccgacaccauugaaaauguuaaggcuaaaauucaagacaaagaaggaauuccuccagaccagcaacgucugaucuucgccggcaaacaguuggaagauggaagaacccuuuccgacuacagcauccaaaaggaaucuacccuucauuuaguauuaagguugagaggaggaaacuga

SEQ ID NO: 5461 - RNA, 1680 nt, Sitophilus oryzae
  misc_feature (584)..(584): n is a, c, g, or u
augaugcaaccacaaauucucuuauuaaaggaaggaacagacacaucucaaggaaagccucaauuaauaucaaauauaaaugcuugucagucuauuguugaugcuguucguacaacauugggcccaagggguauggacaaauuaauuguugucagaucuggcaaggcuacaauaucuaaugauggagcuacuauaaugaagcuccuugauguaguucauccggcugcaaaaacucugguagauaucgcaaagucacaagaugcugaagucggagauggcaccaccaguguuguucuuuuagcgggugaauuuuuaaaacauauaaagccauauguugaagagggaguucaccccagaauuauuaucaaggcuguuagaaagucccugcaacucugcuuggagaaaauacaggaaauuucugugaaaauuaauaaauccaaugcuuuagaauucaggucauuauuagaaaaaugugcuucaacugcaaugaguucaaaacucauuagucaacaaagggcauuuuucucuaaaaugguaguagaugcuguauuauuguuagaugaucucaugccauuaaauaugancucuaaaaugguaguagaugcuguauuauuguuagaugaucucaugccauuaaauaugauuggaauuaaaaaggugcaagguggaggucuugaagacucaacucuaguugcugguguggcuuuuaagaaaacguuuucauaugcaggauuugaaaugcagccuaaagucuauaagaacuguaagauugcauugcucaauauugaacuugaauuaaaggcugaacgggauaaugcugaaguuaggguugauaguguuaaagaauaucagaaaauugucgaugcugaauggaauauauuguauaacaaauugaaaaagauucacgaaucuggugcaaaugugguuuugucaaaguuaccaauuggagauguagcaacucaguauuuugcugacagagauauguuuugugcuggucgaguagcagaagaagaucugagaaggacguuaaaagcuugugguggagcuguaaugacuacuguaaaugaucuuaacgauucaguuuuggguaauugugauuuguuugaagagaggcaaauuggaggagagagauauaacuucuuuagagguuguccgaaugcaaaaaccugcacuauaaucuuaagagguggugcagaacaauuucuugaggaaacagaaaggucacuccaugaugccaucaugauuguucgcagaaccauuaaaaaugaugcuguuguugcugguggaggugcaauugagauggaacuguccaaaauucugcgcgauuauuccagaacaauugccggcaaagagcagcuacuaaucagcgcuguugccaaagcacuagaaauaauaccgaggcaguugugcgacaaugccgguuucgaugcgacgaacauauuaaacaaacugagacaaaaacacgcucaaggccauuguugguacggaguggacgucaguaaagaagacaucagcgacaacuucgaguccugugucugggaaccggccauuaucaaaaucaaugcucugacugccgcuacggaggccgccuguuugauuuugucgguugacgagaccaucaaaaaucaaaagucggccgaaccaccucagaugggaagaggaaugggaagacccauguga

SEQ ID NO: 5462 - RNA, 8805 nt, Sitophilus oryzae
  misc_feature (6191)..(6191): n is a, c, g, or u
auggaauggugcgacaaauaucaagcucaaaucguuguauuggcagcucagauauucuggagcgaggauguagaagcugcuuugucaaaaaugaauggagaaccacagaaagguccguuggaaaaagugcugcaacaagucgagaauaccuugaauguauuggccgauucagugcuucaagaacaaccucaguuaagaagaaagaaauuggaacauuugauuaaugaauuugugcauaagagaaccguuacuaggaagcuuauaguuucuggagugugcagcaauaaagcuuuugaauggcuuugucaaaugagauuuuacuuugauccucgucaaacugagguucuaaaacaacuaaccauccacauggcuaaugcaagauucuacuacggcuuugaguaucuugguguccaagauagacucguccaaacgccuuugaccgacagaugcuauuugacaaugacgcaagcuuuagaagcuagauuaggaggaucgccuuuuggcccggcugguacugguaaaacugaguccgucaaagcucucggcaaucagcugggucgcuucguguugguguuuaacugcgacgagacauucgauuuucaagcgauggguagaauuuucgucgguuugugucaaguaggcgcgugggguuguuuugacgaauucaacagguuagaagagagaaugcuaucggcgguaucucaacaaauccaaacuauccaagaagcccuuaagagccagaaagaaaguagcgacagucaaggacagcaaggaggcaguaucagcguggaauuggucggaaaacaagucagaguuuccccagauauggcaaucuuuauuacuaugaaccccggguaugccggaagguccaacuugcccgacaauuugaagaaacucuuuaggucguuggcuaugaccacaccagauaggcagcuuauugcugaaguuauguuauucucgcaagguuuuagaucugcugaaaaguuagccuguaaaauuguacccuucuucaagcuuugugaugaacagcuguccaaccagucgcauuacgauuuugggcuucgggccuuaaaaucggugcuuauuucugcuggaaacguaaaacgagacaggauacaaagaauaaaagaaaacaugaagcagagaggagaaacaaauauugaugaagcuaguauugcugaaaacuuaccggaacaagagauuuuaauucagucaguuugugaaacuauggugcccaaauugguagcugaagauauuccucuucucuuuaguuuauugaaugauguguucccgaauguucaauacaccagagcugaaaugaagggauuaaaagaugaaauucguaaaguuugugccgaagaauacuugguuugcggcgaaggagacgagcaagguuccgcuuggauggagaagguucuucaauuauaccaaaucugcaacuuaaaucaugguuugaugauggugggcccaagcgguucuggaaaaaguuccgcauggagaguacuucuuaaagcacuggaacgauuugaagguguggaagguguagcccauguuauugauccuaaagccaucagcaaggaagcauuguacgguguucuggaucccaacacuagagaauggacagauggucucuuuacucacauacuaaggaaaaucauugacaacguaagaggugaaauuaauaaacgccaauggauaauauucgauggcgauguagauccagaauggguagaaaauuugaacucuguccuggaugauaacaaauugcuuacgcuaccuaacggcgaacgucuuucucugccaccuaauguccguguaauguuugaggugcaagaucugaaauacgcuacucuagccaccguuucucguugugguaugguaugguuuucggaagauguauuaaccacggaaaugaucuucgagaacuacaugcuucgucuuaaacauauuccucuagaggaaggagaagacgauagcuuuggaaagaaaauagaaaacaaggaagauacagugucuccuacacuacaaguacagcaggauguugccaaucugcuucaaccguuccuucaaccggaugguuuagucaucagauguuuagaacauucaauggaacaggaacauauuauggacuuuaccagacuaagagcuuugaguucgcuguuuucuauguuaaaucagagcgucaggaauguuuuacaauacaaucacucccacaacgacuuuccuuuagccuucgaaaccuuggaacgcuacauucccaaauguuuaauuuacgcuauacuauggagcuucgccggcgaugccaagcuuaaaguucguucggaguuaggcgacuuugucagaucuauuacaacgguaccgcuuccucccgacaacaauacgccaauaaucgauuacgaggucaccauagaaggggaaugggcgccuuggucuaacaagguaccucagauugaaguggagacccauaaagucgcuucuccagauauuguaguacccacauuggauaccguacgacacgagucgcuguuguacacuugguuagcggaacacaaacccuuaguauuaugugguccacccgguucaggcaaaaccaugacauuauucucggcuuuaagagcucugccugacauggaaguaguuggucucaauuucucgucggccacaacucccgaacuuuugcuuaaaaccuuugaucacuauugcgaguacagaaaaacaccuaacggaguuguucuaucaccaguacagcuugguaaaugguugguacuauucugcgacgaaauuaacuuaccggacauggacaauuacgguacccagcgcguuauaauguucuugcgucaaauagucgaacagaaaggauucuacagagccagcgaucaaacuugggugucuuuagaacgcauccaguuugugggggcuuguaacccaccuacugauccaggaaggaagccacuuucccacagauuccuucgacauguuccaguaauuuacgucgauuauccuggagaaacuucgcugaaacaaaucuacggcacauuuacaagggcuaugcugcgucucacuccgggauuaaaagguuacgccgaaccauugacaaacgcuaugguugaguuuuauuuggccucccaggacagauucacucaagauaugcaaccgcauuacguguacucgccucgugagaugaccagauggguacguggaauaugugaggcuauaagaccacuggauaguuuaaguguagaaggucugguaagacucugggcccacgaggcuuugcgucucuuccaagacagacuagucgaagauucugaaaggcaauggaccaacgagaacaucgacucggucgcccugaaacacuucccuucggcgaauugcgaaagggcacuggaaaggccaauucuuuacagcaacuggcuuucgaaggacuacacgcccguggagagggagaagcuuagggaauacguuaaagccaggcuaaagguguucuacgaagaggaacuggacgugccucugguacuuuucgacgaagugcuggaucacguuuugaggauugacaggauauuuaggcaaccucaagggcauuuguuacugaucgguguuuccggugcugguaaaacgacguugucucgauuuguugccuggaugaauggauuaucuaucuuccaaauuaagguucauaauaaauacacggccgaagauuuugaugaagauuuaagaucaguauugagacgaucugggugcaaagaugaaaaaaucgcuuuuauuuuggacgaaucuaacaugcuggauuccagcuucuuggagagaaugaacacauuauuagccaauggggaaguucccggcuuguuugagggcgaugaauacacaacauugaugacacagugcaaggaaggagcucagcgagaagguuugauguuagauucaagcgacgaacucuacaagugguucacccaacaaguaaugcgcaauuuacacguugucuuuacuaugaauccaucuaccgauggucucaaggauagagcugccaccuccccugcauuguucaacagaugcgucuugaauugguucggagauuggucugauggagcuuuguuccaaguuggaaaagaguuuacuuaccguuuagaucucgauagaccaacuuggaaaucgccugacuuuuucccugccgcgugcaaguuuguuccaaccucuccaaaucacagagaagcaguuaucaaugcuuguguauauguccaccagacgcuacacaaagccaauguuagacuagcuaaaagagguggacguacaauggcuauuacuccaagacacuaucuagacuuuauccaucauuuugucaaauuacacaacgagaaaagaucagauuuggaagaacagcagcuacaucugaacguuggucugaacaaaauugcagaaaccguggaacaggucgaagaaaugcaaaagagccucgcgguaaaaucucaggaacugcaggcaaagaacgaagcugccaaugcgaaauugaagcagauggugaaagaccagcaagaggccgagaagaagaaaguacagagucaagaaauucagcaacaacuggcugagcaaacuguccacauugaacagaagcguacagaagucauggcggauuuagcacaaguggaaccggcuguaauugaugcucaaacugccguaaaguccaucaaaaagcaacagcucgucgaaauccguucuaugucgaacccgccggccaucguaaagcucgcucucgaauccauuugccuuuugcugggcgagaacgccagcgauuggaaguccauucgaucggugauuaugcgcgacaauuucaucaacacggucgucaacaauuucaacacggaggacauuagugacgacguucgcgacaagaugaagucgaaguaccucagcaauccagacuacaacuucgaaaaaguaaaucaugccaguaacgcuugcgguccucuugucaagugggccauggcccaaauucaauacgcugacauguugaagaaggucgaacccuuacgucaagaacuuagcucucucgaaacccaagccgaaacaaacaaaaagcguggagaggaagucaagaaucuaaucagccaacuggaacacaguaucgcauccuacaaagacgaauacgcacagcugauugcccaggcucaagcuaucaagaccgacuuggagaacguacaggcuaaaguugaccguuccauugcguuauugaagucguugguuauugaacgagaaagaugggaagccacgagcgaaacuuuuagagcccaaaugucaacuaucguaggugacgugcuuuuaucugcagccuuuaucgcuuauggugguuacuucgaucagcacuaccggcaaaaucuguucauggcguggugccagcauuuaacucaggcuucuauucaauacaggcccgacauugccagaaccgaauaccugucuaauccggaugaaagauuaagauggcaagcuaaugcgcuacccucagaugaccuauguacugaaaaugccaucauguugaagagauucaacagguacccacuuauaaucgauccuucaggccaggcaacugacuucauuaugaacgaauauaaagauaagaaaauaacaaagacgaguuucuuggaugauuccuucaggaagaaucucgaaucagcccuacguuuuggaaacccacuuuuaguucaagacguugaaaacuacgacgcuauauugaacccaguucuaaacagagaacugcgacgaacaggaggucgaguuuuaauaacccuuggcgaucaagacauugauuugucuccgucguuuauuauuuucuuaucuacucgugaccccacuguugaauucccaccggacauaugcucgaggguuacuuucgucaacuucaccguuacuagaaguucuuuacagagccaguguuugaaucaaguacuaaaagccgagaggcccgacaucgaugcuaagcguucugauuugcuuaaacuucaaggcgaauuccauuugagguugaggcaguuggagaaaucccuacugcaagccuugaaugaugcuaaaggcaagauucuggacgaugauagcgugauaacaacucuggaaacuuugaagaaagaggccgcagaaaucgggcagaaagucgaagaaacugauaaggucauuucagaaaucgaggcgguuucucagcaaunaacugauaaggucauuucagaaaucgaggcgguuucucagcaauauuuaccguuaucgcaagcuugcagcaacacguauuucaccauggauagucuuaaccaaguucauuucuuauaccaauauucccugcaguucuuuuuggauauguucaacaguguacuguugagcaauccaaaauuagauggcacuuccgacuaucaacaaagauugacuauaauaacuacugacuuauuccaaguuguauaugaaaggauagcacggggaaugauacacaacgacagauugacguuugcaauucuucugaguagaauuuuccugaaaggucuuccuaacgaaccuaauuacgaucaagaauucaauuucuucuugagggcgaaggaaggucuuuugaguucaucuacugggccuauuguggacggacuaaacagcgaacaacaagaagcgcugacaagacuaucaacaagauugccagcuuuuaagaaacuuccugaaaagaucaaagaaaugcccgaguucggugcuuggcuucaacagagcacacccgagcaagccgugccugguuuguggauagaagagaagcaauuaaguccgauugguacagcaauguaccagcuacucguuauucaagcuuucagaccggacagagucauagcugcagcuacacucuuuguuucuaguguuaugggacaagacuaucuagcuucugcggagaaggagauugauuuaggugugaucguggagaaagaaauuaaagcuaguguuccgguucuccuaugcucaguaccuggauuugaugccucagguagaguagacgacuuagcuacugaacucaacaagcaaauauccagcauugcuauugguucugcggaaggauuuaaucaagcagauagagcuauuaacauggccuguaaaacuggaagauggguuauacuuaaaaacguacaucuagcaccacagugguugguucaacuggaaaagaaacuacauucucuucaaccucacgccaacuuuagguuauuccuaacuauggaaauuaacccuaaacuuccugucaaccuguuacgagccggaagaauauuuguauuugagccuccgccaggcaucagagcuaacuuauuaagaacauuuagcacaguaccagcaagcagaaugaugaaagcucccaacgaaagagcaaggcuguacuuccuucucgcuugguuccaugcaauuguucaagaaagacugagauacuguccguugggaugggcuaaguauuacgaauuuagugaaucugaucugaggguugccugugauacucuugacacuuggauugaugcuacggcaaugggaagaacaaauuugccaccagaaaaagugccaugggaugcuuugguuacucuucuuucucaaucuaucuaugguggaaaaaucgacaacgguuucgaucaacgacuucugcaaucauuccuuaacaaacucuucacuuucaaaaguuuugaagcugauuuugcucugguugcuaacauugauaauggaccuaacgguacuagacacauuacuaugccagauggaaccagacgcgaucauuucuuaaaauggauugaaagucuagcggauaggcaaacuccugcauggcucggacuaccaaauaaugcugaaaaagugcuguugacaacaagagguacugaucugauugguaaauugcuuaaaaugcagcaguuagaagacgaugaugagcuugcauauucgauggacgaaucuucaccaaccgaucccaaggcucaaauugaugguaggccaucguggaugaaaaccuuacauaacucugcccugacauggcuccaacuuuuaccaaaaucuuuacacacgcuaaaaaggaccgucgaaaauauuaaggauccucucuacagauacuuugagcgcgaagugaauucugcgucuaaacuauuaauagaugucauucacgauuugaaugacguucuuuuaauuugccaaggugauaaaaaacaaaccaacuaccaucguacuuuguuggaagaacucgucagagguaucauuccggccaacuggcauagguacacuguacccaaagggugcacgguuauccaguggauuaccgacuucagcaauagaguuaagcaacuucaacaaauaucccaggugguuuccaguucuggagcaaaggaacuacagaguuuuccaguuugguuaggcgggcuucucaaucccgaagccuggauaacggcuacuagacaaugcguagcccaggcuaauaguugguccuuggaggaacuucauuuggauguuacuaucaccgauucccaugacaaaucuagcauuccgcaugacuguuuugcuauuguuggacugaaacuacaaggugcccaauguaagaacaaccagcuccuucuuacauccaguauaaugucggaacuacccauaacccuacugcgcugggcuagaacuggagacgaaaaaccuuccgguagcaagcucucccuaccgaucuaccuaaauuccacaagaacagaguuacucuacacgguagaccucaacauagcaccgggccaagacccgcauagcuucuaugagcgcgguguagcgcugcuuacaucaacugcuuuaaauuaa

SEQ ID NO: 5463 - RNA, 2004 nt, Sitophilus oryzae
augccaggcucaagagauaaaauaaagaaagaaccagaacuuacugaacaagaaaagaaaaagcugacaauugaagaaacuaaaauuaguuugccaauuuuuccauuuaaggaagaucuuauacaagccguucaagaacaccaaguuuuaauaauugaaggagaaacuggaucuggaaaaacaacucaaauuccacaguauuuacaugaagcaggauuuacaaaugacaauaaaaaaauuggcugcacacagccaagaagaguugcagcaaugucaguugcagcgagaguugcucaggaaaugggaguuaaauuaggcaaugaaguuggauaugcaauaagauuugaagacuguacaucugaaagaacuauaauuaaguauaugacagaugguacuuugcacagggaauuuuuaucugagccagacuuacaaucauacaguguuaugauaauugaugaagcucaugaaaggacuuugcauacagauauuuuauuugguuuaguaaaggauauugccagguuuaggccugacuuaaaauuauugauaucuagugcaaccuuggaugcucaaaaauuuucagaauuuuuugaugaugcuccgauauuuagaauaccaggaaggagauuuccaguugauauuuauuauacuaaagcuccugaagcugauuauguagaugcaugugugauuucaauuuuacaaauacaugucacccaaccauuaggugauauuuuaguauucuuaacuggucaggaagagauugaaacaugucaagaauuauuacaagaucgucuaagaagacuggguucuaaaguaaaggaacuaauuguuuuaccaguuuaugcaaaucugccuagugacaugcaggcaaaaauuuuugaucccacaccaccaggggccaggaaaguaguauuggcaaccaacauugcagaaacaucauuaacuauugauaauauuauuuauguuauugauccuggauuugcuaagcaaaauuauuuuaacuccagaacagguauggaaaguuuaaugguaguaccaauuucgaaagcgucagcuaaucaacgugcgggaagggcaggccgaguagccgcaggaaaauguuuuagacuuuauacagcauggucauauaaacaugaauuagaagauaauacgguaccugaaauccagaggauaaaucugggaaaugcgguuuuaauguuaaaagcucuagguaucaaugaucuuguacauuuugauuucuuggacccgccaccccacgaaacguugguuuuagcuuuggagcaacuauaugcuuuaggagcuuuaaaccaucacggcgaacuaacuaaaaugggacgacgaauggccgaauuuccagucgauccuaugauggcgaagacacuguuggcaucagaaaaauacaaauguuccgaagaagugguaacuauuacagcuaugcugucaguuaacagugcuauauuuuauagaccgaaagauaaaauaauccacgccgauacagcaagaaagaauuuuaaucauguagcuggggaucaucuuaguuuauuaaauguauauaaucaauggagggacacugauuuuucgacacagugguguuaugaaaauuuuauucaguauagguccaugaagagagcuagagauguuagagaacaacuugugggauuaaugcaaagaguagaaaucgagauggugucaaauauuuccgaaaccguugacauuagaaaagcuauaaccgcuggcuacuuuuaucauauagcaagauuuuccaagggggggaauuauaaaacaguaaaacauaaccagacaguaacuauacauccaaauaguucguuauuugacgaacucccaagauggauuuuauaccaucaacuaguuuuuacuacaaaagaguuuaugaggcaaguuauugaaauugagaguaaauggcuauuggaaguagcaccacauuauuauaaaccgaaagaauuagaagauucaaccaacaagaaaaugccaaagacuauuggaaga

SEQ ID NO: 5464 - RNA, 1371 nt, Sitophilus oryzae
augaagguggaagaaguaaaaagcacgguaaaaacucaaagaaucagcgcucacagccauaucaaaggccuagggcuugacgaaaauggauucgccauacaacaagcggccggcuuggucggccaagagcaagcaagagaggcagcagggguuguagucgauaugauaaggagcaagaaaauggcaggaagagcgguacuucuagcaggaccacccgguacuggcaaaacugccauagcccuggcuaucgcgcaagaacuaggcaacaaaguaccuuucugcccuauggucgguucagaaguauacaguuccgaaauaaagaaaacagaaguucugauggaaaacuuccgcagagccauaggucugagaauucgcgaaaccaaagagguuuacgagggugaaguaagcgaacucacaccuguagaaacugagaaccccgcuggaggcuacgguaaaacugugagucacgucgucaucggucuaagaacggccaaaggcaguaaacagcugaaacuggaccccagcauuuacgaggcacuccagaaagagaagguugaagugggugauguuauuuauauugaggcuacaaguggggcuguuaagagacagggaagaucggaugcuuaugcuacugaguuugauuuggaagcugaagaguauguuccuuuaccgaaaggugauguucauaagaagaaagaggugguucaagauguaacacuucaugauuuggacgcggcaaaugcaaagccucaaggaggccaggaugucuugucgaugaugggacaacuuuugaaaccaaagaaaacagaaauaacugacaaguugaggaaggaaauaaacaaaauuguugauaaauacauugaucagggaaucgcagaguuaguaccaggaguucuuuuuauugaugaaguucacaugcuagauauugagacuuuuacauaucuacacagggcacuagaaagugccauugcuccaauaguuauuuuugcuacaaacagaggaagaugucuuaucagagguacggaugauauuuuuucaccucacgguauaccucuggaucuucucgacagacuuuugaucauuaggacugugccguaugaucggccugauauggaacaaauuuugaaacugagagcuaaaacugaaggccuggaaauugacgaagaagcaauaacaacuuuaggggaaguuggaguaaaagccacacuaagauacguuguacagcuuuugacaccugcacaucugacagcuaaaaucaacggcagaacuaauauuacgcaaucugacguagaagagguagcuucccuguuuuuggaugccaaacaaucggcaaagauauugucagaaaauaaggagaaguuuaugaauuaa

SEQ ID NO: 5465 - RNA, 2193 nt, Sitophilus oryzae
augacuucaauuauaaagcuccagguacuuucgggggcuauggacgaguccccuccggcuuaucucuuacaggucgacgauguaaaaauuuuguuagauugcggcugggacgaaaaauuuaauauggaauuuauuaaagaagucaaaagacauauucaucaaaucgaugcaguauuaauaucauaucccgauccgucacauuuaggggcucucccguaucuugucgguaaacuaggacuaaauugcccaauauacuccacaaucccuguuuauaagaugggucagauguuuauguacgauuuguaccaaucccaauacaauaugaaggauuucuuccuguuuaauuuagaugauguagacgccacauucgauaaaaucauucaguuaaaguauaaccaaaguguaccauugaaagguaaggguuacgguuuaacaaucaccccguugccagcuggucauaugauuggggguacaauuuggaagaucaugaaagcaggggaagaagauauaaucuaugcuaacucguuuaaucauaaaaaagaacgucaucucaauggcugugaauuggagaagcuccagagaccuucucuccuaauuauugaugcauuuaacgcaacauaccagcaggcuaggcgaagagcuagagaugagaaauugaugacaaauauuuuacaaacucuuagaaacaaugggaauguuuugauugcuguugauacugccgguagaguuuuggaacuagcucauauguuggaucaguuguggagaaauaaggaauccggacuucuuacauauucuuuagcccugauaaguaacguugcuuauaacguuguugaauuugcuaagucccagauagaguggaugagugauaaguuaaugaggaguuuugaaggagcuagaaauaauccuuuucaguucaagcauuuauauuugugccacacuuuaucagaacugaauaaaguagcuaguccuaaaguaguacuggccaguagugcugacuuggaaagcggguuuucgagggaauuauucuugcagugguguucuaauucaaacaauaguguuauuaucacuacaagaacauguccuggaacucuagcgagagaucuaauagacaacaacgaaaaaggcagaaccaucgauaugauuguagaaagaagagugaaauuagaaggugcagagcuggaagaguuugaaaaaagacagcaacaaaggacgcauauaagcaacgggaccaaagaugauguagauucagauuccgauagugauauagagaugucgguuauauccaaaggaaggcacgauauuguuauaaaacaggaagguaaaguuaguggaggauuuuucaaagugaccaaaaaacaguauccuauguauccguuucgugaggacaagauaaagugugaugaauauggagaaauuguuaaaauugaagauuacaggcuggccgauguuaauccugaagcugaagauaauaaagaaaacuuagagguuaagagagaggaagaagaagaagaaauaauugaaauucuggaaguuccaucgaaauguaucgcucuggagaggacgguucaagugaacugucaaguacaauacaucgauuucgaaggccgguccgacggggaaucccugaugaaaauccugucccagcugcgaccuaggagggugaucguggugcacggcacugaagacaacacggaagucauugcggcgcacugcagggauaacauuagggcgagaguuuucacaccucaaaggggggagacgguggaugcaaccagcgaaacacacauauaccagguuagguuaacagauucgcugguaucucagcuagacuucaaaaaggcugcgaaagaugccgagguugcuuuuauaaaugcccagauagcucugagagaaauccaagcugaugccaagagaaugaccaccgauaaugaaccaauggaaguagacgaugaugaccagaagauacuaacuuuagaaccacauaccgcggaagcacaucaugaaccuguuuuuaucaacgagcugaaauugucagauuucaagcagguucuugcuaaagccaauguuucuucggaauuuucuggugguguauugugguguuguaauggcacaauagcuguaagaaagcuugauacugggaagauuguguuugaagguugcauauccgaggauuauuacaaaguaaaagacuug

SEQ ID NO: 5466 - RNA, 2283 nt, Sitophilus oryzae
  misc_feature (1998)..(1998): n is a, c, g, or u
augccuccuuuagaaguagcaaaugcugcuacggaagagucugcccccacaaauccaguggugggcauuauuuauccgcccccggaaguuagaaacauagucgacaaaacugcuaguuuuguagcuagaaaugguccagaauuugaagcuagaauccggcagaacgaauugggaaauccaaaguuuaauuuuuuaaauaccggagaucccuaucaugccuauuaucagcauaaaguuaacgaauuuaaggaggggaaaggucaagaaccaaccauaucacauggcguguccaagcucacuguuucggccagugcccaacagaaacagcacgaaauacuuaagcaagucgaacagccuuuuguuccuaaagauccaccuucugaguuugaauuuauagccgauccaccaucuauaucagcauuggauuuggauauaguaaaauugacugcucaguuuguggcaagaaauggacgagcuuuucuaacacaacucaugaaucgcgaacagagaaacuuucaguuugauuuuuugagaccucaacauucacucuuucaguauuuuaccaaguuacuggaacaauacacuaaggucuuaaucccaccaaaaacgaugcaacaaaaacugaaagaggaagucaaaaguaccaaaaccguucuggaacaggugaaguaccgggcggaauggcaaaaguaccaggaagcccagaaagccaaagaagaagagauauuggaaagagaaagaaucgcguacgcucaaaucgauuggcaugauuuuguaguaguggaaacugucgauuaucagccguuugaaauuggaaauuuuccaccuccaacaacaccggaagaggugggggcaagaauucuaauucaagaaaggcuugaagauggggacgauauugagaugcaacuggaaagcgacgaagaagaugguggucaggaggaucaaaguuuaagcuauauggaagaucguaccaauacgaacagaaaagaugcgagggauaauaaucaagugcaagauauggacgaggagaguucagaugaugaagaucaggauaaacguucagaucaaccgucaauucagccuccacuaccgccaguucccgauaaaguuuugguuaagaaauacgauccuaagcaagcuccuaaagucacucggccgacuguuggugacgauuaucuaguaucaccaaucacuggggagaaaauuccagcuagcaaggugcaggagcacaugcguauuggucugcuggaucccagauggguggagcaaagagauaaacacguuacugauaagaugaaccaagacacgguguacgcccaagguaccgccaucgaggccagcuugaaacuguuggccgaacgucguaccgauauuuucggcgugggcgacgaggaaaccgccauaggaaagaagaucggcgaagaggacauccgcaaagacgagaaggucaccugggacggucacaccuccagcguugaggcggcuacuagagcggccagagccaacauuacucuggaagagcagauucaucaaauccauaagguaaaaggucucuugccggacgaggagaaggaaaaaaucggaccgaagaacguuaccgggggaaguaagaugaaagguaccggucagaugaucaagccaccgccucccccucagcugcaagcuccgaaagcaaccauuguaaccguaccuccgcagccuauucuggcuccacaaccgccgauuaugaugauggcugcuccgccgaugccuccgaugcguccgucuuuaaugguuccaacacauccuccaauggccgguuuuguaacaccucuaccuccaccuccaauggguccuccaguaaccaugcccaugaagcauccuagcgaggugcaacuggaugaugaaccuagcaacaaaaaaaugcgaaacgaggacucccugguacccgaagagguguucuuggccagaaacccaaguccuguaauggugaaaguuacuaucccgaugaugccgganagaaacccaaguccuguaauggugaaaguuacuaucccgaugaugccggaaaaauccgaauggaaacuaaguggucaaguguugaauuuuacucugcccuugggagagucuguggcuaauuugaaggcuaagauccaggaggagauaaguaugccgccggcuaagcagaaguuguucuuugauggcauguucuucaaagauucaaacacgcuggcuuauuacaacaucacuccagcggcugucauucaacuucaggugaaggaaagaggcggaaggaaaaaauaa

SEQ ID NO: 5467 - RNA, 963 nt, Sitophilus oryzae
augccgagccaagaaguaacaacuaguaaagugguaguacaccccuuaguuuuauuaagugugguggaccauuuuaaucggaugggaaaaauuggcaaucaaaaacguguuguggguguuuuauuaggcuguuggagagcuaaagguguuuuggauguaucgaauagcuuugcaguuccuuuugaugaggacgaaagagauaaaucuguaugguucuuagaucaugacuaucuagaaaauauguauggaauguuuaaaaaaguuaaugcuagagaaagagugguugggugguaucauacaggaccuaagcuccaucaaaaugauauugcuaucaaugaacuuguuagaagauauugcccuaauucuguucuuguaauaauugaugcuaagccaaaggaccuuggguuaccuaccgaagcuuaucaggcuguggaagaaguccacgaugauggaucaccuacuucaaaaacuuuugaacaugugccaagugaaauuggcgcugaagaagcugaggaaguaggaguugaacauuuauugagggauauuaaggauacuacagucgguacuuugucacaacgaauuaccaaucaacuuuugggauuaaaaggguuauauucucaguuaagagauauacgugacuauuuaauucaaguuagcgaagaaaaacuuccaauuaaucaucaaguaauuuaucaguuacaagauauauuuaaucucuuaccagauauaaaucagaugcaauucaauaaaucuuuuuauguaaaaaauaacgaucaaauguuagucguauacuuagcagcuuuaguucggucuauaguugcuuuacacaaucuaauaaauaauaaguuaacaaacagagaugccgaagaaggcaaaaaagaggacaaaaaagauaaagaaaaggaaaaggacaacaaaaaggaagagaaaaaaaagaggacaaaaaagauaaagaaaaggaaa

SEQ ID NO: 5468 - RNA, 1683 nt, Sitophilus oryzae
  misc_feature (672)..(672): n is a, c, g, or u
auguuuggcgguggaagagcucccauuuuaguguugagucaaaauacgaagcgcgagucaggccgcaaaguucagcuggaaaacaucaacgccgggaagcaagucgcugauguuauucgaacaugccucggcccccaagcgaugcuaaaaaugcucauggaccccauggggggcauagucaugaccaacgacggaaacgccauacuacgugagaucacugugcagcauccggcagcaaaaaguaugauagaaaucgcacggacucaagacgaggaagugggagauggaaccacgucgguuauugugcuggccggagaaaugcuagcuucggcagaacaguuucuagaacaacaaauccacccuaccguuauuauuaaacaguacagacaagcuuuagaagauauuauugcuuugcuggaagguccgcuuaguguuucuauugauaaaaaugacaaaaaagcauuagcuaauguuguaaaaggcuguauugguacuaaauuuauuaguaaguggucugauuuagcugugaauauugcucuggaugcuguacagacaguaauguuggaggagaacggcaggacggaaguugacaucaaacgguaugcaaaaguagagaaaauaccaggcggaucuuuggaagauucagaaauucucaaaggcguuaugcugaangauucagaaauucucaaaggcguuaugcugaauaaggauguaacucaucccaaaaugaggcguuauauugagaacccaaaaauuauuuuauuggauugcucucuugaguacaaaaagggcgaaucucagaccaauguagaaauaacugccgaaggcgauuuuaccaggaugcuagagauugaagaagagcaugucagaaaacagugcgaugauauuauagccuugaagccugacguaguguucacagagaagggugugucagacuuggcccaacauuuccuuuuaaaggcuggaauaagcgcaguucggagaguucgcaaaucugacaauaacaggaucgcccgagcuuguggggccgucauagugaacagaacggaagaacuacaagccucggacauuggaacuggagcgggacucuuugaaaucaaaaaauugggugacgaauacuuuuguuacaucacuaaaugcaaaaauccuaaggccuguacuaucguucugcguggggccagcaaagacauccugaaugagaccgagaggaaucuccaggacgcgcuccaaguggccaggaauauuguuuugaaaccccgucugguuccuggggguggggcuauagagauggcuguagcucagagacuuuuacagaaagccacucacgggccuuacagggccuuagcccaugcuuuggagauaauaccucgaacgcugucccaaaacugcggcgcgaacacuaucaggacuuugacggcuuugagggcgaagcacgccaaucauaccgaucaaaacaguccuuguacgugggguauugauggugaaaguggggaauuaguugagcagaaggacaaaggaaucugggaaccccuggcuguuaagcuacaaacguacaaaacugccauagaaacagcuauuuuacuguugcguaucgaugauauugugucgggauccaagaaaaaggacaaggaacccaauacacccagucaaauacaagaacagacugcggcaaugcaagauuaa

SEQ ID NO: 5469 - RNA, 699 nt, Sitophilus oryzae
augucucuugcgauuaggccuuauuauccugauuauuccacaguaccaacacagcaucauuuuaauccuuaugccgauaauggagggagcauaguugcuaucgccgguaacgacuuuguaauuauuggagcugauacacgucuuagcgcaggauucucuauuuauacaagagagcaaaacaaauuauuuucauugucugguacaacaguacuaggauguucaggaugcuggugcgauacacuaacuuuaacgcguauuuuaaaguccagaaugcagauguaccagcaggaacauaauaaaguuaugucaacugaagcaugugcacaaauguuaucaacaaugcuauauuauaagcgauuuuuuccauacuacauauccaauguauuaguuggauuagauaaugaagguaaaggaugugucuacagcuaugauccaauuggacacugugaaaaagcaacauacagagcuggaggaucugcaggagcucuuuuacaaccacuuuuagauaaccaaauugggcaaaagaauaugcuaaaugucaaacccgaaucgguaacaaaagaaagggcauugucaauuauuaaagauguguuuaucucugcugcugaaagagauauauacacuggagauagcauuucaauuaauauaaucacuaaagaugguauuacacaggagacuuuugaauuaagaaaagauuaa

SEQ ID NO: 5470 - RNA, 975 nt, Sitophilus oryzae
auguccagaagaccuagaaccagacaaagcacaagaaggguauucauggaaggagcagacucuauuggaggaaacgcagcguuucaguuuggcuuuaacauguucccggacauucccaggcccuuuaacguuacguaccacuguuauuccguggcuaugcuuccaggaaacgaacgacaagauguagaaagaggaggaaaaauuauuaugccucccagugcucucgaacaacuaacaagauuaaauauuaacuauccgaugcuguuuaaguuaacaaauaaaacaaccagcagaguuacgcauugugguguauuagaguuuguagcggacgaaggaaaaguuuaucugccauuauggaugaugcacaauaugacacuggaagaaggugauuuaguacaaauggaaagugucuccuuacccgucgggacauucucgaaauuccagccuuuaucucccgaguuuuuagacauaaccaaccccaaagcagucuuggaaaauugccuaagaucauuugcuuguuuaaccacuggagaugucauugcaguucaauauaaucaaaaaguauaugagcuguguguuuuagaaaccaaaccgggcgaugcuaucaguauuaucgagugcgauaugaauguagaauucgcagcucccguugguuauaaagagccugaaauugaaaggaaaauugaagaugaagagauggcagucgauccuucagauuuaaugccugaaccaucggguuuuguugcuuuuaaaggcgcagguaaccgucuggaugggaaaaaacgcaaggauucuguaacaacagaugcugugcccaaaucuacauauguucgagguauaccggacuacgauuaucaaauugggacacuaaaguucauuagaagaucgguuaaacaaaaaggcaacgauaccgaggauaauaacgaauuuaaagcauuuaguggagcuggcuuuagcuuaagaggaaggaauuaa

SEQ ID NO: 5471 - RNA, 1683 nt, Sitophilus oryzae
  misc_feature (639)..(639): n is a, c, g, or u
augucagccuuuccaggcaguauagcuuucgaugaauaugguagaccuuuuaucauacuucgagaucaagaucaacaaagacgauuaaccggaauugaugccuuaaagucucauauucuggcugccaggcaaauugcaaacacaauuaggacuucuuugggcccuaaaggucuagauaaaaugaugauuucgccugauggugaugucacuguuacaaaugacggggcaaccauuuuaaaacugauggauguugagcacgagguugggaaauuguugguugaauuaucucaaucucaagacgaugaaauuggugauggaacaacuggcguuguuguucuugcuggggcauuguuagagcaggcugcuacuuuauuggaucguggcauucaccccauuagaauagcugauggguuugagauggcaugccaaacugcuguuucucauuuagagaaaauugcagaguuguucccuguuucagacaaaaacccagaaccuuugauuaaaguugcaaugacuacuuuggguucaaaaauaaucaacaagugucacaggcaaauggcugagauugcagucaaugcaguauuagcuguagccgauuuagaacaaaaagauguuaauuuugaauuaauuaaaguggangcuguagccgauuuagaacaaaaagauguuaauuuugaauuaauuaaaguggaaggaaaggugggugguaaacuugaagauacaguauuaguuaaagguguugugauugauaaaaccaugucacauccucaaaugccuaaagaacuuaagaaugugaaauuggcaauucucacaugcccauuugaaccaccaaaaccaaaaacaaaacauaaguuggauguuacugauguugcuggauauaaagagcucagacaguaugaacaagauaaauuuaaggaaauuguuggccuugugaaaaaggccggagcuaccuuagcuauaugucaguggggauuugaugaugaagcuaaucaucuuuugcuacagcaacagcuuccugcugugcguuggguuggagguccagaaauugaauuaauagcaauugcuacugguggacgcaucgugcccagguuugaagaacucagcccugaaaaguuaggauccgcugguuuaguucgugaaauaucauuuggaaccacuagugacaaaaugcuuauaauagaagaauguucuaauucaagagcggucacuauuuuaguuaggggaggaaauaaaauguuaguugaagaagcuaaaagaaguuuacaugaugcauuguguguaguccgaagcuuaguacaggaaccuagaguuguuuauggugguggagcagcugaaauugccuguaguuuagcuguagcagcucaagcugaucagcuagccucacuggagcaauaugcuuauagagcauuugcugaggcuuuggaagcaauuccauuggcuuuagcagaaaauagugggcucucggcaauucaugcacuuggagaaguaaaggcuaaacaagccuccucuggagacccagcucuugggaucgauuguauguucaccgguaaucuuaauaugcgggaacaacauguuauugaaucucucagaucaaagaggcaacaguuauuacuugccacucagcuugucaagaugauuuugaagauugaugauguccguucaccuggcaaucgugaagaauaa

SEQ ID NO: 5472 - RNA, 342 nt, Sitophilus oryzae
auggcuucugcaauggacguagacguugacgaaguagaaaugccaacaucgagcagcucuaaaggcgaccgaaaacgcuucgaaguuaaaaaguggaaugcugucgcuuuaugggcuugggauauugucguugauaauugugcuauuugucgcaaucauauuauggauuugugcaucgaaugccaagcaaaucaagcuucugcaacuagugaggaauguacaguugcuuggggaguaugcaaccaugcuuuccauuuucauugcaucucaagaugguuaaaaacaagacaaguguguccuuuggacaacagggaaugggaauuccaaaaauauggucacuag

SEQ ID NO: 5473 - RNA, 1605 nt, Sitophilus oryzae
augguuucacuuaaugcagugcgaauuuuaagagaaaaugccgaagaagaaaaggcggaaauugcucgguugagcaguuuuguaggagccauugcaauuggggauuuaguuaaaagcacuuugggaccuaaagguauggauaaaauuuugguauccagcggucguaaugccgguucuguagaaguaacaaacgauggagcaacuauauuaaagucugucgguauagauaauccugcugcaaaaguacuugucgauaugucuaaaguucaagacgaugaaguuggugauggaacaacuucagucacuguuuuggcuucugaacuacuuagagaagcugaaaaguugauugaccaaaaauuacauccucagauaauaauagcugguuggagaaaggcuguugacauugcccguaaagcuuuaacagaugcaucacaggauaauagugcaaauucagacacuuuccgugaggauuuguugaauauugcccguacaacucuuaguucaaaaauuuugucucagcauaaggaacauuuugcaaaacuagcagucgaugcuguauuaagacugaaaggaucugguaauuuacaagcuauacaaauuauuaagaagucuggcggaacucuggaagaauccuuucuggaagagggauuuuuguuagacaagaaaccaggaguccaccaaccggguaggguugaaaaugcuaaaauucuaauugcaaacacucccauggauacagauaaaauaaaaguuuuuggaucgacaaucaaaguagacucuauggcaaaaauugccgaauuggaaucagccgaaaaggaaaaaaugaaggacaaaguagccaaaauacugaaacauaauuguacuguguucauuaaucgucaguugauuuacaauuauccggaacaacucuuugcugaugcuggagugauggccauugagcaugcagacuuugauggaauugaaagguuagcauuaguaacuggaggugaaauagucucgacuuuugaucagccagaaagugucaaacuuggaacuugcgaucuuauugaacaaauuaugauuggagaagacacauuacuuagauuuagugggguugcuuuaggagaagcuugcucgauuguuauucggggugcaacacaacaaauuauugaagaggcagaucguucucugcaugaugcauuguguguuuuggcugcuacagucaaggaaagccgcauuguguauggaggagguugcagugagacacugauggcgguagcugugaguaaagcugcacugaguacagcaggaaaagaagcaguugcuauggaagccuuugccagagcuuugcugcaacuacccacaauuauugcugauaaugcugguuaugauucagcucagcuuguaacugaacuuagagcagcccauacuaguggucaauucacaaugggcuugaacauggacaaaggcgaaaucggugacaugcgcacauuaggcaucaccgaauccuucgcagucaaaagacagguccugguuucggcuucggaggcugcagagaugauucucagggucgacaacaucaucagggcggcgccaaggaagcgcgucgaagacaggggacacuguuaa

SEQ ID NO: 5474 - RNA, 948 nt, Sitophilus oryzae
  misc_feature (390)..(390): n is a, c, g, or u
auguuuagaaaucaauaugauagugauguuacaguguggaguccgcaagggcggcuacaucaaguugaauaugcuauggaagcuguaaauuugggaucugcaacaguuggccuuaaaagcaaugcauaugcaguacugauugcacuuaaaagggcuucuucggaacuuucugcguaccaaaaaaagguuauuaacauugaugaccacauuggagugacuauaucaggauuaacagcagaugcaagaauuuugagucguuauaugagaacugaauguuugaacuauaaauauucgcaugauacuuauuuaccuuuaaauagacuuauaacaacauuaggcaacaagaugcaaguauguacucaaagauaugaccgcagaccauauggugunaaauauucgcaugauacuuauuuaccuuuaaauagacuuauaacaacauuaggcaacaagaugcaaguauguacucaaagauaugaccgcagaccauaugguguagggcuuuugguagcugguuaugaugauaaaggaacucauauauaucaaacauguccaucagcuaauuauuaugacuguaaagcaaugucuauuggcucacguucucaaagugcaagaacuuaucuagaaaaacauuuagaucaauuuucuaauaguagccuugaagaauuaauuaaacauggacuuagggcauugagagauacgcuaccuccagaaguugauuuaucaaccaagaaugugucaaucgguuauguugguaaagaacagcaguucaaaauucuagaugaagaagaaacugcuccuuauuugcgccuuauugaaggagaagagcgcagaggagcuacgucugaaaagccucagggacccuuaagagaugaccagggggacgagccaagagauccaaugccagauguagcaaucgaggcagccgaacaugcaauggauacagacuaa

SEQ ID NO: 5475 - RNA, 2565 nt, Sitophilus oryzae
augccuaugaaagaagcaaacaaagauguuccuauggauauuguguuuacugaagaagauuugccuuaugaggaagaaauacugcgaaauccuuauucagugaaacauuggcuucgcuauauagaacauaagaaaaaggcaccuaaacaugguguuaauuuaauauacgagcgagcuuuaaaagaacuuccugguucuuauaaacuuugguacaacuauuuaagaacuagaagacagcaaguuaagaacaaguguauaacacauccaggauaugaagaaguaaauaaugccuucgagagaucuuuaguuuucaugcacaaaaugccaaggauauggauggauuauuguacuuuucuaacugaucaauucaaaauaacuagaacuaggaaaguguuugauagagcguuaagagcuuugccaguuacacagcaccaucguaucuggccuuuauauuuagguuuuguaaaaaaacaugauauaucugaaacggcaguuagaguuuuuagaagguacuuaaaauuaucaccugaaaaugcugaagaauauguagauuauuuaaauaguguugggagauuagacgaagcagcaauuacuuuaggaaagauagugaacgaugaaaauuuuguaucccaauaugggaaaucaaagcaucaacuuuggaaugaauugugcgaguuaauuucaaauaauccugauaaagugcagucuuuaaauguugaugcuauuauuagaggugguuugagaagguauacugaucaguuaggacacuuauggaauucucuugcaaauuauuauguuagaaguggucuuuuugauagagcaagagacauauaugaagaagcuauccaaacagucacaacaguucgagauuuuacucaaguuuuugaugcauaugcgcaauuugaagaacuuaguuuaaguaagagaauggaggaaguuucaaaaaugaccaaaccaacagaagaagaaaaccuugauuuagauuugaaacuggcuagguuugaacauuuaauggaacguagauuauuauuauuaaauucaguacuuuugaggcaaaauccacauaauguucaagaguggcauaagcgaguucaguuauaugaaggaaagccucaugaaauaauaaauacuuauacugaagcuguacaaacuguagagccuaaauuagcugugggaaaguugcauacguuauggguagaauuugccaaguuuuaugaaaaaaauggacaaguugaugaugcucgaauuauuuuugaaaaagcuacugagguaccuuucauuaaaguugaugaucuagcuucuguuuggugugagugggcagaaauggaaauaaggaaugaaaacuacgaagacgcguuaaaacugaugcauagggcaacaacuaugcccgcacgcaagguugcauaucaugacgauacggagcggguucaagauagacuguauaagucuuuaaaaguuuggucuauguaugcugacuuagaagaaaguuucgguacauuuaaauccuguaaagcaguauacgaucguauaauugacuuaagaauugccacuccgcaaaucauuauuaauuaugguguauuuuuggaagagaauaacuauuuugaagaggcuuuccgugccuaugaaaagggaauuucauuauuuaaauggcccaacguauaugacauuuggaauacuuauuuaucaaaauuuuugaaaagauaugguggauccaagcuggagagagcaagggauuuguuugaacaauguuuagaaaaauguccaacacaauuugcaaaaaauuuauaucuauuauaugcuaaguuagaggaggagcauggaauggccagacaugcuauggcuguguaugaacgagcaacaaaagcuguuccagaaaaagaaauguuugaaguauuuaauauuuauauuaaacaagcggcugauauauauggaauaccuaaaacucgagaaauuuauaaaaaagccauugaaguucugccugacgauaaaacgagagaaauguguuuaagguuugcugacauggagacaaaacuuggcgaaauugacagggcuagagcgauuuaugacuauuguagucaaauuugcgauccaaggguaacagucgaauuuuggcaaacuuggaaagaguuugaagugagacacggcaaugaagauacaaugagggaaauguuaagaauaaagagaagcguucaagcgauguauaauacacagguuaacaugaugucugcccaaaugcucaguucugccgggucauuaacgggaacuacggccgaucuugcgccaggugaaaaagauggaaugcgucuuuuggaagcaaaagcugcagaaauggcuggugcugguacaucaggaauaaguucccgaccagguaauauaauguuugugagaggugaaacucaaggcgacaagaaagauaaagucguuaauccagaugaaauugauaucgacgaugaugacgaggaggaagaagacgaaguugaaguaccccuugagaaacaagcuguaccuucugaaguauuugggagucuaaagaaaaauucgacugaagaugauaaugaugauuaa

SEQ ID NO: 5476 - RNA, 1206 nt, Sitophilus oryzae
auggcuaacggaccaaucgcugaacgaaauagagaugcaacaauauacguuggaggucucgacgauaagguuuccgaaucuuuacugugggaacuuuuuguucaggcagguccacuaguaaacguucauaugccgaaagacagagugacuaugaugcaccaaggguacggauucgucgaguucaugggcgaagaagacgccgacuaugccauaaagauuaugaacaugauaaaguuguaugggaaaccuauacgaguaaacaaagcgucggcccaucagaaaaacuuggaugugggagcgaauauauuuauaggaaauuuagauccggaaguggacgaaaaauugcuguacgacacguuuucagccuuuggaguuauacuucaaacgccuaagauaaugagagacccggaaaccggcaacuccaaaggcuucgccuucaucaacuucgccagcuucgaagccuccgacgccucgauugaagccaugaacggccaguaccucugcaaccgacccauaucggugucauacgccuucaaaaaagacuccaaaggcgaaagacacggcucggcagccgaaagauuacuagcagcucaaaacccacucucccaagcagacagaccucaccagcuguucgccgaugcaccuccgaugggcaugaugggcauggccauggcuccuccaccuccuccuguuauuuuagggggucuuaugccuaugccuccuccgacggccauggcuccuccaccuccuccuguuauuuuagggggucuuaugccuaugccuccuccgacgccggcgaguauggcgccuccaccaccgccuccggugccuccgccaucgucguuucccucggggauucccccgccaccuuugccucccagucaaccuccgcugccgccuggagcgccgccuauaucugcugcgggggcagguggagcgccuaggccuccgcugccugcaggagggaugccgagggggaugaugccuccgccgccgccguggcaggcuggagggaugccuccacugccuacuucaggacaagcagcugcuaacagcaauuucccgaacauauucccaccuccgccgccuccaggagcuaggccuccgccccccaacuggagaccgcccccaccgccaaacuucgcaggggcacgaccuccguuucccccaagaggaccucccccaccaccaccuucgaugcaguag

SEQ ID NO: 5477 - RNA, 774 nt, Sitophilus oryzae
augggucguguuauuagagcucagcgaaaaggugcugggucuguuuucaagucccacacgaaaaggaggaagggagccccaaaacugagauaucucgacuucucagagcgacauggauacauuaaaggugucgucaaggauauuaugcacgauccuggcagaggagccccguuagcuguugugcauuuccgugauccuuacaaguucaagacgagaaaggaacuguuuauugccccugaaggaauguacacaggacaguuugucuauuguggaaagaaagcuaacuuacaaauuggaaauguuuugccuguggguacuaugccugaagguacuauuguauguaauuuagaagaaaagacuggcgauagaggucgguuggccagagcuucaggcaauuaugcuacaguuauugcacacaaccaugauacaaaaaaaacuagaguuaaauuaccaucuggugcaaagaaaguuauuccauccaacaacagagcuaugguugguaucguugcuggaggagguagaauugacaaaccuauucuuaaagccgguagagcguaccacaaauacaagguuaagcguaacugcuggccuaaggugcgugguguugccaugaaccccguagagcauccucacgguggugguaaccaucaacacauugguaaagcuucgacagucaagagagggaccucugcugggcggaaaguuggucuuauugcugcuagaaggacgggucguauucguggugguaaaguggacagcaagaaagaagauuag

SEQ ID NO: 5478 - RNA, 411 nt, Sitophilus oryzae
auggcacguacuaaacaaaccgcucguaaaucuaccgguggaaaagcuccccgaaaacaguuggccacuaaggcugccaggaagagcgcucccgcaacaggagguguuaaaaaaccacaucguuacaggccuggaacuguggcgcuucgugaaauccgucguuaucagaagaguaccgaauuguuaaucagaaaauugcccuuccaacguuugguucgugaaaucgcccaggauuucaaaaccgaucuucguuuccaaaguuccgcuguuauggcuuugcaagaggccagcgaagcuuauuuggucgggcuuuuugaagauaccaaccuuugcgccauccacgccaagcgcgucaccauuaugccuaaggacauccaauuggcuaggcguaucagaggagaacgugcuuaa

SEQ ID NO: 5479 - RNA, 1638 nt, Sitophilus oryzae
  misc_feature (217)..(217): n is a, c, g, or u
auggcuauuaguuuauuaaauccuaaggcugaaguagcucgagcugcgcaagcauuagcaguaaauauuucaggugcgaaagguauucaagaugucaugaaauccaacuugggaccuaaaggaaccaugaaaauguuagugucaggugcuggugauauaaaaauaacuaaagaugguaauauuuugcugcaugaaaugcagauacaacauccuaccnaugguaauauuuugcugcaugaaaugcagauacaacauccuaccgcuucccuuauugcaagagcgucuacugcucaagaugauaugacaggggaugguacaacaucaacuguuuuauuaauuggcgagcucuugaagcagggcgacauauauauugcugaaggucuacauccuagaauucuaacagaugguuuugauaaagcaaaaacuaaggcuuuagagguuuuagauaaaauuaaaauugcaauugaacccaauaaggagaauuuaacagauguuugccguacaagucuuaggacuaaaguucaucagaaauuagcagauguucuaacugacguuuguguugaagcuguuuuggcuuugaaaucgcaagauaaaccuguugacuuacacaugauugaacuuaugcaaaugcaacauaaaacugaaacugauacaacucuuguaaaagguuuaguauuagaccaugguucucgucauccugauaugccaaaacguuuggaaaauuguuacauuuuaaccuguaaugugagcuuggaauaugaaaaaagugaaguuaacucuggauuuuuuuauaaaacagcagaagaaagagacaagaugguagcagcugaaagagaauuuauagaucaaagagugaagaaaauuauugaguuaaagaaaaaaguaugugcugggaacaauaaaucuuuuguaguuauaaaucaaaaagguauugacccaaugaguuuggaucaguuggcuaaagaaggaauuauugcauuaagaagagcuaaacgucguaauauggaacgguuagcauuagccuguggugguguugcaaugaauuccuuugacgaucuuucggagucuguucuuggauaugcugguguaguuuaugaacacguacuuggugaaaauaaauauaccuuuguagaggacugcaagaacccucaaucaguaacuauuuuaaugaaaggcccaaauaaacauucguuagaucaaauuaaggauuccauuagggauggccuucgugcuauuaacaaugcucuugaggauaaagcaguuauuccaggugcuggugcguuugaaguaauggcuaauaaggaacuuaugcaauggaaagauacuauuaaggguaaaucgcgauugggagucauugcuuaugcugaagcacugcuaauuauuccaaaaguauuggcaacaaauucugguuuugauguucaggaaacuauuguuaaacuacaagaagaaucuaggauuaaucccgaaccaauuggacuugaucugguaucaggagagccaauuaauccaaaagaugcaggcauuuuugauaauuauauaguaaagaaacaaauuauuaacuccugcucaguuauugccagcaaccuuuuacuuguggaugaaguuaugagggcuggcaugaguagucuuaaaggauaa

SEQ ID NO: 5480 - RNA, 3183 nt, Sitophilus oryzae
augucuagugcugauacggcagauagcuccgucgaucccccaucaaaaaagcggaagcuagauacaagcgguuccauugauauggcgaacaacggaguagccucuggcucgcaagcacagaauaaugcagcugaaaucgaugagggcuuguauucuagacaacuuuauguguugggucaugaugccaugcgacguauggcaucaagcgacguccuuauaucugguuuagguggcuuagguguugaaguugcaaaaaaugugauuuuaggugguguuaagucaguuaccauacacgaugaaaaacagguauccauaacugacuuuaguucucaguuuuucuuuguaccagaagacacagguaaaaaucgugcugaaguuguuuguaagaaguugucugagcugaacaauuauguuccaacucguucguacacuggaccccucaaugaggauuauauuaagaaguuuaguguaguaguguuaacugauucgaccagagcagaacaauuaagaauuagcgaaguaacucaugcuaauaauauugcccuaauuguggcagauacgaaaggguuguuugcccaaguauuuugugauuuuggugacaguuucacuguaguagauacgaauggggagccugugguuucagcuaugauugcugauauuaguacugauaaagaaaguguuguuacuugcauugaugacacaagacacgguauggaagauggagacuaugucacauuuucugaaguacaggguaugacagaacuaaacgguugugcaccaaaaaaaauuaaggugcugggaccauacacauucaguauuggagauacuacagguuuuucaaaauaugagagaggugguauagcuacucaaguaaaaaugcccaaagaauugaguuucaagucucugaaagaaucguuagaaaacccagaauuuguuauuacagauuuugccaaauuugaccauccaucucaacugcaucuugcuuuuaguacuuugcauaauuauguagaaagaaacaagaaauuaccuaaaccguggaguucugaggaugcuucacaguuuuuaucuauugcuaaaacacuaguuaguggugauacagaaguaaacacugaauuguuggaccuuuuugcaaagacuucugcuggugagcuaaauccaauaaacgcuacuauaggagguauagucgcccaagaagugaugaaagcauguucuggcaaguuccauccaaucuuacaauggcuguacuuugacgccauugaauguuuaccauccgauccaaaagacagauuacuuauuacagaagaggaugcagcaccgacaggcaguagauaugauagucaaauagcaguguuuggcaaagaguuccaaaagaaaaucaauucacugaaauaccuuauugugggugccggagcuauuggaugugaacuuuugaaaaauuucuccaugaugggugugggaucugacaauggucagauuuuuauaaccgacauggacuuaaucgagaaaucuaacuugaauaggcaauucuuauuccgaccucaugauguacagaagucaaaaucagucugugcagccaaggcugcaaagaagaugaacgaccaaauaaaugugaucgcccacgaaaaucgagucggucccgaaaccgagagcauuuaugaugaugacuucuuugaaaauuuagacgguguugccaacgcuuuagauaauguugaugccaggauauacauggacagaaggugcguuuauuaccgaaaaccuuugcucgaaucuggcacauuaggaacaaaaggaaacguccaaguuguaguuccguuccucacugaauccuacaguucgucccaggacccuccagaaaaaagcauucccaucugcaccuuaaagaauuuccccaacgccaucgaacacacguuacaaugggcgagggacgcauuugaagggcuguucagacagagugcagagaacgcuucucaguaucuuacagaucccgauuuuaucgagaggacugucaaguugccggguguacagccauuggaaacguuggaaucugucaaagcagcuuugguugaugauaggcccaagucguucgaagaguguauuguuugggcucgaaaacauuggcaggaccaauaucacaaucaaaucagucagcugcucuacaauuuuccaccagaucagcucacaaguaccggucaguuguucugguccgguccaaaacguuguccaguaccacucaccuuugacauaaaugacacguuacacuuggauuacgucauagccgcugcaaaucugaaggcgcagguguaugggauucccacgaauagggauagagcguauaucgcaggaguggcuucaaaaguugaggucccaccguucguaccaaaauccggcguuaaaauugccguaaccgacucacaaauggcagcaaacggcaacagcaucgacauggaccgcauuacccagcucagaggugagcuaccuccucccgaagaagucgcagguuuagugcugacuccucuggacuucgaaaaagacgacgacagcaauuuccacauggacuucaucguugcagcgucgaauuuaagagcggcgaacuauaaaauuccuccagccgauagacacaaaucuaagcugaucgcagguaaaauuauuccugcuaucgcaacaacaacguccgucguagccggucuagccugcuuggaacuguacaaguuggcucguucauugaagagucucgaaccguuuaaaaacgguuucgucaauuuggcguuaccguucuuuggauuuagcgaaccgaucgcagcgccgcagauggaauacugcggaaacaaguggaccuuaugggacagauucgagguccagggcgagaugaccuuggcagaguuucuacaauauuuccaggauaaacaugguuuggaaaucacgaugcuuucucaaggugucugcaugcuguacuccuucuucaugcagaaagcuaaagcacaagaacgucucggccugaccaugucugaaguggucaagcgaguaucgaagaagagaauugagccucacguuagagcgcuaguguucgaacugugcugcaacgaugccgacggcaacgacguagaagugcccuacgucaaauauaaccugggccccaaggaacgagacuccuccgacugcaacagugugaauaagauaugguga

SEQ ID NO: 5481 - RNA, 1272 nt, Sitophilus oryzae
auggccgaaccugaagaucuucucgacuaugaagaugaagaaccaaccgaacaaacggcaaccgaaaccacagccgaaacaaaaaaagguguaaaagguucuuacgccucaauucacaguucaggauuuagagauuuuuuguuaaaaccagaaauuuugagagcuauuguagauugugguuuugagcauccaucugaaguacaacaugaaugcauuccccaggcuguucuuggaauggauauucuuugucaagcaaaaucugguaugggaaaaacagcuguuuuuguuuuggccacuuugcaacaacuugaaccgaccgaaaauguuguguauguucucgcgaugugccauacgcgugagcuagcuuuucaaaucagcaaagaauaugaaagguuuagcaaauauaugcccaacaucaaaguugguguauucuuuggaggaaugcccauucaaaaagaugaagaaguuuugaagaauaauuguccucauauuguugucggaacgccuggacguauuuuggcccuaguaagaucgaaaaagcugaaucuaaaacauuugaagcauuuuauucuugacgaaugcgauaagaugcucgaagugcuagauaugagacgugauguucaagaaaucuauagaaauacaccacauggcaagcaaguuaugauguucagcgccacacuaaguaaagagauucguccagugugcaagaaguuuaugcaagauccuauggaaguuuauguugaugaugaggcuaaacucacuuuacauggucuucaacagcauuacguuaaguuaaaagaaaaugaaaaaaauaagaaguuauuugaauuacuugauguguuagaauuuaaucagguuguuauuuuugugaaguccguacaaagaugcgucgcauuggcucaacuguuaacugaacagaauuuuccagccauugguauccacagagcaauggaucagaaagagagauuaucacgauacgaacaguuuaaggauuuucaaaaaagaauucuugucgccacuaaccuuuucggacgaggaauggauauugaaagagucaauauuguauuuaauuaugacaugccagaagauucagacacauauuuacauagaguagccagagcaggacgguuugguacaaaaggauuagcaauaacauuugugucugaggaaagugacgcuaaaauuuuaaaugaaguucaagacagauucgauguaaauauuacagaacuuccugacgaaauagaccucaguucuuauauugaaggacgauaa

SEQ ID NO: 5482 - RNA, 1479 nt, Sitophilus oryzae
  misc_feature (448)..(448): n is a, c, g, or u
augguucucauagaaaacgacguagaaaugaagaacgccgauaguccuccgggccccgaagcaggugauaguaaaagagacacggauuugcaaaguuugcaggaaauaagggaacaugcuaggcaaauugaaaaagcaguuagcaacaaggaaaaucgcuuuaucaugagaaucuuaagauguuuaccaaacacaagaagaaaauuaaaugguguuguauugagaaguuuaauaacucaaauuuacccuccgucagaaagagaagcguuacuagccuuuguugaagaagcaacgggugaaauugauaguucacaaaccagaacuagaucagcuacaaagaguccaguuccugaaguagacguuuacauuaauuuacucauauugguucguuuaauugauacaaacaagcuggaagaggcuucuagauguucucaagcauuaaugaaunugaauaaaauaacgagucaaaaucgucguaccauagaucaucuagcagcuaaaugcuauuuuuaucacucaagaguagccgaauuaacaaacaaguuggacuccauaagaaguuuccuacaugcgagauuacgaacugcuaccuuaagaaaugauuuugagggucaagcuguucuaaucaauugucuucucagaaacuacuuacauuauucucucuaugaucaagcugauaaauuaguuucaaaauguguuuucccugaaacugcuaguaauaaugagugggcuagauuuuuguauuauuuaggaagaauuaaagcugcuagguuagaauacaguguugcucacaaacauuuaguacaagcuuugaggaaggccccacaaaacacugcaguagguuuuagacaaacugugcaaaaacuauuaguggucguagaacuucuuuugggagauauuccagaaagacaaguauucagacaagcucaaaugcgucauucucugaguucauauuuucaacuuacccaggcaguucguaugggcaauuuacagagauucggugaaguuuuggaaaauuuuggaccacaauuuagacaagaucauacauacacuuuaauuuuacguuuacgccauaaugucaucaaaacagcuauaagaaguauuggguugucauacucucgaauuuccccucaggauauugccaagaaauuaggacuggauucagccgaggaugcggaauuuauuguagcaaaagcaaucagggauggagucauugaggcuacauuggauccacaaggaggauacaugagaaguaaagaaagcacagauauuuacugcaccaaagagccacagauggcuuuccaucaaagaauaucuuuuugucuagaucuacacaaucagaguguuaaagcuaugagauaucccccaaaggcuuauggaaaggaauuagaaagugcagaagaaagaagagagagagaacagcaagauuuggaacuugccaaggaaauggcagaggaagaugacgauggcuucccuuaa

SEQ ID NO: 5483 - RNA, 1764 nt, Sitophilus oryzae
  misc_feature (513)..(513): n is a, c, g, or u
auggcaaauccuacucaggguuuaacaguaucccaaauauugaagaguaaggcggaauuugacgaugaacccaaaaagaaaucaagggaagauuggaggaaagcuaaagaacuagaagaagcacgaaaagcugguacugcuccagccgcuguugaugaagaaggaaaggauaucaauccucauauaccccaauauauuucgaaugcgccuugguauuaugggacaaguggucccaccuuaaagcaucaaaggccucaagaugauaaacagcaagaguacucugcuauagaugaaugguauaaaagaggucuugacacaacuaaaauuguuaccagauacagaaaaggagcuugugaaaauuguggcgcuaugacccauaaaaagaaggauugcauggaucgcccgaggaaaguaggugcuaaguacucuaacacagauauuuuaccugaugaauuuguacaaaagaauuuaucauugaguuucgaugguaaaagagacagauggagugguuanacagauauuuuaccugaugaauuuguacaaaagaauuuaucauugaguuucgaugguaaaagagacagauggagugguuacaauccacuagagcacacaucagugauagaggaauuccagaaaguagaggaagcaaagaggcaacugaaagcugaaaaauuagaugcugaaaauucugauaaugaugaagaugaagacaaauauguugaugaaguagauaugccugguacaaaaguagauagcaaacaaagaauuacuguaaggaauuuacguauucgugaagauacagcaaaauauuuaagaaauuuagauccgaauucugcauauuaugauccaaaaacuagaucuaugagggaaaauccaaauccaggaaaagaugauacauacaaaggagaaaacuuuguaagauuuaguggugcuacaaaaucucaugcaacagcucaacuuuuugcuugggaagccuacgagaaagguguggacguucaucucuuggccgagccuacaaaauuggaacugcuacaaaaggaauaugacaaaaagaaggaacaguucaaaaccaaaguucagucuaauauuuuagaaaaauauggaggagaagaacauuuggaagcuccaccaaaaacuuuauugcuugcccaaacagaagauuauguugaauauucaagaucagguaaaauuaugaagggccaagaaaaagaggagauacguuccaaauaugaggaagauauuuauauuaacaaucauacaaguguuugggguucauauuggaaagguggucagugggguuauaaaugcugucauucuuuuaucaagaauucauauuguuugggugaaucuggaaaaaguacuaacaaugacacagaauuaaaaaauaguucugaugcuaauauuaaccaaagugaauguauuaauaauacaucagaaacuacacaagaaagugaauugacuugugauaaagaaucagaugauuccagugaagaugauaucagaacaaagucugaaaaaaagaaaaagaaaaauaagcauaaaaagaaaaagcacaaagagaaaaaagccgaaaaagacaaauuaucagaggcuuuaaaagcugaagaacagcaucaaaaacaagccgauuauuuguugucuuuggaugaaagaaagcgaccuuacaacaguauguuugaagcaaagaaaccgacggaagaagaaauugaagcauauuaccuaaaaaggaaacgagaggaggauccaaugagucaguuuuuauaa

SEQ ID NO: 5484 - RNA, 630 nt, Sitophilus oryzae
auggguaucagucgagaccauuggcauaaaaggagggccaccggaggcaaaaggaagccucuccguaagaagaggaaguucgaauuaggucgcccagcggcuaauacgaaacuaggagcuagcagaagaguucacuauguaagaacucgagggggcaaccuuaaauacagagccuuaaggcugacccauggcaacugggcuugggguagugaaaguaucacccgagaaagccguauuaucgaugucguuuauaaugcaaguaacaaugaauuaguacguacaaaaacauuggucaagaaugccauuguaguuguugaugccacaccauucagacagugguaugaaggucauuacauucuaccgcuaggacguaagaagggugcuaaauugacugcggaagaagaugcagcauuuaacaaaaaaaggaguaagaagauucagaaaaaauaugaaaccagacagaaaaccgcuaagguagaaccagcuaucgaagaacaauuucacacugguagauuauuagcuuguauuucaucgagaccaggacaguguggaagggcuaguggguauauuuuagaaggaaaagaacucgaguucuacuugagaaaaauuaagucuaagaaagcaaaauaa

SEQ ID NO: 5485 - RNA, 1002 nt, Sitophilus oryzae
  misc_feature (808)..(808): n is a, c, g, or u
auggauagacuacugagauuaggagguggaaugccugguuuaagucaggccccaccaccaagcgacgcuccgguuguagauacagcagagcagguuuauauuucaucuuuagcucuucuaaaaauguuaaaacaugguagagcaggagucccaauggaaguuaugggucuuauguugggagaguuuguugaugauuacacggugcguguaauagauguuuuugcuaugccucagacugguacuggagugaguguagaggcugucgacccuguauuucaagcaaaaauguuagacauguuaaggcaaacaggccggccagagauggugguaggaugguaucauucucaccccggguuuggaugcuggcuuucagguguugacauuaauacacagcaaucauuugaggcuuugucagagagagccguugcuguaguuguagauccuauacaaucaguuaaaggaaaaguuguuauugaugcauuuagauuaauuaauccaaauaugaugguucuuggucaagagccuagacaaacaaccucaaauuugggacauuuacagaaaccuucagugcaagcuuuaauccauggauuaaauagacauuacuauucaaucaguauaaauuauagaaaaaaugaacuugaacaaaagaugcuucuuaauuuacauaagaaauccuggauggacgguuuaacuuuggcagauuauucagaaaauugcacuacuaaugagaaaacuguugcugauauguuagaauuagcaaagaauuauaauaaagcucuugaagaagaggaaaaaaugaccccugaanauauguuagaauuagcaaagaauuauaauaaagcucuugaagaagaggaaaaaaugaccccugaacaacucgccauuaagaauguuggaaaacaggacccaaaaaggcauuuggaggaaaaaguggacguucuuaugacuaauaauauuguacaguguuuaggugcaaugcucgauacaguuguauuuaaauaa

SEQ ID NO: 5486 - RNA, 1257 nt, Sitophilus oryzae
augaccguaauuaacaagauggagauugaugggggcccuaaaggcgaaggguuccguucuuauuacauuacaaaaaucgaagaauugcaacugguuguggcggagaaaagucagaaucugagacgauuacaagcccaaagaaaugaacugaacgcaaaagugcguaugcuuagagaggaacugaugcuuuugcaagaacaaggcaguuaugugggugaaguugucaaaccaauggauaaaaagaagguucuuguuaaaguucacccggaaggaaaauuuguuguggauaucgauaaaaauauugauaucaacgauguaacaccaaacugcagaguagcucugagaaaugaaaguuacacccuacauaagauucuuccaaacaagguugacccauuggucucccucaugaugguugaaaaaguaccagacucuacuuaugagaugguuggugguuuagauaagcagauuaaagaaauaaaggaaguaauugaacucccugucaaacauccugaacuauucgaugcucuuggaauugcccaaccaaaagguguacuguuguaugguccaccaggaacaggaaagacacuuuuagcucgugccguagcccaccacacugaauguacauuuaucagagugucggguucggaauuaguacaaaaauuuauuggagucagagugucggguucggaauuaguacaaaaauuuauuggagaaggaucucgaaugguuagagaauuguucguuauggccagggaacaugccccuucuauaauuuuuauggacgaaaucgauuccauugguucuucacguauugaaucagguucgggaggugacucugagguacaaagaaccauguuggagcuucugaaucaacuggacggauucgaagcuaccaaaaauauuaaaguuauuauggccacuaaucguauagauauuuuggauccggcccuccucagaccugguagaaucgauaggaaaauugaauuuccuccaccaaacgaagaagcucgauuggacauuuugaaaauucacucuagaaaaaugaauuuaacgagaggaauuaauuuaaggaaaauugcugagcuuaugcccggugcuagcggugcagaagucaaggguguuuguaccgaagcugguauguacgcuuuaagagaaagaaggguucacguuacucaggaggauuuugaaauggcaguugccaaaguuaugcaaaaggauucugagaaaaauaugucuaucaaaaaauuauggaaauag

SEQ ID NO: 5487 - RNA, 609 nt, Sitophilus oryzae
  misc_feature (553)..(553): n is a, c, g, or u
augguaaaauuauauugccuuaguauucuguacaaagggaccacugcagcuacuuggcuaaaauccgcauucgauuugcagagcguaagcuuuuuccagcggggaucuguacacgaauuuaugcaguuuuguugcaagacugucguagaaagaacacucccggccucaaggcaaucaguacagcagggugacuacuuuugccauguguauguuagaucugacaaccucgcuggcguaguaauaucagaucaugaauauccacagaggguaucacauacuuuacucacgaaaauucuugacgaguucucagaaaaaauaccagccucgaauuggccaaaccuacaggaaaaagauguggcuuuuccacaacuuaacaccuacuuagccaaauaccaaaacccgcgagaagcagaugcuuugacgaaaauccagaaugaacuagacgaaacuaagauuauuuuacauaguaacauucaagccguauuggagagaggugaaaaacuagaugauuugguugccaaaucggaggugcuaaguacucaaucgaaggcunaguacucaaucgaaggcuuucuauacaacagcgagaaagacaaacucuugcuguaa

SEQ ID NO: 5488 - RNA, 795 nt, Sitophilus oryzae
  misc_feature (649)..(649): n is a, c, g, or u
auguucuuaacaagaagugaauaugaucgugguguuaacacauuuucaccagaaggucgucuuuuucaaguugaauaugcuauugaagcgauuaaauuaggaucuacagcaauuggaauaucuacaagcgaaggaguuguuuuagcaguugagaaacgcauuacuucuccucuaauggagccaacaacaauugaaaaaauuguugaaguggauaagcauauugggugugcauuuucuggucuuauggcagauucaagaacaaugaucgauagagcgcguguagaaugucagaaccauugguuugucuacaaugaaaacaugaguguagaaucuugugcucaagcuguuucuaaucuagcaauucaguuuggugauucagaugaugauggggcagcuauguccagaccuuuuggaguggcgauacuauuugcuggcauugaugaaaagggaccucaacuauaccauauggacccuucagguacauuuguucaauuugaugcuaaagcuaucgggucagguucugaaggugcucagcaaagucuucaagaaguguaucaucguaguaugacuuuagaagaagcuacaacugcagcuuugacgauuuuaaagcaagucauggaagaaaaguugaauucaucaaauguagaanugaauucaucaaauguagaagugaugaccaugacuccaaagaaucuguuucauauguuuacuaaagaacagguggaagaggccuuaacaaauguauucccugcugaacaucccacucccauaaaaguuaacaagcaaaaaguuuaa

SEQ ID NO: 5489 - RNA, 1359 nt, Sitophilus oryzae
  misc_feature (1103)..(1103): n is a, c, g, or u
augacggaguauugguugauaucggcaccaggggacaagacgugccaacagacaugggaaacgaugaacaaucucacggccaagcaaaauuccuuguguguaaauuauaaauuucaaauuccggaccucaagguugguacucuggaucagcuggugggucucuccgaugaccuuggcaagcuggacggauucguugaacaggugaccaggaaggucgcuucguauuugggggaaguacuggaagaccagagggauaagcuucaagaaaacuugacggcuaauaacacugaccugccgagcuaccugaccagguuccagugggacauugccaaauacccgaucaagcaguccuugagaaacaucgcugacauuaucagcaaacaagugggucagaucgaugccgacuugaaaaccaagucuaccgcuuauaacaacuugaagggcagcuuacagagcuuggaaaagaaacaaacuggcaguuugcugacccguaaucuggccgaucuagugaagaaggaacauuuuauuuuggacucugauuaucugcagacuuuguuggugauugugccuaaagcgucuuuugccgauuggaaugccaccuacgaaaaaaucaccgacaugaucguuccuagaucgucucaguugaucacgcaagacaacgaauauggccuguacacagucacgcuguucaagaaggugauugacgaguucaagcaucaugcucgcgagcgcaaguucaucgugagagacuucacuuacgacgaggaacaguuggcggccggcaaaagcgagaucacuaaguugaccacugauaaaaagaagcaauuugguccccuggugcguuggcugaagguaaacuucagcgaguguuucugcgcguggauccacgugaaagcgcugcgcguuuucguggagucugugcugcgcuacggccuacccgucaauuuccaagccauucucauccaccccaacaagaaaacgaugaagcgacucagggacguccugaaucaacuguacggccacuuggacggcagcgugggccaccagggcucgcacgucgacaacgucgacauucccggccuggguuucggccaaucagagunaccagggcucgcacgucgacaacgucgacauucccggccuggguuucggccaaucagaguauuaucccuacguuuacuacaaaaucaacgucgacaugaucgagucgaaggucuagguucgaugaacaggcaaaaaacacaauauuccauuuuuaauauuaauuccucccguagauuuuucuuauacacuuauaaguucgagguaaaauugucccuuuuuucgucccuaaacguccggaauuuuugcacgaguuga

SEQ ID NO: 5490 - RNA, 1674 nt, Sitophilus oryzae
augucgauuuuagcgaguccauuauccguagcaggucagaggcaaucgggggcuucaguccguacacaaaauguuauggccgccgcuucaauugcuaacaucguaaaaagcuccuuggguccagucggauuagauaagaugcuaguggaugacauaggugauguuacaguaaccaacgauggugccacaauucuaaggcuccucgaaguggagcauccagccgccaggguucuuguugaauuagcucagcuucaagaugaagaaguuggugaugguacaaccucaguagucauuauugcagcagaauuacuuaaaaaugcugacgaacuaguaaaacacaaaauacauccuaccucuauaaucagugguuauagauuagcuugcaaagaagcaugcagauauauacaagaucaucuuacaauuccuguugaagaguuggguaaagacuguauuguaaauguugccaagacaucaaugaguucuaaaauaauuggagcugaugcagauuucuuuucugcaaugguuguagaugcugccuaugcagugaaaauuacagaugucagagguaauccuauguaucccauuaaagcagugaauauucuuaaagcacaugguuguagugccagggagaguauuuugguacaaggauaugcccuaaauugcacuguagcuagucaggcuaugcccaagaaaauuguaggugcaaaaauugccugucuugauuuuucauugcagaaagcuaaaaugaaaauggguguccagguuuuaauaaacgacccagaaaagcuugagggaaucagagcccgagaguuagacaucacuaaagaaagaauccaaaaaauuuuauccacugguguuaauguuauacuaacuucaggaggaaucgacgauuuauguuugaaguauuuugucgaagccggugcuaugggagugcgaagaguuaagaaggucgauuuaaaaagaaucgcgaaagcaacaggagcgacauuuuugacgucuuuaucuaacauggauggugaugaaucuuuugaugcuaguauggucggagaagcagcugaaguauaucaagaaagaguaucugaugaugaauugauuauuauuaaaacaccaaaacagcguacagccgcaucuauuauuuuacgugggcccaaugauuucuauugugaugaaauggaaaggucaguucaugacgcucuguguguugucaagagaguuuuggaaucgaagaccguuguuguuggugguggagcaguugaagcugcucuuuccauuuacuuggaaaacuuugccacgacacugaguagcagggaacaauuagcuauugcggaauuugcuaaaagucucuugguuauucccaaaacucuggcagugaaugcugcaaaggacgcuacagauuuaguagcgaaauugcgcgccuaccauaauuccagccaaacuaaggucgaacaugcacaucuaaagcauguaggauuggaucucauugagggcacgguaaaagauaauaagaaagccggugucuuagaaccaacaauuucgaagauuaagucgcugaaguuugccacagaagcggcgaucacgauuuugagaaucgacgacaugauuaaguuggacgcgcaagaaaaaggcggcaagaauuacagacaagcgauggagagcggagaauuguauaacuaa

SEQ ID NO: 5491 - RNA, 837 nt, Sitophilus oryzae
augauacggcgaccaccgagaucuacacucuuucccuacacgacgcucuuccgaucuaaaauaucaaaaauguuuucagcaccacccuuuugggaaaauggcccugcuccaggaaguuucuacaacuuucccaauuugcaaccacaaguacaacaaccucaagauuucagacaacauucucagucuccaguaacaacaucaacaucuuugguuggaaucacauacgauaaggggauucuaguagcuggcgauuugcuagcaucauacgguucucuugcacguuacagaaacuguccuagaauaguaaaaauuaacgagaacaucauuuugggugccaguggagauuaugccgauuuucaauauguaaaagacuuuguugagcaaaaagucauaagugaagaaugucuagaugauggucuugcuuuaaaaccaaaaucucuguauuguugguugacuagaauucuauacaauagaagaagcaagauggacccauuguggaacaacuuuauaguagcaggaauucaagacggacaaccguuccugggaacaguugauaaacaugguacugcuuaugcugauaaaguuaucugcacagguuauggggcacauauugccacaccuuugcugagggacaguuuggacaagaauccccaauuaaauuuagccgaagcuaaggcuuuaaucgagaaaugucuggaagucuuauacuacagggaugccagaaguuauccaaaguaucaguugggaauuauugaugucgaacaaggagugucuauugaaggacccuuggaaguaccacaaaaaugggaaauugcuuaucauucuaaacguuucuaa

SEQ ID NO: 5492 - RNA, 2088 nt, Sitophilus oryzae
auggaacaguugaaagaaccaaguucucaauuauucggugauccagaauuuguugccgaaaaguauguacgagacacaucgcaaaauuauguaggugguuccgaauugcagaauauuaaaaagaaaauucaagcuuuagcagaugaaaccaguagcaguuugaagagaaacguguaucagaauuauguacaguuuauugaaacugcuaaagaaauuucucacuuagaaagugaaauguaccaauuaucgcauuugcuuuccgagcaaaaaucuuuauuaaaugccuuaucugcuacaucaauuuuagaagaugguacucacguuaauguugaaacuaauaauaaauuaagugagcaagaaguugaggaggaaaacaagcaaaaacuaucaaugauccuugaaaaaguagaaaacuguaaggauuuacuggaagugccugguagaacuuuacuuuuugaaggugacuuauuggaaauugauccuacugaaaguacggcuuugaaauuugugcauguuuauuuauuuaaugauggguuaaugauaacaauuagaaauucaaacagucgaggcauaaugagguaugcauuugaaaguauguacgaauuggguaguuuagcuguuguaaauguucgugauuugggcaauaucaaacaugcuuuuaaauuauuaauuuuuccugauacuagaguuuuucaguguucaucaaauacaagcaagaaagaaugguuagauaaaauagaucaggccaaaaaaacaaaguuagcugcugaacaacaaaaaagggaaucgacuuugucagaaaaauugucacccucuaggucaacgucgguugauuuaaguaucaauaauaaaccagaagaaguuacuauaauacauccugaaugguuuuuggauguagcugaugaacuugaugucugcauugcccaaagacauuuugaagaugcagccaauuacuuacaaaaagcccaaaauuacauaacaaaaauuacagcacaaaauggugaacucgaucauguuaucauagauguuaagaaaaaaguugaacaaaagcaagacaguuuaauagagacccugaugaaggaacuagaaguuaacccugauaaaucacuacaagguggauuaagggcuacaagaagagcugugagauugcuuaaucaguugggaagaucuacucaaucaugugacuuguucuuaaaauuauguaguaguauguugaaaacucaauguaaaagaguaaaaagagaaggcucgacgacaauguaugucaggcauuuggcuagugucguuuuuacuaauaugugucauaugucagaggaauuuuugagagcuuuuccugauucaguugacugugccucugcuuauguagucugggcgaguggagaacuuaaucuauucacuacacauuuuaucaaacaaguuuuuaugccacaaacuagucuuucuacaaucacugaaugcgugcuguuaguaagaucucagugugaaagguuauguucauacgguguugauuuucguuaucaguuagauggggcauuaagaucuucauuuguaaaagcauugagagauacaagggagaaacuuguagauucaaugaaguugagagccucugaagacaaauggauuccaaugaauuuaguaucaaaagccaguuuggccaaauaucuacaagaauacagcaauaugggacuuaaauuagacuucuauguuacuggagacguguggcuucaauuaacaucauguaauguagcuuucacaaaaauuuauuugacauuaguugacgauugccuaaaacugaaaaccacugaauuacuacacgugauagaagaaacgcuuuauauuguuuuugagucccaaaugaggcacaauguuguuucuuacaauaaugagcaacaaauagagcaaaaaagguuuauuuugaagaacauugaauuuuuguuaguugcuguucuugaacuggugcagaaaaaauucaagggcgaaacaggauacgaaucagaacauuuaaacaaacucuggaacgaguauucugguuuauuaaagcaauccucucgcaacaccaagacaaaauauucaucagauuuuuuauaa

SEQ ID NO: 5493 - RNA, 2655 nt, Sitophilus oryzae
augaaagauguagaccaacucacaggaaaagauuugaauccauuaucucaugcuccagcugaaagagaagacaaagaucguaauccggauagaccaaugcauagcagcacaucaguacugagacuuccuguaaaucuagaugaaggugaagaagauucuagaaaaaggguuaccaggauaucaaguccugaaaggugggaaauaaaacagaugauaucuucuggauguauagacaaaagcgaauugccugacuuugaugaugaaacuggacuccuucccaaagaugaagaggauggugaagcagacauugaaauugaauuaguagaagacgagccuccauuucugcaaggucaugguagagcuuugcaugaccuaaguccugucagaauuguuaagaauccugauggaucccuugcucaagcagcuaugaugcagucagcacuagcaaaagaaagacgcgaacaaaaaaugcuucaaagagaagccgaaguugauucacaacccucugguaaaaauaaaacuuggauagauccuuugccugaagaggaauccaaagaugugucagcaaggggaauugguuugcagucccaagacuuaccagaauggaagaaacacauuauuggugggaaaaaaucuuccuuugguaaaaaaacgaaccuuucuaucauagaacaaagacagucgcugccuauauauaaacugaaagaggaacuucguaaggcgguuacugauaaucaaauucugauugucauuggugagacugguucaggaaaaacgacucaaauaacucaguauuuagcagaagaaggguuuacagcaagaggcaaaaucggauguacgcaaccacgucguguugcagcuaugucuguggcuaaaagaguagcugaagaauucgguuguagauugggucaagagguuggauacaccauccguuuugaggauugcaccagcccugaaaccauuauaaaauacaugacugacgguauguugcugagagaaugucugauggauuuagacuuaaagggauacucagucaucauguuagaugaggcucaugaaagaacuauucauacugauguacuuuuuggacuacugaagcaggcuguuacaaagagaccagagcucaagcucauuguaacaucggccacauuggacgcaguuaaauuuucucaguauuuuuuugaagcaccaauuuuuacuaucccaggaagaaccuuuccuguggaaguuuuauacacuaaagaaccagaaaccgauuauuuagaugccaguuuaaucacgguuaugcaaauucauuugagagaaccaccaggugacguauuauuguucuuaacuggucaggaggaaauugauacagcaugugaaauucuuuaugaaagaaugaagucuuuagguucugaugugccugaacugauaauuuuaccgguauauucugcuuuaccgucggagaugcaaacaagaauuuucgaaccugcaccuccagguagcagaaaaguuguuauugcuacaaauauugcagaaacaucccucaccaucgauggaauauucuaugucgucgauccaggguucgugaaacaaaaaguguauaauucuaagacugguauggauucuuuggugguuacuccaauuucacaggcccaagccaaacaaagagcggguagagcggggcguacagguccuggaaaauguuacaggcuuuauaccgaaagggcauauagggaugagauguuaccuacuccuguaccugaaauucagcgaacuaaucuugcaacuacgguucuucaguugaaaacaaugggaauaaaugauuuguuacauuuugauuuuauggaugccccaccaguagaguccuugauaauggcgcuagaacaguuacauucgcugucagcauuagaugaugagggacuauugacaagacuaggaagaaggauggcugaauuuccucuugaaccuaacuuaucaaaaaugcugaucaugucugucgccuuacaaugcuccgacgaaauccuuacgaucguuagcauguuguccguucagaacguauucuaccgaccuaaagauaaacaagcguuggccgaucaaaaaaaggccaaauucaaucagccugaaggcgaccacuuaacccuauuggccgucuacaacaguuggaaaaacaacaaguucucuaaugcgugguguuacgaaaauuucguacaaauucggacgcugaagagggcccaggacgugcgaaaacagcuuuugggaaucauggacaggcauaagcuugaugucguguccgcugauagaaacaguguaagagugcagaaagcuauuuguucagguuucuucagaaaugccgcgaagaaagauccacaggaaggauauagaacguugguggacagucaaguugucuacauacacccgucuagugcguuauuuaauaggcaaccugaguggguuaucuaucacgaauuagucugcaccacaaaggaauacaugcgcgaaguuacuacaauagauccuaaaugguuggucgaauuugcaccggcauucuuuaaauuuuccgauccgaccaaacucaguaaauucaaaaagaaucaaaggcucgaaccauuguauaacaaguacgaggaaccuaaugcuuggagaauaucccgaguuaggagaagaagaaau

SEQ ID NO: 5494 - RNA, 1275 nt, Sitophilus oryzae
auggcaccuuauaaaagaaauauagaugauguucuugcucguauuaauuuuccucuuuuuaccguccaaaugcuuacaaacagacauguauuaguuggugggggcggaggcucagcaaaaacugguguugcgaauggauuugaaauuuuugaacugucgcaugacggaaacaaauuccaugucgaggaaguaacuagacaugaaacagguccuaauguuguuaugaauugugcaguggcuuuaaaaaauaaucauacuuauuuaguugcuggucaagagagucauugucaauuauacaauguaaacucugaauugguagcucaagaaaacggugauauugaaaaccuuggaacugaccaccauacuaaugguaaacugaggcacagaaaaucagcgccuaccaguaaaaauaaugacauuaauaagaauuuaaggaaaagguuaaaauuuauuuuaaguccgucagauaguguacagacugauuuuaaugagccugaaccuuuauguagagugguaaggguacacccagaagggaaucuaauggcuacagguggaacagauggcacuauacagauguggagauuuccaagucuuaagccucuaaccaaauuaaaaggucacacaaaagagauagaugauauagauuuuaguuuauucgacaauuauauuauaacaguggcaaaagauggucaagcaauuuugugggacuguguuagaggaaaagaaauuaaaaaacuaacauggaaucaaccgcaggguucgaaauaucuauauaaaagaugcagauuugguaucauagaaggugaaaagaagugugcacuuuauaugcuuuccaauccaaccgguguugccaaaaagcaaaaaucuuuuuugcaacaguggcagcccgaagaagagacaauuaaaagaguugcaauauuugaugaaaguauuucggcccuagcaguaagagaugauggaagauuuguagcugugggaacuauguucaguggaucaguuucgauccauacaucauuuaauuuacagauuguuuuaaagguaccuggagcacaugccauguuuguaacaggucuagaguuuuuaccggucuugaaucaggaaaaccaaacuguuuguaguguagcugaagcugcaguauuaucaauuucuguugauaaucaaguuugcauacacacauugccuuauagaaaaacuauaccauuguggcuggcgauaguaauauuaaugauuacuuuauuuuuaacuuuuuuguuuuguucauacauaggucuguag

SEQ ID NO: 5495 - RNA, 1251 nt, Sitophilus oryzae
auggcgggcgcaauguuguuugaaagaagccaaucuguucguucucagcaugaaaauuugaugaaauuaaaacguggugaugauaaugaagacagugaugaaaaaaguauccaaaauaaagaacaggauauccuaaaccucggcgagaaguauaagaaagaagguaaggccaaagagcuugcagaccugaucaaacaaacacguccuuucuuaagugaaauuaguaaagcaaaagcagcaaaauuaguuagaucucuaguagauuucuuuuuggaucucgaggcgggcauugguauagaaguacaacuuuguaaagaauguauagaaugggcgaaagaggaaaaacgaacauuuuuacgucagucauuggaggcgagauuaguagcccuauauuucgauacuggaauguucucggaagcucuucaauuaggaucaacuuuauugaaggaauugaaaaaauuagaugacaaaaauuuauugguagaggugcaacuguuagaaaguaaaacguaccaugcuuuaaguaauuuaccaaaagccagagcagcucuuaccucagcccguacaacugcaaacgcuaucuauuguccaccuaaaauacaagcuucuuuggaucuucagucagguguuuuacaugccgcagaugaaaaagacuuuaaaacagcuuauucauauuuuuacgaggcuuuugaagguuuugacagugucgaaucuccuaaagcauuaacagccuuaaaauauauguuguugucaaagaucaugcuuaauaccccugaagauguccaacaaauuguaagcggaaaguuggcaauuaaauacgccggucgggauauugaugcaaugaaggcuguagcucaagcaucucauaaaagaucguuagcggacuuucaacaagcaguuaaauuauuuaaaagagaacuagaagaugauguuauaguuagggcacauuuggguacuuuauacgauaauauguuagagcaaaacuuguguagaauuauugaacccuacaguagaguacaaguugauuauaucgcaaaaacuauaaagcuaccuaugccacaaguugaaaagaaauugucucaaaugaucuuggaugcaaaguuucaugguauauuagaucaaggagaagguguucuaauuauuuuugaagaaacuccaguagauaaaacuuacgaaauggcauuagagaccauucaaaguaugagcaaaguaguagauacacuuuaucaaaaagcuaaaaagcugucauag

SEQ ID NO: 5496 - RNA, 1773 nt, Sitophilus oryzae
augucuucaagaucgaagaagucggccacaccggcgucgcaaccucccccgcguccuucgagcccccugagcccuacccggcauuccaggcuccaggaaaaggccgauuugcagaaccucaacgaucgauuggcgugcuacaucgauaaagucagguauuuagagucugaaaacaacagacucacucgggaaauucaaacaacacaggagacuguuacuagagaaguguccaacauaaaaucuauguacgaucaugaacuaagcgaugcacguaaacuauuagaugaaacacacagggaaaaagcacgauuagagaucgaugugaaacguuuguuagacgagaaugaugaguuaaaacaggaacuagccaagaagucgaaggauuuaacguuggcagagaauucugcucgaaucuacgagacuagguguaacgaguugcagcugaaauacaaccaggcuaaugccgaugcuaaaaaagccaucggugauuugaaagaucuggagaaggaacgggacaaacuuaaaaaacuucuagacgaacauagaaaacagcucgaggaagaaucucuggcuagaguggaaguugagaaugccaaucaaagucuaagagaagaauuauccuuuaaagaccaggucuaccaacagcagcuaaccgaaacacguacacgucggcagaucgaaauuagcgagauugacggacaguuggcugaaaaauaugaagccaagcugcaacaagcuuugcaagaucucagggaccaguaugagagccaaauggcuagcaacaggucagagaucgagcugcucuacgaaaauaaaaucaagaaucuccaagcugccgcaaauagacagucaaacgccgcuuccaaugcucuggacgaagccagacaaauccgauccaaaauugacacccuuaccaacaggguaacgcaguuagagaaugaaaacucaggacuaguugccagagcccgagauuuggagaaguuauuagagaacgaacgguuacgucacgccgaagacuuggcagcgcuggaaggcgaauuggccagacugcgugaagagauguccaaccaguugcaggaguaucaagaucugauggacauuaaggugucuuuggacauagaaauugccgcuuacaggaagcuguuggaaucggaggaauccagauuaagaauuacaccaucgggaggagaacgugaagugauccacucuaccagcacucguaguucuucaucucgccucacgccuagcagguugggugccaagcgcaagcgcacgcucauggacgaaagccacgaauccaguuuuuccgacuacagcgucaccgguuccagcaaaggcgacauugaaaucuuggaagccaauccugacggaaaguuugucaaacuccauaacaagaguaaccaggagauaacuguugguggcuggcagauuauuuugagggccggagacaacgaaaccaaauacaaauuuauucguucggcgaaaauugaacccaaagguacagucaccguguggucugcggaucaaaacaaggaucaugaaccaccacaugaucuagugaugaaagggcaaaggugggucacuggagacaacaucacaaccacgcuguugaauuuugauggcgaagaaguugcaguuucggaaagaguaaaacgacagcugucaagcucgcaccuaagacaccgagagauggcggggggguuuauaggggccgaggaucuccaucaucaagucggcgauccccaaggcgaugaaaaaugucgacucauguaa

SEQ ID NO: 5497 - RNA, 2475 nt, Sitophilus oryzae
  misc_feature (829)..(829): n is a, c, g, or u
auggccgaucaacaaaauccggaagaucuagcuacggcgauccuucgcaagaaggacagaccaaacaggcuaauuguagaggaagcugucaaugaugacaauuccguuguggcccuaucucaaggaaaaauggacgagcuacagcuuuucaggggggacaccguucuccucaaaggcaagaggcgcaaggaaaccgucuguauagugcucucggaugauucuugcagcgacgaaaaaaucagaaugaacagaaaugugaggaauaaucucagagugaggcugucagauguuguuucaguucaaccaugucccgaugugaaauacgguaaaagaauacauguccuuccuauugaugacaccguugaaggucucacugggaaucuuuuugaaguguacuuaaagccauacuucuuggaggccuacaggcccauucacaaagacgacguguuuauuguacggggugguaugagagcuguagaauucaaagugguggaaacugauccugcuccguauuguauuguagccccagauacagugauucauugcgauggagauccaauuaaacgugaggaggaggaggaagcucugaacgcugugggcuacgacgacaucggaggcugucgcaagcaacuggcccaaaucaaagaaaugguugaacugccccuacgucacccaucccucuucaaagccaucggcgugaaaccgccgcguggcauccucuuguacggcccccccggcacaggaaagacccucauugcccgagccguagccaacgaaaccggcgcuuucuucuuccugaucaacgggcccgaaaucaugagcaagcucnucuuccugaucaacgggcccgaaaucaugagcaagcucgcuggcgagucggaaaguaaccugagaaaggccuuugaggaagccgacaagaauucuccggcuaucauuuucaucgaugaauuggacgccauugcuccaaagagagaaaaaacccacggcgaggucgagagacguaucgugucucagcuguuaacccugauggaugguaugaagaaauccucccauguuauugucauggcggcuacgaacagaccuaauuccaucgacgcggcuuugagacgcuuuggacgguucgauagggagauagauaucgguaucccggacgcuacaggaagacuggagaucuugcgaauccacacgaagaacaugaaguuggccgaugacguggauuuggaacagaucgcugcggagacucacgggcacgucggggccgauuuggcgucgcuuuguuccgaggccgcgcuucagcagaucagggaaaagauggauuugaucgacuuggaggacgaucaaaucgaugcggaggugcugaacaguuuggcggugacgauggagaacuuccgcuacgccaugacgaagagcagucccagcgccuugagagaaacggugguggaaguacccaacgucacgugggaagacaucggaggccugcaaaacgucaagaaagaauuacaagaacuugugcaguacccaguugaacaccccgauaaguuccucaaguuugguaugcaaccguccagaggaguccuauucuauggucccccggguugugguaagacuuugcuggccaaagccaucgccaacgagugucaggccaauuucaucucuguuaaaggccccgaguugcucaccaugugguuuggugagucugaagcaaacguuagagauauuuucgauaaggccagaucugccgcuccuugcgugcuguucuucgacgaauuggacucgaucgccaaauccagaggcggaaacgugggagacgccgguggggcggccgaccgcgucaucaaucagauuuugacggagauggacggcaugggcgccaagaagaacgucuuuauuauuggagcuacaaaccgaccagauauuaucgaucccgccaucuugagacccggccgucuggaccagcugaucuacaucccgcugcccgacgagaagucgagggaggccaucuucaaggccaaccugcguaaaucccccguggccaaggacguggacaugaacuacaucgccaaggugacgcacggcuuuuccggcgccgacuugaccgagaucugccagagggcgugcaagcuggccaucagacagucgaucgaggcggagaucagaagggaaagggagagggcuaguaaucccgcggccgccgcagcuauggacuuggacgaggacgacccugugccggaaaucacgcgcgcucauuucgaggaggccaugcguuucgcgcgucgaucagucucggacaacgacauccgcaaguacgaaauguucgcgcaaacguugcaacagucucgcgguuucgguaccaacuuccgguuuccggccggcggcggcgcccccaaucccggccagggcggcacgguaccgcccccggucgcucccggugaccaggcuaacuuugacgauccggaggacgaucuuuacaguuag

SEQ ID NO: 5498 - RNA, 825 nt, Sitophilus oryzae
augggagacaaauuugacugugcauuagaccuuaugaggagauugccaccccaacaaauagagaaaaaucuaagugaucuuauagauuuaguucccagcuugugugaggauuuguuaucaucuguugaucagccuuuaaaaauugcuaaagauaaccaaaauggaaaagauuauuuauugugugacuacaacagagauggugauucauacagaucuccaugguccaauacauauuauccaccacuggaugauggucaaaugccuucugaaagauuaagaaaacuggaacucgaugccaauaaugccuuugauuuauauagagaaauguauuuugagggugguguaagcucaguuuauuuuugggauuuagaucauggauuugccgguguuauucuaaucaagaagacuggagauggcaguaaaaaaauuaagggauguugggacucuuugcauguuguugagguucaggaaaagaguucuggucguacuucucauuauaaaaugacaucuacggcuauguuauggcuacaaacuaauaaaccaggaucuggaacuaugaaucuaggaggaaguuuaacuagacagacagagcaagaugcugcaguuaaugaaaauaauccucauauugcuaauauaggaaaaaugguugaagacauggaaaauaaaauucgaaauacacuaaaugagaucuauuuuagcaagacuaaagacauaguaaacagcuuaagaucaguucagcccuuaacugagagcagacaacaggaugcuuuaagacaggauuuagcugcugcuuugcaaagaaggcauaacagaggugacaauuga

SEQ ID NO: 5499 - RNA, 2682 nt, Sitophilus oryzae
  misc_feature (2584)..(2584): n is a, c, g, or u
augcaacaaguggaggcuacaguucaaaauaacacaagugguaaaaugaaugaacaggccucaucuggcaacgguguagcugcuccaccagcaucugcugcuacaauggccucccgugaaguucgugagccuccaccaaggaaugagccagugguugaacccguuaacgguguaguucaaccacuaguaaugccuccuccagagagaccuggcaggaucaccaaucaauugcaguuucugcaaaagacuguacuuaaagcgaucuggaagcaucaguuuguauggccuuuccaacagccuguagaugccaagaaacuaaacuugccggacuaccacaagauuaucaagcaaccaauggacuuggguacaauaaaaaagcgcuuagaaaacaacuacuauuggucgggcaaggaaugcauucaagauuucaacacaauguuuacaaauuguuauguauauaauaaaccaggcgaggacguggucguaauggcccaaacuuuggagaagguuuucuugacgaaaguggcugacaugccuaaggaagaauuuguaguagagacacaagccaaaggugcaaaagguaaaaaagguagaacuaguacuggaccuacuggaguuacuaccccagguagaggaagaccaccagcaacugugucauccacaguaucaaauccuguagcuacaacaacagguucuauggguauuccuuuggguaccagcgccccagucacaguuccgggcaguaccgcuaccaccaccauagcacaacccaacaaugcccaagucacgccuauuacuccuacggggcccucuuacgcugcugcucaggccauggacacuccaguauccgcgcugggcgugguaccuccugcccagccggccaagagcaaaaagggcguuaagagaaaggcugauacuaccacgccggccacagcuuaugauuaccuuccaucuggcgcugauucgaauuccucgucguccgcgagcaagaucuccaaacgucgagaauccggucgccagauaaagaagccucuacguaaucaggagcuggacgguuuggggccuuauggagguucagcggcggcuggugcuguaccaucaccagcagcucaggccggggcgcacgcgcuuaaaaacaaggaaaaacucaaugacacauuaaaagccugcaaugagauacugaaagaacucuuuucaaagaaacauuguaguuaugcuuggccuuucuacaaaccgguagaugcggaacuguuagguuuacaugacuaccacgacauuauaaagaaacccauggaucucggaacagugaaggaaaagauggacaaucgcgaauaccguucggcgcaggaauucgcgcaggacgugcgguuaaucuuuaccaacuguuacaaguacaaccccucggaucaugacguggucgccauggccaggaaacuucaggacguguucgaagucaagauagguuuggugccgcacgaguccaguucguccggauccaguucggagaguuccagcgauacggaggacuccgaggaggagaggcggaacaagcaacugaaacagcucgaaaaagaauugacggcgaugcaggaaagaaugagaaaacugguagaagagaguacgaggcguaaaaaagagaagaaaaagcaaaaacucaaagacaaacccaagaaaaugacagcagcggcgcaagcggugucugccauccccaacaguacgggcccucgaggacccaaaccagcagcggcggcgccaucgggggcggcagcgggaccagcggcgaaaagggccaagacagguagaggggcuggagcaggaaccggucccggaagaaagaaggcgcaagcagcaaugccagcgccggcuuucgacuccgaagaugaagacaacgcuaagccgaugucguacgacgagaaacggcaauugucgcuugacaucaacaaacuaccuggugacaaauuaggucggguggugcacaucauccaaucgagggaacccucguugagggacucgaaccccgacgagauagaaaucgacuucgagacacugaaaccguccaccuugcgagagcuggagaacuacgucgccucgugucugagaaaaaagccacacaaaaagcuuucuggcaaaacaaaagaagaacaaauagcagagaagaaaaaagaacuugaagacagacuuuuggacgucaaucacaaaauaggaccuaguaaaaaagccccuaagaaagaugccaaggcugauccgacaggcgcaggugcuggcagaaugucuuccuccaguuccaguucggacagcgacagcucgucaucgucacuaucuaguaguuccagcgauucaagcgacagcgaagcagguccuggugcgacaacaagacagacuaagaagaaaccuggauugaaaaaaucgccuaaucuuucgguucacccuagcaguauugcaucgacgacuuugucuaucaccacaacucuacaaaaaucgucguccacgaccgcgacgccuaccgucgcgcccauaaccaucucggccacgcccucagucaauuccgccccucccgcaccucaacaaccaccaccgguaacgnaccaucucggccacgcccucagucaauuccgccccucccgcaccucaacaaccaccaccgguaacguuaccugucaacgguccggugcuggcugcuaa

SEQ ID NO: 5500 - RNA, 1290 nt, Sitophilus oryzae
  misc_feature (1138)..(1138): n is a, c, g, or u
auggcguugucuacggcacguccccuuauaaguguuuacgaugagaaaucugaagaaguuaagggagcuagcauugcucucccugcugucuuuaaggcuccaauuagaccagauguuguaaacuuuguccaucagcaaauuucaaugaaccaucgccagccuuauugugucagugauaaagcuggucaccaaacuucugccgaaucgugggguacugguagggccguugcacguauuccucguguucgcgguggugguacccaucguuccggccagggugcuuucggcaacaugugucgcggaggacgcauguucgcucccaccaaaccauggaggcguuggcacagacguguaaauaucaaccaacgucguuuugcccuagcagcagccauugcugccaguggcgucccagcuuugguaaugagcaaaggacacgucguugaccaaguuccagaacucccauugguugucucugacaagguacaggaauucaagaaaaccaaggaagcagugcauuucuugagaagguugaaagcauggccugauauacaaaagguauacaaaagucagagauuccgugcugguaaggguaaaaugcguaacaggaggagaauucaacguagagggccauugguuguuuaccaucaagaucaagguuugcguagggcuuuccguaacauccccggcaucgaccuaaucagcguagaaaaacugaaccuguugaaguuggcuccaggcggucacguuggccguuucgucauuuggaccgaaucggccuucaaaaaauuggauaaagucuucgaaaacuggaaggcaccaucgacgaagauguccaauaccgauuugucaagauuauucaagucggaagaaaucagagcaguacuucgugcaccacaaaagaagauuguucgacguguacgucgucucaauccauugaauaauaccagagcucuauuggcucugaacccauacgcugccguucuuaagagacaagcugucuuggacgacaagaagagaaguuuggccagggaagaauuauuggccaagaaacgcgguaucacuuuacccagcaguagcccgguaaucaggucggcaaaauugcaagcccgcaggagggcagccauuuugaaagcgaaanaaauugcaagcccgcaggagggcagccauuuugaaagcgaaaaaagcgaaaccgacgaaaccugcaaagcccgcggcgaaaaaagcacccgcucccgccaagaaguaacugagguugcuauaguuguuaacuguggugacaagauaaaauaa

SEQ ID NO: 5501 - RNA, 5340 nt, Sitophilus oryzae
auggcugauuuuauugaauccgaagcggaggaaagcagcgaggaggaagaguuagagccccaugaaagaaagaaacuaaaaaaaguuaaggcaauggaugauagcucugaagaggaagacgaugaugaugauaaacuacgugaagaacuucaugacuuaauugaugauaauccuauugaggaaagugauggugaagauucagaugcaucugguggagaaaaaaggaaaaaaucagacgaugaagacuuagaugaccgacuugaagaugaugacuaugaucuacuugaagaaaauuuaggcaugaaaguagaaagaaggaaauuuaagagauuaagaagaauucaagaugaagaaagugaaggugaagaugaaaaugaugcugaccaagaaagggaacauauugcuauggacuuauuuucugaagaugacgaugaaaggcgcuccgaacguagucaucgaccagcggccgaacaagaacaauuuggugaagaggaagaagaaggugaauacucagauacugaugauuuuauaguagacgacgauggaaaaccuauaguaagaacgaagaagaagaaaauauuuucagaugcggcuuuacaagaggcgcaagaaacuuuugguguugauuuugauuaugaugaguuuucuaaauaugaugacgaauaugaugaagaagaggaugaugaagaagaugaauaugaagaagaugaagaaggagaaagaaggcauagacagaaaaaagcugguaaaaaacguccaacuaaaaaaucgauauuugaaguuuaugaaccaucagaacuuaaaaggggauuuuucacggauuuggacaaugaaauacguaauacagauauuccugagagaaugcaacuaagagauguuccuuuaauggcuguuccugaugauucaacugaacuugaugaagaggcugaauggauuuauaagcaagcauuuuguaagucaacuauuucaaacacagaugcgcauuugagucaggaagcuagagaaaaacaacggaaaggaccccaaacuauuggcaaaauuaggaaagcuuuggacuuuaugcguaaucagcaacuugaaguaccauuuauagcauuuuauagaaaggaguauguucaaccugaacuuaauaucaaugauuuguggcgaguguacaaauacgaugcaaaauggugucaauuaaaaacuaggaaagaaaaccuuuuggcucucuuugaaaaaaugagguccuaucaaauagaacaauuaaugaaaaauccagacgcugcuauuccagauaauguuagaguuaugaaagauucagauauugaaagauugaagaauguucaaacaacugaggaacuuaaugauguucauaaucauuuuaucuuauauuaugcucaagaucuugcugcuaugcaugcagcuuggagaauaaaagaaaaagaaaggaaaaaacaggaaaaacgugaagcacgacugaaagcuuuagccgaagcggaagacggagcugaaaucccugacgaaauuccugaagacgaagaugaugaugaacccgaaccugaaacuauaaaauaugcuaaucguucaggcucuuaugcauuauguagcaaagcuggcuuagauacacuagcaaagaaauuugguuuaacuccucagcauuucgcugaaaauuuacgugauaacuaucaacgacacgauguugaucaggaaccuacagaaccagcagagguugcaaaagaauuuuugucagccaaauuucaaacuguggaggaaguacuucaggcaacaacauauauggucgcuuuacaaauugcuagagaaccauugguucgaaagugcguaagggaggcguuuuaugaacgagcuaaauuaaguguggcgccuacaagaaaaggacaaaaaguuauugaugaagcucauucuuguuauagcaugaaauauuugaagaauaagccaguaagagaucuaacuagugaucaauuccugaaacucacauuagcagaagaagagcaacuuauaaaaauuaaaauuagugacacaauugaaggacauacaacaaauucauaugucgaugaaguaaaacaacucuauauuagggacgaauucaguaagaauguucaagaauggaacaaacuucgagcggaguguguugagcgugcuuugaccagaugcauauuuccagacuugcaaucagaaauuaaaagaauucuacuagcagaggcaaaggaauuuguucuaagagcuuguugccgaaaguuauauaacuggaucaagauugccccauaucaaguugaauuuccugaggaggaugaagaugaaugggauacagcuaaagguauuagaguuaugggccuggcuuaugucccagacuauucucagucagcuuuuacuuguaucgccgcuccagauggugauauaacggacuaucuucguuuaccgcacauuuuaaaaaggaagaacaguuaucgccaagaagaaaaauugaugaaagaggccgauuugacggcucuacgaaacuuuaucuacacgaagaagccucacgucauugcaauagguggagaauccagggaagcccugaugauagcggacgacuugagaggaauuauaaaugauuuagucgaagcagaacaguuuccaacccugaaaguagagauuguggauaaugagcuggcuaaagucuacgcgaauucaaacaaaggcacggcugauuuuagagauuauccugaacuuuugagacaagcuauuuccauugcuagaaaaaugcaagacccuuuaauugaauacucccaauuaugcaauggagaugaagaaauucuuagcuuacguuuucauccuuuacaggaacaaauuggcaaagaagaacuucuggaagcgcuuugucuugaguuugucaacagaacaaaugaaguuggcguagauguaaauuuggcuguacagcaagcucacaaaagccacuuaauccaauuucuaugugguuuggggccgagaaaaggacaagcccucuugaaagugcuuaagcaaacaaaccaaagauuagagaacaggacccaacuuguuacagcuugccauauggguccuaaaguuuucauuaacugcucaggguucauuaagauugauaccaacaguuugggagauaguacagaagcguacguagaaauucuagauggaucucgugugcauccagaaacguacgaaugggcccguaagauggccguugacgcuuuggaauaugacgaugacgaaggagccaacccagcuggugcuuuagaagagauccuggagacgccugaaagauugaaagaucuugaccucgacgcauuugcugaagaacuggaacgucaaggauuuggaaacaagagcauuacucuauacgacauaagagcggaauuaaacucuagauauaaagauuuaagaacaccuuacagauccgcgaauccagaagaguuauuugauauguuaacuaaagaaacaccagaaacauuuuacaucgggaaauuaguacaagcuucgguaauaggaaucgcuaggagaaaaccacaaggcgagcaacuggauucagccaauccaguccguaacgaugaaacuggacuguggcaauguccauucuguuuaaagaaugauuuuccagaauuaucggauguauggaaccacuuugaugcugguucuugcccagggcaagcuacugggguuaaauugagauuagacaaugguauuucuggcuauauuuauauuaaaaauuuaagcgacaaaaccguuuccaauccagaagaacgcguuggaauuggacaacuuauacacuguagaauaaugaaaauagacguagaacgauucuccguggauuguacaucaaaaucaagugauuuguuagauaaaaaucacgaauggagaccuccuagggauccauauuaugaccaagaacaggaagacaaagauaacagaacugaggcagagaagaagaaagacaaacaaaaacaaacuuauauuaagagaguaauuguucauccagcuuuucacaauauauccuaugccgaagcggaaaaauguauggucaauauggaucaaggcgaagugauaguaagaccgucaaguaaagguguugaucauuugacaaucacuuggaaaguggccgauaacauuuaccaacacauugauguaaaagaagaggguaaagcuaacgcauuuucauuagguaaaucuuuguggauagcaaaugaggaguuugaagaccuggaugaaauuaucgcuagauauguuaacccaauggcauccuaugcucgagauuugcuuuauuuuagguauuauaaagauacagaaggagguuuaaaagauaaggcggaagaguuucugaaagaagagaaaaagaaaaauccugccaagauacauuaugucauaagcgcagcaaaaaguuuuccagggaaauucauguuaucuuauuuaccuagaaacaaagugagacacgaauauguuagcguuacuccggaaggauuuagauuuagacaacaaauguuugacucuguuacgucauuauuuaaaugguuuaaagaacauuuuagagauccaauaccuggcgguacacccaguacuccucgauugggaucugguagaacuccauaucaaggaacugcuacaacgccguuuaauggaaugaauccugaggcuauacagaggguugcacaaaaccuaccaacccacauguuacaaaguuugucggcaguugccaaucaaacuccucauuacccacauacgccuggaggugcuuauggagcgaacuauauuaacacgccauacacaccuaguggacagacaccuuuuaugacuccauauacccaacaaacgccaagguauggucaagcaacaccaucuccuguaccugcaggaauggcgucuggaccauuuuugcacccgggagcugucacuccuucucacagaacucccaauaguuaucggaaucuaccaagucagucucccaugauaacugcaaguccuguaccaaguccggcgucacaaaguucauauucuagccagagucgaagaagcgcaccaaggagcggcccaauaccgggauacggaacuggagcguaugccaauucagaacaaauggacuggcaaaaagcagcagaagcuugggcugcuagaaguagaacuacuccaaggagugauagugguaggaucacuccuagagguucuacuggucuaaggaccccaaaauucgacgauauucgagccgacuuagaacgaaccaaaaugaagaacguagggaaaagcccuaagucccuacguucuacacccaggacaaauauguccccccauagcaugucucugggagaugcuacuccucuuuacgaugagaacauuuga

SEQ ID NO: 5502 - RNA, 2487 nt, Sitophilus oryzae
  misc_feature (2198)..(2198): n is a, c, g, or u
guuaccaaagaaagaaguaagaaacgugaaaaucggucugaaaaggguaaaaaacguaguagcaggucucguucaucaucucgagagagacguagaaaggacaggaagagacgaaaagcagauaauucggacgaagcuguaauuuugcccagauauuauggagaugaccgaagaaaggaaaacaacgauagguacuggacaaaguauccaaaaaaagacgaaaacgugguuggaaaaagguauuaugacaccaaaagcauugacgaggauaaagucaaagaaaaagagccccaaaaagaugcuucugaggacaaauccauuaucaaaccucgggaaaagaaaaccguugaccuccuuacaucuaagaccgguggagcuuacauaccccccgcgaaacuacgcaugaugcaagcugaaauaacggauaaaucuucagcagccuuucagagaauagccugggaagcauuaaagaaauccauacacgguuacaucaacaaagugaauaccuccaauaucgguauuauagccagagaauuacuacacgaaaacauuauucgugguagagggcugcuuuguaaaucuauaauucaagcccaagcugccucaccuacuuuuaccaacgucuaugcugcuuuagucgccguuaucaacucaaaguuuccaaauaucggagaauuguuauugaagagauugguccuacaguuuaaacgaggguuuaaacagaacaauaagacuauauguauuucagcagcuaccuuuguagcacauuuaguuaaccagucuguugcgcaugaaauucuggcucuggaaauucuaacuuuguuaauagaaacaccgacagaugauucugucgagguggcuauagcuuucuugaaggaguguggacaaaaacuaacagaagugucuagcagagguaucaaugcaauuuuugaaauguuaagaaacauucuucaugagggacagcuugaaaaaagaauacaauauaugauugaaguaauguuucaaaucagaaaagauggauuuaaagaccaugcugccguaauugaagaacuagaugugguggaagaagaugaucaguuuacgcaucugauaaagcuugaugacgucaaacaagccgauucagacgaaauuuuaaaugucuuuaaguuugacgaugacuaccaauuaaaugagggaaaauauaagauucugaguaaagaaaucuuacaaacugauagugaaucugguuccggaucagaagagggaggaucggaugaugaagaggaugauagugaugacgaagaagaggaaggcgaagaagccaaagucaaagacacuauuauugauaauacggaaacgaauuugauugugcugaggagaacgauauacuugacuauacagucuaguuuggacuuugaggagugugcucacaaguugcucaagauggaguugaagccuggccaagagauugaacugugucauauguucuuggauugcugugcugaacaaagaaccuacgaaaaauucuacggacuucucgcucagcgauucugucaaaucaacaaaacuuacguggaaccguuucaacaaauauucaaagauacuuaugcaaccacccacagauuggacgcgaauagguugagaaacgugagcaaauucuuugcucauuuauuauucaccgaugccaucgguugggaggucuuagaaauaaugaagaugaacgaggaagacacuaauaguuccaguaggauuuuuaucaaaauucucuuucaagaauuggcagaguauaugggacugggaaaacugaacgccagacuaaaggacccgacucuccaaggccauuuugcuggacucuuucccagagauaacccgaaaaauacucgguuuucuaucaauuuuuucacguccauuggucuggguggucucacugaugaacuuagggaacacuugaagaacaucccgaaaaaucugccuguuguaacaaaagaagagagugaagaaagcagcaguagcaguucguccaguucagaaucuucugaucaagauaguagcucagaaaguucaagcgauucggaagaagauagaagaagaagaaagaaaaaagauaaaaaacaaagcaauaaaaaagaaucuaaaaaaaguacgaaaaacgacaguaagucuaaagaugaaaaaaggaaagauaauaaaaacagaaaagaaagaaacaaagaagagunuaauaaaaacagaaaagaaagaaacaaagaagagucggaagacagugauaguaacaagaaacaugaaagaaaugccagaaaaaaagauuaccaauggaugaagagucgcuaugaagacaauaucucacaauugaagaacaagagaagagauuuugagaggcccagaucuagagauaggaauagaguaaagguggaaaaggagagaagaucgaggucgcgugagagguaccacagagcggauaauaacgaucacagagagagaacgaaaagagacaggagaagaaguuag

SEQ ID NO: 5503 - RNA, 1791 nt, Sitophilus oryzae
auggcuuugaagaaccagguuggacaaaaaauuaugaaugaaguaaucaaguacagaccuccgaaaaaaaauggaccgggugcuaaaauggaauggagaguauugguaguugacaaacuggccaugagaaugauuucagcuugcuguaaaaugcacgauauaucugcagaagggauuacuuugguugaagacauauucaaaaccagagaaccccuuucuucuauggaggcugucuaucucauaacuccuucaaaagagucuguagaagcccugaugcgagauuucgacgggaucaagcauauaauguauaaaggugcccacguuuucuuuacagaagcaugcccaccaccuuuguucgaugauuugugucaacauaaaguagcuaaauauauaaaaacucugaaagaaaucgauauggcuuuuauaccaaaugaagcacaggucuuuucuuuggacugcaccgaaacauuucaaugcuacuacaacccggcguauucucaaaaguauacagcgaauuuggaaaggauggcugaacaaauagcuacccuuugugcuacuuuaggagaauauccuucaguacgcuacagaagugauugggacaaaaacguggaguuggcacaacuaauccagcaaaaacuggaugcuuacaaagcugaugaacccacuaugggagaaggaccagaaaaagccagaucucaacuacuuauucuggauagggguuuugacugugucucuccccuguuacaugaacucacauuucaagcuauggcauaugauuuguugaacauccaaaacgacgucuaugaguaugaagcaucugcagguguuaaaaaagagguacugcuagacgaaaacgacgacauguggguggaacuucgccaucagcacaucgcugucguuucacagagcgucacgaaaaaucucaaaaaauucaccgauuccaagaggaugaccgccagcgauaagcaguccaugaaagaccuuucuacgaugauuaaaaaaaugccacaguaccaaaaggaacuguccaaauacgcgacucaucuucagcuugccgaagacugcaugaagcaauaucagggauauguugacaagcucuguaaaguugaacaggauuuagcuaugggaacugaugcagaaggugagaaaaucaaagaccacaugaggaauauuguuccgauuuuguuggaccccaaaaucaccgaucaguaugauaaaaugaggauuauugcuuuguaugccaugacgaagaacgggauuacugaggaaaaucuucaaaaacuugccacucacgcccagaucagucagaaacagaccauugccaauuugcaguaccuuggcgucaaugugaucaaugagggugguauaaggaaaaaacccuauacuguaccuagaaaggaaaggaucaccgagcaaacuuaccaaaugucccguuggacucccgugguaaaggacaucauggaagacugcauagaggacaaacuggaucagaaacacuuuccauuuuuggccggacgagcccaaagcaccggcuaccauccuccaucgagcgcccgcuacggucauuggcacaaagaccgcagccagcaaacggugaagaacgugccucgccucaucguguucgucgucggaggcaucugcuucuccgaggugcgcugcgccuacgaggugaccaacgcccucaagaacugggaggucauaaucggcuccucccacauccucacucccaagaccuuccuggagcagcucacggagcucacucccaacuuuuuguuucacccgaauuucuga

SEQ ID NO: 5504 - RNA, 1905 nt, Sitophilus oryzae
auguuuuuucaagaaaucuauaacuuauuagaacaaaacaagcaaucaauggacaauuuucaagaacuagacaguaaaauuaauauuguugccaccaaagugcuccauuuaggugaucaauuggauaguguaaauggcccuagagcucgggugguagaugcacaaaaauuacucucucaucucagugaauuccuuucaaacggaccuuuaacuagcucuauauuuaaugacccauacaggauugaugaagcagcugauguaauucaaaaguuauuuuugauaucucaagaucuaccaucuccaaaauuugagagugucaaacguaaaauagaaagaacauauuccgauauugagaaagcauuaauugaagaauuugucagggcuaugacuaaagaagauuuaacuagaaugaggacuauagcaaauguauugucgcaauuuaaaggguacagucagugugucgaugcguauauugaucaaagccaaacagguugucugcuugguaaagauguauuugccaacuuaguacuccuuuguaaacauaauuaugacauuauaagggagguuuuuaauaauucugagcaaguuauggcuaaguuugucuuaaauuuguaucagcucaagcugucugacuauauugacucaaaguuaagcgcgaaaaugggaagucacggauacuuacagaugcucuaugaguuauacucaaagacaaaucaauuuucuaacgagcucagugucuauaacuuggggaaugacaagaacuauuuaacaaaauuaacaucuaacauauuuacaaagcauauuagugaauauauccaaauugaacuuaaaucauuaaaagacagaugugcuacaaaccuucagagguauuacgauacaaaaaaucaccagaaaaagcagauucaaaguggaggauuucaagacuuaagaagagacuuacaagcgguuauagguacaagagcaaauauaaacauagcccaaauagagaauuaugguggggaaacguuucuaucugaagaacuagcgauuaugauacuucaagacaccaaaaaugcuuuuucuaggugccaauuauuaucaaaaccugaagaaagagcuggcaaugcuucaaaaauucuuaacaccuugguaaauagccuucugauagagcaugucgacuaugcuguugaauuagggcuccacgcuauuccugugguugagggggcuaaaaauuccccuguucuuuauuucuuuacuguaguucaucaaaguaacaacauuacacaucuugcagaaagacaauuuauggauuugguagucccauuaguucauaauaccccuuaccacaaugauugcauccaaaaaaagaaguuuguucuugaagauaucgagcgcaagauaaauuugggacuugacagguguuugaacgcuguuacuacguggguuaaauuauauuugcaaucggaacagaaaaaaagcgauuucaaaccugaaacugaugauuucgacacaguagcuucgccagcuuguaaacacgugucucaauacauaaccagcaucaagaaagaaauucaaacaagucucgauggaaauaauguaacggcaguuuuagaagaauuugguauucguuuacacagaacuaucuacgaucauauguugcaguuucaauauaacacagcaggugccaugauugcgauaugcgauuugaaugaauacagauccuguacuaaaucacuggguccccuuguaacugaauuauuugaaacuuuacacgcauuauguaaucuacuuuugguaaaaacagaaaauuugaaccaaguuugcucagaagacuccuuggugaacuuggacaagucuauucuacauaacuuuauucaacucaggagcgacuauaaggcucaaaaaccacccuuuuuuaaaguuuaa

SEQ ID NO: 5505 - RNA, 873 nt, Sitophilus oryzae
  misc_feature (762)..(762): n is a, c, g, or u
auggauuuucaaaauagaccugguggaaagacuggcggaggaggugucgcaucauggucggaauccaaucgagacagacgcgaaagauugaggcaauuggcuuuagaaacaauagauuuacaaaaagauccuuauuuuaugaaaaaccauuuaggcucuuaugaauguaaacuauguuuaacuuuacauaauaaugaaggaaguuauuuagcccacacucaggguaaaaagcaucaggccaauuuggcaaggagggcagcgaaggaagcuaaggaugcucccucauuacuucagccagagaagccuagaguagaaccuaagaaauuuguaaaaauuggucguccagguuacagggugacuaaacaaagagauccagaaacaggacaacaaaguuuacuauuucaaauugauuauccagagauuagugaccauguuuuaccaaggcauagguuuaugucugcguacgagcagaaaauugaaccaccagaucguaaauggcaguaucugcuuuuugcugcagaacccuaugaaacuauugcauuuaaggugccuagcagagaaguggagaaaacugauaauaaauucuggacucauuggaacagggauacaaaacaguucuuuuugcaguuugcuuucaaaacugaaaauaagaagcagccaacuauuauuaauagacaaacaaugaucacuggaguaccaccgccuccaaugcuaccaguaccaccaccaccaagaccuccuauguucaaucccaugccaccngcuaccaguaccaccaccaccaagaccuccuauguucaaucccaugccaccaccaccuccuaugaugagagcagugaugccuguuccuccaccgcauuaaacuuuaaauaa

SEQ ID NO: 5506 - RNA, 408 nt, Sitophilus oryzae
augucuauuggaguuccaaucaaagugcuccaugaagccgaaggacauauuguuacuugcgaaacuauuaccggugaaguuuauagagggaaacuaaucgaagcggaagauaacaugaauugccaaaugacucaaauaacuguaacuuacagagaugguagaguugcacaacuagaaaacguuuauauuagaggaucgaaaauuagauuuaugauacuuccggauauguuaaagaaugcaccuauguuuaaaaaacaaacaaaaucagguacugcgggacgaggaaagucgggcauucuucgagcccaagccagaggaagggguagagguggaccuccuacuagaggagguagaggaggagcaccuuggccaaaucagcaaguugguccaggaggaagaggacgauaa

SEQ ID NO: 5507 - RNA, 1320 nt, Sitophilus oryzae
auggcuucuucgaucaccaaaggaccuuuacuccguauaguaacggccagaggauauucucaaguggcuccaguuaaugguaucgccaauuacgauuugaaaaccacuacucucacuaacaaacugguaguuguagcagcagaaaaugaauccgcuuugaccagaauuuccgucacguucagagcuggaucgcguuacgaaaccagcgauaaucucggugcuguacacguuauccguaccgccgcuggauuauccacaaaaaacgcaucccaguuugcuauuauccguaacauacagcaaguuggggcuagccuaacugcuacagcagaccgugaaacuaucucuuauacuuuggaaggcaccagaaaagcuguagagcaaguuuuaccuuucuugaaagaaguggcuacugagcaaguauucaaacccugggaacuauccgaacuuggagaucgguuaaagauugacuuggcaguucgaccauugcaguuacgugcacuugacuuacuucacaaagcugccuacagaacaggguugggcaauucccaguuuguucccaaauuucaaauagguaaacuuuccugcgaaacauugcaacacuacguugccaauaccuucacuucaagcagagcggcuguaguugguuuuggaauagauaauuccagucugacgcaguucgcucagucuuugaacuuggagcccaaugaaggugucuccaaucccaguccuuacaagggcggagaaauuaggucggacaaagggggcgauuucgcuuuuguggcgaucgcuggcgagggggcagcggugaacaaccccaaagaagcccuagcggccgccguccuacagaacguccucagugccggaccccaguugaaauggagcaccaacgacaacggagucauucccagggcccuagguggcaccgacggcuauucaguuaggggcaucaaugcaagcuacaaagacacgggauuggucggaauuuugcuggccgugcccgccaagucggccaagaaaauuguaccgggagcagugaaugcuuucaaaagugccagcgucaccgaugcggacguuaacagagguaaaaacuugcugaaaaccaguuugcugucggaacuggaaagcggaucgacagcggcucaaguauacggcgcgcaagccgcucuaaccggcaccgcuuuguccgcagaggaagucgccucuguagucgauucaguaucggccagugaugugaacagcguuuuacaaaaggcccgaaaaaacaucucaaucgcaucggugggcaacuuggccgauguuccuuaugcggaugaccuauaa

SEQ ID NO: 5508 - RNA, 333 nt, Sitophilus oryzae
augagacgagcacacacaggaaauuacuaugaacccuuaccacaagaaaacaaugaaauggaacaagaaaaugaacguauggcacaggaccucucagacaaaaucggggugcuuaagucuuuaucaauagauauaggaaacgaaguaaaguaucaagacaggcuacucagagauguugaugaugauauggaacguacaggagguuuucuuggucgaacuaugcaacgaguuguuaaacugucuagagguucacaaaauuauauuguuuuauauuuauuucuuuuuucaauugccguguucuuuauauuauaucuaguacucaaguucagguaa

SEQ ID NO: 5509 - RNA, 1491 nt, Sitophilus oryzae
augucuuaccccucgaguuuaucggccaaacaggccaccagggaacacguccucgcaguguccagagauuucguaucgcagcccagauugaccuacaagacgguguccggugugaauggacccuuggucauccucgaagaugugaaauuucccaaauucaacgaaaucgucgaacugaaauuggccgauggaagucuuagguccggucaaguucuggaagucagcgguuccaaggcugucguucaaguauucgaaggcacaucaggcauugacgcuaaaaacacacuaugugaguucaccggagauauuuugagaacuccuguaucagaagacauguugggaagaguuuuuaacggcucaggaaagccuaucgacaaaggaccuccaauuuuggcugaggacuucuuggacauucagggacaacccauuaacccuuggucgcguauuuacccagaagaaaugauccaaaccgguaucucugcuauugaugucaugaauucuauugcccguggucagaaaauccccauuuucuccgcugcugguuuaccucacaaugaaauugcugcccagaucuguagacaggcuggucuaguaaaaguaccgggaaaaucaguacuagacgaccaugaagacaacuuugcuauuguguuugcugcuaugggugucaacauggaaaccgccagauucuucaagcaagauuucgaagagaaugguucuauggagaauguaugcuuguucuugaacuuggccaacgauccaacuauugaaagaauuauuacaccgcguuuggcuuugacagcugcugaauuuuuggccuaucaaugcgagaagcacguacugguuauauuaacugacaugucuuccuaugcugaagcuuugcgugaaguauccgccgccagagaggagguacccggacgucgugguuuccccgguuacauguacaccgauuuggccaccaucuacgagcgugcuggccgugucgagggcaggaacgguuccaucacccagauucccaucuugacuaugccuaacgacgauauuacccauccuauucccgauuugaccggguauauuaccgaaggucaaaucuacgucgaccgucagcugcacaacagacaaaucuacccaccugucaacgugcugccaucucugucccgucugaugaaguccgcuaucggggagggcaugaccaggaaagaccauucugacguuucuaaccaguuguacgcuugcuacgccauugguaaggacgugcaagccaugaaggccguagugggugaggaggcuuugacucccgacgaucuucucuaccuagaguuccugacgaaguucgagaagaacuucaucucgcagggcaacuacgaaaacaggacgguguucgagucgcuggauaucggcuggcaauugcugcguaucuuccccaaagaaauguugaaacguauaccagcggcaacacuggcggaguucuaucccagggacucgcgccacuaa

SEQ ID NO: 5510 - RNA, 327 nt, Sitophilus oryzae
auggaauaugacaaagaagaacccgaugacacagaagaaacugaagcaaaaucaauaccagcaauauucaaggaccagguucuagaguuuauuaugaauauucuacuggaucaucccgaagacauuauggaauacggccaaagcuauuuuaaaaaaguagaagaaaacaggcguaccaccauaguuuaugauuuagucaaaguuagcaaugaaaauuuaacuggagguggucaaagagauacagacaauguagauaauacgacucguaaugcagagaaugauucagaaaagauaguuagaagcauuagugcgaauuucaguuuuuga

SEQ ID NO: 5511 - RNA, 2322 nt, Sitophilus oryzae
augaguuaccaaagccgaucaaugucguaucaaaacgccuccgacaugcccaaguccaacuccaaagacccggcugucauguccuggcagcagaacaacuacaugggcgauucugguauccauucaggcgcccaaacccagguaccuucccugagcggaaaggaggaccuuuccgaggaucucuuugaccuggaccaaggagguuacccggguuuuacccaggaucaggucgacgagaugaacaaccagcugacgcagaccaggucgcacagggugagggcugccauguuuccagaaacucuugaagaagguaucgaaauaccaucaacucaauuugacccucagacccaaacagcaguccaacgauuggcggaacccagccaaaugcugagacaugccguggucaaucuaauuaacuaccaagacgaugccgaacuagccaccagagcuauccccgaguugaucaaacuccuaaacgacgaagaccaaguggugguaucccaagcggccaugaugguccaccaauuguccaaaaaggaggcuuccaggcaugcuauaaugaacaguccucaaaugguagcagcuuugguucgagcuauauccaauucaaaugacuuggagaccacgaagggugcaguugguaccuugcauaaguugucccaucaccggcaaggguugcuggcuauauucaaaagcggugguauaccagcuuuggugaagcuacuaaguucacccguagaaaguguguuauucuaugcaauaaccacauugcauaaccucuuguugcaccaggaagguuccaagauggccgugcgucuggcuggaggguuacagaagaugguggccuuguuacagaggaacaacaccaaguuuuuggcuauugucaccgacuguuugcagauuuuggcguuuggcaaucaggaaagcaagcugauuauucuggcuucgcaaggacccauugagcuggucaggauaaugaggucuuacaauuacgagaagcuguuguggaccacuucaagaguuuugaagguuuugucaguuugcucuagcaacaaaccagcuauaguugaagcgggcgguaugcaagcccuagccaugcacuugggcaguggaagucagagauugguccaaaacugccuguggacuuuaaggaauuugucugacgcugcuacaaaagucaacggacuggacacucuccugucauccuugguacaagucuugucaucgccagauggcaauguagucacuugugcugcaggaauuuuaucgaaucugacuuguaacaaucaguuuaacaaagagacuguuugucaguaugauggcauuuccgcguuggugaggaccaucgugaacgcuggagaucacgaagaaaucacagaacccgccauaugcgcucucagacauuugacaucgagacacgauaaaucagaacucgcacaaaaucaagucagaguuguuggugguauucccguaaucguaagauugcugaacccuccgucucgcuggccuuuggucaaggcagucauuggacugaucagaaaccuagcuuuauguccugacaauuucuugccucuucgugaaucgugcgccaucaauuauuuggugcaguugcugaugagggcuuaccaagauacucaaagacgagccagcuuggccagcggaggcagccaacccccagguacauacgccgacgguguccgaauggaggagaucauagagggcaccguuggcgccuugcacauccuagcccgcgaguggaacaaccgcgaacagauccggcaacagcgcgucauccccaucuucgugcagcugcucuucaacgacaucgagaacauccagcgcguggcggcgggcguguugugcgaacuggccgccgacaaggaaggagcggauaugaucgagcaagagggcgccacugcuccuuugacggaauuguugcauucgaggaacgaaggcguggcuacuuacgcggcugcaguuuuguuccguauguccgaggauaagccucaggaauacaagaaacgucuguccauggaacuguccagcucucuguuccgcgaagagaaccucuggaacccugaucuggguauggguaccgauuuccaggauauguuaaguccugaacaggcuuacgauaauauguacgcccaggacccgccuagcguucacaguagucauggcggaaggccauaucaacagcaacaagcccuguuuagcgaacuacaaauaaauauggacauggacauggauaccauggaagcgcucccagcgccgcccgagucuaacgaccaagucgcggcuugguacgacaccgaucuuuaa

SEQ ID NO: 5512 - RNA, 807 nt, Sitophilus oryzae
auggcucgaaaugcggagaaggcuaugacuacacuggcccguuggagagcugcccaacugggagagaaugaaaaaguuaaaaagcgacggcccuaucucgcaucggaaugcaaaagccucuaugccugcgagaaauggagacugcagauuaucagagagauugcgaaaaagguggcccagauucagaacgccggccugggcgaguuccgaauucgugacuugaacgacgaaaucaacaaacuguuaagagaaaagcgacauugggaggaccaaauuaaggaauugggcggaccagacuaucaaaagguaggaccucgaauguuggaccacgaagguaaagagguuccaggcaacaggggcuacaaauacuuuggagcagcaaaggaacuaccagguguaagagaauuguucgaacaagaaccuccaccaccucccagaaaaacacgggcagaacugaugaaagauaucgaugcagauuacuaugguuauauggaugacgaugauggcauuuuaauaccuuuagaaaucaaagcugaaaagauagcucugcaaaagguggacgccgaauggaaaucuaaaaaagaacaagcaauggaaacagauaccccagaagaggaauacgaagaagagaauaucuauaaaguccaugauucugacgaagagcaagaaaaagaaauuguugaugguucccaacaaagauucguugcacaugucccagugccaucacaacaagacaucgaacaagcccuuuuaaggagaaggaaacaagaauugauggaaaaguacggaauacccucggaacaauaa

SEQ ID NO: 5513 - RNA, 648 nt, Sitophilus oryzae
auggcagcagaacaagaaaugcccacauuuaaauguguuuugguaggagacggugguacagggaagacuacguuugugaaaaggcacuugacuggugaauucgagaaaaaauauguagcaacuuugggagucgaaguccauccauugguuuuccauacgaacagggggccuauuagauuuaauguaugggauacagcgggucaagagaaauucggaggucuccgugacggauacuacauccagggacagugugcuauuguuauguucgauguuacaucucguguaaccuacaagaauguaccgaauuggcauagagauuuaguuagaguuugugaaaacauuccuaucguauuguguggaaacaaaguagauauuaaggauagaaaagucaaagccaagagcauuguauuucacagaaagaagaauuuacaguauuaugauauuucugccaaaucaaacuauaacuucgaaaaaccuuuccuaugguuggcaagaaaacugauuggugauccuaaucuugaauucguggccaugccugcuuuggugcccccagaaauccagauggauccccauuggcagcaacaaaucgagaaggaucuuaaagaugcucaggacacugccuugccugaagacgaugaagaucuauaa

SEQ ID NO: 5514 - RNA, 645 nt, Sitophilus oryzae
  misc_feature (389)..(389): n is a, c, g, or u
augguuuugaccacgauugcaucuauaauugugaagauaguuaaacugguauuaaauuuaauaauaauuauaauauaccgggugggauuccaaggcgauuuucugggaguugguggaacauggaacuuguacgaagacaaaaacucagauguggaaaucauugcuucggguguauucgugggauacauggucuacaacaucgucucucuuauaagcauguguuuugcagacagcgaaaacaaaagcaccuuuacggauauucucaugaacaucguugguauauuuuuauggguggcugugggagcaacagcccuucacuacuggcaugguuaccuggcugaacacaaauauacauacgucaauuccgagagacagguuggguuggcaunaauauacauacgucaauuccgagagacagguuggguuggcauuaggaucucuauguguccucaacggugcagcuuaucucguggauucagucuuaucaguuauuuucauuauaaaggccaaaaugcaauaguaaacgaauacaaaguguuauacgaacaaguucuaguguuaaguagaucaucauccuucaaauauuuauguuuuuuuagaaucauaucaaaacgaacuuugugguacaaauuuuuauauuauuaa

SEQ ID NO: 5515 - RNA, 2544 nt, Sitophilus oryzae
augccgcgaauuaugauaaaaggcggaguguggcggaacacagaagaugaaauccuuaaggcugcuguuaugaaauauggcaaaaaucaguggucccguauugcgucguuguuacauagaaaaucagcgaaacaauguaaggcacguugguuugaaugguuagauccaaguauaaagaaaacagaauggucaagggaagaagaugaaaagcuauuacauuuagcaaagcuaaugccuacgcaguggcgaacaauagccccaauuauuggccguacugcugcucaguguuuagaaagauaugaauauuuguuggaucaagcacaaaagaaagaagauggugaagauacugcugaugacccaaggaaacuuaagccuggcgaaauugaucccaauccggaaacuaaaccugccagaccugauccaaaagauauggaugaagaugaacuugaaauguuaucagaagcucgugcucgauuggcaaauacucaaggaaagaaagcaaaacguaaagcuagagaaaaacaacuugaagaggccagacgucuggcagcuuugcagaaaagaagagaacuucgagcagcaggaauugaagucaauccucgucggcgaaaaaagcgugguguugauuauaaugcggaaauaccuuuugaaaaacgaccugcuauuggauuuuaugauacaucaaaugaggcucuugauccuauggcaccagacuuuucuaaaaugacccagcaggccuuggauggcgaaauaagaagugaacaagaagaaaaagagaggaagaaagauaaacagaaauugaaacaaaggaaagagaaugacauaccacaggcaauguuacagaaccaagaaccugcuaagaaaagaucaaaacugguuuugcccgaaccacagauuuccgaccaagaacuucaucaaguuguuaaacugggaaaagcgagcgaaguggcgcgcgaaguagcuuccgagaguggaauugacaguaccgacacguugcugaaugauuauacuuuaaccccucaagcagcugcaacgccuagaacuccugcuccugucacugauagaauucuucaagaagcucaaaaugucauggcccuuacccaugucgauaccccacucaaaggaggcuuaaauacuccucuacauaauucagauuuuaguggcguagcuccucaagcacagacaauagcuacaccaaacacaguaauugccacaccguuuaggucagccagaagugacggcgguauuacaccagccaguucagguuuugcaacaccucguaguggagcguugguuccgguaggacaagggaguaguuuuacucccucaguuagggacaaacuuaacauuaaugcagaggagagucuagaggcugcagaaacgccaguacaacagcgcauauaucaaaccucccuuaaagagcaacuaaaaauggguuuaaguaguuuaccccagccaaagaacgacuacgaaauaguuguuccagagcaaguugaucaggagaugccagaacaagcucaagagcacaugauugaagaucaagcagauauugacaagagauaucaagaggauuugaaagcaaaagcagcaaaagaauuagcaaugagaucucagguuauacaaagagauuuucccagaccauuagauguaaaccuuuccguuuugcgaccuccuaaugaaaauuauucauugacugaacugcaaaaggcggaagaauugauaaaaugcgaaauggccacuaugcuacauuucgacaacuuaaagaaucccauacccaaucaaaguaaacaaucuaccaagucgcaagcacaacaguuagcauuuuuagaagagcauccguaucaaaauuuuagaccagaugaacuggaacugucgaaaaaaauguuaaaaaaagaaauggaaauugucaaaaugggaaugaaucauggugaauugcccauagaagcguacacucaagugugggaggaguguuugggucaaguguuguuuuuaccaaaucaaaacagauauacuagggccaauuuagcuaauaaaaaagacagauuggagucugcggagaagcguuuggaacagaaucgaucgcauauggccaaagaagccaaacgggcugcaaaaauggagaagaaauugaaaauuuuaacuggagguuaucaaucuaaggcccagguacucauuaaacagcuccaagaugcuuacgagaauauugaucaagcuaauuuggaauugaacacuuuuaaguuuuugcaagaacaagaaaagaaugcuuugccuagaagggucgagucauuaacugaagacguugaccgacaaauggaacgagaaaaaggauuacaaaagcgguauaacgaucuucagaacgaaaucagggaauuacaagagcaauacaaguaugugcaacaggaaguguacgaggagcaaagccaacaaaacguugugacagaugaaacuguugaaaaucauauaucugaugaucaaaaugugguuagcaguucuacagugaauggaauagaugagagcccugaagacgagucgaauaugaauuga

SEQ ID NO: 5516 - RNA, 495 nt, Sitophilus oryzae
  misc_feature (456)..(456): n is a, c, g, or u
augaugcaauuuauguugcuguuuagccgacaaggcaagcuucguuuacaaaaaugguacgucgcccauccagacaaauuaaaaaagaaaaucacgagagagcugauuaccacaauauuagcucgaaaaccaaagaugugcaguuuucuugaauggagggaccucaaaauugucuauaaaagauaugcaaguuuguauuucuguugugcaauagaacaggaugauaaugaacuguuaacuuuggaaguuauacauagauauguugaguugcuugauaaguauuuuggaagugugugcgaguuggauauaauuuuuaacuuugagaaggccuauuuuauuuuggaugaauuaauguuagguggggagauucaggaaaccaguaagaagaauguauugaaagcaauagcugcucaggaucucuuacaagaggaggagacaccacaaggauucuuuganaggagacaccacaaggauucuuugaugaccauggacuag

SEQ ID NO: 5517 - RNA, 1260 nt, Sitophilus oryzae
augcaccaguucagcaaauuuauguuuacccaaguuaccagauccacuagagaugcaauucgacauuauucaagagaaccucaaaggcgacccuccuucuuaucaagguuguaugauaauuuuagggaagaauuggcaaagaauaaggaaaugaaagagucacugaaaaaguuuaaagaagaagccgaaagauuggaacagagugaugccuugaaagcugcacgccaaaaguuugaaacuguagaaaaggaagcaacaaaaagcagcgauauauuaaaggaaaaacuuacuacaauuaaagacaaagugcaggguguucuagaugaaacgggcaaaacagaaauugcaaaaaaagcagguaaacuaagugagggaauaagcaagacugcucauacaauaggggaaaaagcgcaggaaauugggaaaacuggugcguuucaaagcauuucuaaagcaacagaggcugucaagagugaaauagauaccacuaguaugcaaggaaggguuuaugucagccccacaaaacuuaggaaaagaaaagaaaccacagcuguacagcaucaaaaguauuaugagccaaauacagaagcuuccgguguagaauuacauaaagauucaaaguuuuaccagucguggcaagacuucaaagauaacaacccuuauguacauaaaguuauggacuggaaauugaaguaugacgagagugagaauccacuaauucgugcaucuagagcuuuaacugaaaaaguaucagauguaaugggagguuuauuucaaaaaacagaacuaucugaaacuuuaacagaaaucuguaaaauugacaauacauuugauaccaagcgguuuuuaaaacagugugaaacugauauuauucccaauguacuugaagcuaugacaagaggugacuuagaaauauugaaggauuggugccacgaagggccuuauaauguuuucgcaauaccaauuaaagaagccuacaaaaaagguuauaaaauugagucaaaaauauuagauauagauaacguagaucuagucaugggaaaaguuauggaccaaggaccaguuuuaaucauuuccuuuaccucgcagcaaguuauggucguaaaggacuuggaaggaaaugugguggaaggagaugcugauaaaaucaugagagucaauuauguauggguauuauguagagacguuacagaaacugauccaaggucggcuuggagacuucuagauuuaucagcaagcaguaaugaacaacuaguuuga

SEQ ID NO: 5518 - RNA, 921 nt, Sitophilus oryzae
auggaauauucaagcgauucggaacuaagugauagcgauaaggaacuacaagaggcuuuugcggaaggaaaacugaaaccagggcucaauacuguacacgaagcacccaaaucauucauaaacaaugugcaaggacuaaaacauaaauuggacgaaauaaaacuaaauuuaacuuggcuagaaagacuggauaguguaaacgaucaggcaccacuagcaccugaauuagcagcccaaauguuagcccacgaacauaaacgugaaaaccaguugaagaauaacaagaaauugccacaauuuucacccaccgaagauccaguguugaaugauuucaaacgagagaugugcuuucaucgucaggcacaggcaacaauuuuagaggcuauucccaagcuuacaaaauugggauuaccuacuagaagaccagaagauuacuuugcugaaauggcuaaaacugacgagcacaugcaaaaaaucagggaacaccuaaugcaaaagcaacaacaacaacaaagaagugaaagagucaaacaacuaagacaacaaaggaaagaaggaaaaaugcuacagauucagacaaaacuacaacgaaugcaagagaaaaaagaaauguuggaccaaguuaaaaaguacaaaaaggguguuucaaaggacuuggacuucuuagauuccaaaaagaacaccaguagcaaagcaauuucuagaaaaucuuuagagaaacggagacagaaaaauaagaaguucggguuuggugguaagaaaaagggcaugaagcugaacacaaaagacagugcugcugauauaagugaguacaggaaaccuucaaaggguccuagcaaagggaagaaggguaaaggucaaaugaagaacagcagaccagggaaaaauaggaggauaaaaaacaaaacuaaaaggaaauaa

SEQ ID NO: 5519 - RNA, 615 nt, Sitophilus oryzae
auggaugaaguaaaaaaauuggaauaucuuucuuuaguguccaaaauauguacagaacuagagaaucauuuggguaugaaugauaaagauuuggcugaauuuauaauauuucuaucggagaaaaauaauacuguggauacauucaagaaagcccugacagaaaauggagcagaguuuucagauucauucgucucaaauuugcuucgaauuauucaacacaugaggcccaaaaccaaagaugcuuccagcgaaauaaacgaugaagauaaaauugaaaaaagcuuuuuagcucaaaaauuuccgggccuugcucuuccaaacgagccgcaaaaaccucuaagugaugaugaaguggaaaaagaugaagagacuaauaaugaagaaggugauauuguagccgaucuuauggcacaauuugaagcagaugcuccuucugcuguuaagaaaacuaaauccaaagaaacagaaagggauagacacagaucuaggucucgccauagagauaaaucaagauccagaucaagggauagaagaagagauaggucacgagaaaacagaagaaacagaaucagagauagaucuagagauagagauagggacagagaucauuacaag

SEQ ID NO: 5520 - RNA, 1878 nt, Sitophilus oryzae
augaaucaaggggcaccaaauuaccccauggcgucguuguacgucggggauuuacauucugauauuaccgaggccuugcuuuuugagaaauuuuccacugcuggucccguacuuucaauccgaguaugcagagauuugauaacccgaagaucucuuggauaugcauacguaaauuuucagcagcccgccgaugcugagagggcucuagauacuaugaauuuugacuugaucaaagggagacccaucaggauuauguggucccaacgugauccuuccuugagaaaaucuggcgugggaaauguauuuauuaaaaacuuggaucgguccauugacaauaaggcuauguacgacaccuuuucugcauuugguaauauucuuaguugcaaaguagcucaagaugaaaauggggcaagcaagggcuaugguuuuguccauuuugaaacugaagaagcugcuaagaaguccauagaaaagguuaacggcauguuguugaauggaaaaaaaguuuacguuggacguuucauuccccguaaagaaagagaaaaggaacuuggagaaaaagccaaacucuuuacuaacgucuauguaaagaauuuuggagaagacuuaucugaagaacaauugcgcaacauguuugagaaguuuggaaaaauuacuaguuacaagaucaugagcaaagaugaugggaaaucuaagggauuuggauuuguugcauuugagagcccugaagcagcagaagcggcuguggaaaauuugaaugguaaggaaaugguagaaggaaaaucucuuuauguaggccgcgcucaaaagaaggcugaacgucaacaagaacugaagcgucgcuuugaagcacugaaaauagaaagauugaaccguuaccaaggagucaaucucuaugucaaaaacuuggaugacacuaucgacgaugaacgucuacgcaaggaguuuucuccauuuggaacgaucacuuccgccaaggugaugauggaggagggucguagcaaaggauuuggauuuguuuguuuuucuucccccgaagaggccacuaaggcagucacggaaaugaacggccgcaucgucgguuccaagccacuuuaugucgccuuagcucagaggaaggaggacaggaaggcucacuuaaccucucaguacaugcagcguauggcaaacaugcguaugcaucaaauggggccguucauccagccuggaggcucuaguuacuucguuccgacacugccggcccagagauucuauggugcggcccagauaccccaaaugaggaccagucccagauggccggcccaaaacccugucagaccaggaggucaagcaggaccaacagcuuaugccaauaugcccaccacuuaccgagccacagcacgaccacccaaucaaaccgcggccaugcguaguaacaucaacguucccaggcccaucacuggccaacagccacccaacauccaaggacgcccauuggcuggucaaagcguggucgcugccgguggaagucgcacgcccaacuucaaauacacgucuaacaugcgcaacccgccgccuuccaugggcaccaugccugccgcaccagugcaacaagcgguccacauccaggggcaggaaccacucacugcuacuaugcuggcugccgcucccccaccggaccagaaacagaugcugggagaacguuuguucccucuuauccaacgcauguauccagacuuggccgguaagauuacgggaauguuguuggagauugacaacacugaguugcugcacauguuggaacacaacgagucgcucaagaauaaggucgaagaagcaguggcuguauugcaggcccaucaagccaaacaggcugcaacucagaucaaaaaagauuaa

SEQ ID NO: 5521 - RNA, 2775 nt, Sitophilus oryzae
augaccgauucaaaauauuuuaccacuacuaaaaagggagaaauuuucgaguuaaaauccgagcuaaauaaugauaagaaggagaaaaagaaggaggcuguaaaaaagguaauagcaucgaugacuguugguaaagauguuucagcuuuauuccccgauguuguaaauuguaugcaaaccgacaauuuggagcuuaaaaaacugguuuacuuauauuuaaugaauuaugcuaaaucucaaccugauauggcuauuauggcagugaauacauuuguuaaggauugcgaggacccuaacccacucauuagggcuuuagcagugaggaccauggguuguauucguguagauaaaauaacggaauauuuaugugaaccuuugaggaaauguuuaaaagaugaagauccuuauguucguaagacugcugcgguuugcguggcaaaguuauaugauauuucaucagcucaaaacacaaauuuaggccuagucgaagaccaaggguucuuggaacaguuaaaagaauuguuaagcgauucaaacccgaugguuguugccaaugcaguagcugcuuuaucggaaauuaaugagaguagucccacaggucaaccguuaguugaguuaaguacaucaacaauuaauaaguugcuuacugcucuaaacgaaugcacugaauggggucaaguguucauuuuggauucucuaucaaauuacacucccagagaugagagggaggcucaaagcauuugcgagagaauuacaccaagauuagcucaugcuaaugcggccguagugcuuucggcugucaaagucuugaucaaaaugauggaaauuuuacaaggugauguagaguuuuguaauacgcucaguaagaaguuggcuccuccauuaguaacuuuguugaguuccgaaccugagguucaguacguagcacucagaaacaucaaucuaauuguccaaaagaaaccugauauuuuaaaacaugaaaugaagguauuuuuugugaaguauaacgauccaaucuauguaaaacuagagaaauuggauaucaugauucgucuggcuucgcagaguaauauuucgcaaguccucagcgaauugaaagaauaugcuacagaaguugaugucgauuuugucagaaaagccgugagggcuauuggacggugugcuauuaaagucgaaccaucugcagagaaaugugucuccacauuauuggaucucauccaaaccaaggucaauuacgucguucaagaagcuaucgugguuauuaaggauauuuuuaggaaauacccuaacaaauaugagaguaucaucaguacacucugcgagaaucucgacacacucgacgaacccgaagccagagcuuccaugguuuggauuaucggcgaguacgcugaaagaauugauaaugcugaugaacuucuagauaguuucuuggaagguuuugcugacgaaaaugcgcagguucaauugcaauuacugacggcgguggugaaauuguuuuugaaacguccucagcauacucaaggacuaguucagcacgugcuuaguuuggccacucaagauucggacaacccagaucuaagagacagaggauucauuuacuggagauuauuaaguacggauccagcugcagcaaaagagguagucuuagcugacaagccucucauaucagaagaaaccgaucuucucgaaccaacguugcuugaugaacuuauuugccacauuucuucuuuggccaguguuuaccacaaaccacccacugcuuuugucgaaggcagaagcgcagguaucagaaagacccuuccuguucgccaagggucagacgaagcuccggcucaggaagcuacagucauacccaaucaggagagccuuauuggagacuuguuauccauggaucuuggugcaccuacaauuccauccggucccgcaccuaccacagcuccgauaaguaauguggaucuacuuggaggcggauuagauguauuguauggaggcacggaacuuaguggugcuccuacagcugcugcuccuucaacuacagggcuuuuaggagauauauuugguaucaccacaacaccaacuauguauacuccaccaaaaacauuaugguuaccagcugauaaagguaaagguuuggaaauacggggaacuuuuucaagaaaaucuggacaaguacacauggaaaugacccuuacuaauaaagcuaugcaggucaugaguggguucgcuauucaguucaauaaaaacaguuuugguuuagcaccuuuaguucccaugaacgucacagguuugcagccugggcaaagccucgaauauagcuuagcuuuaagcacaacagggccaguacaaagaauggagccccuuacuacuuuacagguggccauuaagaauaauguggacguguucuauuaugccugucaaauaccaauucagauucuauuccuagaggacggcacacuagauaaacgagucuuuuuaacuacuuggagagacauuccaucugcaaaugagguucaauacacucuaaaugauaucaaagguucugcagacgcuauuucaagcaagaugacuaugagcaauaucuuuaccauagcaaaacguaacguggaagggcaagacaugcucuaccaaucacugaaguugacaaauaauauauggguucuucuugaacuaaaauuaacuccugguucaaccacugcaacuuuaagcuugaaaucaagaucuguggagguggcaccauauguauuucaggcuuaugagaugauuugcaaaaauuag

SEQ ID NO: 5522 - RNA, 498 nt, Sitophilus oryzae
augccuccaaaauucgauccgaacgaaguaaaauacguuuauuugagauguguuggaggagaaguaggugcuaccucuucguuggccccaaaaaucgguccuuuaggucugucuccuaaaaaaguaggugacgauauugcaaaaggcacagcugacuggaaaggucuuaaaaucacuguacaguugaaaauccaaaaucgucaagccagcauuucaguaguacccucugcagcuucccugaucauuaaagcucuuaaagaaccaccaagggauagaaagaagcagaaaaauauuaaacacaguggcaacauuuccuuugaugauguuuuggcuauugcaagacaaaugagaccgcgauccauggcuaaagcacugucaggaacaguaaaagaaguuuuagguagugcucagucuguugguuguacaauugauggaaaagcgccccaugauguuauagaugaaguaaaugacggcaguaucgaagucccugacgaguaa

SEQ ID NO: 5523 - RNA, 1155 nt, Sitophilus oryzae
  misc_feature (784)..(784): n is a, c, g, or u
augggugaaaguggaaugagagcacuuauucuuguugggggcuaugggacgagauugaggccucuaacuuugagucguccaaaaccgcuuguugaauuugcuaauaaaccuauacuauuacaucaggucgaggcuuuaguuaagguuggcguguccgaaguuauuuuagcuguaucuuaucgagcagagcaaauggaaaaagaauugguuuuagaagcaaaaaaauuaggcguuaaaaugguguuuucccacgaaacccaaccauugggaacagcuggaccgauagcuuuagcagcagagcauuugacaaaagauaacaaaccauucuuuguauuaaacuccgacauuauuugcgacuuuccuuuuaaaaaacuaauggacuuccacaaagcucacgguaaagaagguacaauaguagugacaaagguagaagaaccuucaaaauauggugugguaguguacgaugaaacaaaguguauagaaaguuucguugaaaaaccacaggaauucauuuccaauaaaauuaaugccgguuuauacauuuuaaauccuaguguuauuaaucguauagaauugaaaccaaccucuauugagaaagaaguauuuccaaauauggcagcugaaaaagaacuguaugcuuucgaauuacaaggcuuuuggauggacguuggacagccuaaagauuucuugauagggaugugucuuuaccucaaacauuuaagaacuacagauccggagagauuauacagugguccuggaguuguuggaaaugucuugguacauncuacagauccggagagauuauacagugguccuggaguuguuggaaaugucuugguacauuccacugccaaaauuggaaaaaguugucaaauaggacccaaugucguuauugggcccgguguaguuaucgaggaugguguauguauaaaaaggaguacaauacuggaagaugcuacuauccguucaaauucgugguuagaaagcuguauuauuggauggagauguauaguuggacaauggguuagaauggagggcauaaccguauuaggggaagaugucauuguaaaagaugagacuuauauuaauggaggucaggugcuuccccauaaaaauauaggagauucgguacgcacaccacaaauuauaauguaa

SEQ ID NO: 5524 - RNA, 858 nt, Sitophilus oryzae
accgacggcgaagaaauuccugaucaggaaaaagugcgaauaguuucugauuuuauccuucguucgccccccggcgaguuuaaugaaguguucaacgauguccggaagcuccuggacgacgacgaccugcucaaagagggggccagcggggccuucgcccaguacaacaaagaucagcucacgccagugaggauagauaacgccgaucauuuaguuuugaucaccgaauacaacgauuuaggcaauaacagauuuuuugauucccguuccaaacaaagcuuucgguacgaccauuuaagaaaagaggcuucagacuaucaaccuuucacgcccgacgcaacagcagagcccuggagaucggcacuugacgcggaauuuauucaguacacgcguaaucacuauaaagacggagucaguuuggugguaggccguagugagggaaacacgauaacuuuagcugccuguauugaggaccaucaguuccaaccuaagaauuucuggaaugguagauggcguagucaaugguauauuucacuaaaugguaccucuacagcugaguuaaggggcguuuuaaaggugcaggugcacuauuacgaagaggguaacguccagcuaguuaguacuaaggaaauuaaggaaacuauaacuguuucgucggaaacgcagacugcaaaggaaauugugugggcuaucgagaaugcggaggacuccuaucaaacugcuauuucggugaauuaucagaauaugucugauaccacguuuaaggcucucagaagguuacuuccggugacccguaccaaaaucgauuggagcaaaaucguaucuuacaguauuggaaaggaacuaaagacgcaauga

SEQ ID NO: 5525 - RNA, 4158 nt, Sitophilus oryzae
augaagccuaaauggguccugguggcccuggugcuuugccuuuguacuauaaguuucggucaagauguuaauccggacgcugaagcggugcccggaguugaaagugacggaaacacggaucaggauggccaaccugugccagccgaagaacaaccggaagagggagcuaauggggauguaccaucaacggcuuacgaagaaccuuccguagacaauuccccuccuaaucccgaagauagcaacgcuccaucgucagauguugaauccauggaugggucggauaccacaggucugaaaacuggucaaaagaucuuuaaaucuggaaaguacaucacguauuacggggcugauuaugauccuaugaauucaagaaucgcuccuccggauaccgaccaaagggguggugcuggaacaccuuacacucucaccgaucagcguuugucaacgauuagacagaucuuuauguaucccuuuuacgaucagggugguaacgccgacaacgaaggagauuaccaaaaggaaauucaguccucaucaccacagguucacaaaaacuugaauuuccaacugccauuuuucggauucagauucaacuacacuagaguuuccuugaaugguuauuuggaguucagcgauccacccccaaauuacgacuacccccuaguauucccuacgagagauuggcccaaaaagaacgauccaucuuuuauuggaguauuuuucagcaagugcagaauaggugacuugagagauggugauauugacccacgaaaaccaggagucuauuuuagaauggaaagagauuugagacaacgaaacgaucagaugggaguggaaaucagagaaagauugaaaugggauaucagagaaggugugauugguucugagacguuugauccuaaacaugccaucauuauaaccuggaagaacgugucauucaauggcggauuugccaaugcuaaauauaggacaaacaccuuucaagcuguucuugcuaccgacgaagucuacacauacgccauguuuaauuaccuuaaccucgccuggacuagucacacugaagcugguggagauacaauaacuggagaaggagguguuccagcuuacauuggauucaaugccgguaacggaacuagaaauugggaguacaguccauacagucaagcgucaguuuugagagaucuuacagccacagguuuugcaaaugguuuuccaggaagacacuuauuuaggauugaugaaaacauucuugugggaacuuguaacaaggauauagauggagcaaauuuaccucuaauguuugcucccgagucuggaaacauguugggaggaacuguagucaacaucacuggaccauguuucaauccuuccgaucagguucuuugcaaguuugauguggcugacgugguuuaugguguaguagucaguagaaacagagcuauuugcauucagccaccuuuaaugguagaagguuacguuaggcuggaaauugcuauuggaccuggaacuuauaaauggaaagggagauacuauguugaaaauccugcuagugcagcccagaaaauuuacuucaaagauaugaagguccaugacaaaucaccugcagaaaucaaaauaacaugggaaaaguacaauuuaacuaccaacgauaacgcaaauauuaggauaucauuaugggguuacagagaaacaacuauucguccugcauuuuuguauauuacagauauugcaagcaacguccagaauacaggagaguauaccauugugccaucacaauauagaaauagagaaaacacuuuccuaacagacaucaaguucgguuucauucaaauaaauuugacagauacuaucccaguacagucugauuauaacagcgcugcacaaucgguagaaauaaauccaguaguauggaguagacccaucccucuugguugguacuucggcuggcaaugggaaagacuuuacggaacaaacuggccagaauauuugugcaacgauuggcugcgaacugacagauacuugaagaacuucgcacacgaacuaccccaguguccguguacuuuagaacaagcccuagcagacaaaggcaaauacaugccugauugggauugugacaaagauuccaaccccacuugcuauuacaacaaccaagcugugcauugcguuaaaacuggaucaccaacauuggaagguucugagcagcaauguugcuacgacaaaaaccacuaccuuaugcuuucuuacgaucagcagugggguucaaguccaaggcguugccacaauuuaggucucaugccuuaccaagaagcaaccaagguacccacgcuaucucaaugguuuaacgauguuguucccaaguaccugugcuguuuauggcaagaugaacaagccgugggaugcgaaacauugagauuugaaaggagaccuacucaggauugcguagcauaucaagcaccaggcguugcugguguuuauggugauccccacauuguaaccuucgacgauuuggaguacacguuuaauggaaaaggagaauuuguuuugauaaaguccaacgccagacuagauaacauugaaguucagggccgauuugaacagauggauccuaaccuauauggugaaguuagagcgacucaacugacaucuguaguagcaagaggcaauucuucuacugugguagaaguuaggagaagaccagaauacgcaagauggagauacagacuagauguuauaacagauggaaaaaggguuuacuuugacagaccguccuuaaaauuccaacauuuuccuggugugaccguuuauacuccgaccuacauuuugaaucagucugaagugauuaugauguuugacaauggaguuggaguggaggucuuggacaaucaagguuauaugacagccagaguauaucugccauggucauucauuaacaaaaccgccggucuacuuggaaauuggaguuuuaauaaagaagacgauuuuacuuuacccgauggcucuagaguaagcguaguuucaaauaucaacgacaugcagagaguauacaccgauuuuggaucaaaauggaugauagaugauguauuagauucacagaaaggcagagcacuauuccuucgagaaaauggcuugacuuccucaaacuacaacaaucguuccuucgugccgguguuuguuaugacuccagaagaaauuauaccggcaaacagauccgaacaaauuacgcgaaccuacgacgugugcagcacaaagauguacgaauguuacuacgauuacgcaaugacucugaacagagaccuggcccacuacacccaaaacuacaaggcuacgauauaucagcuuaaggagguuucuagaaccaagguggugucuuguggcaucuuagagacgccuagguucggaagaaagagcacauucuuguuuguucccggcaccaaagugaccuacgaguguaaccaagacuucguucuugugggcgauccaaggagaacguguuuagcuacaggccaaugggacacgcccgaauaugguuacacuuacugucuacgucaacaagaauauucucaacgcaacgcagccauaaccucaggaauaauuuuugcaguacucauacccuuagucuuagucauaguguuuaucgccuuuaagguauaucaaaaguacaugaacucggacgauaguuccuggcaauacgcccagaaacccgcgcuggcagcaagaagcuucagucccaccgaguccaacaagaguccacugagugacacuucgacaaguagcguauuuaaaccgcgcauaauguacgauaagagcuaucgcacucacgagccccuuguuggacucccugaaaccgaguuugagucgaaacaggucgauccuaacgauguggguuacgaaaucgacaggaagucgcugaguaguccgaauauuccugucaguccuacucccaguucuguuucauacaccaugccguaccaacaaaagcccgauauaguaaauuaugguagcaaaccaaaguuagauuaugguucugaugauuaugcccaaccuuauaaacccacuaguaguuccucugauccagcaaguccuacuacuggaaaauugucacccaucacuuauagagacaggguugcuaguagaagcaguguaauuacugauguuuaa

SEQ ID NO: 5526 - RNA, 375 nt, Sitophilus oryzae
ccagcugguggugguggagcugcuccagcugcagcugcaagaucggcagagcgucguguagggacagaguguggaucucgggguucgccggaucauugcgacauugaaaaaauucuuggcucgguaggaauugaagcugauggagaaaaacugaaaaggguuauuucagaacuaaauggaaaaucuauugacgaauuaauugcacaaggucgggagaaacugagcucaauuccagcugguggugguggagcugcuccagcugcagcugcaggaggugcugcaccagcugcugaagaaaagaaagaugccaagaaagaggaagccaaagaagaaucagagucagaugaagacaugggcuuuacucuuuucgacuag

SEQ ID NO: 5527 - RNA, 2733 nt, Sitophilus oryzae
augacaacaacugaucacuuugggcugaaaugggacccgaagaauuuagagauaaggacaaugucugucgagaagacuuuggagccuuuggugcuucaaguuacaacacuagucaauacaaacggcccaucaaagaagaagaaaggcaaguccaaacgugcgaaugcauugguaagcacaguggaaaaagccacugaaaacuucaucgaaaaaggagagcagauugcuuaugaaaauccugauauuacugaggaaaugcuugcagcuguugaugaaguaagaaagacagguacacaaaugaguagagaugcuagggaguuuucagaagaucccuguucuucauugaagcgcagcaauaugguucgggcagccagaaauuuauugucagcuguuacacggcuacuuauuuuggcagacaugguugauguccauuuacuacuaaaaucccuucauauaguagaaaaugauuuggagaaacugaaaaaugcaucaagcaauggagaacugcuggauaauauagaaacauucaggcagaaugcaaaugaauuaaugaaccaggcugcuaagaggcagcaggaacuaaaagacccucagcuuagggaugauuuagcugcagcaagagcuguuuuaaagaaacauucuacuauguuguuaacagcuucaaaaguguauguacgucauccagagcuugcagcagcuaaagcaaauagagacuauguucucaaacagguuugugaagcugugaacacuauuagugauguugcucaagguagaacaccuccaguagcaggcccguaugaugguccaggugaacuugcugcugccuuagaugauuuugaugaaaauauaguaauagagccuuuggcauauaaugagguucacacuaggccaucauuagaggaacguuuagaaagcauuauaaguggugcagcacucauggcagauucaagcugcacucgcgaugauagacgagaacgcauuguugcugaauguaacgcuguccgucaagcacugcaagaucuuuugucggaauauaugucaaauauggguaacaaagauaaaucugagagccuagcaaaugcuauaaauaauaugaaagggaagacaaaagauuugaggagacagcuaaggaaagcuguuguggaccacauaucugauagcuucauggagacuagcauuccucuacugauucucaucaaggcagcugaaaacggagaugagaaacaaguagaggagaaugccuacguuuuuacugaacauucaaauaagcucguugaggucgcaaauuuaguuugcaguauguccagccuugaggauggaguuaaaauggugcgcuaugcggccgcccaaauugauucacuuugcccugaaguaauuaaugcagcuagaauucuagcagccagauccaggagcaaaguugcucaagaaaacauggaugccuucaaauauaauugggagaaucaagucagaauuuuaacagaggccaucgaugauauaacaacaguagaugacuuuuuggcugucucugaaaaucacauuuuggaagaugugaacaaguguguccuagcucuucaggagaaugaagcagacacauuggaacguaccgcagcggcaaucagaggccguacugggcguauugcuguuguggucgcggcggaaauggauaauuaugagccuuguauuuacacgaaacgaguuuuggaggcagugaaggugcugaaugaucaggugaugccuaaauucacacagaggguccagguggcaguucaaacaauuuugaguggccagcaaggacaaccugcgaaagaacuggaugaaaacgaauuuauugacgcuucccgucuggucuacgauggugugcgugaaauucgucgugccguacuuaugaaucgggccgacgaagacuuagacccugaagauguggagcuugaugaaaauuacacauuagaaaccaagagcaaaucaagugcccauacaggagaacauaacguggaugaauauccggagauaagcgguauaacgacagcucgcgaagccaugggcaagaugccugaggaagauaaacagaagauccuccaacagguggaauauuucaggagcgagaagcugaaguuugacagggaaguggccaagugggacgacacgggcaacgacaucaucguucuggcgaaacacaugugcgucaucaugauggagaugaccgacuucaccagaggucgcggcccguuaaaaaccacaauggaugucaucaacgcggcgaaaaagauauccgaagccggcacaaagcuggauaaacucacccggcaaaucgcagaccaguguccagaaagcucaacgaagaaagauuuguuggcguauuugcaacguauagcgcuuuacugucaucaaaugaacaucaccuccaaggugaaagcugaugugcaaaauaucaguggugagcuaauuguuucaggcuuagauagugccacaucauuaauucaagcugcuaaaaaucugaugaacgcugucguuuugacaguuaaagcgucguauguugccucaacaaaauacccaagacaacaaggaaccguugccucuccaauuguuguauggaagaugaaggcucccgagaagaagccuuuagugaggccugagaagccugaggaaguucgugccaaagucaggaaagggucacagaaaaagguucagaacccgauccacgcauuaucggaauuccaaacagaaucuguuuaa

SEQ ID NO: 5528 - RNA, 1221 nt, Sitophilus oryzae
auguauagcguuuauuguuuuaaggagaucccaaauaauuauugcuacaaaacaaugucguuuucguuuggugccccaccuaaaacuacgacagcuuuugcuuuaccgacaucuacaaccguuacaaaagcagccacuacaagugcuccuacuuuacaauuuagcuucggaggagcaacaccaucgccuauuacuucaacaggacccucgacaggucuucaguuuaauuuugggggugcgucaacaacuccugcaaaugcuaauacaucuuugacaaccaguuuuacuccaauuuuagcuccagccagugcagcuacuaauacagguauuacauucgguacaccagcagcaacaguuggugcuucuacagcuacauuuggugcaccaacaacgacauuuggugcaccaacaacgacauuuggugcgccaaccacuacauuuggugcuccaacaacaacauuuggugcaccaacaacgacauuuggugucccaacaacaacaacaacugcaguaguuuugggucaaacuacaucaguagcuccuguuacaacuucugcuccuaguuuuccuaguagaucuauagcagcaucuaauguagccccgacaguaacuacaaccacgacaacaucaauuccagcaacaggaucuuuaacuuuuguucaacuggaagaucuaaucaauaaauggacgauugauuuagaagagcaaggaaaguauuuuguuaaucaggcuaaacaguuaaaugccugggacacuuuguugauuuccaauggugaaaaaauuuuaaacuuaaacagcagcauugaaagaguuaaacagcagcaaucgcagcuagaucaagagcuugauuuuauuuuagcucaacaaaaagaacuugaggagcucauugucccuuuagagaaagaauugguugauguuccagugacggauauugauagaaaucaaauguaccaguuugcugaaauaauugauucacaauugaagcaaaucucugaugauuugaaggaaauaauugagaauauuaaugaaacuaacaaagaugaggagguguccaauccuauaacacaaaucaguaaaauucugaacgcucauaugaacucacugcaguggauugauagaaacacugccgaaauuagcagaaacuuggaagaaauuucgaaaauugaagaugcaaacaggaggaauuugagucugaacaguucucucaauuuauuucaguag

SEQ ID NO: 5529 - RNA, 636 nt, Sitophilus oryzae
  misc_feature (566)..(566): n is a, c, g, or u
auguuuauuugggacugguuuacaggcguuuuaggauauuuagguuuguggaagaaaucuggcaagcuccuguucuugggcuuggacaaugcaggcaaaaccacuuuauugcauaugcugaaggaugaucgacuugcuguacaucuucccacacuucaucccacauccgaagaacucucaauuggcaacaugagguuuaccacauuugauuuagguggacacguucaagcaagaagaguauggaaagauuacuucccagcuguugaugccauaguauuccuaguugaugcaagcgauagaaugagguucgacgagaguagacaagaacuaauauccuugcugacagaugaaaguuuggcaaacugcccuguauugauuuuggguaacaagauugauuugccaguugcagcuucugaagacgaacucagaaauguauuugcauuguuuggccaaacaacaggaaaggguaaaguaccaagguccgauuuacccggucguccccuagaauuguucaugugcuccauccuccagagacagggauacggagaagguuuucgcugguuggnuguucaugugcuccauccuccagagacagggauacggagaagguuuucgcugguuggcgcaguacauuga

SEQ ID NO: 5530 - RNA, 624 nt, Sitophilus oryzae
agcuuuggaacugcaaaucaauuuuuuauuuucuuuuucuuaaaacuaagcacaaaaaauucagauauggaugccguugacuuauuagagaaacguauagaagcuuuggaacugcaaauauugccaaaagacaaaucaguucucaguaacaaaucucaaaccauugccgaucuuuuaacugaaacccaaacaaugauaucuucagcucuuagcugcagagaaucgguuacaucgcucuuacaacauaugcacacaaucaaugaguaucucgacccaucgaguggugaauaugauuuagaagcugauauaaaaaagcaguauuuguugcagauauauccagaguuaaaggcaagaguugaacucauuaaaacguucaacaaucucauucaguuuacuaauucggaaagucuucaaaaaguuacugaauuaucagguaaauuacaaacuuuggcugguucaaacguggaaauuuaugaagaauguaaagagguuaacgaaaauguccucaaagccuuacaggaguacaauaauauaaguaacacuauuaaaguauuguuuacucaaauggauaaagacauaucucaguuugaguauacccaaaauauuaaaauuuccacagaauaa

SEQ ID NO: 5531 - RNA, 1746 nt, Sitophilus oryzae
augucuaauuccgauguauacaacgaccuaacuuuguacauuacuccugagaaauuuuauauagaaccaaaaacuagugaugaauuguuaguaauugaucguggaucggaagcuguaacuguacaucgaaacacgggucaaauuccggcagcuaauaguaacaaagacuuuugcgggcuucucggaucuauuaauuuguuggcuggaagauauuuaauuauagcaacacagagagauuugauuggguauauagguggucauccaauauggaagcuaguuaaaacugaacugauaccauauugucgcaguaugcuucauuugaccaaugaaaaguuagcugacaacaauacuuaugugaauaugguagaaaauguguuagcaacuccaaguuuuuauuucagcuauaguuaugauauuacucauuccauucagagguugcaugaucuuacaccugauuuuuggcaacaauccauguuacaaagggcugauaauagguuuguuuggaacagauaucuuuuagaacaauuuaaggagacaaaugcuaaaagguuuucccuuccuuuauuacauggauuuguuucaauuaaccaaugugucauaaauggucguaauuuuacuugggcaauuauaucuaggagaaguauuuauagagcuggaacaagaugguuuagaagaggcauagauaaggaugggaauguagcuaauuuuguugagacagaacaaauuguugagucuagugaaggugauagagcuaguuuuguacagauaagagguucaauaccacucuuuugguaucaaaagccagauuugcgguacaaaccaagcauaacuuuggacuugggaguggauguucaagaucaacaagcugcuugcuuaagacaucuagaaaccacagcagguauauauggcagacaggucaugauagauuugguugaucaagugggcucugaaggucgauuggagaaggcauuuaaggacaccauaagcuauuuaucucauccgucaguucguuacgaaccauuugacuuccacgccgaaugucgaaaaaugaaauggcacagacuauccauauugacagauagaguugcuuuagaucaggaugauaugaguuauuuccuaauucuuucugauggaacauuuucuucuuugcaagaagggguguuccgaacaaauugcauugacuguuuggauagaaccaauguuguucagagcauguuggcucauaggaacuuagagauuguauugaggaaauuuacgaucuugagcuaugaucagaaguuagaagauuaucggacuuuugagucauuguuuaagaacguaugggcugaucaugcugauuugauuaguauacaguauucaggcacuggggcuuuaaaaacggauuuuaccagaaccgguaaaaggacgaaaucgggcaugauccaagaugguaucaacucgcugauccgguauuacaagaacaacuuuaacgacggcuccagacaagacucuauagauuuguuucuggguaauggaaaggugguaucuccuuuggccccacccccugguuggagauacauuaccuucccuucuguuuugcuaguggccacagcaauguuugucgcuucugucauauuccccgccgaguacuccagugagugccuguuguaccuaauguuuuggggcggcaugauggcuuccacaacuuacuauauauuccaauauggcgucgaauuuguugacaggccuaaguugacgccuacguaa

SEQ ID NO: 5532 - RNA, 1725 nt, Sitophilus oryzae
  misc_feature (1393)..(1393): n is a, c, g, or u
augccuccuacaauacagaacgggucaaaucccguugaaaaacgcccugaaaggccgacgaaaccuguugaaaaaaggucggauuuaauaugcaaaguaaaguacuguaacacucuuccggauauacccuuugaucuaaaguuuauuuccuacccuuuugagucguccagguuuauucaguacaauccuacaucuuuagaaagaaacuaccgcuaugaaguguuaacagaacaugaucuaggcguuaguaucgacuuaaucaauaaagauauauaugccgucgaucacggggcuacuuuagacccggcagaugagaaauuacuggaagaagacauccugacgccacaggauucgaaaagaucccggcaccaugcaaaaucuguguccugguugcguagaacugaauauauuucgacggaacagaccagguuccagccucaaacuauggacaaagucgaggcaaagguuggauuuaguauuaagaagucauuuaauagugaaacacuuuauauggaccgugauucucaaaucgaagcuaucgagaaaacauuuuccgauacaaaggugccuauugaaaagcauuauaguaagccaaauguuacgccuguugaaguuuugccucuguauccugacuuuaacuuguggaaauauccuugugcucaggucauauuugauucugauccugcuccaguaggaaagcagguuccagcucagauugaagaaaugucacaagcaaugauucgaggugugauggaugaaagcggugaacaauucguugcauacuucuuaccaacugaggaaacauugacuaaacguagagaagacuuugcuaauaauguaacguaucgggaugaugaagaauacgaauauaaaauggcuagagaauacaacuggaaugucaaaagcaaagcuaguaaaggcuaugaagagaauuauuucuuuguggugagacaagaugguaucuauuacaaugaguuagagacucgaguaagacugaguaagagaaggcaaaagguuggucaaggucccaguaacaccaggcugguuguuaaacauagaccgaugaaugaaauggaauucaagaugaagcgguacagagaaaagcaguuagaaccgccaggcgaagaugacgaagaaauggaauuggaagagcaacaagacgaacaagaacagcaacaaggcgacgacagucaugcagaguccgaucaagagcaggaagagacaaaagauaguggaaaugagagcaacgaagagcaaaaugacaaagaaaauggcgucagagaaucgagagccuccucgagauccucgagaaaaucaaaaucggcaucuagauccagaucgcgaucagccaguggaucgagaucacauucaaaauccaaguccagaucaaggngaucgcgaucagccaguggaucgagaucacgcucaagaucaaaauccaaguccagaucaagauccaaaucaagaucaagguccaaaucagcuuccaagucacccucuagaucaaggucuggaucucgcuccuccaaauccccuucaagaucaagaucugcguccaaaucccguucaagaucaagauccagaucuaagaguaaaucuaagagcaggucgcccucugggucaaagucuaggucugucucaagguccaggucccgaucuaggucuaaaucuggcucuagauccaggucugggucagaaucgcguucaggaucagaaagugaauaa

SEQ ID NO: 5533 - RNA, 1170 nt, Sitophilus oryzae
augccuaucgaaaaccuggaagaccaaggguuggagaagaaccccgauuuggaauuggcucauuucaaauucuugcuuacauugccagaauaccgaaacgacaaaacaguccaugcaaaaaucaccgaagcuauaaaaaaagaugauauggcuccuugguaugaguuaauuugucaagaaauuggcuggaaauuggacgagaaauuguugaaaaccaucaaagcgaagaacgaugaacaagugaagaaacuaaacgaagcuauugaggaugcagagaaaaaucuuggcgaaauggaaguaagagaagcuuauuuaagaaaagcagaguauuacaguagaaucggcgacaaagaaaacgcuuuaagcaccuucagacaaacauacgacaaaacagucucucuaggacaucguuuagacauuauuuuccauuuaaucagaaucggguuguuuuuuauggaucaugauguuaucacaaggaauauugauaaagcaaaaacucuuauugaggaaggaggcgauugggacagaaggaaucgguuaaaaguauaucaaggagcuuacuguauggcuguaagagauuuuaaaaccgccucaaacuuguucuuagauacugucaguacuuuuacuucguaugaacuuauggauuauaaagcauuuguuagguacacuguguauacuucgauuauaaguuuaccucguaaucaguuaagggauaagguuguaaaaggcucagaaauauuggaaguucuacauucugaaccauuugugaaagauuauuuguucucacuguauaauugucaauaugcagaguuuuuuggaaaucucgcaaaaguugaagaaguucuuaggaaagauuauuuucuaaauccccacuaucgguauuauguuagggaaaugaaaauuuuagcuuauacacaacuucuggagucauauagaagucuuaccuugcaguacauggcugaagcauuugguguaucaacugaguuuauugaugaugaauuaucuacguuuauagcaacaggaaggcuucauuguaaaaucgaucgugugggugggaucguggaaacaaacaggccggauuuaaagaacgcacaauucaauucgguugugaagcaaggagaucuauugcuucagcgcguucagaaguuaucucgcgucauuaacauuuaa

SEQ ID NO: 5534 - RNA, 909 nt, Sitophilus oryzae
gacgaugacaacacugaagauuugaaagauguuuuggcuuuguccggcgaucuguuggacccugaucuggugaacaguauuauuaaugaggaagaugacgacuuaacuaaaaacacggaguuggaaacguugggagaugagggagaauugucacaaacccugggaagcacggaaagcuccaaagaugccaaagaugaacuuagugauauuuuaggaccucacuuuagcuuggaguccauacaaaacauuaacagcaaagacguugaagacauuuucaagggcguuuuaacugacgagucgcaagaaucgcaacugucccaagaaacuaacauauuuccuccuauacaaucaaguacgcaggcgauguucgccggaagcaugucgcagccuucgcccguuucgauuccgcaaaugccacaaauuacgucuggcgcugugcguccaaccgcuuuaccggguguacaacacgccaguuuuccuccaucuccauaucacucugaguauagcaauaguccacaauuuaguccagccuuuuccgaaccgccuaguccuugggugagcaugagcgaggguguugaaauugacaguaccaguguuggaguagcauccacguauaaucaacggucgucggagaaaaugaaagccgacgaagcucuagguaguggagccaccauaucagcgguacucuacgccaacaugaaucaucccgaauggaagacugaauauccugcguggucugacagauauaaacaauuaauuaaaaaauggcguacucuaagucaagaacaaaaggcaccuuaucuucagcaagccagagacaaucgaagccaguugagaaugaaaaaacagcaacagucacagaccgccaaggacuccuccgccucgagccccguaccgggcccgaagccc

SEQ ID NO: 5535 - RNA, 441 nt, Sitophilus oryzae
aagggucccugcugguuagauguucguaauccugaacuaaacaauaacccacugaguuggugcaaguuugaaguaaauuguguaguaaaaaauauuguuaaagucgaugaacaguuagaaagaccgccauuaguuguguccgcuuuaaacuuucgucauuaucgaaauccuagaacgcaccagaaugagauuuugaugauaucuuguauuacucaaacuaaauauucuguggauaagcaacaaccuaagccaccuuuuaaugaacauuuuuguguuuuuacaucuccagccaaacagccccuuccaaugaacauuuacgagugccuaaaaacuuauaaaggaaccaaaguacaaaaaauggacuccgaaaaagcguuacucaacuauuuuguuacucaguuccuuaaaaucgauccugauaugaucguaggcuuugauaug

SEQ ID NO: 5536 - RNA, 1440 nt, Sitophilus oryzae
  misc_feature (149)..(149): n is a, c, g, or u
auggcgguugcagcugcagccaagauugccgaaguccgugagacaacacggguagagagaauaggagcacauucacacauucgugguuuaggauuagacgacagucuugaggccagacaugugucucaaggaaugguaggccaaguauncagucuugaggccagacaugugucucaaggaaugguaggccaaguaucggcaaggcgagcgguuggaauaguguuacaaaugguucgagauggucgaauagcuggcagagcuguuuuauuagcuggacaaccugguacuggcaaaacugcaauagccaccgcauuagcagcugccuuaggauaugacacaccauuuacaaguauggcuggcucagaaauauauucuuuggagaugaguaaaaccgaggcucucacucaagccauuagaaaaaguauuggaguaagaauuaaagaagaaagugaaauuauugaaggugaaguaguagaaguucaaauugaaagaccagcuacagguguagguaccaaaguuggaaaauugauccuaaaaacgacugacauggagacaguauaugaucuugguggaaaaaugauugacaguauuuugaaagaaaaaguucagucuggugauguaauaacuauugauaaagccacaggcaaaaucacccgccugggaagaucauuugcgagagcucgugauuaugaugcaacaggacagcaaacaagauuugugcaguguccagagggugagcuucaaaaaaggagagagguuguacauacuguuacuuuacaugaaauugauguaauuaauaguagaacucaugguuucuuggcucuauuuucuggugauacaggagaaauuaaaccagagguuagagagcagauuaauggcaaaguggcugaauggagggaagagggaaaagcagaaauuauaccagguguuuuauuuauagaugagguucauauguuagacauugaauguuuuucuuuccuaaacagagcguuagagaaugaaauggcgccuauaguaauaauggcuacaaaucgugguauuacuaaaaucagaggaacuaauuacaaaucgccucaugguauuccauuggaucugcuugauagaacuauaauagucccuaccacaccuuaugaugagaaagaacuuaaagaaauucuuaguauucguugugaggaagaggauugccaaaugucagauaaugcauuaacaguacuuacuaggauuucuaaagagacaucuuugcgauaugguaugcaacuuauuaugacuucaaguuugauugcaagaaagagaaaagcucaugaaguugauguagaagauauaaaaagagcauaucaguuguuuuuugaugaagguagaucaguacaguuucuuaaggaguaucaacaagaauuuauguucaaugaaauggagggggaagacaagauggauguaaauuag

SEQ ID NO: 5537 - RNA, 1170 nt, Sitophilus oryzae
  misc_feature (1087)..(1087): n is a, c, g, or u
augagucuucgaacuuauggugauaaaccaaucaguuuccaacuggaagaaaauggagaauauuacugugucggauccgaaguuggaaacuaccuaagacucuuuagggguucucuuuauaaacgauacccuggaauguuuagaagggcuauaacaaaugaagaaaggaaaaaguuaauugacuuaggacucucacagcauugucuugcaaguagugucucuuuacuuagagcuacagaaguagaggauauuauagaagggaacgaugacaaauauaaggcuguuucgguucauaccagugauccuccucuaccacgcgaagguaagagcaaaaagaauuugcaauggguuccauccuuaccaaauucaagucauuuggaugcaguuccucaagcgacaccuauuaaccguaauagaguugcugccaaaaaaguaagaacauuuccgcuaugcuuugaugauacagauccacagcuaaaucaagagaaugguugucagcacgaauugcuuguuccaauucgacuugauauggaaauugaaggucaaaaacuaagagauacuuuuacguggaauaaaaaugaaagucucauaacaccagaacaauuugcugagauuuugugugaugauuuagaucugaauccucuuacuuuugugccagcgauagcucaagcuauccgucaacaacuggaagcuuuuccuaacgaaccuccuaguauuauagaagagaauucugaucaaagaguuauugugaaauuaaauauccauguugggaauacaucauuaguugaucaaguugaaugggauaugagugagaaacaaaacaauccugaagauuuugcucugaaauuauguucagaauuaggucuaggaggugaauuuguuacagcuauugcauauucuauaagggggcaacuaagcuggcaucaaagaacuuacgcuuuuagugaagcgccucuaccuacaguugaaguuccauuuagaacuccuucugaaucugaucagugggcuccauuuuuggaaacauuaacggaugcugaaauggagaagaaaauaagagaucaagacagaaauaccagaagaauacganauaagagaucaagacagaaauaccagaagaauacgacgauuggccaauacuacccccgguugguaaaaaauauuauuauuuaa

SEQ ID NO: 5538 - RNA, 702 nt, Sitophilus oryzae
auguucuguugcugggccccgcaagaggacuucggaaaagguccgauggcugccauacgaaagaaauuggugaucgugggcgacggugcaugcgggaaaacuugccugcugauuguuuuuagcaaggaccaauuuccagaaguguacgugccaaccguuuucgagaacuauguggccgauaucgaagucgacggaaaacaagucgaauuggcccuaugggauacagcaggacaggaagacuacgaccgucugcgucccuuauccuauccagauaccgacgugauccuuaugugcuucucuguggauucuccagacucgcuugaaaauaucccggacuuauccuauccagauaccgacgugauccuuaugugcuucucuguggauucuccagacucgcuugaaaauaucccggaaaaauggacuccggaagugaaacauuucuguccgaacgucccuaucauucugguagguaauaagaaagauuuacguaacgaccccacaacuauaaacgagcuaagaaagaugaaacaggagccugucaagccucaggacggucguucgauggcagagaaaauuaacgccuuugcuuaucucgagugcucagcuaaaaguaaggaaggugugagggaaguguuugaaaacgccacucgcgccgcucuucaggugaaaaagaagaagaagcaucguugcauuuuguucuga

SEQ ID NO: 5539 - RNA, 3846 nt, Sitophilus oryzae
augccuuuggcguuaaguaauuuaacucaaauuaaaacaauaaauaauguuccgcuaccgccagaaauuguagaccauuuuagucauguacagugccauuguaugaugggaauauuuccagacauaaaucgugcuuggcuaacaguagacagugauaucuacauuuggacuuacgaagaaaauacugauuuagccuauuuugauggcauaaaugaaacaauuuuauguguuggguuaauaaagccaaagccuggcguauuucaugcuuuuauuaaguacuuauugguuuuaacaacugcaguugauauuguugugcuggguguuacuuuuacugaagguaguacuaguggcuuggaagagauucaguuaauaucugacccuguuuuuacacucccaacugauggaaauacuauuacuacuauugcugcaacugcaaauggcaggcuauuuguuggaagcaaggaaggaucguuauuugaaauaucuuaucaggcugaaagugguugguuuggaaaacgcuguaaaaugauuaaucuuuccacaagugcauuaucauuuuugguaccuucauuuuugaaugcugcucuuagcgaagaagacaguaucguucaaauugcuauugaugacagcagaaauauaauguauacuuuaacagaaaagggaucaauugaaguaugugauuuaggagagaaaugcaacacuuucucaaggauuaguaaaaugacacagaacacuuuaguuacucaagcaaugaauacugucaagacauuagauagucaaaauuuuagaccaaucauuaguauuucuccgauugagucuuaugaaucugcaaaccuaaaucuuguagcugucacucaaacagguguuagauuuuaucuaucaguuguaggauuaucuaaucaacagccuaaucagaggccuuauacauuaacuuuagcucauguuagauugccaccagguuauucagccaauguuacuguuaggccaagaaguguucauaugagucacuacagagacagaaacuugauuuuaauauccaauguaaaagauaaggauguuuugugguguuuaaguucugacuuauuucccuucagucagucuuuaauggaagcuuauacuacaguuaauuuagauggcccagcucuagcuuuagcagaggugcgacacaauaauuauuugcaaauaagcccagaucaacaagaagcuccaccuuuaguaguaagacaacauggggaagcuccuaaaaaauauguagugcuaacgucacauaguguacaaauauuuauaaaacuaagaccuguagauuugcuucgacaaauuuuaagagauagucacggccaagacacagaagcucuuagagcauuuuuuaugauucaaaaagaaagccaggcgugugccacaagcuuaauuuuggcuuccuuggaaagugaagagaaugccgaaauugcugaauuggccacuagggcauuuuuuauguuuggaggugaaccaaaaauuucaccccuuaaucagacuaauguuuucucagguaccacaauguuuucaccuaauauaauaucuacucccgcaccuccacaauaucagcaaaguggcuucuuaccucagucgccugguggagccuauucucaaucaggauauuuacaagguaguuuuucucaaaguauuccgcagcagacauucgauccugcaaacuugauuaguuauucaaauaaacacaauggucuguauuuguauuugggucgaauauugagaccagucuggaauaggagauguguagagagaaucuguccagaugggaaaacuguucugaaccaaaguacuauuacuguugaagauuguguccagauucuuaacaauuugacagcacuucacaauuuucuguccuuaaauacacaacuuucaacaacauauaaugcaucuacucaauauaauucaacaauuaaggcuaacucucuaacgacaucucauaugaauccuacuccucaggauauacagguagaagagaggcauucguuagaugcuuuaaaaacuuuuguuugucauuguugucaaauaaucggucuauggaggauacuuugugaucaucaauuucacgaauuaguuggaucuuuaccugaaaaccaacaacagauucuucagaguauaacuuuuaaagaauuauuuuuauacaggcaagauauuuguaguguuuugauuaccacccuugugaauaguuaucucggagauaaugcuucuguugauucaauaaguaacaaauugauugaaguauguucucauuuauacaauacagaaaaugcugaaauuucaaaggcuagcgaauuauuaaaaaccacuaggacaauacaaaauacagaugagaaggaagaaaugcuaguaucugcauuacaguuauguaaaaauauagcuccuaauguaaaucuaccugaaguuuguaagcaauuuacaacauugaaagcuuacaaggcuguuauagaauugugugcuuuuugugcacauaaauuagauccagauaauauugguggaaacuuuuauaauagugaugacaacgcuggagaucaagaagguuuuaguuacuaucagagaaggauggaaauauauagagaaauaguaguaauguuggagacacuuuacaaugaacaagagccaauugucaagcagaauuuugaaccagauuauucaaauagcaaaucuguucuuuuagaaggaaugggagaaacuaaguuagauacuacuuuacaucaaauaauagaugaaaucuuguuuuaugaugaugaauuaaugcauauagcucuuuaugaguggaugguuaguaaacagaugaccaacgaucugauuaaaaucgguaaaccuucauuggaaaauuaccucaaacguacaucuauucagacgccagauaauaucgcuguaauggaucuuuuauggaaauuuuaugaaagcaauaauaaccaugcggcagcugccaaaauauuaaacaauuuagccucgagaaccggacauagugugacccuaaaagaacggauaguguauuuagcgcgagccaucauguguaugcguagugacaaagucgguuaugcaccauauuuaggaguuuucuuaagagauuuagaggauaaaauggagguggccaaaguacaagaacuuauuuuagaccaaauaacuaauaugcgagaucagauuccuaacucaaaagaagcaauugcugcauuaaauaguggauuauaugaaauaucucagcuuuaugagaacuuugcggaaccauucagucuuuuagaaugccaguuagcuauuauugauugugcaggauauacugaaagugauaaugcuuuaguaaaaucaauauggcaacaaauucuagcuaaugaacugagaaagucuucagguaguggcacugauaggaugagucagguucuaaguaaaguaaaacauuuagcaagacaauacauuaacucaaauaauuguuuuccacuugcuuauauagugggagaauuagaaaugguuaaugcaaaacuuaaaggagauaaacauuugguaucaacuauguuagcauccgugaauauuccauuugaaagguuaauucaaguauacaaccauuuaauuacuuugucaguaaauuuggauuucuggcaaagugaagaaaaugaauuucauuugucugaagcaacggcugcauuaauaacguguuuuuuaaauaaccacgauucauuuaauaguguggaaaagcgaaaaauuacugccauuugccaagauacaguagcagcauuauuaucaaaucuuuacaguaaagcgaauagcgaucacguuguuaaccgcaucagaucaauucaagcaaaacugucccgaauuuga

SEQ ID NO: 5540 - RNA, 384 nt, Sitophilus oryzae
augucugaauucacacugaguuaucgagaagugacccccgaucaagcccuguacgaaaaauggaucgaaauaacauuacacacagggggcacccagagcacauugcaggacauaaaaaucaccgaacgagcuaauggguacaguuacuuagauuccacaagacauuauacaagaaaucgguuuauauauuggcgaauuagcucggauaccuuggagcuaauugagcagaguuuagauauaaaccuuacgggaaacacugugagguacagguuuauggauaguccgauaauugaugguauuucaguacaagaaacugaagaaaacguaauuauuuugguuccuacaguuuguagcgugcauauguuaagauuuccucauccuuca

SEQ ID NO: 5541 - RNA, 2967 nt, Sitophilus oryzae
  misc_feature (2026)..(2026): n is a, c, g, or u
auggaaauuucagacgaaaaucuacgcaccuugggcaaauacuuauuugaaacauuaaaugccgauguuaccguccguagaacagcggaaaaauuucuagaaggugucgaaguuaaucaaaauuauccucuuuuauugcuucaucuuguucaucaaccagaaacagauaugcugaucagaacagccggugccauagcuuuuaaaaauuauaucaagcgaaauuggacuguuguugaagaucaggcagaucguauucacgaaucugauagaacuucgauaaagaaucuaauaguaacuauuaugcuuacggccccugauaauauacaaaagcaauugagugaugcuauaaguauaauugggaagacugauuuuccuacaaaauggccacaauugauaacagaaaugguugaaaaauuugcuauaggugauuuuaagauaauaaaugggauauuacguacggcacauuccuuauuuaaaaaauauagguaugaauuuaaaucaaacgagcuauggacugagauaaaauacgucuuggaaaaauuagcaaaaccucuaaccgaucuucuuguggcaacagcagguguuauuucugcaaaugcaucugauauuguagcaucacaauuaauuuucagcucgcuaguguuaauagccaaaaucuuuuauucuuugaauuuccaagaccuuccagaguucuuugaggauaacauggaaguuuggaugaaucauuuccaugcuuuacugaauauugaacaggauacuuuggaaacacccggaauagaugaaccagguguuuugcaaaugcuuaaaucccaaauuugcgauaauguggcacuuuaugcucagaaauaugaugaagaauuucaaaaauauuuaccacaguuuguugaagauguuuggaguuuguugagcaagacuggauugcaaccaaaauaugauuugcugguuuccaaugcauugcaauucuuaucaacaguagcagaaagaacucauuauaggaauuuauuugaaaauccuaguguucuaagcaguuuaugugagaagguuguuauuccuaacauggaauuuagggugacggacgaagaacuuuucgaagacaacccggaagaauacacgagaagagacaucgaagguuccgacguggacacgcgcaggcgcgccgcuugcgaucuucucaacacccuaagcauccaguucgagccgaaaaucauggagaucugcgggcaguaccuccaggugauguuauccaaguacguggagaauccgaaaaccaacuggcgcaacaaggacacggccuuguacuuggucauaucgcuggucaguaggggaucgacgcagaaacacggcgucacucagacgagucagcuggugaacaucagccaguuuugucagcagcagauauugccagagcuggagaggccugaugugaaugaauuaccaguacuuaaggcugacgccaucaaguacauaaugacguuuaggucaguauuaccgaacgagguugugguuuccacccugccucaacucaucagacacuugcagagcgaaagcgcagucguucauacuuacgcggcuugcgccauugagaaaauucuaauuaugaaagacagcaacaaucaagcuauaguuucaggaggucauauucaaccguuugccaaggauuugauuagucaauuauuggagguguuggagagaccuguaucagaggaaaaugaauauauuaugaaagcuuuaaugaggacauuuucgacucuacaagaacugguuauacccuacuugggcguggcauuaccgaaacuuacugaaauacuuaaagcuguuacgaagaacccaucucggccacauuucaaucauuacuuguuugaaacguucucccuuucagucagaaucguauguaaaucuaaucaggcugcuguaaaaucguuugaggacauuuuguuuccgauuuuccaaggaaucuugcaacaagauguacaagaguucauccccuacgucuuccaaguauuaucaaugcuauuggauuacaccnuacaagaguucauccccuacgucuuccaaguauuaucaaugcuauuggauuacaccccuucaggaucguuaucugaugcauacaugcaacuuuuaccauguuuguuggccccuguacuuugggaacgaccugcuaacaucagcccguuaguacgauuguuacggucguugguaagccaggcggcccaacagauuauugcucaggauaaauugccuggcuuuuugggcguguuucaaaaacugauagcuucaaagaccaaugaccaugaaggauuuuacuuaaugcaggcacuuauuuuacauuguccuaaggaauguuugcaaccauacuugaaacaaauauuuuuccuucuauuccaaaggcugucguccaguaaaaccacgaaauaugugauaaauguaaucguuuucuucucguuauuuauuaucaaauacucggcaagugauuuaaucacuaugaucgauggaauccaagaucaaauguuugguaugguuuuggaaaaacuguucaucgcagagacacaaaaaguuacuggucaaauugaaagaaaaauuguuucuugcggaauaacaaaacuguugugugaaagucccgagauguacacaggaaaauaugcaaaauauuggaaucagcuuuuacaggcacuuuugauguucuuugaacuaccuccagaugaaagcaccuucccggacgaucauuuuaucgaaguagacgacacacccacuuaucaaacgucaaaugccaagcuaaauuucgcaaacgccgacaaagaagaucccguagcugguuuaggagaaccaagacaauucuuaguccaaagucuagcaacgcuaggugcgucacaaccaggucguuugcccacucucaucaguaacacagcuccacaaucgcaaacuguucuacagacauauuuggcaaaauucggcguccagcucguuuaa

SEQ ID NO: 5542 - RNA, 636 nt, Sitophilus oryzae
auggcaaaaguucagcuauguaauauuacuguuauggauaauccuaguccuuuucuuaauccauuucaguucgaaauuacauuugaaugcauugaggaacuuaaagaagauuuggaguggaaaaugauuuauguuggaucugcugaaucugaagaauacgaucaaauuuuggauucgguauuuguuggaccuauaccagagggcaagcacauguuuguuuuucaagcugauccaccaaaugucucaagaauaccagaaaaugaugccuuaggaguuacaguuguauuacuaacauguucauaccgugcucaaguacuaacauguucauaccgugcucaagaauuuauacgaguugguuacuuuauaaacaaugaguauaaugauccagaguuacgagaaaauuugccaaguccaccucaauuugauaaaguuacgagaaauauucuggcaucugaaccuagagugacaagguuuaaaauuaacugggaggagccuaaugcacaagaaguugugucaaauuuagagaauacagaaaauaguucgauuacgacugaacaaaguaauaaugcaacucaaucccaaauuccuaguuuuaaugauaauucaaacucaugggcaacaauggaauguucuuaa

SEQ ID NO: 5543 - RNA, 978 nt, Sitophilus oryzae
  misc_feature (828)..(828): n is a, c, g, or u
auggaucaaaugcuaccgagucccggguuuagcaucccuaguauuggaacuccacuacaccaaccugaggaagaccaacagauuuuaccaaaugcauuacaacagcaacaacagucccaaccugccaccagucaaguaccaucuuuagcuccgaugggaggucuaacgcccacauuaggccugggcaugggaaaugccauguccaugccacacacaaaauacguuacagcuuaucaaaugccuauguccacuaugcauaguggaaugaccccucaaacaccacagcacacuaugaugucaccuaugguaaacuugggugguucgggggguaguggugccacuccaaauguuggcggcccugcuacuccuucuccuaugacuccgaugacuccacauuccgcagacccaggaauuguaccacaauuacaaaauauuguaucaacuguaaacuuaaacuguaaauuagacuuaaaaaaaauugcguugcaugcuaggaaugcagaguacaauccgaaacguuuugccgcagucauuaugagaauuagggagccuagaacuacagcacugauauuuaguucgggcaagaugguguguacaggggcgaaaagugaagaggauucuagauuggcggcuagaaaguaugcuagaauaauacaaaagcuuggauucccagcgaaauuucuggauuuuaaaauacagaacaugguaggcaguugugacgucaaguuucccauccgucuagagggcuugguauugacgcacaguucuuucaguuccuacgagccggaacuuuuucccgguuugaucuaucguauggugaaacccagngguuugaucuaucguauggugaaacccaggaucguucuguuaauauucgugucuggaaaggugguccuaacgggagcuaagguuaggcaagagauuuacgaggcguucgauaacaucuaucccauuuugaagaguuucaaaaaacaguga

SEQ ID NO: 5544 - RNA, 477 nt, Sitophilus oryzae
auggccgccaucagaucaaugucccgucuucuuacaagcagaucccuuagcucaacagcaaaaagauguuauucggaagaaaugaacuuuacuuuugccucaggaaaucaaauauuuuaugauggaaaaagcguuaaacaaguagaugucccuucguuuucugguaguuuugguauccuacccaaacauguuccaacuuuggcaguuuuaagaccaggagucgugucuguauaugaaaacgaaggagcuguuaagaagaucuuuguauccagugggacugucacaauuaaugaugauuccucuguacaaauuaucgcagaggaagcucauccuguugaaaauauagaucuaucagcugccagagaucuuuuaaguaaagcucagagucaauugucuucagcagccaaugaucaggcuaaggcugaagcugaaauagccaucgaagugggagaggcguuaguaaaggcugcugaguaa

SEQ ID NO: 5545 - RNA, 990 nt, Sitophilus oryzae
augagcggugacgguaacaaaacggaccaguuugauacccuguuccucaguauugcacaacaccauccagaaggggcccaucagcuuuuagacacauuuguuggauuucucggucgaaaaacugauuucuucaccgggggaaaugaaggggauugggaaaaacuugucaugaauacauuuaaaaaacacgaaaagaucagccguucucggcacgacgcugaaguaaaggagcguaaagauagagaagccgcuaaaaaagcgaaaaaggcugaagcggaagcuguaaaaccagcagaaauuacugaauugacagaugaagaagcugaccgucuucagaaagagauugauaagaaaaagggaauugaugcugucccuucugugauaaacaacgaagaaucuaauccuuccacgucugcaaguucugcagagaaaauugaagaggacgaagaugaguccgagaagggaaaauuaaaaccuaauaaaggaaaugggugugauuuggagagguauaaauggacacagacucugcaggauauugagcuccgagugccccuagaaaucaacuuuagagcgaaacaaaaagaucugguagucaaucuugccaagaaacacuugacgugcggcgucaagggucagccaccaaucauagacgacgacuuacaacacgagaucaagcuggaagaguccacgugggucaucgaggauggaaagguuuuauuauuuaauuuagaaaagguaaacaaaaugaauugguggggaaaacugguacaguccgauccagaaauuagcacgaagaaaaucaauccugaaccuucgaaacugagcgauuuggauggugaaacccgggguaugguagagaaaaugauguacgaucagcgacagaaagagaugggacuacccacuagcgaugagcagaagaaacaagauguacuuaagaaguuuauggaacaacacccagaaauggauuucucaaaaugcaaguuuaauuaa

SEQ ID NO: 5546 - RNA, 459 nt, Sitophilus oryzae
auggccacauauuccggagccccuccuguauuacaguggaguccagacaagaaauucagcgaccgagagagguggauuuguaucuaucccgcuuacauaaacagcaaaaaauccaucgccgaggguaggaggauugcaaaaaguagggcaguugaaaauccaacuuaucaggagauacgagauguuuuaguugcuucaggauuaaauguuggcguggaaaacaagcaauauagucgcgaacgcagcaaagaacuucuaugcagggguagaaucaggguacaguuaaaacacgacgaugguucacucuacaacuccucauuuccuaccagagacaguguauuguugcauuugggugacaugauaccgaaacugaagacccgacuuaguaaaccuucuggugaacagcaaccgcagagcagucaggguaaagguaaaggcaagggaaaaggcaggagauaa

SEQ ID NO: 5547 - RNA, 2133 nt, Sitophilus oryzae
  misc_feature (1201)..(1201): n is a, c, g, or u
auggaaggcaaagcccaaaagaugcccaaaguggcgaaaguuaagaauaaggcucccgcggaaauccaaauuacagcagaacaacuuuuaagggaggccaaagagagggauuuagaaauauuaccaccaccuccgaaacaaaaaauaucagauccagcugaauuagccgauuaucaguugagaagacguaaacaauuugaggauaauauucgcaaaaaucggacuguuauuuccaauuggauaaaguaugcucagugggaggaaucucaaaaagaaauacaaagggcacguucagugugggaaagggcucuagauguagaccacaggaauaucacaauauggcuaaaauauacagaaauggaaaugcgaaaucgccaagucaaucacgcaagaaauuuaugggacagggcuguaacaauucuuccgagaguuaaucaguuuugguauaaauauacauacauggaggaaauguuagagaaugugccuggagcuagggcuguuuucgaaagauggauggaauggcaaccugaugaacaagcuuggcagacauacauuaauuuugaacugagauauaaagaaauugauagggcaagaucaauuuacgaaagauuugugguaacucauccugcuguaaaaaauuggaucaaauaugcacguuuugaggaaaaccauggcuuuauucauacauccagacagauuuuugagagggccguucaguuuuuuggugaugaucauauggaugagagauuguauauugcuuuugcaaaauuugaagaaggacaaaaggagcacgauagggcaagaguuauuuauaaauaugcauuagauaauauuccaaaggaucaaacuaaagagcucuauaaagcuuauacaauucaugaaaagaaauauggugauagaaguggaauugaagaaguuauuguuucuaaaagaaaauuucaauaugaacaagaaauuacugagaaucccacaaauuaugaugcuugguuugauuacauaagacugguugaaggggaaggagauguagaaauaauuagagaaacauaugaaaaagcgauagcaaauaugccaccuacaagaaacaaagacuacuggcgaagauacauauacuuauggauaaauuaugcauuuuucgaagaauuagaagcacaagauuaugaaagaacucgacaaguguauaaggccuguuuggagcuacuanacuggcgaagauacauauacuuauggauaaauuaugcauuuuucgaagaauuagaagcacaagauuaugaaagaacucgacaaguguauaaggccuguuuggagcuacucccccauaaaauauuuacuuuuucuaaaaucugguuguuauucgcaaaguuugaaauaagacagaaaaauuuaacagcagcucgaaaaauauugggcacuuccauuggauuguguccuagagauaaacuguuucggggauauauugauuuagaaauacaacuucgagaauuugaucgcaguagaaaacuuuaugaaaaauuuuuagaauuuggaccagagaacugcgugacuuggaugaaauucgccgaacuugaaacucuuuugggugauauugacagagccagagcgauuuacgaacuggcaguaaaucaaccuagguuagauaugccagaacuuuuauggaaagcauuuaucgauuuugaaauaucccaagaugaaucagauaaugccagacaauuguaugaaagacuucuagagaggaccacucaugucaagguguggcuaucauaugcuaaauuugaauuaaaucaacaaacggaugaugguuuaaauauuaggcuugcucgaagaauuuuugaaagaggcaaugacaaucugaaaaauucaguagagaaagaaagcagagcucuuuuacuggaaaacuggaaggaauuugagcucaaccauggcgaugagucuucccaagcaacaauaaauaguaaauugccuaagagaauuaagcguagacaaaaaguugucgaugaggaugguaaugaacaagguugggaagagauauuugauuauauauuuccugaagaugaaucaagcaaaccgaaucuuaaacuucucgcugcugcaaaaaguuggaaaaaaucugcugcaguucaagacgaagcaguuuag

SEQ ID NO: 5548 - RNA, 1431 nt, Sitophilus oryzae
auggggauaaaauuucuagagguuauuaaaccuuuuuguaguauucuuccagaaauaggcaagccagaaaggaagauucaauucagagaaaaaguacuauggaccgcuauuacauuauuuauuuucuuaguauguugucagauuccuuuauucggaaucaugaguucagauucagcagauccauuuuacuggauccguguuauccuggcuucuaacagaggaacgcuuauggagcuugguauuucccccauuguaacuuccggauugauuaugcagcuuuuagcuggagcaaagauuauugaaguuggugacaccccuaaagaccgagccuuguuuaauggugcccaaaaauuauucggcaugguuaucacugucggucaggcaauagucuauguaaugacuggaauguauggagacccugcagaaaucggugcuggagugugccuguugauuauuauccagcuuuuuguagcugguuuaauagugcuucuccuugaugaacuucuccaaaaaggauacggucugggaucuggaauuucucuguucauugccacaaauauuugcgaaacaauuauauggaaggccuucucaccagcaacugugaacacaggaagaggcacagaauucgaaggugcuguaauagcauuguuccaccuccucacaacaagacaggacaaaauuagggcucuuagagaagcuuucuaccgacaaaauuuaccaaacuugaugaaccuucuugcuacaguuuugguguucgcuauagugauauacuuccaaggauuuaggguggauuugccaaucaaaagcgcuagauacagggggcaguauucuagcuacccuaucaagcuguuuuauacaucaaauauuccgauuauucuucagucugcguuggugucgaacuuguacguaauuucacagauguuggcuguuaaauuucaaggaaauauccucauuaauuuguugggaguuugggccgauguuggggguggugggccagcuagaucuuacccuauaggaggucuguguuauuaucuaucaccuccugagaguguaggacauauacuggaggacccucuucaugcuuuguuauauauuauuuucaugcugggaucuugugcguucuucucaaaaaccuggauugaaguaucaggaaguucagcuaaagacguagccaaacagcugaaggaacagcaaaugguuaugcgaggacaccgagauaacucaaugauucacgaauuaaacagauacaucccuacugcagcggcguuugggggguuguguaucggagcccugucggucuuagcugacuuuuugggugcuauagggucugggacggguauuuuacuggcugucacgaucauauaccaguauuuugagauauuugucaaggaacaaagcgagaugggugguaugggagcucuucuguuuuag

SEQ ID NO: 5549 - RNA, 519 nt, Sitophilus oryzae
  misc_feature (41)..(41): n is a, c, g, or u
auggcaacaaauacuuccccguccaucgauuugaguucuunaacaaauacuuccccguccaucgauuugaguucuuaccgugaucaacauuucaaagguacacgagcugagcaggacaaauuauuaaggcucuccacuacacucuauguagggaacuuaucguucuuuacaaccgaagaacaaauuuaugaacuauuuucaaaguguggagauauaagaaggauuauuauggguuuggauaaauauaaaaaaacuccuugugguuuuuguuuuguagaauauuacacuaggccugaugcugaaaauuguuuaagguauguaaaugggacacgucuugaugauagaauuguuaggacagauugggaugcuggauuuauugaaggacgucaauaugguagaggaaaaacugguggacaaguaagggaugaauacagaacagacuaugaugcaggaagaggaggauauggaaaaauuauucaacaaaaaaucgguacagagguaccagccuuuuuaagauga

SEQ ID NO: 5550 - RNA, 942 nt, Sitophilus oryzae
auggcugccacaguuggacgagucugcggugcuggacuuuuaaaaucgaaaacagggccuuguuugagucagauaagcuccuauuccacgacgagagaauggucgagaggcaaaaaagcacuuuugggaaguuuagguguaauugcugggggagccggagccuuaaucauagcucuggauaagucaguacgagcuucagaacucauacugcauccucccaagaauccauggagucauaacggcugguucaaugguuuagaucaugcgagugugagacgugguuaugaaguuuauaaacaaguaugugcugcgugucacucuuuacguuauguugcuuaccgugacuugguugguguuacacacacugaagaagaggcuaaagcugaagcugaggaacaguuagugacagauggcccagaugaggcaggaaauauguuccaaaggccaggaaaguugucagacuacuucccuaguccuuauccuaaugaagaagcagccagggcagccaauaacggugcuuuucccccagauuugucuuacauuguaccugccagacauggaggugaagauuauauauuugcucuacuuacuggauauuaugaugcuccagcggguguuguuuugagagaaggucaauacuacaaucccuauuucccuggccccuauuucccuggcggugcuauuucuauggcacaagcuuuauacaaugaaguuauagaauaugcugaugguacuccagccacugccagucaacuagcuaaggacauaggaacguucuuaaaauggaccgccgagccugaauuagaagaccgaaaaauaaugacgauucgggccauugguauauucuccauauugauuguucugaguuacuacgccaagcgauucaaguucgcuucauugaaaacgagaaagaucgaguucaaaccuaaagagaaaaaauaa

SEQ ID NO: 5551 - RNA, 1725 nt, Sitophilus oryzae
auguuaucacugcaagcuuauaauaguaguagugaugaagaaucugaucaaacagcaguucaagaaaaaucaaauggaacgccuuacgaaacucuaccgccggaacuccaaaaguuuucaucuaaaaaagaucuucagguuugugcaacccccguagucuuaccccccgcuauagaugaagauaaaauucauauucacccugauacaucagagcuccaguauaacccaaaauaugaugaacuauuugcaccagucguagggccaguaaauccuuuuaagacgcaacaacaagcaaucgaaagaaauauacuaucagggcauauugagccugcacaugucagugaauuucaguuugagaaucaaaggcgaacguuugcuaguuucgguuaugcauuggauccuucaguaaguacuaccgaaaaggaauuacauaaaguaauuggaggaucagaagaaacaccugauucagauaugaaaaccguuuuugaaaauacuaaauugagaccauuagauaaaagaaaaagaaagaaaaaugaugauccaagugauguagaaggauuuuuagguccaugggguggauuuguuggagaacaaagaguaaugaaaccaacagaagaagagcaagccgagcuucaagaacugguuucuaaaagaaauaggcgagggaaagaaguggaagaaaaacaauuugaagaaaaaucuguucugcauauuaaagaugcaguugauuaucaaggaagaucauucuugcacgcuccccaagauguugguguuaaucuuaagucagacacuccaccagaaaaauguuucuugccaaaagcucacauucauaccuggucuggacauacaaaagguguaucugcaauucgaugguuuccaaaaacagcacaucuauuuuuaucuuguaguauggauuccaaaaucaaacucugggaaguuuacaacgaaaggcgauguaucaggacuuauuauggccacagacaagcaguuagagauauuaacuucaauaauaguggacaucauuuccuaucagcugguuacgauagauauaucaaguuaugggacacugaaacuggacguguuauaucgcgauuuacuaguagaaaaauaccuuacugcguaaaauucaaucccgaucauaauaagcagcaucuguuuguagcugguacgucugacaagaaaauuauuuguugggauacaagaucaggcgauauuguucaagaauaugauaggcauuugggcgcuguaaauaccauaacuuuuguugacgaaaacagacguuuuguuacuacuuccgaugacaaaucauuaagagugugggaauggaauauaccaguugauaugaaauauauugcugauccgacuaugcacaguaugccagcuguaacuccaaguccaaaugguaaaugguuagcaugucagaguauggacaauaaaauugugauuuuuucugcauuaaauagauuuaaacuaaacaggaaaaaaacauuuacaggucauaugguagcaggauaugccugccaauuagauuucucaccugaucuuucguauuuggucucaggagaugcugacggaaaauguuuuauaugggacuggaaaaccaccaaauuguacaaaaaauggaaggcacaugaugguguguguauugguucucuuuggcauccccacgaaccaaguaaagugaugacagcugguugggaugguuuaauuaaguauugggauuaa

SEQ ID NO: 5552 - RNA, 828 nt, Sitophilus oryzae
auggugcagaaaaaaccgaagaagaaggucgguaagaagguugccgcggccccccugguuguuaagaagguugagcccaaaaaggagguaaacccucuuuuugaaaagagaccaaggaacuuuggaauuggucaggauauucaaccaucucgcgaucucuccagauuuguaaaauggcccaaguacaucagaauucagagacagaaagcagugcuucagaaaagauuaaagguuccuccaccaaucaaccaguucacacagaccuuagauaagcaaacagcaacacaguuguuuaaaauauuggaaaaauacagaccagaaagcauuauucaaaggaaugaaagguuuaaagcuauagucgacucgaggaaacaggauaaggaauauguuccuagcaagcgcuuguuuguacguuuuggcacaaacaccguaacaaaacugguugaacagaaaaaggcacaacugguagucauugcgcaugacgucgacccaauugaguugguccuguuccuuccagcccucugcagaaagaugggaguaccauacuguauaguaaagggaaaagcucguuuaggcgugcuggucaggcgcaagaccugcucgaccgucgcucugacccagguggauuccggcgaccgguccuccuucaacaaggugguggaggcgaucaagaccaacuucaacgaccgcggcgacgagaucagaaggcacuggggcggcgguuugcucggcuccaagucgucggcgcgcguggccaagcuggagagggccaaggccaaggaacuggcucagaagcaggguggaggcgaucaagaccaacugcaacga

SEQ ID NO: 5553 - RNA, 1005 nt, Sitophilus oryzae
  misc_feature (165)..(165): n is a, c, g, or u
auggcgcuguuacuuaaagauauaaaacuaggagauaauauuguaaaaaaaguuuuguuugagaaacacauagauuuuauaaacgauuacggucaagaugaaaacaacuaugauuacgguaugaccgacuaucugcgagugucaggcauguauuggggcuuaacnuuaacugcuuuggaguugaugaacagugaaccaguacaaggaaaagauaaaauuguugaauauauaaaacaaugucaggauccacaaaguggaggaauuagugcaugcauugggcaugacccucauauacuucauaccuuaagcgcaauucaaauuuuagucauguacgauagacuagcugcaauagauauugaaggcguaguccgguauauucaaggacuucaacaagcugaugguaguuuugcuggagauaaauggggugaaauagauaccagauuuucauucugugcuguuaaugcacugucuuuacugaagaaaauggauguaauagauauugaaaaggcuguugaauuuguagcaaguuguaaaaacuuugauggugguuuuggaucaagacccuuaucugaaagucaugcugguuuaauauauugcuguguaggauuuuuaucuauuacuaauagauuagauauaauagaucaagauacauuagcuuggugguuaugugaaagacaauuaccaucagggggauuaaauggcagaccugaaaaauuaccagaugucuguuauucaugguggguucuuucuucguuagcuauauuaggcagauuacauuggauagacacugaagcuuuaaaaaccuuuauauuugcaugucaggauacagaaacaggaggcuuugcagaucgaccaggugauguagcagaccccuuucauacauuauuuggauuggcaggcuuaucauuauuaggcuaugauaguauacaaaaaguuaauccuacauauuguaugccacaacauguaauugacaaacaggaauuaaaaccacaacgcuugaacuaa

SEQ ID NO: 5554 - RNA, 2682 nt, Sitophilus oryzae
augcaccaagaagcuauucaacuuauacaaguauuagaaaagaccauaucaccggauaaaaaugaauuggaacaagcuucaacauuccuugaacaagcagcagcaacaaauguguuagguuuuauuaaaacauugucggauauuuugagacauggagguaauagcccugucgcccgaauggcugcaggucugcagcuuaaaaaucaucuuacauccaaagauccaaauauuaaagugcaauaucaacaaagaugguugucuuuuccugaagacaucagaucauacauuaagaagaauguggucggugcauuaggaacagaaacaaaucguccuucuucagcggcucaauguguugcauauauagcaguuacugaauugccucagagacaauggccagaucuuauuaguacauuaguuaauaauauacugaaugcaacaucugaaaugcagaaagaagcaacauuggaaacuaucggauauauuugucaagaaauugacugugauguacugguaucucaaucaaaugauauucuaacugcuauaguacauggaaugagagugacagaaacuaguagucaugugcgauuagcugcuacacaagcucuccucaauucguuggaauuuacuaaagcaaauuuugaacaacccacugagaggaacuauaucauggaaguuguuugugaagccacacaaucagcugauacucaaauuaaagucgcugcucuacaauguuuaguaaaaauuaugucacucuacuaccaacacauggagacauauauggcaccugcuuuauuucccauaacuuuggaagcuaugaaaucagaaaaugaugcuguugcuuuacaaggaauagaauuuuggucgaacguaagugaugaggaaguugacuuagcaauugaagauacugaagcucaggaagcuggcaggccaccuucuagagucucgcgucauuaugcaaaaggagcuuuacaguuuauugugccgauuuuauuacaaaaauuaacaaaacaggaagaacuugaugaugaggacgauuggaauccuaguaaagcagcuggaguauguuuaaugcuuuuagcuacauguugcgaggaugagauuguuccccauguuuugccauucauuaaagauaauaucaagucagauaauuggagauuuagagaugccucuuuaauggcguuugggucaauccuuggcggacuagaaaguaauacucuaaaaccacugguugaacaagcuguacccacucuaauugagcuuauguaugauagcagcguaaugguccgcgauacugcagcguggacauucggucguauaugugaaaucauaccugauguggcaauaaacgaaacauucuugaaaccacucuuggaaaguuuaauuacaggacugaaagcugaaccccgaguagcugccaauguuugcugggcuuucucaggucuggcggaggcggcguaugaagcggcaaccugcgaucuaguuggagaagaaaccacucccgaaacauacuguuugucaccauucuucgaauuuauuguucagagauuauuagaagcuacugauaggccugacggagcucaagccaaucuccgaccugcugcauacgaagcuuuaauggaaaugauuaaaaauucgccuagggauugcuauguaacuguacaaaaaacuacuaugguuauuuuggauagacugcagcagguacuucagauggaaucacaaaucaguagucacagcgaccguucgcaguucaacgauuugcaauccuugcuaugugguacuuugcagucaguuuugagaaagguuacaccagaggacgcuccucaaauuucagaugcggucaugacagcucuuuugaccauguucaauucucauaaaacuggagguguucaagaagaugcuauuauggcuguuucuacuuuaacagagguuuuaggagaugguuucuuaaaauacauggacgcuuucaagccgauuuuauaucuuggccugaaaaaucaccaagaguaucaaguuuguggcacugcagugggucuuacuggugacaucuucagggcguuaaaaauuaaggccuugccuuauugcgaugagaucaugacacuuuuguuagaaaaucuuggggagccuaccguucaucggaguguaaagccacagauccucucaguuuuuggugauauugcucugagcauaggaaccgaauuuaaaaaauauuuagacauaguuuuagcuacucuagcccaagcaucccaagcgcagguaaagguugaucguaccgacuacgauaugauugacuaccuaaaugaauugagagagggcguucuagaugcuuacacugggcucauucaagguuuaaaaggcgacaguaacacuccuucuggcgacauuucccucuuagaaccccacauaccguucauuauccaguuuaucacaguuguugcucaagauucugagcauucugauggcaccauggccguagcugcaggcauuauuggugauuuauguguauguuuuggagcacccaugcucccucugcuagauuuggaaccgaucaaugagauguugucucaagguagaagaucgaggguucaacgcacaaaaggccuguguaauugggcaacuaaagaacugaggaaguugaagagucagcaggguggccagaccacggcuccugcggcuaguugguaa

SEQ ID NO: 5555 - RNA, 1503 nt, Sitophilus oryzae
auggaaacgauauuagaacaacagcgacguuaucaugaagagaaagagcgucuugucgauacaaugaccaaggaaaugcuucaaaagaaaaucaguuacagagaacaaauaaauucggaucaucgcaugaaauaccuccuggacagguacaugacuucgacgaaucgucuuaucgaccuguacgaagauaaagauggucaaagaaaagcugaaguggccgcucucacugggcccaaugaauucaaugaguuuuacagcagguugaagcaaauuaaggauuuuuauaggaaacaucccaacgagauuaguguucccaugucgguggaguuugaugaacugacaaaagccagagagaacccaucugaagaaaugucaaauuugguugaguuuacugaugaagaaggguaugggaaguuuuuagauuugcaugaguguuaugaaaaguauauuaauuuaaaaggcauugagaaaguagacuauauaacguacuugggcauguuugaucaguuauaugacauaccaaaagagcguaaaucaggugaauaucggaaauauuugcucugccuuaucgaauaucuuuccugguucgugcaaagaauaaaaccacucaccgaucuggaugcuauacuggaagaggaaguuaauaauacucuaccacagugggagaauggaaauuguccaggauggccaaaagaaacagggucagcuuuagcuaaugucggugcucaucuggaccuaucugcuuucuccaguugggaggaguuagcuucucuggguuuggacagguugaagucagccuuguuggccuugggacuuaaauguggagggacacuggaagaaagggcucaaagauuauucucuacuaaagggcagaguucuuuggauccaucucuaaugacaaaaucaacuaaaggaaaagcuaguaaggacaaggaacuuuugcgucauagagaguuggcuauguuagaagcccagaucuauaaguuagcugauauugucaguccucaaagaggggcaaccaaagagaacgugcaacgcaaacaagcaagaaccgacggagaaagagacgacagcgaaaacgaagaguccgaagaugacagucccgaugaaaaugacgaugacgucccuuacaaucccaaaaaccuuccuuuggguugggacggaaaaccuauaccauacugguuauacaaauugcauggucuaaacauaaguuacaacugugaaauuugcggaaauuacguguacaagggucccaaagcguuccagaggcauuuugcugaguggagacacgcccacgggaugaggugucuggggauaccaaacaccgcccauuuugcuaaugucacgcaaaucgaagaugcucuugcacugugggaaaaacugaaaguucaaaaacaggcggaaagguggcagccugaaacugaagaagaguacgaagacucgcaaggaaacgucgugaacaggaaaacauacgaagaucuuaaaagacaaggccuacuuuaa

SEQ ID NO: 5556 - RNA, 633 nt, Sitophilus oryzae
augacgaucggcaaaaacaauaagaugauccagcacaucaacuaccgcguucgaauuacgcuucaggacucucggacguuuaucgguacuuucaaagccuucgacaaacacaugaacaugauuuugggagauugcgaggaguuucgcaaaguaaaaccgaaaaauuccaaaguagaacgggaagagaagagaguacuaggguucguacuucuucgaggggaaagcauuguuuccuugaccguugaaggcccaccuccacccgaggaagguuugccaagaguaccgauuccuggagcaacuccuggaccaggaauggggagagcagccggccgugguaugccugcaggcaugagcggagucccuguagggcuucaagggccuguuaggggugucgguggacccucgcagcaaguaaugacuccgggaggaagaggucaaguaucagcgccaccucaaaugaaucacggcccaccuagaauggguauuccaccacccggcaugauggggggucccccaccaggcaugaugccaccuaacgcuauggguaugggcaggggggguccaccaccaaugggaaugagaggucccccaccugguaugaugagagggggaccaccacccagaggauacuaa

SEQ ID NO: 5557 - RNA, 996 nt, Sitophilus oryzae
augucugugagaagcuuugaugaacuuuauggccuucugcgcgaagacuuacagaaaaauaauaccaacaugcggguugcgauugguccaauugaaagacuuguaauuccauuaagguaucuugcaacgggagcagauuuugcagcuuuggaauauguauuucagguuucgaaaaguacaaucagacuaauuguucggcaaacuuguguggcaguauggaauaaaaugcagccguuggaaaugccacagcccgaugcggaauuguggacgaaaauagcagaagaauuuuacagaaaaaguaauuuucccaauuguuugggagccaucgacggcaagcauaucagacuuguuugcccuccgaauacagggacgcaguauuuuaacuacaaaaaauauuucucgauuguuuuauuggcaguaagcgaugcagauuauugcuuuaccgcaauugacgugggagcuuacggcagagaagcagauaguaauauuuucaaaucuucaguuuucggucgaagguuggcacaaaagaaucuugaucuaccaggaaacagaccgcuuccaaacaccccaaauauuucacucccucauguuuuuguagcugaugaagcauuugguuuaggugaaaacgugaugagaccuuaugcacggaauaaucugucaauugaaaagagaguauuuaauuaucgauuaacucgagcucgcagauauguugaauguacuuuugguauacucgccaacaaguggagaguauuucacacaaauauacugguuucggaagauuuugccacugacguaacaaaagcugcuuguuuguuacacaauuuuguacgaagaagagauggaguugaaucaaacgacgaaucgaguugccugauggaaaacauuccagcuauuggcacaggagggccgucugccgguauugcgauuagggaaaaauuuaaagauuauuuuguaagccgagaaggagaacuuuuguaucaguaugacaaaguguaa

SEQ ID NO: 5558 - RNA, 576 nt, Sitophilus oryzae
augcagggucguacaaaaaaauacaacauacuuaauaucacagauucugcggaaucgccagaucaagaugcaacuaccgaaccuucuacggagcccgaagacgaagagcugacacaaccuuuugaagaaucugaaguaguuguuauagaucaaccuguuaagucaccagaggagcaaauaucaacaaaagaggacuuugaagaauuaauagacgaagguucgaggaaagaaaaacuaaugaaaccugauccuaaacaaauugcagauuuucacaaauacgcagcaccgacaaacguguucaguuuuccaccuaaagcgcaggccacaauuagacccgcuaauguuauuggaccgaauacgaaaaugccucagaaaauuucgcucauuacuaccccgaucauacagaauuuuacaaauagaucugacgguucgaagccaacuuuggaaacccaacaauuaauuuuaacaccuacaacaaaaauaaacaccacagcagcaucaaaauugucaucucaccacaucauucucacucauaauccaguaagaaguaacauaauuagugucgggcccaaaauc

SEQ ID NO: 5559 - RNA, 2067 nt, Diabrotica virgifera
auggaacguagucgaaaacaaagagaucagucaauuucaaauaguuccgaggauaguaauaaaaaaaagcaauauuccaaacauucaaaaggaaaagaaaaauaucgagacacacgggauagaaguagcgauaaaagcaaagaaaaacguaagaaaucaaagaaaaagaaaaaaagauccaggagcaguucugaggaauccagcucgaacagcgacagcucugauaauucaguaaaauugcuggaaaagcucacaaaagaaagaauuagacuuggagaagaaaggaagaagcaaaaagaacuaaucaaagcuacugaaacagcagaggagaagagaaugaggcggcucguaaagaaggagaacaaagagagauccaggaaagagagaaugggcugggauaacgaguauuuacauuauacaaacagugacaauccuuucggggauggaaacuuguugucuacauuugugugguccaagaaguuaaacaaagaaggauugaaagguguuagucaagaagaaaucgaagcaauaaacaggaugaaacaagaagaaaacaaaagagaacuggaaaaaguaaaaaagagacgucuagaaagggaauuagaaagacagaagagggacgaagaaacccagaugcuccaaagaagcaaggaagcagcacaauuugaagagugggagaggcaagaagauaaguuccaucuggaacaagcaagacugagaucacauauaagaauccaagauggcagagccaaacccauagauuuguuagccaaauauauaagugcggaagaagagguagaugcuguugaaaugcaugaaccuuacacauaccuaaacgguuuacauaucaaagauuuagaagaucuaguagaggauauuaaggucuauaaagaguuagaaagggggaaaaauuuggauuauuggaaugauauaacuguaauaguggaagaugaguugcagaagcuuaggaagcuggaaaaacagaaugauuuugauuuagguuugaauagaagagaagguauacaucagucaguagcuggagauguuacuucuguauuuaaagguaaaacggcuguccaguuagcagcuuuggaaaagcaaauagagggaaaaauuagcggcaaagcugaugguauugauauagguuacugggaaucucuguuaucacaacuuaaagcgcacauggcuagagcaagacuacgagauagacaucaagaaaguuugaggagaaaacuucaagucuugaaagcugaacaagccaucauuguaacagcuccaagugaaagucauuccaguggaggcgaggaagcuccaacgaaagaugugcaagaaccaaagccugggccuucucaggaaccuggugauaaggaaaauaaugaggaggaaccugcagaugaggaagcagcuaauucauggcugaaugaguguuuugaugccuaugaagcugguggauauagucccaaguuucuuacuccugacgaaauagaaccaggaacuauuguuguuauagaagaagaugaucugaaaagauuggaauuugcaagaauucagguugucgguaaagguaagacuguggaaaauguuauaacgaaggaggaguugaugcuacaaaaagaggcucguaaaggcauggauggagacgaggcacaguucucuguagagcaagcuuuggacagccaagucuaucuuugguccgacaaauaccguccuaggaaacccagguacuuuaauagaguacacacuggauucgaauggaacaaauacaaucaaacacauuaugauauggacaauccuccuccuaaaaucgugcagggauacaaguucaacauauucuauccugauuuaauagacaaaaguaguaccccagaguauuuucucacuccuugcccagaaaauaaagaguuugccauauugagguuucaugcugggccuccguaugaagauauugcuuucaagauugucaauagagagugggaguauucguauaaaagaggguucaggugccaguuucacaauaacaucuuccaacugugguuccacuuuaaaagauauagauauaggagauaa

SEQ ID NO: 5560 - RNA, 1263 nt, Diabrotica virgifera
auggacaacuuagaaaccaauauuauggauaagucgaugagaucagucuucguggggaauauuccauaugaagcaacugaggaaaaauugaaagauauauuuggcgaaguuggacaaguacuaucuuuuaagcucguguuugaucgugaaacuggaaaacccaagggauaugguuucugugaauauagagaucaagaaaccgccuugagcgcaaugaggaauuuaaacgguuacgaaauaggcggaagaaauuuaagaguggacaaugcuuguacugaaaaaucuagaauggaaaugcaaaaucuccucaaccaaccuccaguagagaaucccuauggagaggcaguucaagcugaaaaagcuccugaggcuauaaguaaggcuguugcaucucuaccuccugaacaaauguuugaauugaugaagcaaaugaagacaacuauucagaauaauccaacagaagcaagacagaugcuuuuacagaauccgcagcuugccuaugcucuuuuacaagcucaaguuguaaugaaaauuauugacgcagcuacugcaguuaguuuacuucaucccgugaaccaagugccagcgacacuuaugccuggagacaagaauguuccuguccaaguaccaguuaauaaucaguacagggagccuccagcaccuguucaaccgccuguccauccaagacaagacuuccaaccuguuccuccuccuguuaugcauccaucucaaaaucaaguauuuccaagucaagauauagaucugagauccauugguggugugccagaucuaagaaaccuaagacccaugggugaccaggauaugagacaaaugccaucugcuauucaaaaucccuuaccaccaacuaucggagaaagcuuuauucgagauccuagagcagcgcaggcguuugcaggagauccaagacaagcacgcauggauccacgucagaaacccauggugccuccuccucaaagccaaaugcccauaccaccuccaaucgcaagaccaccuguaaugccgccucagccucaaguuccugugacgagagcagcaccuccaccucaaccgucuccagcuccuacuccugcaacggccaguccaaauguugcaaaugcuggggcuucggaucaagaaaaggccgcacucauuaugcaaguauugcagcugucagaugaacagaucucuaugcuuccgccugaacagaggaauaguauuuugguauuaaaggaacaaauugcaaaaagugcacacacacguuaa

SEQ ID NO: 5561 - RNA, 1179 nt, Diabrotica virgifera
augacccaaauggaccccgaacgugaaaaaagccuucaagaguacaggaaaaaauuauuagaacacaaagaaguugaaucuagauuaaaagagaugcgagagcagcuaaaagaucuuacaaaacaauaugauaaaucagaaaaugaucuuaaggcuuuacagagcaugggccaaauaguuggagaaguacucaaacaacucacugaagaaaaauuuauaguuaaagcuaccaaugguccccguuaugugguaggaugucgucgucaacuagacaaggcaaaguuaaaagcaggaacuagaguagcauuggauaugacuacauuaacuauuaugagauauuugccaagagaaguggacccauugguguauaauaugagucacgaagaucccggagauguuacuuauucugcuauuggugguuuaucugaacagauuagagaacuucgagagguuauugaacugccuuuguugaauccagaauuguuuaugagaguuggaaucacuccaccuaaagguuguuuguuguaugguccuccagguacuggcaaaacucuacuagcuagagcuguagcaucucaguuagaugcaaacuuccucaaagucgucuccagugcuauuguugauaaauauauuggagaaucugcaagacugaucagagaaauguuuaacuaugcuaaagaccaucaaccuugcauuauuuucauggaugaaauugaugcuauuggugguagaagauuuucugaagguacuucagcugauagagaaauccaaaggacucuuauggaacugcuuaaccaaauggaugguuuugauucauuaggacagguaaaaaugauuauggcaaccaacagacccgauacucuagauccugcucugcuccguccaggucguuuggacagaaaaaucgagauaccucuuccaaacgagcaagcccgucuugaaauuuugaagauccaugcccucccgaucgcuaaacauggagaaaucgauuaugaagccaucguaaaauuaucugacacauucaauggagcugauuuaagaaauguaugcacagaagcuggacuuuuugcuauaagagcugaacgagaguauguaauccaagaagacuuuaugaaagccgugagaaaaguggcugauaacaagaaacuugaaaguaaauuagauuauaaaccuguauaa

SEQ ID NO: 5562 - RNA, 777 nt, Diabrotica virgifera
auggcucgucgauaugauaccagaaccacaauauucucuccugaagggagguuguaucagguggaguaugccauggaggcuauuucucaugcagguacuugucugggcauuuuagcaaaugauggaauuuuguuggcugcugagaggcguaacacuaacaaauuauuagaugaaguuuuuauuucagaaaaaauauacaaacuaaaugaugauaugguuuguaguguggcuggaauaacaucagaugcuaauguuuuaacaaaugaauugagacuuauaggucaaagauauuuauuucaguaugccgaaucuauuccuugcgaacaguuaguuuccuggcuuugugaugucaagcaggcauacacucaguauggagguaaacguccauuugguguuucaauauuauauaugggaugggauaaacauuauggauaccagcuauaucagucagaucccaguggcaacuauucugguuggaaagcuaccugcauaggcaacaacaguucagcagcaauuucaaguuugaaacaagaauauaaagaaggucaaaugacuuugaaggaugcaaagacguuagcaguaaagguucuggcaaaaacauuggauauggcaaaacuaacuucagaaaaaguggaaauggcuacacuuacccgcaaaaaugauaaaaccaugauuaaaauuuuaagcggcaaggaaguagaagaacugauuucagaguaugaaaaaagugaagcugccgcagaagcuagcaaaaaagagcagaaggcaucagcuuaa

SEQ ID NO: 5563 - RNA, 2670 nt, Diabrotica virgifera
augggcgauacaaagguagaaccuacaaagguggauaaaacaaaggggacugaggacaaaaacaaaaaugaacugucggaagaagacaaacagcuucaagaugaauuaaauuuguguguugagaaacuccaggauaacgaugaaaagagauaccuacuugcuuugcaagcuuuaucaaaucauauucaagccucaacuacuucgaugacuucuguuccuaagccguuaaaauuuaugaggccccauuacgaaaccaugaagacaguacaugaaaaaauuacugauccugauacuaaaaaagucugugcagauauuauaucuguuuuagcuaugacaaugggagaaggcagagaauguuugaaauaccgucuucuuucuaauuuggauaaaauuggcgaauggggacaugaauauguuaggcauuuggcaggagagauugcaggagaaugggccgagacugauuuuauagugaacacugaaauuagggaaaaacuuaucuuacuaacaaaacaaauugugccauauaauauggcacacaaugcagaagcagaagcaugugacuugcuuauggaaauugaaaggcuugaucuacuagaacaguauguugaugaaaacaucuaccauagagugugcuuauaucucaccagcuguguacccuauguggcagauccugagaauacuacucuacugcagacugcucuuuuacuguuuagaaaguuugaucaguauccccaggcacugagauuagcaaugcaguuaaaugacuuuggauuaauugaagaaauuuuugucaacugcccagauucggacguacaaaaacaacuggcauuuaugcuaggacgacaacagauauauguugaaauuccugagcauacgccugaauacgaagaucuaaucgagauaauggcaaacugucaucuuaauaaccacuucuugaaccucgcucgcgaguuggacauuauggauccuaaaacccccgaagacguuuacaaaucccauuuagaaaauagucguccuccauuugguggaaaccaaguugauucagccagacaaaacuuagcugccagcuuuguuaacgguuuuguuaaugcugcuuuuggucaagauaagcucuuaauggaagaugggaauaaauggcuuuacaaaaacaaagaacauggaaugcuuagugcuacugcuucuuugggacuaauucuuuuaugggauguagacgguggucuuacuccuaucgauaaauacuuguacucuucugaagaccauaucaagucuggcgcuuuauuagcuuguggcauuguaaacugcggugucaggaaugaaugugaucccgcacuugcacuuuuaagugauuauguucuucacaacacaaacauaaugagaauaggagcuauuguaggucuagguuuagcguauguugguucaaauagggaagcaguauuaucucuaaucacgccugugcuaucugacccuaaaucaaauauggaggucauuggaauggcggcucuagcaugcggaaugauuucugcaggaucugguaacucacaugugacaacaucaauaaugcaaguucuuauggaaaaguccgaaauagaauuaaaggacacuuacgccagauuuuugccucugggucuuggauugugucauuuagguaaacaagaaagcauugacacaauuauagcagcauuagaaguuauaccugacccuuucagauccauggcgacuacuauggucgauauuugcgcuuaugcaggcacaggaaauguuuuaaaaguacaacauuuguuacauauauguucagaacauuacgaugcuccugaaacuccugacaaaacuucaaaggacaaagauaaaaaagaagcagagaaagaaaaagauaaggaucuuucagcuagacaagcuauugcgguuuuggguauagcuuuaauuagcaugggagaagacauugguagcgagauggcuuuccggacauuuggucauuuacuaagauacugcgaaccagcgaucagacgugcuguucccuuagcccuaggcuuaaucucaguuucaaauccaaaauuaaguauucucgauacuuugaguaaauuuucacaugauagcgaugcugaaguggcucauaaugccaucuuugcgaugggucuggugggagcugguacuaacaaugcaagguuagcagcuaugcuaagacaguuagcacaguaccaugccaaagaucccaauaauuuauuuaugguucgcaucgcccagggucucacucaucuuggcaaaggaacuuuaacucucaguccauuccacagugauaggcagcugaugaguccaguagcuguagcuggucuaauggcgacacucaucggcuucuuggauguuaaaaacauuauauuggggaagucacacuacuuacuguacaccuuagcagcugcaaugcaaccaaggauguuagucacauuugacgaugagcuaaauccucuaccagugccugucagaguuggauuggcaguggauguuguuggccaagcaggaaaaccaaagacuauaacagguuuccaaacccauaccacuccugugcuucuggcuuauggugagcgcgcugagcucgcaacugaagaauacauugcauugacgccaauuauggaaggauuuguuauuuuacgaaaaaauccugaauuuaauucauaa

SEQ ID NO: 5564 - RNA, 1557 nt, Diabrotica virgifera
augacugauaacgagauggacucgaaggacgagcagaagccuucaccugaagaaguuaaaccaaaaauagauacuucagacacagacucucaaccaccucagauuuccguuacuucuggcggaggugugauacgaagaaauuuuauaacuacagcuggaaccauagucgaaacaaacgaagaacagccgccagaacccaccaccgaagagauuguuaacacagaaaauucaacuccacaggaacaaaguccuguggaacauaaaauugagccaacagagacaacaacuuaucaagaucugcgcauggaaacgcaucaaagggaacaguuuacggaaccaaaacaguacacaguagaaaugccagcagaaagcuucucaggacaaaacuuuucacaggauaucgguuacaccaguaauauagcuacuguuaauauagaagguaaugaggugccuauaacgauaucuucggaaauagaucaacccggaggugauuauacaagucugcagacagcccaauacaauaacgguuauaccgacgguccacaguauuuacaacaacaucaguaucaaaauuuauacguugacagaggcaguguugaaaauucaccuccagcaacuuuauuguuuaaagacgaucccaauuuagcaacagcuagauauccgacaaacuacgacguaucuagcagucaaucgcagcugaaucuucuuccaaaugacaccuacuucaccacaacagccaauugggcuucaacgagcaccggauccuaccaacaacaauacagcaauaccaucaacauccuucaccaagcggacaguacgcagucauauggaggaggucccuacgugaauacagcauggucauccaguccgauggaggauggacguccaccaagccaagagguacuagucaaagagugcgugaauuguggugcuaguguuacaccccuuuggcguagagacgguaccgggcauuaucuauguaacgcgugcggguuauaccacaaaauuaaugggguucacagaccuccgauuaggccuucgaaaaaaccacaggcgacaggaaacagaagaaaugguguuucaugugcaaauugcaaaacaaacaacacaacacuuuggcgaagaaacaaucaaggggaaccaguuugcaacgcuugcggucucuauuuuaaauugcacgggguuaaccgaccgaugaguaugaaaaaggauggcauccaaacacguaagagaagacccaaaaacuccgguggaaauccuggcccaucuggucaagucaggcuugguaacaucuaccaauaucaacaugcuccagaacuugaaauacaacaggacaccuaccaguugccuauuaauguauauccuucacccacucaaggaccuuacagacaauacgcugcugagaaucuucgaggcuuaaaugcucagccauugcaaccaauuauuaccacagaugacgaacagacaagcgucauaacaucuaccucacaacaagcacgguuucgagucgauacagaagaggacgaugguaguaacaacccaccugccaaugcuuag

SEQ ID NO: 5565 - RNA, 4908 nt, Diabrotica virgifera
auggcacuuccagggaacgggauauuugucgucaaaggagaaaucuccaacaugauggcggcuaugaaaagaggaacaagguggucgucucauucuuaucaggacgaugauguagauucauuacuaagaaacuuucaagaacuaagagauauucuagacaauguagacgacuuaagauucguagaacccaacacauuuuuggcccccuuuuugaaugucauaagguccgaagaaaccacugggcccgugaccagucucgcccuaucagcuguuaauaaguucuuguccuauggauuacuggaucccuugcaugcaucuaucccucaaaccauccacaguauagcagaugcagucacccaugcccguuucguuggaacagaccagucgucagauggaguaguucucauaagaauauugcaaguccuaagaacucuaacauuaucuccagaagguaccgccuuaacuaaugaaagccucugugagauaaugcugucauguuuucgaauaugcuuugaaacaaggcuugucgaccuauugagaaaaacugccgaacauuauuuaaaagaaauggugcaauuaauuuuuaugagguugccgcaguuuagugaggaucucaaaguuucuuacauuaaacaguuaaagaugaaaccuggagcuuuagaucaaacacguacuaagaggaaaaagcaguauucuucacuuaaaaaagauaagagugacacugacauuaagucuccccaaaccccacaagguaaucuugcagcaguagcacaaaguaguauaguagauaugcaagguuccuugcaaaauccugaaaacgcuaacccuguaaccucaaaugcuaguccaaaagaaaacuucaagugugauguagauaucauuguugauaguccuguuaguaauaaugaagaucuaaaaaauaucgauucuauaucgucugguguagaagaggcagcaacagaaccuaaaucacuuacugaagaagaaauuacagaagaacagaguccgaguacucaagauuacauaaaucagagaggcauaagguuuacuccacaauugcagcaagaagcuaacuuaucacccuaugguuuggcauguguaagagaauuacugagauuuuuaauaagccuuuguaacccucuugauaaacaaaauacagaaaucaugauccauuuagguuuaacccuuuuaacaguugcauuugaaauaagugcugauaauauugguaaauauaacacuuugcuagcuuuaguaaaggaugauuuaugcaggaaccuauuuucucuuaugaauaccgaaaggcuagcaauauuuucauuggauuuacaggugucuuuuuuauuauuugaaucauugaggacacaucuuaaguaucaauuagaacacuaccuaaagaaauuaauagaaaucauccucagcgauucucccaaaguaaccuacgaacacaaggaaauagcauuagauaauuuacuucagcuguggcgaauaccaggguuucauaccgaacuauauauuaauuacgacugcgauauguacugugcgaaucuguacgaggaauuaacuaaauuguuagcuaaacauucaauaucuucuaauacuggaguguaccauacacauuuguuaucuuuggaugcacuuaugauaaucacugaagggauugaaaaccgguguugugaagaaaaagauagguuagacgcaggaaauagcgaauugguucaacaaucaaaugacauuagcuucuaugucggaaaaaauucuagaacuaaaguuucuccaaucaugccaaagaaggaggaauuagcucaaaagaaaaguauuaagaaguggcuaccgcaagguaccgaauacuucaacaaaaagccaaaaaagggcauagaauuucuucaagaacacggaguauuaaagcaggauaucgauuuggaugaaaucgcaagauuuuuaagggaaaauccaguucugaacaaggcuaugauuggugaauauauaaguaaucgaaguaauuugaaaauucugcaauccuucgucgauacuuuuaauuuugucggagugcguaucgaugaagcuuugagagcuuuucuagagacuuuuagguuaccaggugaggcacccacaaucucccugaucuuagaacauuucgcagaaaccuggcauaaagccaacaacgaaccuuucgcagauguggauucggccuucacuuuagccuaugcgauaaucaugcucaacgucgaccaacauaacgaaaaugccaaaaaacaaacgacucccaugucggcuaaugcuuucaagaaaaauuugaaaggcguuaacggagguaacgacuuugacgaagaaauguuagaugauauauauacaacaauaaaaaacgaagaaauaguuaugcccgccgaacaagccggguuaguuagggaaaauuauuucuggaagaucuugcugagaaagggacagacgaaagauggcaucuacauccaugauaauagugguacuuaugauucugagcuuuuccagauuguuuauggaccuauaguagcagcucugucuucuguuuacgagaaggcugaaaacgaaaguguacauaaaaaaguuaugcaaggauucgaaagaugcgccuuuauugcugcaaaucucaauauaucuacaaauuuggauaugcuuauucuaggcauuuguaaauucacuguguucuacaaucaacagaaacagaacaacauuguggugcaauuuggaaugaacagcaaggcucaguuggcacuuaggacgguauuuucucuaauucaucaacacggaaacaccaugagggagggauggaaacauuuauuugaucucuuguuagcgcucuauagcaacggacuguugucaaaaacguuuguagagguagaagacuuuauugaaccaaguggcaaauuaaugcuagucuacaaggaagcaccaucugcggcgaagcaggauaccgguuuacugaguucucuuuacucauacaugguuuccgcggaaaaucuaucaaaaauaccgacuccagaagagcaaaacuguauagaugcugcuaaagaauguauaaaagacuguaaucuagagcaaaugauaaccgacuccaaguuucuccacgaagaagcucuguuugaacucguaaaaaccuuaauagaguuaucuagagggccggauguacacgaaaguguggcuuaugacuacaaugauaacguuaccguguucuucuuggaguuauugaucaaaguuguuauacaaaauagagauagagugaugacaguguggcagaaugugagggaucauauauacacuuugguuaugaaugcaucuguuuucgauuuccaguucuuguuggagagaucuguuauuggucuauuacguauugcuauccgucugaugagaaaugaagaaaugagucauauaguucuucagucuuuaagaaugcuacugcuuuuaaaaagcaguacccuuucuaggauaucccggcaaauaucauuugguuuauacgaacuucugaaaacuuccgcacaaaacauucacaccaacacugacuggacuauuauuuucacgcuuuuggaaugugugggagcaggggcucaaccaccuaagccuguuaguucagccgaagauacagaacugaaaaguaaaucugacggugaaacuuccgauaaccacgaggaagagggcacccuuucagauucagaaggaaggaagaguccgaaagauaauacccagagaucacaaaguccugugaguguuguaacuucgccuguuggaacuccaaauacagguggauggauuuugguaggcaacgaaggugaaauucaacccgucaugggccgcaccgucccuccaacacaauacggccuagcuuuagagaagaaccuuggaagccaugaccccagaaguaugaugaagugcugcgaaagucucgcguuucuaguaagagaugucgcccacauuacaccguacaauuuugacguuuguguucauuguauaaggacuuuuguagaagcuagcuuacaugguucuaauuucaaaagguugagagauucuaggucuagaaagaaaacuuuagauaggacuagaacuagaaaaaguccgacaaguagucccgaugaggaagauagugacgacgaaaacauuccaagugguuaucaccaaauaucaauacaauuauuagauuuaaugcauacuuuacauacacgaacggcucagauauucaaauggugggcugaagaagguggugaaauaucgcaagaaacuucucuuuggacgcaaggcuggugcccucuucugcaagguauagcaagacugugcugugauacgagaaggccuguaaggaugagugcuauaacguaccuacagagagcgcuacuuguccaugauuuacaaacuuugagugggucagaaugggagcaauguuuccaaagaguauuauuuccuuuacuuaguuaccuguuacagucaauaaauccuaaagaugccauaucgauggaagaaacuaggauaaggguagcaacuguguugucgaaaguguuucuacaucaccuuacuccucuauuagcacuucccaguuucuuuaaucuauggcuggugguuuuggacuuuauggauaaauauaugcaugcagauaaaagugaacuucuuuacgaagccauuccagaaaguuuaaaaaauaugcuucuggugauggauucugcuaaaguuuuugacggucccgauggaaagaacauucuauggaaugccacuugggaaaggauagggaaauuucuaccuaacaugaaagacgacuuauuuaaggaaauagaagaccaaaauagaaaaaacgaagaaguuaguaacauagagauaauagugaauaaagaagaaaaagauguaaauacagagaaauugacuacuaacgauaaccuuauuacguguuag

SEQ ID NO: 5566 - RNA, 618 nt, Diabrotica virgifera
auguccauucuagcuuacaaugguggugcuaugguggcgaugaagggagaaaacuguguagcaauugcagcagauaggcgguuugguauucaagcccaaacaguagcuacaaauuuccaaaaaaucuuugaaaugggaccacauuuauaugugggucuuccaggauuagccacagauacccaaacaguuauggaaaaacuccguuuccgaaaaaacuuguacgaacuuaaggaaaaucgaaaaauaucuccaaaaguauuugccucuaugauaucaaauauguuguaugaaaaaagauuugggccauuuuuuguagaaccuguaguagcuggacuucuaccuaauacuuaugaacccuuuaucuguaauauggauuuaauugguuguauaaaccaaccuucagacuuuguuguugguggaacagcgucagcacaguuguaugguaugugugaagcacuuugggagccuaaccuaggaccugaggaucuuuuugaaaccaucucucaagcucucaucaaugccuuugacagagaugccauuucugguuggggagcuacaguguacaucauagaaaaaaauaaggugacuguaaaaaauuugaagacacguauggacuag

SEQ ID NO: 5567 - RNA, 2808 nt, Diabrotica virgifera
auggaucagaaaccagauuuagaucuggugauaucggcaguuucagcguuguacaauaacccuaacagcagugagaaggaaagggcuucuaaauggcuuuuggaacuccaaaaauccguccaugccuggacuguagcagacgaauuauuacauuuaaaaagggacuuggaaucauguuacuuugcugcucaaacuaugaggacgaaaauccaccagucuuuccacgaacuuccucuagaagugcacacgucauuaagagauucauuacuugaacauauuggccaaauuaacgaagcaacuaacacuguuauagugacacaauuguguguugcuuuggcagauuuagcccuacaaaugccauccuggcagaauccuacguuagaccuaaucaauagauucucccaaacuaauauauggccauugcuagaaauuuugacuguguuaccugaagaauuggaaaguagaucugucaggcuaggugaaaacagaagaauagauguguuagaagagaugaaaauuucugcuccaacagugaaugaauuuuuaaaacauuguucuaaacucuacgaaacuaauuggcaagagcauguucaguucaauguaaaaguauuacgcugcuuuacguccuggaucucaguaggagcuauuagucugaaugaucuuucugauaguauuguuauuaacagagcauucgagauacucaacuucaagccucaaaaugauaaacauaccauaucagcugccuuccaugaggcugccacugacugcauuuguacucuuuuacuaagucuugaaaacaacaauaaccaacucgguuuggaaaauuaccucuucaauaauauuaucaaccuagauguaccuuaucaccuuucuguugcgaaugaggaucaaggaaaaucuauggacuacuguagacuguuuacagaacuggcagaaucauuuuuagaaaaaauuauagcuaauaguaauacaaaacagaugcacuaugcuauuaaaauuuuagaucuaguuuuaauguguguuggacaccaugacuaugagguagcagaaaucacuuuuaaccuuugguauguuuuaagugaagaauuauaccaaaaaaauaacaaagaaaagacagaacuauuccgacccuauguagaacgauuaauaacagcacuauguaggcauugucaaauggagccagauagcgaaggguuguuagaagauggagaugaauuuaaagauuuuagauugaagguagcagaauuaauacgagauguaguuuucauagugggcaguagugccuguuucaaacaaauguuuauuaauauacaagguccaggaguuaugugggauuccaccgaggcagcucuguuuguaaugcaagcuguugcaaaaaacguaauaccuggugaaagugaagugguaccucaggucguagaagcaauauuaaauguuccagaaaauacacauguagccguaaaauacacgucggugcuuuugcuaggagaacuuugugaauggauagagaggcauccaaacacgcuggauccaguuuugaacuuuuuaguguguuguuugccucaaccuggaguaggagcugcugcggcuguggcccuucaaaacaucugugccaguuguaacgaucauaugccaagacacgucccaauacucuuacagcuucuucaccaagcugauuccuucgccaucaccaacacagcaaccuugggucuucugcgaggaguggcuucgauaauaggucgaaugccgcacgaggaguugacgacggcuuuacgggaauuauguucuaugcagcuuaauccgauaugucaaauaauagaacaggauguucauccggugaaaggagcccaaacggauccaguaauguggcuagauagacuuagugcggugcuuagauauguuaauguacauauuccggaagguguggaaaacccuuguaaaccgguaauucucgaaguguggccgguauugucucgcacguucgauaaauuccaaagugacauuaggauaauggagagauguugucgugccgugcguuucaugcugcggugcgucgcgcaagaagugcgugaacucuuagaaagccuaguuggacaaauagugaggaucuauacguuauaccaacauucguguuuucucuaugucgguaguauacucguggacgaauacgcaauagauccgauaugcgugccaggucugcuggauaugcugcaagcguuucuggaaccuaccuuccacguguugcaggaggagaacgggcugaagaaucaucccgauacaguggaugacuuuuuuagguugugugcaagauuuaugcagagggcgccuuuagcauuuuuaaaauguucuuccuugguccacaucuuacagugugcccuuuuggcuucuucccuggaccaccgagaagcgaauaugucugugaugaaauucuuuuacgauuugauaaaccagggccagagugggagagcugaucccgaauucaaucaacgacagauguuaguuaaaagcauccucgacgaguauggccaacaacuagucucaaaucuaauccauucuugugucuucuaccuccauuccuacaugcucagcgaagucggcgacguauucgugcagcugcucgauuucgacagagagaucaccugcaaauggguagcggcuggucuugacguguuaccgaagaacaguaccggcggcaucauggccgccacaccucaacaguugacggauauacauaccacuauuagcaggucgaauacuuccaaguccguaacacaugcucucaaggaucuagccagguuauaccguuaa

SEQ ID NO: 5568 - RNA, 1506 nt, Diabrotica virgifera
auggcucagcgguuucccggcccugugccaaaucaaaguccaggaggaccgccuccucagagauaucaacaacagcccccuaaucaaggaauucggcaguaugcacaacaaaauuucccucaaagaccuggauacaauccuccaccaccaaauauaccaucuaguggcgguacgaugauucaaagaccugcuggugcucccuauucaccaaugagagguggaauuauuccgccacagcaaggaaauaaaaggccugcagacaauaggacucaaaugcaacagaaaaguaaugaauacagccauaguacaaguaagaagaagaaaaagcuggcggauaaaauccugccacagaaagucagagauuugguuccagaaagucaagcuuacauggaucuauuagcauuugaaagaaagcuagacucuacuauuaugagaaaaagauuggacauccaagaagcucuuaagcguccgaugaagcaaaaaaggaaguugagaauauuuauuuccaauaccuucuauccugccaaggaaccucagccugaaggacccgauggaccaugucaggaaggcacuguugcaucuugggaauuaagaguagaaggucgucuuuuagaagauccaaagaacgauccaaauaaaguuaaacgcaaguuuucuucuuucuuuaaaucucugguuaucgaauuggauaaggagcuguauggaccggacaaucauuuaguugaauggcacagaacccuaaccacccaagaaacagaugguuuucagguaaaacgcccuggugacaagaaugugagauguacuauuuuguugcuucuugauuaucaaccucugcaguuuaagcuugauccuagacuagcuagacuuuugggaguucacacucaaacuagaccggucauuauuucagcuuuguggcaguacauaaaaacucaucgcuugcaagaugcccaugaacgcgaguuuaucguuugugacaaguauuuggaacaaauuuucaacuguacccguaugaaauuugccgagauuccucagcgucugaauccacuauugcauccuccagauccaaucgucaucaaucacgugaucuccguagaaggaggggccgagagcaaacaaacugcuuguuaugauauugauguagagguugaugauacauuaaaaacccagaugaacaauuuccuauugaguacagcuagccagcaagagauucaaggacuugaugcuaagauucacgaaaccguugauaccauuaaucagcuuaaaacaaauagagaauuuuuccugagcuucgcuaaggauccacaacaguucauucauaaguggauugugucacagacucgugaucuaaagacgaugacugacguggucggaaauccagaagaagagaggcgcuccgacuucuucuaucagccuugggcacaagaagcaguuuguagauauuucuauacuaaggugcagcagaagagagcagagcuggagcaagcucuugguauucguaauaauuag

SEQ ID NO: 5569 - RNA, 435 nt, Diabrotica virgifera
augccaaaaguacgacgaaguaagaaaccuccaccugaggguugggaacugauagaacccacauuagacgaguuagaacaaaaaaugagagaaguugaaacacagucacaugaggguaaaaggaaaaaugaaucauuguggccaauuuucaaaauccaucaucaaaaauccagauauauauuugaucuuuuuuauagaagaaaagcaaucagcagggaacuauaugacuauugucuuggugaaaacauugcagauaaaaauuuaauagcgaaguggaagaagcaaggauacgagagucuuuguugucuaagauguauucaaacgagagacaccaacuuuggaacaaacuguauuugucguguaccuaaaucuaaguuagaagaagggagaauuguugaaugugugcacugugggugcagagguuguuccggauag
